(12) United States Patent
Blume et al.

(10) Patent No.: US 7,341,835 B2
(45) Date of Patent: Mar. 11, 2008

(54) METHODS OF ANALYSIS OF ALTERNATIVE SPLICING IN MOUSE

(75) Inventors: John E. Blume, Danville, CA (US); Alan J. Williams, Albany, CA (US)

(73) Assignee: Affymetrix, Inc., Santa Clara, CA (US)

( * ) Notice: Subject to any disclaimer, the term of this patent is extended or adjusted under 35 U.S.C. 154(b) by 563 days.

(21) Appl. No.: 11/036,317

(22) Filed: Jan. 13, 2005

(65) Prior Publication Data

US 2005/0214823 A1    Sep. 29, 2005

Related U.S. Application Data

(60) Provisional application No. 60/536,639, filed on Jan. 13, 2004.

(51) Int. Cl.
  *C12Q 1/68* (2006.01)
  *C12M 3/00* (2006.01)
  *C12M 1/34* (2006.01)
  *C07H 21/04* (2006.01)

(52) U.S. Cl. ............ 435/6; 435/287.2; 435/91.1; 536/23.1; 536/24.3

(58) Field of Classification Search ............ None
  See application file for complete search history.

(56) References Cited

OTHER PUBLICATIONS

Hu et al. (Genome Research, vol. 11, pp. 1237-1245, 2001).*

* cited by examiner

*Primary Examiner*—Juliet C. Switzer
(74) *Attorney, Agent, or Firm*—Sandra E. Wells

(57) ABSTRACT

The invention provides nucleic acid sequences which are complementary, in one embodiment, to a wide variety of mouse genes. The invention provides the sequences in such a way as to make them available for a variety of analyses. In one embodiment the nucleic acid sequences provided are present as an array of probes that may be used to measure gene expression of different mature RNA isoforms from at least 5,000 alternatively spliced mouse genes. As such, the invention relates to diverse fields impacted by the nature of molecular interaction, including chemistry, biology, medicine, pharmacology and medical diagnostics.

10 Claims, 3 Drawing Sheets

METHODS OF ANALYSIS OF ALTERNATIVE SPLICING IN MOUSE

RELATED APPLICATIONS

This application claims the benefit of U.S. Provisional Application No. 60/536,639, filed Jan. 13, 2004. The entire teachings of the above application are incorporated herein by reference in their entirety for all purposes.

FIELD OF THE INVENTION

The present invention provides pools of nucleic acid sequences and arrays of nucleic acid sequences that are useful for analyzing alternative splicing in nucleic acid samples derived from mice. The invention also provides a collection of probes that hybridize to regions of transcripts to detect splicing events. The invention relates to diverse fields, including genetics, genomics, biology, population biology, medicine, and medical diagnostics.

REFERENCE TO SEQUENCE LISTING

The Sequence Listing submitted on compact disk is hereby incorporated by reference. The machine format for the discs is IBM-PC, the operating system compatibility is MS-WINDOWS 2000, the file on the disc is titled "3654.1seqlist.txt", the file is 138 MB and the compact discs were created on Jan. 12, 2005.

BACKGROUND OF THE INVENTION

Recent genome-wide analysis of alternative splicing indicates that a large portion of human genes, probably more than half, have alternative splice forms. Alternative splicing provides the cell with a mechanism to generate multiple gene products from the same transcript, adding to the functional complexity of the genome. Recent reports that the human genome may contain many fewer genes than expected have resulted in the suggestion that alternative splicing may play a major role in the production of complexity.

The identities of the genes that are being expressed in a biological sample at any given time and the amount of expression of those genes provide a gene expression profile for that sample. The gene expression profile is an indication of the status of that sample. For example, different tissue types will have different gene expression profiles reflecting the expression of different genes and differences in the spliced forms of individual genes. Differences in expression profile may also be observed between samples from the same tissue type when one sample is diseased. High-throughput methods to analyze and detect expression of alternative splice forms, characterization of alternative splicing, and regulation of alternative splicing are an important research focus.

SUMMARY OF THE INVENTION

Methods and probe arrays for measurement of the expression of multiple isoforms of RNA from mouse genes are disclosed. In one aspect probe arrays that include more than 100,000 different probe sets are disclosed. Each probe set includes at least one probe, and preferably, 2, 4, 6 or more probes that are complementary to different regions of the same exon or a subsequence of an exon from a mouse gene. More than 100, 1000, or 10,000 different genes are interrogated by the array and each multi-exon gene is preferably interrogated by at least two probe sets and preferably by a probe set for each exon in the gene.

Arrays of probes that are complementary to alternatively spliced mouse transcripts are disclosed. In one embodiment an array comprising a plurality of nucleic acid probes, wherein each probe in the plurality of nucleic acid probes comprises one of the sequences listed in SEQ ID Nos. 1-991,174 and wherein the plurality of nucleic acid probes of the array comprises each of the sequences listed in SEQ ID Nos. 1-991,174 is disclosed. In another embodiment an array comprising SEQ ID Nos 1-495,673 is disclosed and in another embodiment an array comprising SEQ ID Nos. 495,674-991,174 is disclosed. The probes may be attached to a solid support which may be a membrane, a glass slide, or a bead, for example. The probes may be attached to a single solid support or to two or more solid supports.

In one embodiment a method of monitoring alternative splicing in a biological sample from a mouse is disclosed. Nucleic acid is isolated from the sample and amplified and labeled. The labeled sample is hybridized to the array and a hybridization pattern is detected and analyzed. The intensity of signal resulting from hybridization to probes on the array is used to monitor the levels of alternatively spliced forms of a gene. The hybridization patterns from two or more different samples may be compared to detect differences in alternative splicing.

In one embodiment labeled cDNA is hybridized to the array. In another embodiment labeled RNA is hybridized to the array. The labeled RNA may be complementary to the mRNA (antisense) in another embodiment the labeled RNA may be sense RNA.

Figure 1:
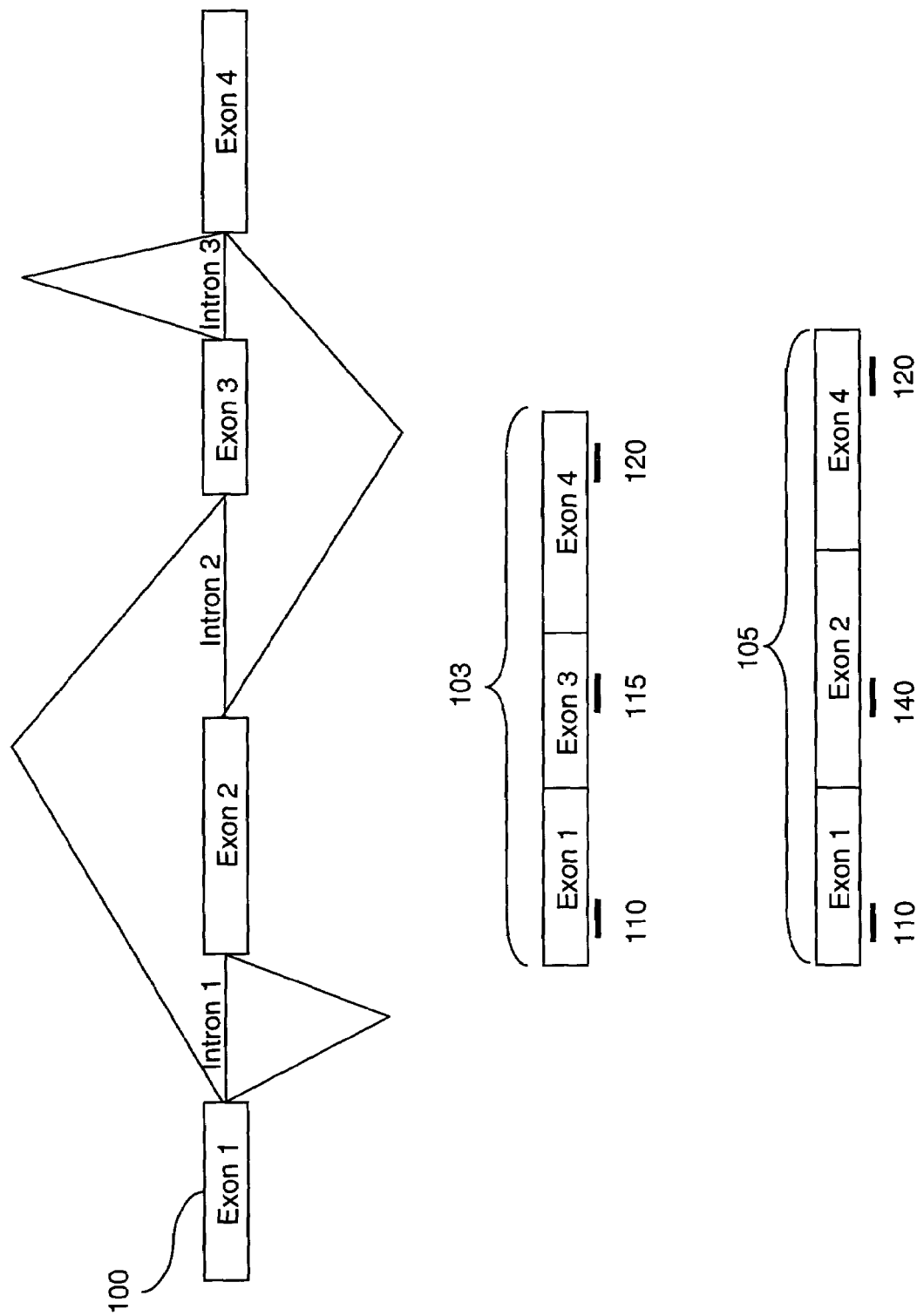
FIG. 1 shows an example of alternative splicing. Two mature RNA isoforms are generated differing in the inclusion of exons 2 and 3. The isoforms can be distinguished by probes that are specifically complementary to exon 2 or exon 3.

DETAILED DESCRIPTION OF THE PREFERRED EMBODIMENTS a) General

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series (Vols. I-IV), Using Antibodies: A Laboratory Manual, Cells: A Laboratory Manual, PCR Primer: A Laboratory Manual, and Molecular Cloning: A Laboratory Manual* (all from Cold Spring Harbor Laboratory Press), Stryer, L. (1995) *Biochemistry* (4th Ed.) Freeman, New York, Gait, *"Oligonucleotide Synthesis: A Practical Approach"* 1984, IRL Press, London, Nelson and Cox (2000), *Lehninger, Principles of Biochemistry* 3$^{rd}$ Ed., W.H. Freeman Pub., New York, N.Y. and Berg et al. (2002) *Biochemistry*, 5$^{th}$ Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication Number WO 99/36760) and PCT/US01/04285, which are all incorporated herein by reference in their entirety for all purposes. See also, Fodor et al., *Science* 251(4995), 767-73, 1991, Fodor et al., *Nature* 364(6437), 555-6, 1993 and Pease et al. *PNAS USA* 91(11), 5022-6, 1994 for methods of synthesizing and using microarrays.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring, and profiling methods are shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 60/319,253, 10/013,598, and U.S. Pat. Nos. 5,856,092, 6,300,063, 5,858,659, 6,284,460, 6,361,947, 6,368,799 and 6,333,179. Additional methods of genotyping, complexity reduction and nucleic acid amplification are disclosed in U.S. patent application Ser. Nos. 60/508,418, 60/468,925, 60/493,085, 09/920,491, 10/442,021, 10/654,281, 10/316,811, 10/646,674, 10/272,155, 10/681,773 and 10/712,616 and U.S. Pat. No. 6,582,938. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, e.g., *PCR Technology: Principles and Applications for DNA Amplification* (Ed. H.A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. Ser. No. 09/513,300, which are incorporated herein by reference.

Other suitable amplification methods include the ligase chain reaction (LCR) (e.g., Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. Ser. Nos. 09/916,135, 09/920,491, 09/910,292, and 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* (2$^{nd}$ Ed. Cold Spring Harbor, N.Y, 1989); Berger and Kimmel *Methods in Enzymology*, Vol. 152, *Guide to Molecular Cloning Techniques* (Academic Press, Inc., San Diego, Calif., 1987); Young and Davis, *P.N.A.S*, 80: 1194 (1983). Methods and apparatus for carrying out repeated and controlled hybridization reactions have been described in U.S. Pat. Nos. 5,871,928, 5,874,219, 6,045,996 6,386,749, and 6,391,623.

The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 60/364,731 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800, 992, 5,834,758; 5,856,092, 5,902,723, 5,936,324, 5,981, 956, 6,025,601, 6,090,555, 6,141,096, 6,185,030, 6,201, 639; 6,218,803; and 6,225,625, in U.S. Ser. No. 60/364,731 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, e.g. Setubal and Meidanis et al., *Introduction to Computational Biology Methods* (PWS Publishing Company, Boston, (1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., 2$^{nd}$ ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in U.S. Ser. Nos. 10/063,559 (United States Publication No. US20020183936), 60/349,546, 60/376,003, 60/394,574 and 60/403,381.

b) Definitions

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

Preferred arrays typically comprise a plurality of different nucleic acid probes that are coupled to a surface of one or more substrates in different, known or determinable locations. Arrays have been generally described in, for example, U.S. Pat. Nos. 5,143,854, 5,445,934, 5,744,305, 5,677,195, 5,800,992, 6,040,193, 5,424,186 and Fodor et al., *Science*, 251:767-777 (1991).

Arrays may generally be produced using a variety of techniques, such as mechanical synthesis methods or light directed synthesis methods that incorporate a combination of photolithographic methods and solid phase synthesis methods. Techniques for the synthesis of these arrays using mechanical synthesis methods are described in, e.g., U.S. Pat. Nos. 5,384,261, and 6,040,193. Arrays may be nucleic acids on beads, gels, polymeric surfaces, fibers such as fiber optics, glass or any other appropriate substrate. (See U.S. Pat. Nos. 5,770,358, 5,789,162, 5,708,153, 6,040,193 and 5,800,992.)

Arrays may be packaged in such a manner as to allow for diagnostic use or can be an all-inclusive device; e.g., U.S. Pat. Nos. 5,856,174 and 5,922,591. Preferred arrays are commercially available from Affymetrix (Santa Clara, Calif.) under the brand name GeneChip® and are directed to a variety of purposes, including genotyping and gene expression monitoring for a variety of eukaryotic and prokaryotic species.

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a l column by m row matrix of the building blocks to be added. The switch matrix is all or a subset of the binary numbers, preferably ordered, between l and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See, M. Kanehisa Nucleic Acids Res. 12:203 (1984), incorporated herein by reference.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The phrase "massively parallel screening" refers to the simultaneous screening of from about 100, 1000, 10,000 or 100,000 to 1000, 10,000, 100,000, 1,000,000 or 3,000,000 or more different nucleic acid hybridizations.

The term "microtiter plates" as used herein refers to arrays of discrete wells that come in standard formats (96, 384 and 1536 wells) which are used for examination of the physical, chemical or biological characteristics of a quantity of samples in parallel.

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but include other undesirable populations. For example, a complex population of nucleic acids may be a sample which has been enriched for desired messenger RNA (mRNA) sequences but still includes some undesired ribosomal RNA sequences (rRNA).

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid library" or sometimes refer by "array" as used herein refers to an intentionally created collection of nucleic acids which can be prepared either synthetically or biosynthetically and screened for biological activity in a variety of different formats (for example, libraries of soluble molecules; and libraries of oligos tethered to resin beads, silica chips, or other solid supports). Additionally, the term "array" is meant to include those libraries of nucleic acids which can be prepared by spotting nucleic acids of essentially any length (for example, from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "nucleic acids" as used herein may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

Perfect match: The term "match," "perfect match," "perfect match probe" or "perfect match control" refers to a nucleic acid that has a sequence that is designed to be perfectly complementary to a particular target sequence or portion thereof. For example, if the target sequence is 5'-GATTGCATA-3' the perfect complement is 5'-TATGCAATC-3'. Where the target sequence is longer than the probe the probe is typically perfectly complementary to a portion (subsequence) of the target sequence. For example, if the target sequence is a fragment that is 800 bases, the perfect match probe may be perfectly complementary to a 25 base region of the target. A perfect match (PM) probe can be a "test probe", a "normalization control" probe, an expression level control probe and the like. A perfect match control or perfect match is, however, distinguished from a "mismatch" or "mismatch probe."

Mismatch: The term "mismatch," "mismatch control" or "mismatch probe" refers to a nucleic acid whose sequence is deliberately designed not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at the center of the probe, for example if the probe is 25 bases the mismatch position is position 13, also termed the central position, such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: 5'-AGGTCCA-3', a probe designed with a single homo-mismatch at the central, or fourth position, would result in the following sequence: 3'-TCCTGGT-5', the PM probe would be 3'-TCCAGGT-5'.

The term "target sequence", "target nucleic acid" or "target" refers to a nucleic acid of interest. The target sequence may or may not be of biological significance. Typically, though not always, it is the significance of the target sequence which is being studied in a particular experiment. As non-limiting examples, target sequences may include regions of genomic DNA which are believed to contain one or more polymorphic sites, DNA encoding or believed to encode genes or portions of genes of known or unknown function, DNA encoding or believed to encode proteins or portions of proteins of known or unknown function, DNA encoding or believed to encode regulatory regions such as promoter sequences, splicing signals, polyadenylation signals, etc.

Target sequences may be interrogated by hybridization to an array. The array may be specially designed to interrogate one or more selected target sequence. The array may contain a collection of probes that are designed to hybridize to a region of the target sequence or its complement. Different probe sequences are located at spatially addressable locations on the array. For genotyping a single polymorphic site probes that match the sequence of each allele may be included. At least one perfect match probe, which is exactly complementary to the polymorphic base and to a region surrounding the polymorphic base, may be included for each allele. In a preferred embodiment the array comprises probes that include 12 bases on either side of the SNP. Multiple perfect match probes may be included as well as mismatch probes.

Hybridization probes are oligonucleotides capable of binding in a base-specific manner to a complementary strand of nucleic acid. Such probes include peptide nucleic acids, as described in Nielsen et al., *Science* 254, 1497-1500 (1991), and other nucleic acid analogs and nucleic acid mimetics. See U.S. patent application Ser. No. 08/630,427.

C. Mouse Exon Arrays

The RNA transcripts of most eukaryotic genes undergo a series of processing reactions. Often this involves removal of unwanted internal segments and rejoining of the remaining segments in a process termed RNA splicing. The 5' and 3' ends of the transcripts are typically also processed by, for example, capping at the 5' end and polyadenylation of the 3' end. The resulting processed transcript will correspond to the expression product, which may be either a polypeptide or a noncoding RNA. Generally for vertebrate genes, only a small portion of the sequence of the gene is used to generate the final product. For most genes, the genetic information that will be present in the final transcript (exons) is separated by intervening sequences that do not contribute genetic information directly to the final product (introns) and are typically removed during processing of the primary transcript to the mature transcript. For genes that contain multiple exons the primary transcript contains sequences that are complementary to both the exons and introns of the gene. The RNA transcript undergoes splicing, a process that excises the introns and joins the exons.

The signals that define the boundaries of introns and exons are not completely understood so predicting exons and introns from primary sequence is difficult. Many introns start with GT (GU in the RNA) and end with AG (GT-AG rule), but this alone is not sufficient to define introns and there is at least one other minor class of introns that start with AT and end with AC (AU-AC spliceosome), see Tarn and Steitz, *Trends Biochem. Sci.* 22:132-137 (1997). Introns also contain a conserved branch site that includes an A residue.

Processing of primary transcripts, along with the possible use of alternative promoters and alternative polyadenylation sites, allows a single gene to generate many different mature RNA isoforms, by varying the pattern of splicing in a process known as alternative splicing. In this way a single gene may generate a dozen or more different mRNAs.

The human dystrophin gene is one example where different promoters are used to to generate different protein isoforms. The gene has at least 7 different promoters that can be used and has at least 79 exons. Three of the promoters are near the conventional start site. One is used in brain-cortex, another is muscle-specific and the third is used in Purkinje cells of the cerebellum. Each promoter results in the inclusion of a different exon 1 in the mature transcript. The other 4 promoters result in shorter forms that are lacking upstream exons so that each generates a progressively smaller isoform. Alternative splicing is also known to occur in the 3' end of the gene.

It is currently thought that more than half of all human genes are alternatively spliced, allowing alternative pre-mRNA splicing to account for much of the diversity of the proteins present in human cells. See, for example, Lareau et al. *Curr. Op. Struct. Biol.* 14:273-282 (2004), Boue et al, *Bioessays* 25:1031-1034 (2003), Modrek and Lee, *Nat. Genet.* 30:13-19 (2002), Mironov et al., *Genome Res* 9:1288-1293 (1999), and Modrek et al., *Nucleic Acid Res.* 29:2850-2859 (2001). Other mammals such as rats and mice have similar levels of alternative splicing. Alternative splicing functions as a regulatory process that generates biological complexity by controlling the expression of proteins.

Variation in mRNA structure may result from, for example, intron retention, competing 5' splice sites, competing 3' splice sites, multiple promoters, multiple poly(A) sites, cassette exons (exon skipping) and mutually exclusive exons. See, Roberts and Smith, *Curr. Opin. Chem. Biol.* 6:375-383 (2002). These changes may be regulated, for example, depending on tissue type, sexual genotype, cellular differentiation or activation of cell signaling pathways.

An example of the use of mutually exclusive exons is shown in FIG. 1. The primary transcript (100) contains 4 exons, exons 1-4. The transcript can be spliced to generate a first RNA isoform (103) or a second RNA isoform (105). The first (103) and second (105) isoforms both contain exons 1 and 4. The first isoform contains exon 3 but not exon 2 and the second isoform contains exon 2 but not exon 3. A probe to exon 1 (110) and a probe to exon 4 (120) will hybridize to both isoforms, while a probe to exon 3 (115) will hybridize to the first isoform and not the second and a probe to exon 2 (140) will hybridize to the second isoform and not the first. Probes (115) and (140) may be used to differentially detect the two isoforms while probes (110) and (120) may be used to detect both isoforms but will not distinguish between the two isoforms.

In one aspect probe arrays that have probe sets that are complementary to individual exons or subsequences of exons are disclosed. Probe sets may have 1, 2, 3, 4, 5, 6, 7 to 10 or more probes. Each probe in the probe set may differ from the other probes in the probe set by at least one base. The probes in a probe set are perfectly complementary to different regions of the same predicted exon or subsequence of an exon. In preferred aspects the probes in a given probe set are selected so that they may be used to detect the presence or absence of a specific exon in RNA. Arrays of probes are disclosed that allow for simultaneous measurement of relative gene expression levels mouse genes, including detection and measurement of multiple isoforms of mature RNA generated from the same gene. Many of the probes of the array are designed to be complementary to about 25 contiguous bases of a selected exon or exon subsequence. Mismatch probes may be included on the array for use as controls to measure discrimination and specificity. Antisense probes that are derived from the opposite strand of the gene may also be included. Other control sequence probes may also be included. For example, control probes may be included to assay for manufacturing defects, problems with sample preparation and problems with hybridization.

Splicing analysis using microarrays has been reported by, for example, Clark et al. *Science* 296: 907-910 (2002) and Johnson et al. *Science* 302: 2141-2144, which are both incorporated herein by reference in their entireties. See also Modrek and Lee, Nature Genet. 30:13*19 (2002). It has been estimated that approximately 15% of disease-causing single point mutations may affect splicing. See Krawczak et al. *Hum. Genet.* 90:41-54 (1992).

In one aspect the array includes a probe set for each exon in each of at least 1,000, 2,000, 3,000, 5,000, 10,000, 15,000, 20,000 or 25,000 human genes. The array may include a probe set for each exon in each of at least 1,000, 2,000, 3,000 or 5,000 genes that each have at least 2, 3, 4, or 5 to 10 exons. Previous array designs utilized amplification methods that resulted in a bias toward the amplification of the 3' end of the RNA and probe sets were directed at regions that were within about 600 bases of the 3' end of the mRNA. This typically includes 3' UTR and the most 3' exon or exons. Probes to exons that were nearer to the 5' end of the RNA were not included unless the RNA was short, for example, less than 600 bases. The WTA and small WTA methods of amplification of RNA utilize random primers and are therefore not as biased toward the 3' end of the RNA as methods that use oligo dT primers. Using unbiased amplification methods all exons of a gene may be detected and probes are accordingly designed to detect exons throughout the RNA and including the 5' exons.

The arrays may be used, for example, to identify and measure tissue-specific alternative splicing, to verify the existence of splice variants, to identify novel splice variants and to estimate gene expression levels. Hybridization intensity data from exon, junction, gene and unique probes can be deconvoluted using a computer system and the used to determine the expression levels of alternatively spliced forms of mouse genes. Different mature RNA isoforms may contain different exons or portions of exons-resulting from the use of alternative splice sites within an individual exon or from use of alternative promoter or poly (A) sites.

In a preferred embodiment an array of probes is disclosed and the array comprises a plurality of different features. A different probe sequence is synthesized in each feature. Each feature may have many copies, for example more than 1,000,000 copies, of the probe sequence. Probes of the array have sequences corresponding to the sequences in the sequence listing, SEQ ID NOs 1-991,174. SEQ ID NOs 1-72114 and 495,674-852095 are exon probes. SEQ ID NOs 72115-155,804 are gene probes. SEQ ID NOs 155,805-399, 413 and 852,096-991,174 are junction probes. SEQ ID NOs 399,414-495,673 are unique probes. In one embodiment SEQ ID NOs 1-495,673 are immobilized on a first solid support (chip A) and probes 495,674-991,174 are immobilized on a second solid support (chip B). Arrays comprising 100,000, or more probes selected from the sequence listing are also contemplated.

Different types of probes may be included on an array. In one embodiment "exon", "gene", "junction" and "unique" probes may be included. Exon probes are complementary to exon regions and an exon probe set may include probes that are complementary to different exons so that more than one exon of a transcript may be represented by an exon probe set. Gene probes hybridize to spliced forms of genes in regions that are present in all known spliced forms. Junction probes hybridize to the junction between two exons after the intron has been removed by splicing. In a preferred embodiment the junction probes of the array hybridize to alternatively spliced junctions. In a preferred embodiment a probe set consists of 6 probe pairs for a junction. The probes vary in the position of the central position, for example one probe pair may have the central or 0 position of the probe correspond to the last base of the upstream exon and other probes in the set are then shifted upstream or downstream so that the central position of the probe corresponds to a base that is upstream or downstream of the junction. Probes may be positioned, for example, at 0, −1, −2, −3, −5, +1, +2 and +4 relative to the junction, see Wang et al. Bioinformatics p 1-5 (2001). Unique probes detect a single form of an alternatively spliced gene or a subset of forms. Unique probes can be used to detect the presence of specific alternatively spliced gene products. Combining different types of probes on an array provides increases sensitivity, specificity, information and assay potential.

In one embodiment an array comprising a subset of SEQ ID NOs 1-991,174 is disclosed. The subset preferably includes at least 100,000 different sequence probes wherein each probe is one of the sequences of SEQ ID NOs 1-991, 174. The probes may be attached to a single solid support so they can be monitored simultaneously in a single experiment or the probes may be divided so that they are on two or more chips or solid supports. The arrays may also be attached to pegs for high throughput analysis.

SEQ ID Nos. 1-991,174, encompassed in the Sequence listing, represent probe sequences that may be included in aspects of the invention. In one aspect the complement of the probe may be included on the array. In a preferred aspect the complement is the perfect complement of the probe and is the same length as the probe. For example, if the probe is 5'-ggtagcatc-3' the perfect complement is 5'-gatgctacc-3'. In one aspect a mismatch probe corresponding to the provided probe sequence is included on the array for a plurality of the probes. The mismatch probe may be identical to the probe except for a change at the central base, position 13 of a 25 base probe.

In one aspect an array that includes at least 100,000 different features wherein each feature includes a different sequence probe that contains at least 15 nucleotides from one of the sequences listed in SEQ ID NO: 1-991,174 is provided. In one aspect the probes may be longer than the sequence provided in the sequence listing, for example, the probes may be 26 to 100 bases in length. The additional sequence may be sequence that is immediately adjacent to the provided sequence in the human genome, for example, bases that are immediately upstream of downstream of the provided sequence. Preferably the probe is complementary to 15 to 100 contiguous bases in the human genome.

Figure 2:
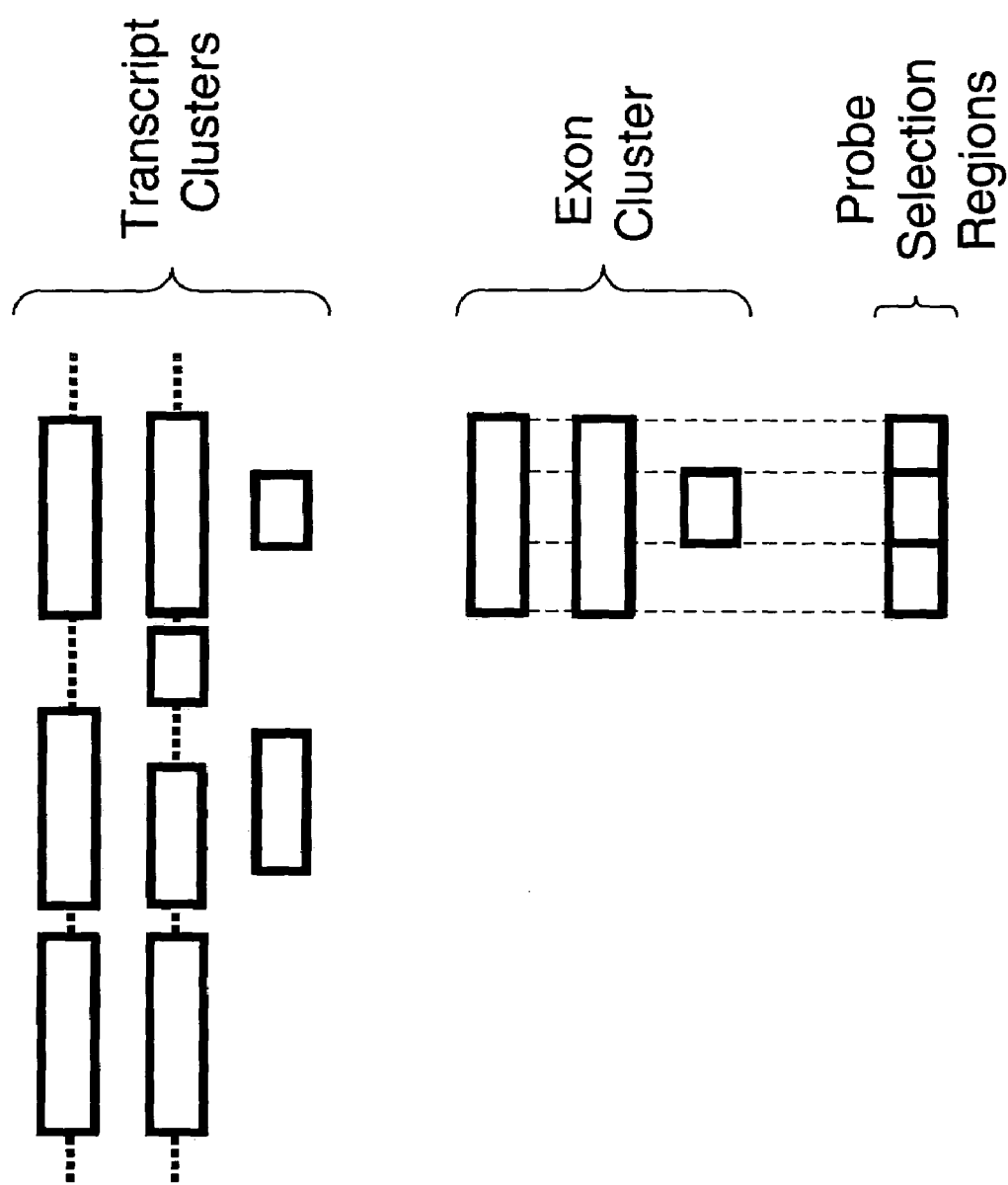
FIG. 2 shows examples of transcript clusters, exon clusters and probe selection regions. Individual probe sets are designed to be detect individual probe selection regions. A transcript cluster may be represented by many probe sets each corresponding to different probe selection regions. Transcript clusters may include multiple exon clusters.
Figure 3:
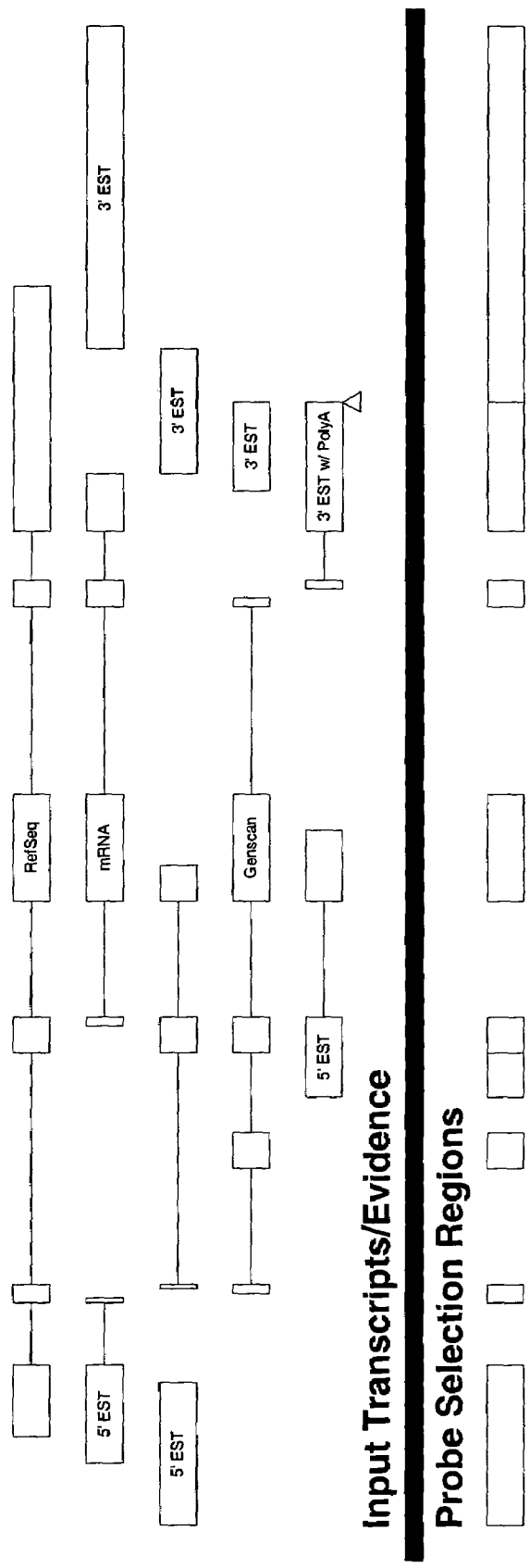
FIG. 3 shows a series of input transcript evidence from a number of sources and the output probe selection regions.

In one aspect probes were selected for the array by consolidating input sequences and annotations onto the mouse genome and into transcript clusters. Exon clusters were identified from the transcript clusters and Probe Selection Regions (PSRs) were identified from the exon clusters (FIG. 2). Individual probe sets were designed to be complementary to the PSRs. Each probe set including at least 4 different probes that are complementary to the same PSR. The probes in a probe set may overlap but differ from each of the other probes in the probe set by at least one base. The PSRs were selected to have the property that they are contiguous and do not overlap in genome space. An example of PSRs resulting from the consolidation process is shown in FIG. 3. A collection of input annotations from a plurality of sources were projected onto the genome to infer transcribed regions. Internal splice sites, polyadenylation sites (indicated by triangle) and CDS start and stop positions may be used to infer "hard edges" which are may be used to define the boundary of a PSR. This may result in the fragmentation of a contiguous piece of transcribed sequence (an exon cluster) into multiple PSRs. Each PSR may represent a different possible splicing or processing event or it may be the result of errors in the available annotations. Exon clusters may be further grouped into transcript clusters based on overlapping boundaries of input annotations. A transcript cluster may include more than one gene if the genes overlap. A gene may also be split into multiple transcript clusters if there is fragmented evidence of the gene in the input data source.

Many annotations are incomplete at the 5' or 3' end so in many aspects the outer boundary of a transcript are not treated as hard edges for the boundary of a PSR. A single gene that has, for example, 10 exons, may be represented on the array by more than 10 probe sets, each probe set being complementary to a different PSR. One or more of the exons may be divided into two or more PSRs based on variable evidence of the boundary of the exon in the input data.

Probe sequences were chosen to detect alternative splicing in mouse genes. Probe sequences listed in SEQ ID NOS 1-991,174 corresponds to sequences in the GenBank database. The GenBank sequence database may be searched through the use of computer programs such as BLAST to identify the region of the genome that is complementary to a probe. Access to BLAST is available to the public through the internet at, for example, http://www.ncbi.nim.nih.gov. One of skill in the art will be familiar with the use of the BLAST program to obtain information about particular sequences in order to, for example, determine the GenBank accession number, determine the gene from which the sequence is derived, to determine other genes and species which contain similar sequences and to determine the degree of similarity between one sequence and another.

When measuring expression one of skill in the art will recognize that the probes of the array should be designed to be complementary to the sequence to be detected. This may vary depending on which amplification method is used. For example, one method of amplification calls for reverse transcription of the mRNA using an oligo-dT-T7 primer. Double stranded cDNA with an RNA polymerase promoter is then generated and antisense RNA is transcribed and labeled. The antisense RNA is then hybridized to the array. The antisense RNA is complementary to the mRNA so the sense probe on the array that is designed to hybridize to the antisense RNA is identical in sequence to a portion of the starting mRNA. In another method the amplified RNA to be hybridized to the array is sense, meaning that it has the same sequence as the starting mRNA. In other embodiments the amplification product that is hybridized to the array may be cDNA that may be of the sense (same as) or antisense (complement of) orientation relative to the starting mRNA.

In preferred embodiments the mRNA to be analyzed is amplified and labeled using an amplification method that has reduced bias of amplification. Methods of amplification may preferentially amplify selected regions of nucleic acid, for example, amplification of mRNA using oligo-dT primers preferentially amplifies the 3' end of mRNA because reverse transcription is always primed from the 3' end. Methods that prime reverse transcription using random primers, for example, show reduced bias toward the 3' end of mRNA. Other methods for amplification are disclosed in U.S. Patent Application Nos. 60/498,023, 60/495,232 and 10/090,320 which are each incorporated herein by reference in their entireties.

In one aspect the RNA to be analyzed is reverse transcribed in a first cycle to generate first strand cDNA using a T7-(N)$_6$ primer. The primer may include a 5' T7 promoter sequence and a 3' random segment. Second strand cDNA is then synthesized and cRNA is generated by in vitro transcription using T7 RNA polymerase and un-labeled ribonucleotides. The cRNA (antisense RNA), which may first be cleaned, is then used in a second cycle to synthesize a second round of first strand cDNA using random primers and in the presence of dUTP. Then second strand cDNA is synthesized also in the presence of dUTP. The double stranded cDNA from the second cycle, with dUTP incorporated is fragmented using uracil DNA glycosylase and an AP endonuclease, such as APE 1. The fragments may be end labeled with a biotin-labeled compound in the presence of terminal deoxytransferase. The labeled fragments may be hybridized to an array. In some aspects polyadenylated controls are added to the total RNA sample prior to the first cycle first strand cDNA synthesis step.

The present invention provides a pool of unique nucleotide sequences complementary to alternatively spliced mouse sequences in particular embodiments which alone, or in combinations of 1,000 or more, 10,000 or more, or 100,000 or more, can be used for a variety of applications. Probe sets are complementary to a single exon or to a subsequence of an exon. Genes with more than one exon are represented on the array by more than one probe set, each probe set being complementary to a different exon. For example, if a gene has 10 different exons the array will include preferably include a unique probe set for each of the 10 exons. In some aspects a single exon will be represented by more than one probe set. Each different oligonucleotide may be a different feature of the array and each feature may be approximately 25, 18, 11, 8, 5, 2 or 1 microns square. The oligonucleotides may be 15 to 20, 21 to 25, 26 to 30, 31 to 40, 40 to 80 or 15 to 100 bases in length.

In one embodiment, the present invention provides for a pool of unique nucleotide sequences which are complementary to alternatively spliced mouse mRNAs formed into a high density array of probes suitable for array based massive parallel gene expression. Array based methods for monitoring gene expression are disclosed and discussed in detail in U.S. Pat. Nos. 5,800,992, 6,309,822, and PCT Application WO 92/10588 (published on Jun. 25, 1992), all of which are incorporated herein by reference for all purposes. Generally those methods of monitoring gene expression involve (1) providing a pool of target nucleic acids comprising RNA transcript(s) of one or more target gene(s), or nucleic acids derived from the RNA transcript(s); (2) hybridizing the nucleic acid sample to a high density array of probes and (3) detecting the hybridized nucleic acids and calculating a relative expression (transcription, RNA processing or degradation) level.

The development of Very Large Scale Immobilized Polymer Synthesis or VLSIPS™ technology has provided methods for making very large arrays of nucleic acid probes in very small arrays. See U.S. Pat. No. 5,143,854 and PCT Patent Publication Nos. WO 90/15070 and WO 92/10092, and Fodor et al., Science, 251, 767-77 (1991), each of which is incorporated herein by reference. U.S. Pat. No. 5,800,992, describes methods for making arrays of nucleic acid probes that can be used to detect the presence of a nucleic acid containing a specific nucleotide sequence. Methods of forming high density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In a preferred detection method, the array of immobilized nucleic acids, or probes, is contacted with a sample containing target nucleic acids, to which a flourescent label is attached. Target nucleic acids hybridize to the probes on the array and any non-hybridized nucleic acids are removed. The array containing the hybridized target nucleic acids are exposed to light which excites the flourescent label. The resulting flourescent intensity, or brightness, is detected. Relative brightness is used to determine which probe is the best candidate for the perfect match to the hybridized target nucleic acid because flourescent intensity (brightness) corresponds to binding affinity. Once the position of the perfect match probe is known, the sequence of the hybridized target nucleic is known because the sequence and position of the probe is known.

In another embodiment, the current invention may be combined with known methods to monitor expression levels of alternatively spliced forms of genes in a wide variety of contexts. For example, where the effects of a drug on gene expression are to be determined, the drug will be administered to an organism, a tissue sample, or a cell and the gene expression levels will be analyzed. For example, nucleic acids are isolated from the treated tissue sample, cell, or a biological sample from the organism and from an untreated organism tissue sample or cell, hybridized to a high density probe array containing probes directed to the gene of interest and the expression levels of that gene are determined. The types of drugs that may be used in these types of experiments include, but are not limited to, antibiotics, antivirals, narcotics, anti-cancer drugs, tumor suppressing drugs, and any chemical composition which may affect the expression of genes in vivo or in vitro. The current invention is particularly suited to be used in the types of analyses described by, for example, pending U.S. Applications No. 6,309,822 and PCT Application No. 98/11223, each of which is incorporated by reference in its entirety for all purposes. As described in Wodicka et al., Nature Biotechnology 15 (1997), hereby incorporated by reference in its entirety for all purposes, because mRNA hybridization correlates to gene expression level, hybridization patterns can be compared to determine differential gene expression. As non-limiting examples: hybridization patterns from samples treated with certain types of drugs may be compared to hybridization patterns from samples which have not been treated or which have been treated with a different drug; hybridization patterns for samples infected with a specific virus may be compared against hybridization patterns from non-infected samples; hybridization patterns for samples with cancer may be compared against hybridization patterns for samples without cancer; hybridization patterns of samples from cancerous cells which have been treated with a tumor suppressing drug may be compared against untreated cancerous cells, etc. Zhang et al., Science 276 1268-1272, hereby incorporated by reference in its entirety for all purposes, provides an example of how gene expression data can provide a great deal of insight into cancer research.

In one embodiment, the current invention provides a pool of unique nucleic acid sequences which can be used for parallel analysis of gene expression and alternative splicing under selective conditions. Without wishing to be limited, genetic selection under selective conditions could include: variation in the temperature of the organism's environment; variation in pH levels in the organism's environment; variation in an organism's food (type, texture, amount etc.); variation in an organism's surroundings; etc. Arrays, such as those in the present invention, can be used to determine whether gene expression is altered when an organism is exposed to selective conditions.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. In a preferred aspect the amplification method results in a DNA target for hybridization and the DNA is fragmented and end labeled using a terminal transferase.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example nick translation or end-labeling (e.g. with a labeled RNA) by kinasing of the nucleic acid and subsequent attachment (ligation) of a nucleic acid linker joining the sample nucleic acid to a label (e.g., a fluorophore).

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$p), phosphorescent labels, enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and calorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an aviden-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology*, Vol. 24: *Hybridization With Nucleic Acid Probes*, P. Tijssen, ed. Elsevier, N.Y., (1993), which is hereby incorporated by reference in its entirety for all purposes.

Arrays may be designed so that the array has probe sets that include 1, 2, 4 or 6 or more perfect match probes that are each complementary to a predicted exon of a gene. Many genes contain multiple exons and preferably a probe set is included for each exon. Probe sets may be designed to recognize a single exon or a single intron. An array with probe sets complementary to more than 5,000, 10,000, 30,000, 50,000, 75,000 or 100,000 exons is disclosed.

In one aspect a pool of unique nucleic acid sequences which are complementary to exons in mouse genes are disclosed. These sequences can be used for a variety of types of analyses, including analysis of alternative splicing and measurement of gene expression. An array to detect alternatively splicing, comprising probe sets to exons that are alternatively spliced is also disclosed. Some exons may have alternative 5' or 3' splice sites resulting in alternative forms of the exon being present in alternative spliced forms and probe sets may be designed to detect alternative forms of a single exon. Probe sets to detect retained introns, mutually exclusive exons, alternative promoter sites and alternative polyadenylation sites may also be included.

In one aspect probe sets are designed to be complementary to regions that are within exons or PSRs. In one aspect probe sets are designed to interrogate PSRs that are 25 bp or greater. In another aspect probe sets are also included for PSRs that are less than 25 bp. In another aspect splice events may be interrogated with junction probe sets. Exon junction probe sets include probes that spanning multiple exons which are not contiguous on the genome. Exon-intron junction probe sets span the junction between an exon and an intron. Junction probe sets may be used to detect specific splicing events such as the joining of a first and second exon. Some exons or PSRs may be very short, for example, 1, 2, 3 or 4-24 bp. These exons may be detected by junction probes that include the small exon or PSR and flanking exon sequence that is joined to the small exon or PSR by splicing. The junction probe spans the PSR and flanking sequence from the upstream or downstream PSR.

In one aspect probe coverage varies from gene to gene depending on how many exons (or more specifically PSRs) a gene has. As such, some single exon transcripts may have fewer than ten probes, although in the array described in Example 1 the majority of the putative full-length mRNAs are covered by 10 or more probes.

CONCLUSION

The inventions herein provide a pool of unique nucleic acid sequences which are complementary to alternatively spliced mouse genes. These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (991174 sequences)

SEQ ID NO: 1 - DNA, 25 bp, Mus musculus
aaaaaacaacatctataatgctacc

SEQ ID NO: 2 - DNA, 25 bp, Mus musculus
aaaaaacaacatgtataatgctacc

SEQ ID NO: 3 - DNA, 25 bp, Mus musculus
aaaaaacagaggcagctaccacagc

SEQ ID NO: 4 - DNA, 25 bp, Mus musculus
aaaaaacagcctttcataactcaag

SEQ ID NO: 5 - DNA, 25 bp, Mus musculus
aaaaaacagtgggacgcacattcta

SEQ ID NO: 6 - DNA, 25 bp, Mus musculus
aaaaaaccacaatggccacagtggt

SEQ ID NO: 7 - DNA, 25 bp, Mus musculus
aaaaaactccagaacagattatgca

SEQ ID NO: 8 - DNA, 25 bp, Mus musculus
aaaaaactccatccctttgctggag

SEQ ID NO: 9 - DNA, 25 bp, Mus musculus
aaaaaactctttgcacaacggatgg

SEQ ID NO: 10 - DNA, 25 bp, Mus musculus
aaaaaacttccaatcctgtatcagc

SEQ ID NO: 11 - DNA, 25 bp, Mus musculus
aaaaaagacttattgatctgcacac

SEQ ID NO: 12 - DNA, 25 bp, Mus musculus
aaaaaagctttctgtggcctctgcc

SEQ ID NO: 13 - DNA, 25 bp, Mus musculus
aaaaaagggaacagactgcccatag

SEQ ID NO: 14 - DNA, 25 bp, Mus musculus
aaaaaagtgagctacagccatattc

SEQ ID NO: 15 - DNA, 25 bp, Mus musculus
aaaaaagtgccagagccttcccctg

SEQ ID NO: 16 - DNA, 25 bp, Mus musculus
aaaaaatacagggagcatcggagag

SEQ ID NO: 17 - DNA, 25 bp, Mus musculus
aaaaaatcaaagtcgcaccctgcct

SEQ ID NO: 18 - DNA, 25 bp, Mus musculus
aaaaaatgcgttataatgtaatctg

SEQ ID NO: 19 - DNA, 25 bp, Mus musculus
aaaaaattcatagagcccctgacag

SEQ ID NO: 20 - DNA, 25 bp, Mus musculus
aaaaacaagaagcagatgagttgag

SEQ ID NO: 21 - DNA, 25 bp, Mus musculus
aaaaacagcagattacgcctttgag

SEQ ID NO: 22 - DNA, 25 bp, Mus musculus
aaaaaccaagccgtcgcacagagca

SEQ ID NO: 23 - DNA, 25 bp, Mus musculus
aaaaaccctgattggccacgtgcca

SEQ ID NO: 24 - DNA, 25 bp, Mus musculus
aaaaacctgctatacattgaacccg

SEQ ID NO: 25 - DNA, 25 bp, Mus musculus
aaaaaccttcccttgcatgcctcgt

SEQ ID NO: 26 - DNA, 25 bp, Mus musculus
aaaaacctttccctgagatacagcg

SEQ ID NO: 27 - DNA, 25 bp, Mus musculus
aaaaacctttccgtgagatacagcg

SEQ ID NO: 28 - DNA, 25 bp, Mus musculus
aaaaacgtgaacatttcctacacag

SEQ ID NO: 29 - DNA, 25 bp, Mus musculus
aaaaactcgactgtatatggatgac

SEQ ID NO: 30 - DNA, 25 bp, Mus musculus
aaaaactctctacttaatcatggaa

SEQ ID NO: 31 - DNA, 25 bp, Mus musculus
aaaaagaaacagcacagctgagaga

SEQ ID NO: 32 - DNA, 25 bp, Mus musculus
aaaaagaaccgcatccgagtaatgg

SEQ ID NO: 33 - DNA, 25 bp, Mus musculus
aaaaagaagtgaatgtcaccacaca

SEQ ID NO: 34 - DNA, 25 bp, Mus musculus
aaaaagacattcacacttataccag

SEQ ID NO: 35 - DNA, 25 bp, Mus musculus
aaaaagacgcttgtgctgcgtgagc

SEQ ID NO: 36 - DNA, 25 bp, Mus musculus
aaaaagagagtggtcgttataggca

SEQ ID NO: 37 - DNA, 25 bp, Mus musculus
aaaaagagcttcagcgaccgtaccg

SEQ ID NO: 38 - DNA, 25 bp, Mus musculus
aaaaagctcatcgagaggatggtca

SEQ ID NO: 39 - DNA, 25 bp, Mus musculus
aaaaagctgcttataagactcacgg

SEQ ID NO: 40 - DNA, 25 bp, Mus musculus
aaaaaggaacgtggagctgaagatg

SEQ ID NO: 41 - DNA, 25 bp, Mus musculus
aaaaaggcaccttacatatgcggag

SEQ ID NO: 42 - DNA, 25 bp, Mus musculus
aaaaaggccgttactctcctgccat

SEQ ID NO: 43 - DNA, 25 bp, Mus musculus
aaaaaggccttctgcgacttgccag

SEQ ID NO: 44 - DNA, 25 bp, Mus musculus
aaaaaggctgacctagcagctgcag

SEQ ID NO: 45 - DNA, 25 bp, Mus musculus
aaaaaggttgcagttatctgtccag

SEQ ID NO: 46 - DNA, 25 bp, Mus musculus
aaaaagtattgtaacagctgaagtc

SEQ ID NO: 47 - DNA, 25 bp, Mus musculus
aaaaagtcagagatggctcctgccc

SEQ ID NO: 48 - DNA, 25 bp, Mus musculus
aaaaagtccagttgccttctctcag

SEQ ID NO: 49 - DNA, 25 bp, Mus musculus
aaaaagtgtactcctcacatactgg

SEQ ID NO: 50 - DNA, 25 bp, Mus musculus
aaaaatacatgcgtcaggacctccg

SEQ ID NO: 51 - DNA, 25 bp, Mus musculus
aaaaatacctggctccagcgctacg

SEQ ID NO: 52 - DNA, 25 bp, Mus musculus
aaaaatacgctgacgcaggaagagg

SEQ ID NO: 53 - DNA, 25 bp, Mus musculus
aaaaatatacaaggcttcagcccca

SEQ ID NO: 54 - DNA, 25 bp, Mus musculus
aaaaatatccagcaagacaacagtg

SEQ ID NO: 55 - DNA, 25 bp, Mus musculus
aaaaatatcttgaaaggcctggaag

SEQ ID NO: 56 - DNA, 25 bp, Mus musculus
aaaaatatgttctactttctgacag

SEQ ID NO: 57 - DNA, 25 bp, Mus musculus
aaaaatcaaagtcgcaccctgcctc

SEQ ID NO: 58 - DNA, 25 bp, Mus musculus
aaaaatccagcagaaattgtcaaaa

SEQ ID NO: 59 - DNA, 25 bp, Mus musculus
aaaaatccatatcctctgcttctgg

SEQ ID NO: 60 - DNA, 25 bp, Mus musculus
aaaaatcgagttgagcagcaacttc

SEQ ID NO: 61 - DNA, 25 bp, Mus musculus
aaaaatctccggagtttctctgcgc

SEQ ID NO: 62 - DNA, 25 bp, Mus musculus
aaaaatctccggtgtttctctgcgc

SEQ ID NO: 63 - DNA, 25 bp, Mus musculus
aaaaatctttgcagacctgatagtc

SEQ ID NO: 64 - DNA, 25 bp, Mus musculus
aaaaatgcttctctacaagctgaga

SEQ ID NO: 65 - DNA, 25 bp, Mus musculus
aaaaatggcatcattcggcgggaca

SEQ ID NO: 66 - DNA, 25 bp, Mus musculus
aaaaatggctgacaaggctgcatcc

SEQ ID NO: 67 - DNA, 25 bp, Mus musculus
aaaaatggtttgacactgattgagc

SEQ ID NO: 68 - DNA, 25 bp, Mus musculus
aaaaatgtaattcaagagagaagcc

SEQ ID NO: 69 - DNA, 25 bp, Mus musculus
aaaaattctcaatggacagacagag

SEQ ID NO: 70 - DNA, 25 bp, Mus musculus
aaaacaaaaatgaagggcaggatgc

SEQ ID NO: 71 - DNA, 25 bp, Mus musculus
aaaacaaaggagaccagcatgggag

SEQ ID NO: 72 - DNA, 25 bp, Mus musculus
aaaacaagaagcagatgagttgagt

SEQ ID NO: 73 - DNA, 25 bp, Mus musculus
aaaacaagcctgtatttttccagca

SEQ ID NO: 74 - DNA, 25 bp, Mus musculus
aaaacaagttgatttcgatatagac

SEQ ID NO: 75 - DNA, 25 bp, Mus musculus
aaaacacagaaagggcatctctcct

SEQ ID NO: 76 - DNA, 25 bp, Mus musculus
aaaacacattcgacctgtgcagtca

SEQ ID NO: 77 - DNA, 25 bp, Mus musculus
aaaacaccatcttcaccaacgtggc

SEQ ID NO: 78 - DNA, 25 bp, Mus musculus
aaaacaccattgaaggagagccgga

SEQ ID NO: 79 - DNA, 25 bp, Mus musculus
aaaacaccattgtggagcatgattc

SEQ ID NO: 80 - DNA, 25 bp, Mus musculus
aaaacacgtcttctctccgagtaca

SEQ ID NO: 81 - DNA, 25 bp, Mus musculus
aaaacactggtcctgtaaacaagat

SEQ ID NO: 82 - DNA, 25 bp, Mus musculus
aaaacagaatggagcaattggaaga

SEQ ID NO: 83 - DNA, 25 bp, Mus musculus
aaaacagacctacagatggccctcc

SEQ ID NO: 84 - DNA, 25 bp, Mus musculus
aaaacaggctcaaggtgacttccag

SEQ ID NO: 85 - DNA, 25 bp, Mus musculus
aaaacaggctcatggtgacttccag

SEQ ID NO: 86 - DNA, 25 bp, Mus musculus
aaaacatcttgtgtacgaagaaggt

SEQ ID NO: 87 - DNA, 25 bp, Mus musculus
aaaacatgattctgatagcggcaag

SEQ ID NO: 88 - DNA, 25 bp, Mus musculus
aaaacatggcatccacatgcagcac

SEQ ID NO: 89 - DNA, 25 bp, Mus musculus
aaaacatggctctcctctcgcagct

SEQ ID NO: 90 - DNA, 25 bp, Mus musculus
aaaacattaggacggtatatcattg

SEQ ID NO: 91 - DNA, 25 bp, Mus musculus
aaaacattaggagggtatatcattg

SEQ ID NO: 92 - DNA, 25 bp, Mus musculus
aaaacattgattcagggacaagaag

SEQ ID NO: 93 - DNA, 25 bp, Mus musculus
aaaaccaaggcataatttcacaaag

SEQ ID NO: 94 - DNA, 25 bp, Mus musculus
aaaaccactctgagcgcgcgtggga

SEQ ID NO: 95 - DNA, 25 bp, Mus musculus
aaaaccactctgtgcgcgcgtggga

SEQ ID NO: 96 - DNA, 25 bp, Mus musculus
aaaaccagggactttgccaccatgc

SEQ ID NO: 97 - DNA, 25 bp, Mus musculus
aaaaccatcgatgctcatggcctga

SEQ ID NO: 98 - DNA, 25 bp, Mus musculus
aaaaccatcgctaatacccaggatg

SEQ ID NO: 99 - DNA, 25 bp, Mus musculus
aaaaccatgagattgttccctgcag

SEQ ID NO: 100 - DNA, 25 bp, Mus musculus
aaaaccctgatgaggccgtggtgtg

SEQ ID NO: 101 - DNA, 25 bp, Mus musculus
aaaaccgagagccttctaagaagca

SEQ ID NO: 102 - DNA, 25 bp, Mus musculus
aaaaccgtgctcagcgcaggcagct

SEQ ID NO: 103 - DNA, 25 bp, Mus musculus
aaaaccgtgctctgcgcaggcagct

SEQ ID NO: 104 - DNA, 25 bp, Mus musculus
aaaacctaggcgaatcctgcgctca

SEQ ID NO: 105 - DNA, 25 bp, Mus musculus
aaaacctcaggctgagccagcagct

SEQ ID NO: 106 - DNA, 25 bp, Mus musculus
aaaacctctgagtaacaagctgaca

SEQ ID NO: 107 - DNA, 25 bp, Mus musculus
aaaacctctgttttgggctgggctg

SEQ ID NO: 108 - DNA, 25 bp, Mus musculus
aaaacctgcctcctagtggtactgt

SEQ ID NO: 109 - DNA, 25 bp, Mus musculus
aaaacctgctatacattgaacccgg

SEQ ID NO: 110 - DNA, 25 bp, Mus musculus
aaaaccttgctcagaagcttccaaa

SEQ ID NO: 111 - DNA, 25 bp, Mus musculus
aaaacgaccgtctcctggtgtgtca

SEQ ID NO: 112 - DNA, 25 bp, Mus musculus
aaaacgagctggctctccaccagag

SEQ ID NO: 113 - DNA, 25 bp, Mus musculus
aaaacgcaggccatgtcgccgcaca

SEQ ID NO: 114 - DNA, 25 bp, Mus musculus
aaaacgcctccaccgggaggctctg

SEQ ID NO: 115 - DNA, 25 bp, Mus musculus
aaaacggaagtgtcttcagtggcat

SEQ ID NO: 116 - DNA, 25 bp, Mus musculus
aaaacggctcaaagatgagggtgat

SEQ ID NO: 117 - DNA, 25 bp, Mus musculus
aaaacgtgtgagaaacttggacagc

SEQ ID NO: 118 - DNA, 25 bp, Mus musculus
aaaacgtgtgtctaggaggcagcag

SEQ ID NO: 119 - DNA, 25 bp, Mus musculus
aaaactatattcctgcgtgcttacg

SEQ ID NO: 120 - DNA, 25 bp, Mus musculus
aaaactatgatggagacgtgcagtc

SEQ ID NO: 121 - DNA, 25 bp, Mus musculus
aaaactcagactctgacatctagca

SEQ ID NO: 122 - DNA, 25 bp, Mus musculus
aaaactccagaacagattatgcaag

SEQ ID NO: 123 - DNA, 25 bp, Mus musculus
aaaactccagcaatgggcagcgtga

SEQ ID NO: 124 - DNA, 25 bp, Mus musculus
aaaactccgtgaaatatttgggctg

SEQ ID NO: 125 - DNA, 25 bp, Mus musculus
aaaactctcggacttatctcgactg

SEQ ID NO: 126 - DNA, 25 bp, Mus musculus
aaaactgaaaacacagcctatctgt

SEQ ID NO: 127 - DNA, 25 bp, Mus musculus
aaaactgaggatggcaaagtagaaa

SEQ ID NO: 128 - DNA, 25 bp, Mus musculus
aaaactgcaattttggagcaactcc

SEQ ID NO: 129 - DNA, 25 bp, Mus musculus
aaaactgccacctgattgagggcct

SEQ ID NO: 130 - DNA, 25 bp, Mus musculus
aaaactgccacgaaacaatggcttc

SEQ ID NO: 131 - DNA, 25 bp, Mus musculus
aaaactgcgactggcttatacaagg

SEQ ID NO: 132 - DNA, 25 bp, Mus musculus
aaaactgctcataaacgactttggg

SEQ ID NO: 133 - DNA, 25 bp, Mus musculus
aaaactgggtgtgggacattgactc

SEQ ID NO: 134 - DNA, 25 bp, Mus musculus
aaaactgtactgtgtactgtggagg

SEQ ID NO: 135 - DNA, 25 bp, Mus musculus
aaaagaaaaactagtgagcagggag

SEQ ID NO: 136 - DNA, 25 bp, Mus musculus
aaaagaaaatcattgcggacatcaa

SEQ ID NO: 137 - DNA, 25 bp, Mus musculus
aaaagaaagccacatttagggctat

SEQ ID NO: 138 - DNA, 25 bp, Mus musculus
aaaagaagagagtacctttatcagc

SEQ ID NO: 139 - DNA, 25 bp, Mus musculus
aaaagaagctatgaggcagtggaag

SEQ ID NO: 140 - DNA, 25 bp, Mus musculus
aaaagaagtgaaggcagagcaactt

SEQ ID NO: 141 - DNA, 25 bp, Mus musculus
aaaagaagtgaatgtcaccacacag

SEQ ID NO: 142 - DNA, 25 bp, Mus musculus
aaaagacataggcacatttggattc

SEQ ID NO: 143 - DNA, 25 bp, Mus musculus
aaaagacattcacacttataccagc

SEQ ID NO: 144 - DNA, 25 bp, Mus musculus
aaaagaccaagggatcaaagatcag

SEQ ID NO: 145 - DNA, 25 bp, Mus musculus
aaaagacctcgtttatgtttctgcg

SEQ ID NO: 146 - DNA, 25 bp, Mus musculus
aaaagactcagtattgggtggagag

SEQ ID NO: 147 - DNA, 25 bp, Mus musculus
aaaagactgtgccattcggacccag

SEQ ID NO: 148 - DNA, 25 bp, Mus musculus
aaaagactgtttctgttctcctacg

SEQ ID NO: 149 - DNA, 25 bp, Mus musculus
aaaagacttattgatctgcacacaa

SEQ ID NO: 150 - DNA, 25 bp, Mus musculus
aaaagagagcggctggtcttcagtc

SEQ ID NO: 151 - DNA, 25 bp, Mus musculus
aaaagagcccgatttctgaagatcc

SEQ ID NO: 152 - DNA, 25 bp, Mus musculus
aaaagaggcctcaaagaacgaagtg

SEQ ID NO: 153 - DNA, 25 bp, Mus musculus
aaaagagtactgtgctgcctcagaa

SEQ ID NO: 154 - DNA, 25 bp, Mus musculus
aaaagagtgagcttatcctggacat

SEQ ID NO: 155 - DNA, 25 bp, Mus musculus
aaaagataagccaagactgatttcc

SEQ ID NO: 156 - DNA, 25 bp, Mus musculus
aaaagatcatcacagtcccaaaggg

SEQ ID NO: 157 - DNA, 25 bp, Mus musculus
aaaagatctctatgcacggatgagt

SEQ ID NO: 158 - DNA, 25 bp, Mus musculus
aaaagatgcctcgaagaagaagaag

SEQ ID NO: 159 - DNA, 25 bp, Mus musculus
aaaagatggaacctttgctgcagga

SEQ ID NO: 160 - DNA, 25 bp, Mus musculus
aaaagatgtggagtgggctgttacc

SEQ ID NO: 161 - DNA, 25 bp, Mus musculus
aaaagcaacagatgggcgcagacgg

SEQ ID NO: 162 - DNA, 25 bp, Mus musculus
aaaagcaagcacaggaagatcctgg

SEQ ID NO: 163 - DNA, 25 bp, Mus musculus
aaaagcaataagcagaaggttgctc

SEQ ID NO: 164 - DNA, 25 bp, Mus musculus
aaaagcaataaggagaaggttgctc

SEQ ID NO: 165 - DNA, 25 bp, Mus musculus
aaaagcaatattcggcctccgcgcc

SEQ ID NO: 166 - DNA, 25 bp, Mus musculus
aaaagcagtgaaagaagacggactt

SEQ ID NO: 167 - DNA, 25 bp, Mus musculus
aaaagcagttgctactaacagaggg

SEQ ID NO: 168 - DNA, 25 bp, Mus musculus
aaaagcccagaacataatgcagtcc

SEQ ID NO: 169 - DNA, 25 bp, Mus musculus
aaaagccgaagttcgaggacacaga

SEQ ID NO: 170 - DNA, 25 bp, Mus musculus
aaaagccgaccaagaaccagataca

SEQ ID NO: 171 - DNA, 25 bp, Mus musculus
aaaagccggccccatgtgaagccag

SEQ ID NO: 172 - DNA, 25 bp, Mus musculus
aaaagcgactcaaggcagaatcttc

SEQ ID NO: 173 - DNA, 25 bp, Mus musculus
aaaagcgagctgtttgactatacgg

SEQ ID NO: 174 - DNA, 25 bp, Mus musculus
aaaagcgagggtactggtactgaga

SEQ ID NO: 175 - DNA, 25 bp, Mus musculus
aaaagcgccggcctggtcttgactg

SEQ ID NO: 176 - DNA, 25 bp, Mus musculus
aaaagcggcatctgtgatagccaag

SEQ ID NO: 177 - DNA, 25 bp, Mus musculus
aaaagcgtgccagccatcatgagag

SEQ ID NO: 178 - DNA, 25 bp, Mus musculus
aaaagctcaagacccaagagaggag

SEQ ID NO: 179 - DNA, 25 bp, Mus musculus
aaaagctgaagccaggagacctggt

SEQ ID NO: 180 - DNA, 25 bp, Mus musculus
aaaagctgagtgaagacagtttgac

SEQ ID NO: 181 - DNA, 25 bp, Mus musculus
aaaagctgcttataagactcacggg

SEQ ID NO: 182 - DNA, 25 bp, Mus musculus
aaaagctggaacctcaaggccctca

SEQ ID NO: 183 - DNA, 25 bp, Mus musculus
aaaagctggaacgtcaaggccctca

SEQ ID NO: 184 - DNA, 25 bp, Mus musculus
aaaagcttcaggagcggagacacct

SEQ ID NO: 185 - DNA, 25 bp, Mus musculus
aaaaggaaacagacttctctgagag

SEQ ID NO: 186 - DNA, 25 bp, Mus musculus
aaaaggaagtcgagttccagcgtgc

SEQ ID NO: 187 - DNA, 25 bp, Mus musculus
aaaaggaatagtcccattagcaaag

SEQ ID NO: 188 - DNA, 25 bp, Mus musculus
aaaaggaccatgcttcgtatacatc

SEQ ID NO: 189 - DNA, 25 bp, Mus musculus
aaaaggagcgcaaggcaactctgcc

SEQ ID NO: 190 - DNA, 25 bp, Mus musculus
aaaaggatcggatcctctgggacgg

SEQ ID NO: 191 - DNA, 25 bp, Mus musculus
aaaaggatgagcaagtccgtgccag

SEQ ID NO: 192 - DNA, 25 bp, Mus musculus
aaaaggatgtactactgccaggagc

SEQ ID NO: 193 - DNA, 25 bp, Mus musculus
aaaaggcatatgctacaagccagca

SEQ ID NO: 194 - DNA, 25 bp, Mus musculus
aaaaggccagatatcaccccggagc

SEQ ID NO: 195 - DNA, 25 bp, Mus musculus
aaaaggctccagtgcggtcggcctc

SEQ ID NO: 196 - DNA, 25 bp, Mus musculus
aaaaggctgtttgctctatggaccg

SEQ ID NO: 197 - DNA, 25 bp, Mus musculus
aaaaggcttcagcttgggagagaaa

SEQ ID NO: 198 - DNA, 25 bp, Mus musculus
aaaagggtgcacacggaggcactgc

SEQ ID NO: 199 - DNA, 25 bp, Mus musculus
aaaaggtgtcatggacggaagctgc

SEQ ID NO: 200 - DNA, 25 bp, Mus musculus
aaaaggtgtggcatccgcaataccg

SEQ ID NO: 201 - DNA, 25 bp, Mus musculus
aaaaggtgtggcttccgcaataccg

SEQ ID NO: 202 - DNA, 25 bp, Mus musculus
aaaaggttactctctcagtgctcag

SEQ ID NO: 203 - DNA, 25 bp, Mus musculus
aaaagtaccatttgagaccccagca

SEQ ID NO: 204 - DNA, 25 bp, Mus musculus
aaaagtcagacggtgggcactacca

SEQ ID NO: 205 - DNA, 25 bp, Mus musculus
aaaagtccatcataagcgagtatga

SEQ ID NO: 206 - DNA, 25 bp, Mus musculus
aaaagtcctgggatcccagggctga

SEQ ID NO: 207 - DNA, 25 bp, Mus musculus
aaaagtcgtgtttctgtgtctccag

SEQ ID NO: 208 - DNA, 25 bp, Mus musculus
aaaagtctcacttctgaatgccacc

SEQ ID NO: 209 - DNA, 25 bp, Mus musculus
aaaagtgaaaacgaatcactccctg

SEQ ID NO: 210 - DNA, 25 bp, Mus musculus
aaaagtgaatcctgaaggtacagtc

SEQ ID NO: 211 - DNA, 25 bp, Mus musculus
aaaagtgataaatggattgacatcc

SEQ ID NO: 212 - DNA, 25 bp, Mus musculus
aaaagtgccactatctacaacccca

SEQ ID NO: 213 - DNA, 25 bp, Mus musculus
aaaagtggataattgctgctgtggc

SEQ ID NO: 214 - DNA, 25 bp, Mus musculus
aaaagtggcccattgatgcattcat

SEQ ID NO: 215 - DNA, 25 bp, Mus musculus
aaaagtggtgttacccagtgcctca

SEQ ID NO: 216 - DNA, 25 bp, Mus musculus
aaaagtgtccactcccctagcctat

SEQ ID NO: 217 - DNA, 25 bp, Mus musculus
aaaagttgctcgcaagtgcgacgtc

SEQ ID NO: 218 - DNA, 25 bp, Mus musculus
aaaagttgctcggaagtgcgacgtc

SEQ ID NO: 219 - DNA, 25 bp, Mus musculus
aaaagtttcttcagtgtcttgggcg

SEQ ID NO: 220 - DNA, 25 bp, Mus musculus
aaaatacagggagcatcggagagaa

SEQ ID NO: 221 - DNA, 25 bp, Mus musculus
aaaatacagtgggattatgaatgcg

SEQ ID NO: 222 - DNA, 25 bp, Mus musculus
aaaatacccgcccatggattcagag

SEQ ID NO: 223 - DNA, 25 bp, Mus musculus
aaaatacgaagattatttgccaggg

SEQ ID NO: 224 - DNA, 25 bp, Mus musculus
aaaatacgctgacgcaggaagaggt

SEQ ID NO: 225 - DNA, 25 bp, Mus musculus
aaaatacttagtgacattgggttgg

SEQ ID NO: 226 - DNA, 25 bp, Mus musculus
aaaatactttgtcggctatctggga

SEQ ID NO: 227 - DNA, 25 bp, Mus musculus
aaaatcaaatgactctgcctttggg

SEQ ID NO: 228 - DNA, 25 bp, Mus musculus
aaaatcaatctttccaagaccaggc

SEQ ID NO: 229 - DNA, 25 bp, Mus musculus
aaaatcaggacagcatccacccaag

SEQ ID NO: 230 - DNA, 25 bp, Mus musculus
aaaatcagtcagctctatggagacc

SEQ ID NO: 231 - DNA, 25 bp, Mus musculus
aaaatcatcagctggcagccaccag

SEQ ID NO: 232 - DNA, 25 bp, Mus musculus
aaaatcatctttgctctcacgcgag

SEQ ID NO: 233 - DNA, 25 bp, Mus musculus
aaaatcgagaaagactgcagctggc

SEQ ID NO: 234 - DNA, 25 bp, Mus musculus
aaaatcgagaaggtgcgggtcctca

SEQ ID NO: 235 - DNA, 25 bp, Mus musculus
aaaatcggcatcatgcctggccaca

SEQ ID NO: 236 - DNA, 25 bp, Mus musculus
aaaatctactccctgaaggcaaaat

SEQ ID NO: 237 - DNA, 25 bp, Mus musculus
aaaatctctggctcaaagttgtgca

SEQ ID NO: 238 - DNA, 25 bp, Mus musculus
aaaatctgagtaaggcaggagggcc

SEQ ID NO: 239 - DNA, 25 bp, Mus musculus
aaaatctgcgctctcgatgaccatg

SEQ ID NO: 240 - DNA, 25 bp, Mus musculus
aaaatctggcttcggctccgcgggc

SEQ ID NO: 241 - DNA, 25 bp, Mus musculus
aaaatgaaacggaggaagcaagatg

SEQ ID NO: 242 - DNA, 25 bp, Mus musculus
aaaatgactgagctcttccaatccc

SEQ ID NO: 243 - DNA, 25 bp, Mus musculus
aaaatgaggccttctctctaacagc

SEQ ID NO: 244 - DNA, 25 bp, Mus musculus
aaaatgatcaacagcagatttggcc

SEQ ID NO: 245 - DNA, 25 bp, Mus musculus
aaaatgcaacactacccggtttgag

SEQ ID NO: 246 - DNA, 25 bp, Mus musculus
aaaatgcacatatcccagtccattg

SEQ ID NO: 247 - DNA, 25 bp, Mus musculus
aaaatgcagcccacggccaccatgg

SEQ ID NO: 248 - DNA, 25 bp, Mus musculus
aaaatgccagcacggataactcagt

SEQ ID NO: 249 - DNA, 25 bp, Mus musculus
aaaatgcctgtgaaagaacgtcctt

SEQ ID NO: 250 - DNA, 25 bp, Mus musculus
aaaatgcctgtgtaagaacgtcctt

SEQ ID NO: 251 - DNA, 25 bp, Mus musculus
aaaatgctgggctccaaaccccaag

SEQ ID NO: 252 - DNA, 25 bp, Mus musculus
aaaatgcttttcgaggaactatccg

SEQ ID NO: 253 - DNA, 25 bp, Mus musculus
aaaatggacgtgatctcccagaccc

SEQ ID NO: 254 - DNA, 25 bp, Mus musculus
aaaatggagtatgtctttgaactgg

SEQ ID NO: 255 - DNA, 25 bp, Mus musculus
aaaatggccattgtccatctagaag

SEQ ID NO: 256 - DNA, 25 bp, Mus musculus
aaaatggcggtgttgttactacagc

SEQ ID NO: 257 - DNA, 25 bp, Mus musculus
aaaatgtacgactcggtgctcgccc

SEQ ID NO: 258 - DNA, 25 bp, Mus musculus
aaaatgtatctcgtgatggagcttt

SEQ ID NO: 259 - DNA, 25 bp, Mus musculus
aaaatgtctgccatagcctgtgctt

SEQ ID NO: 260 - DNA, 25 bp, Mus musculus
aaaatgtgattggagccagaagagc

SEQ ID NO: 261 - DNA, 25 bp, Mus musculus
aaaatgtggccgtattctgagccag

SEQ ID NO: 262 - DNA, 25 bp, Mus musculus
aaaattacaacaccagactctcgcg

SEQ ID NO: 263 - DNA, 25 bp, Mus musculus
aaaattacaagctggtagctgcacc

SEQ ID NO: 264 - DNA, 25 bp, Mus musculus
aaaattcaccgtcgccattgccaga

SEQ ID NO: 265 - DNA, 25 bp, Mus musculus
aaaattccagagtaatcaattggcc

SEQ ID NO: 266 - DNA, 25 bp, Mus musculus
aaaattcgggtacagagtctgaaga

SEQ ID NO: 267 - DNA, 25 bp, Mus musculus
aaaattcgttttgctaatcattcag

SEQ ID NO: 268 - DNA, 25 bp, Mus musculus
aaaattctaccctcccacagcttgg

SEQ ID NO: 269 - DNA, 25 bp, Mus musculus
aaaattgagcatactgacagcaagc

SEQ ID NO: 270 - DNA, 25 bp, Mus musculus
aaaattgctcactatccctccactg

SEQ ID NO: 271 - DNA, 25 bp, Mus musculus
aaaattgtcggtgatctggcctccg

SEQ ID NO: 272 - DNA, 25 bp, Mus musculus
aaaattgtctgaacctgccaactgg

SEQ ID NO: 273 - DNA, 25 bp, Mus musculus
aaaattgtctgatcctgccaactgg

SEQ ID NO: 274 - DNA, 25 bp, Mus musculus
aaaattgttaaggagagaactccag

SEQ ID NO: 275 - DNA, 25 bp, Mus musculus
aaaatttctattccagatgcctttg

SEQ ID NO: 276 - DNA, 25 bp, Mus musculus
aaaatttctattgcagatgcctttg

SEQ ID NO: 277 - DNA, 25 bp, Mus musculus
aaaatttgatggttgtcactgtgac

SEQ ID NO: 278 - DNA, 25 bp, Mus musculus
aaaatttgttcaggacagacataga

SEQ ID NO: 279 - DNA, 25 bp, Mus musculus
aaacaaaaagaagtgaatgtcacca

SEQ ID NO: 280 - DNA, 25 bp, Mus musculus
aaacaaaaatgctttgaacttcaag

SEQ ID NO: 281 - DNA, 25 bp, Mus musculus
aaacaaacagcccacatcactggaa

SEQ ID NO: 282 - DNA, 25 bp, Mus musculus
aaacaaactgttccctgagtcagtc

SEQ ID NO: 283 - DNA, 25 bp, Mus musculus
aaacaacaaaggctgggcttcagaa

SEQ ID NO: 284 - DNA, 25 bp, Mus musculus
aaacaacatgggaaatcctcttctg

SEQ ID NO: 285 - DNA, 25 bp, Mus musculus
aaacaacccagtgcttttggagaat

SEQ ID NO: 286 - DNA, 25 bp, Mus musculus
aaacaacttcctgcggctgtgtgtt

SEQ ID NO: 287 - DNA, 25 bp, Mus musculus
aaacaagacagggacatcgcacttc

SEQ ID NO: 288 - DNA, 25 bp, Mus musculus
aaacaagacggccagttcagggtga

SEQ ID NO: 289 - DNA, 25 bp, Mus musculus
aaacaagcccgtcagtgtcaaggtg

SEQ ID NO: 290 - DNA, 25 bp, Mus musculus
aaacaagcccgtgagtgtcaaggtg

SEQ ID NO: 291 - DNA, 25 bp, Mus musculus
aaacaagccttcaccgatgtggcca

SEQ ID NO: 292 - DNA, 25 bp, Mus musculus
aaacaagctaagaagttctggtcct

SEQ ID NO: 293 - DNA, 25 bp, Mus musculus
aaacaagctaagtagttctggtcct

SEQ ID NO: 294 - DNA, 25 bp, Mus musculus
aaacaatcccttggcaagagcgcag

SEQ ID NO: 295 - DNA, 25 bp, Mus musculus
aaacaatggaggcagcagggcactc

SEQ ID NO: 296 - DNA, 25 bp, Mus musculus
aaacaattggctcagtcattcttgg

SEQ ID NO: 297 - DNA, 25 bp, Mus musculus
aaacacaacccgtgccacaaaggag

SEQ ID NO: 298 - DNA, 25 bp, Mus musculus
aaacacaaggcgcttctcactcacg

SEQ ID NO: 299 - DNA, 25 bp, Mus musculus
aaacacaattagaaggcattattcc

SEQ ID NO: 300 - DNA, 25 bp, Mus musculus
aaacacaattagtaggcattattcc

SEQ ID NO: 301 - DNA, 25 bp, Mus musculus
aaacacacaggcctacacacagagt

SEQ ID NO: 302 - DNA, 25 bp, Mus musculus
aaacacagatacagagatcaatgca

SEQ ID NO: 303 - DNA, 25 bp, Mus musculus
aaacacagatactgagatcaatgca

SEQ ID NO: 304 - DNA, 25 bp, Mus musculus
aaacacagccaagaacccatgtaca

SEQ ID NO: 305 - DNA, 25 bp, Mus musculus
aaacacagctggagcggacagaagc

SEQ ID NO: 306 - DNA, 25 bp, Mus musculus
aaacaccacaaaggctccatattac

SEQ ID NO: 307 - DNA, 25 bp, Mus musculus
aaacaccagcgaaagtgggtctgcc

SEQ ID NO: 308 - DNA, 25 bp, Mus musculus
aaacaccagtgtttctgtctgtgcc

SEQ ID NO: 309 - DNA, 25 bp, Mus musculus
aaacaccattgaaggagagccggag

SEQ ID NO: 310 - DNA, 25 bp, Mus musculus
aaacacgcggacagcaagcccgtgg

SEQ ID NO: 311 - DNA, 25 bp, Mus musculus
aaacacggagagtgcgtcgggccaa

SEQ ID NO: 312 - DNA, 25 bp, Mus musculus
aaacactcgggaatgcaccacagga

SEQ ID NO: 313 - DNA, 25 bp, Mus musculus
aaacactctctggagtgctccctga

SEQ ID NO: 314 - DNA, 25 bp, Mus musculus
aaacactgcacgaagttaagctgac

SEQ ID NO: 315 - DNA, 25 bp, Mus musculus
aaacactgctgggagatgtccctgt

SEQ ID NO: 316 - DNA, 25 bp, Mus musculus
aaacactgggctatggtgaggacac

SEQ ID NO: 317 - DNA, 25 bp, Mus musculus
aaacagaaaggtgctcctgtcaaac

SEQ ID NO: 318 - DNA, 25 bp, Mus musculus
aaacagaagactaaaatagggcaca

SEQ ID NO: 319 - DNA, 25 bp, Mus musculus
aaacagaatgcacaggtggatgttc

SEQ ID NO: 320 - DNA, 25 bp, Mus musculus
aaacagaccatgcaagtggacgagc

SEQ ID NO: 321 - DNA, 25 bp, Mus musculus
aaacagagatggtaacaatttctga

SEQ ID NO: 322 - DNA, 25 bp, Mus musculus
aaacagaggcatcgaggtgttcagc

SEQ ID NO: 323 - DNA, 25 bp, Mus musculus
aaacagagtctcaccgacagcgcct

SEQ ID NO: 324 - DNA, 25 bp, Mus musculus
aaacagatcacttcctatcctgcta

SEQ ID NO: 325 - DNA, 25 bp, Mus musculus
aaacagatgtccctgaccataagga

SEQ ID NO: 326 - DNA, 25 bp, Mus musculus
aaacagcaagtgaaggcaagaaatg

SEQ ID NO: 327 - DNA, 25 bp, Mus musculus
aaacagcagctcaccaagactacca

SEQ ID NO: 328 - DNA, 25 bp, Mus musculus
aaacagcatttcgagcaacagatca

SEQ ID NO: 329 - DNA, 25 bp, Mus musculus
aaacagccgaactgaacaaaccgat

SEQ ID NO: 330 - DNA, 25 bp, Mus musculus
aaacagccgccgctaaagcagagga

SEQ ID NO: 331 - DNA, 25 bp, Mus musculus
aaacagcggaagatgggattttcca

SEQ ID NO: 332 - DNA, 25 bp, Mus musculus
aaacagctaaaccagactgcttccg

SEQ ID NO: 333 - DNA, 25 bp, Mus musculus
aaacagctcctgcacaccttcaagg

SEQ ID NO: 334 - DNA, 25 bp, Mus musculus
aaacaggagacattcacctttgcct

SEQ ID NO: 335 - DNA, 25 bp, Mus musculus
aaacaggatactgggcatcgcacct

SEQ ID NO: 336 - DNA, 25 bp, Mus musculus
aaacagggcgcaaagtctgcagagg

SEQ ID NO: 337 - DNA, 25 bp, Mus musculus
aaacaggtgaattctggtaattacg

SEQ ID NO: 338 - DNA, 25 bp, Mus musculus
aaacagtccaccacccaaaagcaag

SEQ ID NO: 339 - DNA, 25 bp, Mus musculus
aaacagtccccgctgaaagtgaggt

SEQ ID NO: 340 - DNA, 25 bp, Mus musculus
aaacagtcgagaaggatggctaaac

SEQ ID NO: 341 - DNA, 25 bp, Mus musculus
aaacagtgatgaggctgtaatcaat

SEQ ID NO: 342 - DNA, 25 bp, Mus musculus
aaacataggacttgaatgtgacaga

SEQ ID NO: 343 - DNA, 25 bp, Mus musculus
aaacatccgtcaaatatagcagtgg

SEQ ID NO: 344 - DNA, 25 bp, Mus musculus
aaacatcctcggcttggctacctgc

SEQ ID NO: 345 - DNA, 25 bp, Mus musculus
aaacatctcagtagcagctcaccac

SEQ ID NO: 346 - DNA, 25 bp, Mus musculus
aaacatctggtgatgggtgacattc

SEQ ID NO: 347 - DNA, 25 bp, Mus musculus
aaacatgcctcctgtacctcatgga

SEQ ID NO: 348 - DNA, 25 bp, Mus musculus
aaacatggagaaaatggagccaata

SEQ ID NO: 349 - DNA, 25 bp, Mus musculus
aaacatgtctcaatccatagaagtc

SEQ ID NO: 350 - DNA, 25 bp, Mus musculus
aaacattgctggtattttgaaggac

SEQ ID NO: 351 - DNA, 25 bp, Mus musculus
aaacatttcggctgccgagtgacca

SEQ ID NO: 352 - DNA, 25 bp, Mus musculus
aaaccaaactcatgaccaggtcaaa

SEQ ID NO: 353 - DNA, 25 bp, Mus musculus
aaaccaacaggagttcatggttacg

SEQ ID NO: 354 - DNA, 25 bp, Mus musculus
aaaccaagaaagtgggacaccagat

SEQ ID NO: 355 - DNA, 25 bp, Mus musculus
aaaccaagagatgggaaggacagag

SEQ ID NO: 356 - DNA, 25 bp, Mus musculus
aaaccaagccgtcgcacagagcaca

SEQ ID NO: 357 - DNA, 25 bp, Mus musculus
aaaccaagtgccattagctaaaggc

SEQ ID NO: 358 - DNA, 25 bp, Mus musculus
aaaccaagtgcctttagctaaaggc

SEQ ID NO: 359 - DNA, 25 bp, Mus musculus
aaaccaatgtgagtggaggcgccat

SEQ ID NO: 360 - DNA, 25 bp, Mus musculus
aaaccacagcaagtactggtgtgtc

SEQ ID NO: 361 - DNA, 25 bp, Mus musculus
aaaccaccagaccaaggagactgca

SEQ ID NO: 362 - DNA, 25 bp, Mus musculus
aaaccacccagcaagattttttgca

SEQ ID NO: 363 - DNA, 25 bp, Mus musculus
aaaccaccctggagcaactgcagaa

SEQ ID NO: 364 - DNA, 25 bp, Mus musculus
aaaccacctcgaaggcagggaggct

SEQ ID NO: 365 - DNA, 25 bp, Mus musculus
aaaccacctcttagctgaatggaag

SEQ ID NO: 366 - DNA, 25 bp, Mus musculus
aaaccacgaggatcctaagacgcat

SEQ ID NO: 367 - DNA, 25 bp, Mus musculus
aaaccactgagcaaagaaatggtga

SEQ ID NO: 368 - DNA, 25 bp, Mus musculus
aaaccactgcaaagaagcagctcca

SEQ ID NO: 369 - DNA, 25 bp, Mus musculus
aaaccagaaggcagcgctagtgtct

SEQ ID NO: 370 - DNA, 25 bp, Mus musculus
aaaccagagaatgcgtgtgaaccca

SEQ ID NO: 371 - DNA, 25 bp, Mus musculus
aaaccagccctcatctcttggatgg

SEQ ID NO: 372 - DNA, 25 bp, Mus musculus
aaaccagtgaatctgggcctatggg

SEQ ID NO: 373 - DNA, 25 bp, Mus musculus
aaaccagttgcttctggagttcagc

SEQ ID NO: 374 - DNA, 25 bp, Mus musculus
aaaccataaattgctcctgacagga

SEQ ID NO: 375 - DNA, 25 bp, Mus musculus
aaaccatccttgctacagcctagaa

SEQ ID NO: 376 - DNA, 25 bp, Mus musculus
aaaccatctctaatctccttattgg

SEQ ID NO: 377 - DNA, 25 bp, Mus musculus
aaaccatctttctttgacctgtaca

SEQ ID NO: 378 - DNA, 25 bp, Mus musculus
aaaccatgcccgttgctattcctgc

SEQ ID NO: 379 - DNA, 25 bp, Mus musculus
aaaccatggcatggtcgccctgggt

SEQ ID NO: 380 - DNA, 25 bp, Mus musculus
aaacccagagccttatacttgctag

SEQ ID NO: 381 - DNA, 25 bp, Mus musculus
aaacccagcacgatcggtggtgacg

SEQ ID NO: 382 - DNA, 25 bp, Mus musculus
aaacccagcacgttcggtggtgacg

SEQ ID NO: 383 - DNA, 25 bp, Mus musculus
aaacccaggacgaacaatttgcagc

SEQ ID NO: 384 - DNA, 25 bp, Mus musculus
aaacccaggcaagaacgcgtagcca

SEQ ID NO: 385 - DNA, 25 bp, Mus musculus
aaacccctcaggatacagcctacaa

SEQ ID NO: 386 - DNA, 25 bp, Mus musculus
aaacccctgtctacccagaatggat

SEQ ID NO: 387 - DNA, 25 bp, Mus musculus
aaaccctcagcttacggaaggatgg

SEQ ID NO: 388 - DNA, 25 bp, Mus musculus
aaaccctccttgttactgcagacag

SEQ ID NO: 389 - DNA, 25 bp, Mus musculus
aaaccctggagatagagctacagtc

SEQ ID NO: 390 - DNA, 25 bp, Mus musculus
aaacccttaaagaatgcagcagctt

SEQ ID NO: 391 - DNA, 25 bp, Mus musculus
aaaccgagcggctgctgtggacttc

SEQ ID NO: 392 - DNA, 25 bp, Mus musculus
aaaccgaggcttggacatgaaatcc

SEQ ID NO: 393 - DNA, 25 bp, Mus musculus
aaaccgcatctgcttgtcctcaaca

SEQ ID NO: 394 - DNA, 25 bp, Mus musculus
aaaccggctctgaaatcaggctcag

SEQ ID NO: 395 - DNA, 25 bp, Mus musculus
aaaccggtcattctcacccagatag

SEQ ID NO: 396 - DNA, 25 bp, Mus musculus
aaaccgtggtcaccgaacagtgcaa

SEQ ID NO: 397 - DNA, 25 bp, Mus musculus
aaaccgtggtcagcgaacagtgcaa

SEQ ID NO: 398 - DNA, 25 bp, Mus musculus
aaaccgtgtcagcatggttgcctgg

SEQ ID NO: 399 - DNA, 25 bp, Mus musculus
aaacctacagatgagaatcttctca

SEQ ID NO: 400 - DNA, 25 bp, Mus musculus
aaacctactctgaagatacttacag

SEQ ID NO: 401 - DNA, 25 bp, Mus musculus
aaacctagtttgttctctgatcgcc

SEQ ID NO: 402 - DNA, 25 bp, Mus musculus
aaacctcatgagatagaaaacgtgg

SEQ ID NO: 403 - DNA, 25 bp, Mus musculus
aaacctcgctttgttgactgatgac

SEQ ID NO: 404 - DNA, 25 bp, Mus musculus
aaacctctctccctgcctgggattt

SEQ ID NO: 405 - DNA, 25 bp, Mus musculus
aaacctgacgcccagagtttgagtc

SEQ ID NO: 406 - DNA, 25 bp, Mus musculus
aaacctggaggtaggcaagcttcac

SEQ ID NO: 407 - DNA, 25 bp, Mus musculus
aaacctgggcgcctcagaatgagct

SEQ ID NO: 408 - DNA, 25 bp, Mus musculus
aaacctgggtcttccgcaggattgc

SEQ ID NO: 409 - DNA, 25 bp, Mus musculus
aaacctgtcaacactgcccctgata

SEQ ID NO: 410 - DNA, 25 bp, Mus musculus
aaaccttccagaaacatgacttttg

SEQ ID NO: 411 - DNA, 25 bp, Mus musculus
aaaccttcctagagattatgctcgg

SEQ ID NO: 412 - DNA, 25 bp, Mus musculus
aaaccttgctcagaagcttccaaac

SEQ ID NO: 413 - DNA, 25 bp, Mus musculus
aaaccttgctgtatcgccactttga

SEQ ID NO: 414 - DNA, 25 bp, Mus musculus
aaaccttgtggttatcagcagagcc

SEQ ID NO: 415 - DNA, 25 bp, Mus musculus
aaacctttcaccgttacactgtgcg

SEQ ID NO: 416 - DNA, 25 bp, Mus musculus
aaacgaagtccatcagtgtccaggg

SEQ ID NO: 417 - DNA, 25 bp, Mus musculus
aaacgacaaagagcaggcaccgtgc

SEQ ID NO: 418 - DNA, 25 bp, Mus musculus
aaacgatcatcaagaccaaccattg

SEQ ID NO: 419 - DNA, 25 bp, Mus musculus
aaacgatgaaggcactgtatatggt

SEQ ID NO: 420 - DNA, 25 bp, Mus musculus
aaacgccttcataccaaaggatcta

SEQ ID NO: 421 - DNA, 25 bp, Mus musculus
aaacgctggcattacttcagacggg

SEQ ID NO: 422 - DNA, 25 bp, Mus musculus
aaacgctggtttgtcctcaggcggg

SEQ ID NO: 423 - DNA, 25 bp, Mus musculus
aaacgcttccatcccttctgcctgg

SEQ ID NO: 424 - DNA, 25 bp, Mus musculus
aaacggaagcgcatgctacgtgacc

SEQ ID NO: 425 - DNA, 25 bp, Mus musculus
aaacggagagtctgcagagagccca

SEQ ID NO: 426 - DNA, 25 bp, Mus musculus
aaacggccgtcactgcagctggcac

SEQ ID NO: 427 - DNA, 25 bp, Mus musculus
aaacggctcaaagatgagggtgatt

SEQ ID NO: 428 - DNA, 25 bp, Mus musculus
aaacggctcttctgggttcaggaca

SEQ ID NO: 429 - DNA, 25 bp, Mus musculus
aaacgggagatctatgaccgctatg

SEQ ID NO: 430 - DNA, 25 bp, Mus musculus
aaacgggagctggagcatcggctca

SEQ ID NO: 431 - DNA, 25 bp, Mus musculus
aaacggtgactctttgcaggctggc

SEQ ID NO: 432 - DNA, 25 bp, Mus musculus
aaacggtgtgtacaatggagctgtc

SEQ ID NO: 433 - DNA, 25 bp, Mus musculus
aaacgtctcagagaggctgtgcaac

SEQ ID NO: 434 - DNA, 25 bp, Mus musculus
aaacgtctgcatggccttgatgaag

SEQ ID NO: 435 - DNA, 25 bp, Mus musculus
aaacgtgattgtggtggaggtgtca

SEQ ID NO: 436 - DNA, 25 bp, Mus musculus
aaacgtgttcatccaagtgccacgg

SEQ ID NO: 437 - DNA, 25 bp, Mus musculus
aaactaatccaagaagctcagcggg

SEQ ID NO: 438 - DNA, 25 bp, Mus musculus
aaactacaattactgaagacatagg

SEQ ID NO: 439 - DNA, 25 bp, Mus musculus
aaactagagtatggtggcatgggcc

SEQ ID NO: 440 - DNA, 25 bp, Mus musculus
aaactatgaggcctgtctcaaggag

SEQ ID NO: 441 - DNA, 25 bp, Mus musculus
aaactatgttccaacttcctgtcaa

SEQ ID NO: 442 - DNA, 25 bp, Mus musculus
aaactcaatcgaaataacaggccgg

SEQ ID NO: 443 - DNA, 25 bp, Mus musculus
aaactcagattgcagagagctggac

SEQ ID NO: 444 - DNA, 25 bp, Mus musculus
aaactcagccagcttgtcaggtctc

SEQ ID NO: 445 - DNA, 25 bp, Mus musculus
aaactcagccaggttgtcaggtctc

SEQ ID NO: 446 - DNA, 25 bp, Mus musculus
aaactcatacagaacaagaactttg

SEQ ID NO: 447 - DNA, 25 bp, Mus musculus
aaactcattttcagcttctgccaaa

SEQ ID NO: 448 - DNA, 25 bp, Mus musculus
aaactcccctagcatcttccgtgag

SEQ ID NO: 449 - DNA, 25 bp, Mus musculus
aaactcccgaaaccgtcagcagcca

SEQ ID NO: 450 - DNA, 25 bp, Mus musculus
aaactccgggcttccattagacgca

SEQ ID NO: 451 - DNA, 25 bp, Mus musculus
aaactcctggtaccctcaccagagg

SEQ ID NO: 452 - DNA, 25 bp, Mus musculus
aaactcgtggcgaccctgcctttgc

SEQ ID NO: 453 - DNA, 25 bp, Mus musculus
aaactctacctgatcatgtctgcct

SEQ ID NO: 454 - DNA, 25 bp, Mus musculus
aaactcttcagcattagagcctatg

SEQ ID NO: 455 - DNA, 25 bp, Mus musculus
aaactcttcagctttagagcctatg

SEQ ID NO: 456 - DNA, 25 bp, Mus musculus
aaactctttatatatcagaagctgg

SEQ ID NO: 457 - DNA, 25 bp, Mus musculus
aaactgaaaacacagcctatctgtt

SEQ ID NO: 458 - DNA, 25 bp, Mus musculus
aaactgaaccgtgatgcctttcata

SEQ ID NO: 459 - DNA, 25 bp, Mus musculus
aaactgaagatcaacatcgatgttc

SEQ ID NO: 460 - DNA, 25 bp, Mus musculus
aaactgaccccggaacagttctatg

SEQ ID NO: 461 - DNA, 25 bp, Mus musculus
aaactgaccttaaatgactcaagtg

SEQ ID NO: 462 - DNA, 25 bp, Mus musculus
aaactgacgtctattggactgactc

SEQ ID NO: 463 - DNA, 25 bp, Mus musculus
aaactgagacagtgatgcagccgca

SEQ ID NO: 464 - DNA, 25 bp, Mus musculus
aaactgatccgggacagcccagatg

SEQ ID NO: 465 - DNA, 25 bp, Mus musculus
aaactgcacagccatctgggaggcc

SEQ ID NO: 466 - DNA, 25 bp, Mus musculus
aaactgcagttggtgctggccccac

SEQ ID NO: 467 - DNA, 25 bp, Mus musculus
aaactgccccttttcacagaggctc

SEQ ID NO: 468 - DNA, 25 bp, Mus musculus
aaactgctcaaccaaaagactggag

SEQ ID NO: 469 - DNA, 25 bp, Mus musculus
aaactgctcataaacgactttggga

SEQ ID NO: 470 - DNA, 25 bp, Mus musculus
aaactggaagggaagacaggacatg

SEQ ID NO: 471 - DNA, 25 bp, Mus musculus
aaactggagcatgcccgcactaagg

SEQ ID NO: 472 - DNA, 25 bp, Mus musculus
aaactggctgtaactgttctcatcg

SEQ ID NO: 473 - DNA, 25 bp, Mus musculus
aaactgggctcacctggaccaactg

SEQ ID NO: 474 - DNA, 25 bp, Mus musculus
aaactgtaacgcaaaacggagctca

SEQ ID NO: 475 - DNA, 25 bp, Mus musculus
aaactgtagaggactccccacctct

SEQ ID NO: 476 - DNA, 25 bp, Mus musculus
aaactgttggctcagtttgaccagg

SEQ ID NO: 477 - DNA, 25 bp, Mus musculus
aaacttaaccgaagatgaattacag

SEQ ID NO: 478 - DNA, 25 bp, Mus musculus
aaacttactctgagtactaggctgg

SEQ ID NO: 479 - DNA, 25 bp, Mus musculus
aaacttatagcccagctttgattaa

SEQ ID NO: 480 - DNA, 25 bp, Mus musculus
aaacttatctactgctcacggaccg

SEQ ID NO: 481 - DNA, 25 bp, Mus musculus
aaacttcaaagtgccagggcggtgg

SEQ ID NO: 482 - DNA, 25 bp, Mus musculus
aaacttcaactcaggcgccaactct

SEQ ID NO: 483 - DNA, 25 bp, Mus musculus
aaacttcagatacgaaatatcccgc

SEQ ID NO: 484 - DNA, 25 bp, Mus musculus
aaacttccagatgacctaggctgca

SEQ ID NO: 485 - DNA, 25 bp, Mus musculus
aaacttccaggactttgactgtcag

SEQ ID NO: 486 - DNA, 25 bp, Mus musculus
aaacttccataaagagatgagtaag

SEQ ID NO: 487 - DNA, 25 bp, Mus musculus
aaacttccatggtgaatacccagcc

SEQ ID NO: 488 - DNA, 25 bp, Mus musculus
aaacttcgacggaatccccagagag

SEQ ID NO: 489 - DNA, 25 bp, Mus musculus
aaacttcgagcgctctgcaggcctg

SEQ ID NO: 490 - DNA, 25 bp, Mus musculus
aaacttcgcatcatgaaaccccagg

SEQ ID NO: 491 - DNA, 25 bp, Mus musculus
aaacttcgtggcagcggtgttgctg

SEQ ID NO: 492 - DNA, 25 bp, Mus musculus
aaacttgacctaccgcgtgggcctg

SEQ ID NO: 493 - DNA, 25 bp, Mus musculus
aaacttgacttagggtgtgcatgca

SEQ ID NO: 494 - DNA, 25 bp, Mus musculus
aaacttgaggaaagcggtcgagaag

SEQ ID NO: 495 - DNA, 25 bp, Mus musculus
aaacttgattgaaccagagcagtgt

SEQ ID NO: 496 - DNA, 25 bp, Mus musculus
aaacttgctcttgagctttctgcac

SEQ ID NO: 497 - DNA, 25 bp, Mus musculus
aaactttgcatgaggctaaatctga

SEQ ID NO: 498 - DNA, 25 bp, Mus musculus
aaagaaagagcccttcagccggcgc

SEQ ID NO: 499 - DNA, 25 bp, Mus musculus
aaagaaagagccgttcagccggcgc

SEQ ID NO: 500 - DNA, 25 bp, Mus musculus
aaagaaagtttctgaagagatggaa

SEQ ID NO: 501 - DNA, 25 bp, Mus musculus
aaagaaatcttcatccgtcatgacg

SEQ ID NO: 502 - DNA, 25 bp, Mus musculus
aaagaaattgatgagctgacccgga

SEQ ID NO: 503 - DNA, 25 bp, Mus musculus
aaagaacatatgagcttggcctgct

SEQ ID NO: 504 - DNA, 25 bp, Mus musculus
aaagaacatttagccagccttcctg

SEQ ID NO: 505 - DNA, 25 bp, Mus musculus
aaagaaccttgcctctaggatctac

SEQ ID NO: 506 - DNA, 25 bp, Mus musculus
aaagaactaaaacagtatgacaaca

SEQ ID NO: 507 - DNA, 25 bp, Mus musculus
aaagaactcatgaagtgcagcatca

SEQ ID NO: 508 - DNA, 25 bp, Mus musculus
aaagaactcctgtccgtggtgattg

SEQ ID NO: 509 - DNA, 25 bp, Mus musculus
aaagaacttgcatcaagatcaggcc

SEQ ID NO: 510 - DNA, 25 bp, Mus musculus
aaagaagaaagctgcagtgaggcaa

SEQ ID NO: 511 - DNA, 25 bp, Mus musculus
aaagaagagagtacctttatcagct

SEQ ID NO: 512 - DNA, 25 bp, Mus musculus
aaagaagcggtgaaccactgatatt

SEQ ID NO: 513 - DNA, 25 bp, Mus musculus
aaagaagtgaaattccaaaagacag

SEQ ID NO: 514 - DNA, 25 bp, Mus musculus
aaagaagtgcgaagaagtgatttgc

SEQ ID NO: 515 - DNA, 25 bp, Mus musculus
aaagaagtgcgatgaagtgatttgc

SEQ ID NO: 516 - DNA, 25 bp, Mus musculus
aaagaatatatcatccccagccctg

SEQ ID NO: 517 - DNA, 25 bp, Mus musculus
aaagaatctgagtccactcagaagg

SEQ ID NO: 518 - DNA, 25 bp, Mus musculus
aaagaatcttcaagagggagacata

SEQ ID NO: 519 - DNA, 25 bp, Mus musculus
aaagaatcttgtgtcctttagatcc

SEQ ID NO: 520 - DNA, 25 bp, Mus musculus
aaagacaaaagcctcgggatgacaa

SEQ ID NO: 521 - DNA, 25 bp, Mus musculus
aaagacaccagtttgacttactggc

SEQ ID NO: 522 - DNA, 25 bp, Mus musculus
aaagacacccaagacatcctctatg

SEQ ID NO: 523 - DNA, 25 bp, Mus musculus
aaagacactggcagagaagagccgg

SEQ ID NO: 524 - DNA, 25 bp, Mus musculus
aaagacactggcttcatgggtcctt

SEQ ID NO: 525 - DNA, 25 bp, Mus musculus
aaagacacttataaccatgaggtga

SEQ ID NO: 526 - DNA, 25 bp, Mus musculus
aaagacacttattaccatgaggtga

SEQ ID NO: 527 - DNA, 25 bp, Mus musculus
aaagacagggcagctagtgagtcgc

SEQ ID NO: 528 - DNA, 25 bp, Mus musculus
aaagacatgctcacctccttatatt

SEQ ID NO: 529 - DNA, 25 bp, Mus musculus
aaagacattcacacttataccagcc

SEQ ID NO: 530 - DNA, 25 bp, Mus musculus
aaagaccaagccacaggaatttgcc

SEQ ID NO: 531 - DNA, 25 bp, Mus musculus
aaagacccgcgccaatgtggacaag

SEQ ID NO: 532 - DNA, 25 bp, Mus musculus
aaagacctcatggatcttgaagctg

SEQ ID NO: 533 - DNA, 25 bp, Mus musculus
aaagacctcgatcccaacaacgttg

SEQ ID NO: 534 - DNA, 25 bp, Mus musculus
aaagacctctggagcgcccagtctg

SEQ ID NO: 535 - DNA, 25 bp, Mus musculus
aaagaccttactgggacatgtcaaa

SEQ ID NO: 536 - DNA, 25 bp, Mus musculus
aaagacgaacatacttctgcggtac

SEQ ID NO: 537 - DNA, 25 bp, Mus musculus
aaagacgaagctgatgcggatctca

SEQ ID NO: 538 - DNA, 25 bp, Mus musculus
aaagacgagttcagtgacctttctg

SEQ ID NO: 539 - DNA, 25 bp, Mus musculus
aaagacgtgcttgaaggacggttgc

SEQ ID NO: 540 - DNA, 25 bp, Mus musculus
aaagactccattgacggtggcccag

SEQ ID NO: 541 - DNA, 25 bp, Mus musculus
aaagactcggactgccgggctgttg

SEQ ID NO: 542 - DNA, 25 bp, Mus musculus
aaagactcggactgctcaggcaaga

SEQ ID NO: 543 - DNA, 25 bp, Mus musculus
aaagactgccctggcggtggctgcc

SEQ ID NO: 544 - DNA, 25 bp, Mus musculus
aaagacttactgaaccaatggtcag

SEQ ID NO: 545 - DNA, 25 bp, Mus musculus
aaagacttccaaggtctcccggctg

SEQ ID NO: 546 - DNA, 25 bp, Mus musculus
aaagacttgcccatagacataggag

SEQ ID NO: 547 - DNA, 25 bp, Mus musculus
aaagacttgcctcctgatgcactta

SEQ ID NO: 548 - DNA, 25 bp, Mus musculus
aaagagaaaaatggatggcgtacgc

SEQ ID NO: 549 - DNA, 25 bp, Mus musculus
aaagagaacccggatgatggagata

SEQ ID NO: 550 - DNA, 25 bp, Mus musculus
aaagagaagggctactgtgctgccc

SEQ ID NO: 551 - DNA, 25 bp, Mus musculus
aaagagaatcctattcatctcactg

SEQ ID NO: 552 - DNA, 25 bp, Mus musculus
aaagagaatccttttcatctcactg

SEQ ID NO: 553 - DNA, 25 bp, Mus musculus
aaagagagaagagaacaggcccagc

SEQ ID NO: 554 - DNA, 25 bp, Mus musculus
aaagagagcattggactccccagga

SEQ ID NO: 555 - DNA, 25 bp, Mus musculus
aaagagagcttgcagtgacctcccc

SEQ ID NO: 556 - DNA, 25 bp, Mus musculus
aaagagagtggtcgttataggcatt

SEQ ID NO: 557 - DNA, 25 bp, Mus musculus
aaagagagttcccaggacttcatgg

SEQ ID NO: 558 - DNA, 25 bp, Mus musculus
aaagagatctttgcccgagccagaa

SEQ ID NO: 559 - DNA, 25 bp, Mus musculus
aaagagatgtcatttctgacagccc

SEQ ID NO: 560 - DNA, 25 bp, Mus musculus
aaagagcaacagaggcagagactgg

SEQ ID NO: 561 - DNA, 25 bp, Mus musculus
aaagagcagagagatatttactggc

SEQ ID NO: 562 - DNA, 25 bp, Mus musculus
aaagagcagcttacattttctgtga

SEQ ID NO: 563 - DNA, 25 bp, Mus musculus
aaagagcagctttcattttctgtga

SEQ ID NO: 564 - DNA, 25 bp, Mus musculus
aaagagcccgatttctgaagatccc

SEQ ID NO: 565 - DNA, 25 bp, Mus musculus
aaagagcttcacgtctgcaggcatg

SEQ ID NO: 566 - DNA, 25 bp, Mus musculus
aaagaggaacacatttcgcttgcgc

SEQ ID NO: 567 - DNA, 25 bp, Mus musculus
aaagaggagcttgcgcagagccagc

SEQ ID NO: 568 - DNA, 25 bp, Mus musculus
aaagaggctatatccaggtgccaga

SEQ ID NO: 569 - DNA, 25 bp, Mus musculus
aaagagggatccgaacaagctcaga

SEQ ID NO: 570 - DNA, 25 bp, Mus musculus
aaagaggtagatccaacaaaacaca

SEQ ID NO: 571 - DNA, 25 bp, Mus musculus
aaagaggttcaaattggaccactca

SEQ ID NO: 572 - DNA, 25 bp, Mus musculus
aaagaggttcttggatcagggatgc

SEQ ID NO: 573 - DNA, 25 bp, Mus musculus
aaagagtatatacctgctgacactg

SEQ ID NO: 574 - DNA, 25 bp, Mus musculus
aaagagtatccagaagacatgccat

SEQ ID NO: 575 - DNA, 25 bp, Mus musculus
aaagagtattctgtgctgaacgccg

SEQ ID NO: 576 - DNA, 25 bp, Mus musculus
aaagagtccaggatatgtgctcgat

SEQ ID NO: 577 - DNA, 25 bp, Mus musculus
aaagagtccgccttccgccggatct

SEQ ID NO: 578 - DNA, 25 bp, Mus musculus
aaagagttcaggaaacacggcatag

SEQ ID NO: 579 - DNA, 25 bp, Mus musculus
aaagagtttgtcattttcagaggac

SEQ ID NO: 580 - DNA, 25 bp, Mus musculus
aaagataaaaggaacagaacctcag

SEQ ID NO: 581 - DNA, 25 bp, Mus musculus
aaagataacttcaccttcaaatgcc

SEQ ID NO: 582 - DNA, 25 bp, Mus musculus
aaagataacttcctgaaatggaggc

SEQ ID NO: 583 - DNA, 25 bp, Mus musculus
aaagataagaaaagcagtgagagcg

SEQ ID NO: 584 - DNA, 25 bp, Mus musculus
aaagatactgcaatgcacatgtcag

SEQ ID NO: 585 - DNA, 25 bp, Mus musculus
aaagatactggagtactgactccca

SEQ ID NO: 586 - DNA, 25 bp, Mus musculus
aaagatagaggaattggcccgtagg

SEQ ID NO: 587 - DNA, 25 bp, Mus musculus
aaagatagcttctgccccgtttctg

SEQ ID NO: 588 - DNA, 25 bp, Mus musculus
aaagatatccgacccgagtaccgag

SEQ ID NO: 589 - DNA, 25 bp, Mus musculus
aaagatccttatgcacttgatgttc

SEQ ID NO: 590 - DNA, 25 bp, Mus musculus
aaagatcgtgcactgtcacaaggca

SEQ ID NO: 591 - DNA, 25 bp, Mus musculus
aaagatctagtagcagcctagcacc

SEQ ID NO: 592 - DNA, 25 bp, Mus musculus
aaagatgcctactatcagactcttc

SEQ ID NO: 593 - DNA, 25 bp, Mus musculus
aaagatggatcttgggaccggccga

SEQ ID NO: 594 - DNA, 25 bp, Mus musculus
aaagatggcttcaacccggctcatg

SEQ ID NO: 595 - DNA, 25 bp, Mus musculus
aaagatgttcctcagttccggatat

SEQ ID NO: 596 - DNA, 25 bp, Mus musculus
aaagattacaatctgtctgatggag

SEQ ID NO: 597 - DNA, 25 bp, Mus musculus
aaagattccagttggagccttctgt

SEQ ID NO: 598 - DNA, 25 bp, Mus musculus
aaagattgtgtaccgtgatctcaag

SEQ ID NO: 599 - DNA, 25 bp, Mus musculus
aaagatttacagttggaggagagag

SEQ ID NO: 600 - DNA, 25 bp, Mus musculus
aaagatttaggcaaatgctgtggcc

SEQ ID NO: 601 - DNA, 25 bp, Mus musculus
aaagcaaatatgaagttctcacagg

SEQ ID NO: 602 - DNA, 25 bp, Mus musculus
aaagcaaatatgtagttctcacagg

SEQ ID NO: 603 - DNA, 25 bp, Mus musculus
aaagcaacaaatggaccaagatacg

SEQ ID NO: 604 - DNA, 25 bp, Mus musculus
aaagcaacagccttctcgacagcct

SEQ ID NO: 605 - DNA, 25 bp, Mus musculus
aaagcaagcacaggaagatcctggg

SEQ ID NO: 606 - DNA, 25 bp, Mus musculus
aaagcaaggcgatttggatagccaa

SEQ ID NO: 607 - DNA, 25 bp, Mus musculus
aaagcaaggtggattcctgccaggg

SEQ ID NO: 608 - DNA, 25 bp, Mus musculus
aaagcaataaggagaaggttgctca

SEQ ID NO: 609 - DNA, 25 bp, Mus musculus
aaagcaataaggtgaaggttgctca

SEQ ID NO: 610 - DNA, 25 bp, Mus musculus
aaagcaatataagttccctggatga

SEQ ID NO: 611 - DNA, 25 bp, Mus musculus
aaagcaattggcaagataggagagg

SEQ ID NO: 612 - DNA, 25 bp, Mus musculus
aaagcacaagaggactgcagcacag

SEQ ID NO: 613 - DNA, 25 bp, Mus musculus
aaagcaccattcattgcagagagaa

SEQ ID NO: 614 - DNA, 25 bp, Mus musculus
aaagcaccggaccaattcaggcagc

SEQ ID NO: 615 - DNA, 25 bp, Mus musculus
aaagcacgcctagcatgtgacctgc

SEQ ID NO: 616 - DNA, 25 bp, Mus musculus
aaagcagaagataccaccatgccta

SEQ ID NO: 617 - DNA, 25 bp, Mus musculus
aaagcagagcgggaacattgtgtag

SEQ ID NO: 618 - DNA, 25 bp, Mus musculus
aaagcagcacctgaaatcaacaata

SEQ ID NO: 619 - DNA, 25 bp, Mus musculus
aaagcagccatcctgttggagctga

SEQ ID NO: 620 - DNA, 25 bp, Mus musculus
aaagcagccctgttgatgactgaaa

SEQ ID NO: 621 - DNA, 25 bp, Mus musculus
aaagcagccggctccattgcgagtg

SEQ ID NO: 622 - DNA, 25 bp, Mus musculus
aaagcagctagtgagaccggatcag

SEQ ID NO: 623 - DNA, 25 bp, Mus musculus
aaagcagctgcacctggctgaggcc

SEQ ID NO: 624 - DNA, 25 bp, Mus musculus
aaagcagggaggttatgaggcttaa

SEQ ID NO: 625 - DNA, 25 bp, Mus musculus
aaagcagggctagaattggaactca

SEQ ID NO: 626 - DNA, 25 bp, Mus musculus
aaagcaggtctcctttgttgatgag

SEQ ID NO: 627 - DNA, 25 bp, Mus musculus
aaagcaggtgcagaagctcaaagag

SEQ ID NO: 628 - DNA, 25 bp, Mus musculus
aaagcaggtggtggcatttcatctc

SEQ ID NO: 629 - DNA, 25 bp, Mus musculus
aaagcagtcatcgattttaaatcca

SEQ ID NO: 630 - DNA, 25 bp, Mus musculus
aaagcagtgagagcgtaaaagataa

SEQ ID NO: 631 - DNA, 25 bp, Mus musculus
aaagcatcggcttgtggcacctata

SEQ ID NO: 632 - DNA, 25 bp, Mus musculus
aaagcatgcaagtgtgattgccagg

SEQ ID NO: 633 - DNA, 25 bp, Mus musculus
aaagcatgcccagacctttttggcc

SEQ ID NO: 634 - DNA, 25 bp, Mus musculus
aaagcatgctagtgattcaagttca

SEQ ID NO: 635 - DNA, 25 bp, Mus musculus
aaagcatggaaagcagaccgggcag

SEQ ID NO: 636 - DNA, 25 bp, Mus musculus
aaagcattggccgatgccacctcga

SEQ ID NO: 637 - DNA, 25 bp, Mus musculus
aaagcatttctcgatagcctacccg

SEQ ID NO: 638 - DNA, 25 bp, Mus musculus
aaagccaaagagactccctctgtga

SEQ ID NO: 639 - DNA, 25 bp, Mus musculus
aaagccacaggactcaccaacagaa

SEQ ID NO: 640 - DNA, 25 bp, Mus musculus
aaagccacagtcagtgggaactaca

SEQ ID NO: 641 - DNA, 25 bp, Mus musculus
aaagccacagtctgtgggaactaca

SEQ ID NO: 642 - DNA, 25 bp, Mus musculus
aaagccacgtggcagaaaaccttct

SEQ ID NO: 643 - DNA, 25 bp, Mus musculus
aaagccagggatggtgccagccctt

SEQ ID NO: 644 - DNA, 25 bp, Mus musculus
aaagccagtgtaactccttcaagac

SEQ ID NO: 645 - DNA, 25 bp, Mus musculus
aaagccagtgtgtctgtaaacgttc

SEQ ID NO: 646 - DNA, 25 bp, Mus musculus
aaagccatctacctgcatgttctca

SEQ ID NO: 647 - DNA, 25 bp, Mus musculus
aaagccatcttcctactgtttccct

SEQ ID NO: 648 - DNA, 25 bp, Mus musculus
aaagccattacagatgtcaccagga

SEQ ID NO: 649 - DNA, 25 bp, Mus musculus
aaagccattccccatccagactata

SEQ ID NO: 650 - DNA, 25 bp, Mus musculus
aaagcccaagctccaagaggcctgt

SEQ ID NO: 651 - DNA, 25 bp, Mus musculus
aaagcccctccttactgtgacatca

SEQ ID NO: 652 - DNA, 25 bp, Mus musculus
aaagccctggacttcatcgccagca

SEQ ID NO: 653 - DNA, 25 bp, Mus musculus
aaagccgaagttcgaggacacagag

SEQ ID NO: 654 - DNA, 25 bp, Mus musculus
aaagccgaccaagaaccagatacaa

SEQ ID NO: 655 - DNA, 25 bp, Mus musculus
aaagccgtcacatccgcgacagctt

SEQ ID NO: 656 - DNA, 25 bp, Mus musculus
aaagcctattgaacaagaagtcaga

SEQ ID NO: 657 - DNA, 25 bp, Mus musculus
aaagcctcagaggtagaagagatcc

SEQ ID NO: 658 - DNA, 25 bp, Mus musculus
aaagcctgcaaaatcagagcccctc

SEQ ID NO: 659 - DNA, 25 bp, Mus musculus
aaagcctgcaaggtctgctcctgtg

SEQ ID NO: 660 - DNA, 25 bp, Mus musculus
aaagcctgcaccttctagtccacag

SEQ ID NO: 661 - DNA, 25 bp, Mus musculus
aaagcctggacagtgcactcacgcg

SEQ ID NO: 662 - DNA, 25 bp, Mus musculus
aaagccttcaaggaacagctgaccc

SEQ ID NO: 663 - DNA, 25 bp, Mus musculus
aaagcgagcaagatcaggatagact

SEQ ID NO: 664 - DNA, 25 bp, Mus musculus
aaagcgaggccttcatttcatcacg

SEQ ID NO: 665 - DNA, 25 bp, Mus musculus
aaagcgatggcagtcaccagtgact

SEQ ID NO: 666 - DNA, 25 bp, Mus musculus
aaagcgattggccagcctctggctc

SEQ ID NO: 667 - DNA, 25 bp, Mus musculus
aaagcgcacagtgggcgaatcccca

SEQ ID NO: 668 - DNA, 25 bp, Mus musculus
aaagcgcgagtagattcggacgccg

SEQ ID NO: 669 - DNA, 25 bp, Mus musculus
aaagcggaagacgagaccagggcaa

SEQ ID NO: 670 - DNA, 25 bp, Mus musculus
aaagcggccttataactgtgagatc

SEQ ID NO: 671 - DNA, 25 bp, Mus musculus
aaagcggtacttacactgggcacaa

SEQ ID NO: 672 - DNA, 25 bp, Mus musculus
aaagcggtactttcactgggcacaa

SEQ ID NO: 673 - DNA, 25 bp, Mus musculus
aaagcgtgtaccttcatcaagtcca

SEQ ID NO: 674 - DNA, 25 bp, Mus musculus
aaagctaagcggcacgaagtaaaga

SEQ ID NO: 675 - DNA, 25 bp, Mus musculus
aaagctatacgtacaatggcaaggg

SEQ ID NO: 676 - DNA, 25 bp, Mus musculus
aaagctcaggaagccaatatgaacc

SEQ ID NO: 677 - DNA, 25 bp, Mus musculus
aaagctcatccctgtctctggaaag

SEQ ID NO: 678 - DNA, 25 bp, Mus musculus
aaagctccacccatctcctgaatag

SEQ ID NO: 679 - DNA, 25 bp, Mus musculus
aaagctccacccttctcctgaatag

SEQ ID NO: 680 - DNA, 25 bp, Mus musculus
aaagctcgcttatctaccattttat

SEQ ID NO: 681 - DNA, 25 bp, Mus musculus
aaagctcggctccatccaggaaaaa

SEQ ID NO: 682 - DNA, 25 bp, Mus musculus
aaagctctctggagtcagaatcagc

SEQ ID NO: 683 - DNA, 25 bp, Mus musculus
aaagctctgagacagagactgggtc

SEQ ID NO: 684 - DNA, 25 bp, Mus musculus
aaagctctggctcccgagtatgcca

SEQ ID NO: 685 - DNA, 25 bp, Mus musculus
aaagctcttcacagtttcacagcag

SEQ ID NO: 686 - DNA, 25 bp, Mus musculus
aaagctcttcactgtttcacagcag

SEQ ID NO: 687 - DNA, 25 bp, Mus musculus
aaagctcttcttgccaagaggaaaa

SEQ ID NO: 688 - DNA, 25 bp, Mus musculus
aaagctgaagccaggagacctggtg

SEQ ID NO: 689 - DNA, 25 bp, Mus musculus
aaagctgacaaagaggccgtggtac

SEQ ID NO: 690 - DNA, 25 bp, Mus musculus
aaagctgatggtttgtgttttaact

SEQ ID NO: 691 - DNA, 25 bp, Mus musculus
aaagctgatttggacggcccgctct

SEQ ID NO: 692 - DNA, 25 bp, Mus musculus
aaagctgcagggtgaagaaactcgc

SEQ ID NO: 693 - DNA, 25 bp, Mus musculus
aaagctgctcaaagaccgtggcatg

SEQ ID NO: 694 - DNA, 25 bp, Mus musculus
aaagctgctcagactgcctgctcac

SEQ ID NO: 695 - DNA, 25 bp, Mus musculus
aaagctgcttataagactcacgggc

SEQ ID NO: 696 - DNA, 25 bp, Mus musculus
aaagctggaaatattcttctgggtg

SEQ ID NO: 697 - DNA, 25 bp, Mus musculus
aaagctggaaccacaaggccctcag

SEQ ID NO: 698 - DNA, 25 bp, Mus musculus
aaagctggaacctcaaggccctcag

SEQ ID NO: 699 - DNA, 25 bp, Mus musculus
aaagctggcctcaaagctgtgaccc

SEQ ID NO: 700 - DNA, 25 bp, Mus musculus
aaagctgggctgagtcttaaggaca

SEQ ID NO: 701 - DNA, 25 bp, Mus musculus
aaagctgtgcgacgtcctcactgac

SEQ ID NO: 702 - DNA, 25 bp, Mus musculus
aaagctgtggcatgtttatttctac

SEQ ID NO: 703 - DNA, 25 bp, Mus musculus
aaagcttccagtagaacgatagctc

SEQ ID NO: 704 - DNA, 25 bp, Mus musculus
aaagcttgccccatgcctagtgttg

SEQ ID NO: 705 - DNA, 25 bp, Mus musculus
aaaggaagaaaatagtggcatcgtc

SEQ ID NO: 706 - DNA, 25 bp, Mus musculus
aaaggaagaattttcgccaacagag

SEQ ID NO: 707 - DNA, 25 bp, Mus musculus
aaaggaagatggtcatgaactccat

SEQ ID NO: 708 - DNA, 25 bp, Mus musculus
aaaggaagtcgagttccagcgtgca

SEQ ID NO: 709 - DNA, 25 bp, Mus musculus
aaaggaatctgttgtctttcatgca

SEQ ID NO: 710 - DNA, 25 bp, Mus musculus
aaaggacactagagaagagcttcca

SEQ ID NO: 711 - DNA, 25 bp, Mus musculus
aaaggacactcgctttatcccaggg

SEQ ID NO: 712 - DNA, 25 bp, Mus musculus
aaaggaccagtcaaccatcaaatgt

SEQ ID NO: 713 - DNA, 25 bp, Mus musculus
aaaggactgcgattcacccgtctcc

SEQ ID NO: 714 - DNA, 25 bp, Mus musculus
aaaggactgtgaggaaaatctgcgc

SEQ ID NO: 715 - DNA, 25 bp, Mus musculus
aaaggactgtgcaagtgacgggact

SEQ ID NO: 716 - DNA, 25 bp, Mus musculus
aaaggagaacttgaaagctcagatc

SEQ ID NO: 717 - DNA, 25 bp, Mus musculus
aaaggagagtccgagttgccattct

SEQ ID NO: 718 - DNA, 25 bp, Mus musculus
aaaggagcaccgactacgtccctcg

SEQ ID NO: 719 - DNA, 25 bp, Mus musculus
aaaggagcgcaaggcaactctgccc

SEQ ID NO: 720 - DNA, 25 bp, Mus musculus
aaaggaggctgtgagcctgctctgc

SEQ ID NO: 721 - DNA, 25 bp, Mus musculus
aaaggagtgaggataatggacagcc

SEQ ID NO: 722 - DNA, 25 bp, Mus musculus
aaaggagttctcactggagagccag

SEQ ID NO: 723 - DNA, 25 bp, Mus musculus
aaaggagtttccagagctacagcag

SEQ ID NO: 724 - DNA, 25 bp, Mus musculus
aaaggatattgccaggagaagcaaa

SEQ ID NO: 725 - DNA, 25 bp, Mus musculus
aaaggatgaccagtatgtgaaggac

SEQ ID NO: 726 - DNA, 25 bp, Mus musculus
aaaggatgactcaaagtctaacctg

SEQ ID NO: 727 - DNA, 25 bp, Mus musculus
aaaggatggcgtccttcgggcactt

SEQ ID NO: 728 - DNA, 25 bp, Mus musculus
aaaggattcggaaatattgccacca

SEQ ID NO: 729 - DNA, 25 bp, Mus musculus
aaaggattgctgtaattggagcagg

SEQ ID NO: 730 - DNA, 25 bp, Mus musculus
aaaggattttgcaggccaacaatag

SEQ ID NO: 731 - DNA, 25 bp, Mus musculus
aaaggcaaaggtgcaagatacaggc

SEQ ID NO: 732 - DNA, 25 bp, Mus musculus
aaaggcaacatggatgagacctgca

SEQ ID NO: 733 - DNA, 25 bp, Mus musculus
aaaggcacagatcaattcctcaatg

SEQ ID NO: 734 - DNA, 25 bp, Mus musculus
aaaggcagatactccctgacaccac

SEQ ID NO: 735 - DNA, 25 bp, Mus musculus
aaaggcagatgtcgtgccaaagact

SEQ ID NO: 736 - DNA, 25 bp, Mus musculus
aaaggcatctgccaccatggttggc

SEQ ID NO: 737 - DNA, 25 bp, Mus musculus
aaaggccaagattaggtactacatc

SEQ ID NO: 738 - DNA, 25 bp, Mus musculus
aaaggccataatatttctgaaggac

SEQ ID NO: 739 - DNA, 25 bp, Mus musculus
aaaggcccagcggaaacggagctgc

SEQ ID NO: 740 - DNA, 25 bp, Mus musculus
aaaggccccagaagctcctagcaaa

SEQ ID NO: 741 - DNA, 25 bp, Mus musculus
aaaggccctgttcaggtaccagtga

SEQ ID NO: 742 - DNA, 25 bp, Mus musculus
aaaggccggcgagtgcagcctcagt

SEQ ID NO: 743 - DNA, 25 bp, Mus musculus
aaaggccttcatccaccatgagctg

SEQ ID NO: 744 - DNA, 25 bp, Mus musculus
aaaggcgctctaatggaacagatag

SEQ ID NO: 745 - DNA, 25 bp, Mus musculus
aaaggcgctggcacggacgactcca

SEQ ID NO: 746 - DNA, 25 bp, Mus musculus
aaaggcggatacttggaccagcgag

SEQ ID NO: 747 - DNA, 25 bp, Mus musculus
aaaggcggccatgcttctctgctct

SEQ ID NO: 748 - DNA, 25 bp, Mus musculus
aaaggctaccaaaagctgcagcccc

SEQ ID NO: 749 - DNA, 25 bp, Mus musculus
aaaggctctgatgcaccctcgtccc

SEQ ID NO: 750 - DNA, 25 bp, Mus musculus
aaaggctctgttgtccttgaccacg

SEQ ID NO: 751 - DNA, 25 bp, Mus musculus
aaaggctgagaggaactaccacatc

SEQ ID NO: 752 - DNA, 25 bp, Mus musculus
aaaggctgggcctttctgcatcacc

SEQ ID NO: 753 - DNA, 25 bp, Mus musculus
aaaggcttcaagcaacgaatcctta

SEQ ID NO: 754 - DNA, 25 bp, Mus musculus
aaaggcttcctcaacgtgaatgacc

SEQ ID NO: 755 - DNA, 25 bp, Mus musculus
aaagggaagaagtacctcatgtggg

SEQ ID NO: 756 - DNA, 25 bp, Mus musculus
aaagggaagagcaaagttggagaca

SEQ ID NO: 757 - DNA, 25 bp, Mus musculus
aaagggacaggctcttccgcaagga

SEQ ID NO: 758 - DNA, 25 bp, Mus musculus
aaagggaccgactcagagtgacctc

SEQ ID NO: 759 - DNA, 25 bp, Mus musculus
aaagggagatctccgttgctctctg

SEQ ID NO: 760 - DNA, 25 bp, Mus musculus
aaagggccagccacattctagaagt

SEQ ID NO: 761 - DNA, 25 bp, Mus musculus
aaagggccagcctcattctagaagt

SEQ ID NO: 762 - DNA, 25 bp, Mus musculus
aaagggccctgacattagagtcaat

SEQ ID NO: 763 - DNA, 25 bp, Mus musculus
aaagggctcggctctgtatgaaagc

SEQ ID NO: 764 - DNA, 25 bp, Mus musculus
aaagggctggaggttcccagccagc

SEQ ID NO: 765 - DNA, 25 bp, Mus musculus
aaagggctgttgtatctatagacca

SEQ ID NO: 766 - DNA, 25 bp, Mus musculus
aaaggggagtgtgtttgcctacagt

SEQ ID NO: 767 - DNA, 25 bp, Mus musculus
aaagggtctcctgtaagccatagag

SEQ ID NO: 768 - DNA, 25 bp, Mus musculus
aaagggttgtgtgactcctgtgaag

SEQ ID NO: 769 - DNA, 25 bp, Mus musculus
aaaggtacttttcatgtatgtgcct

SEQ ID NO: 770 - DNA, 25 bp, Mus musculus
aaaggtctggtgacatcggaggact

SEQ ID NO: 771 - DNA, 25 bp, Mus musculus
aaaggtgaagctcctgtttgaagac

SEQ ID NO: 772 - DNA, 25 bp, Mus musculus
aaaggtgatgtcaacgttgttgacc

SEQ ID NO: 773 - DNA, 25 bp, Mus musculus
aaaggtgcaaggttgaagagagcat

SEQ ID NO: 774 - DNA, 25 bp, Mus musculus
aaaggtgcagcatttacagaaggcg

SEQ ID NO: 775 - DNA, 25 bp, Mus musculus
aaaggtgcctcctggcctaccttct

SEQ ID NO: 776 - DNA, 25 bp, Mus musculus
aaaggttcagaagtagacacctgac

SEQ ID NO: 777 - DNA, 25 bp, Mus musculus
aaaggttcatggagagatacgcacc

SEQ ID NO: 778 - DNA, 25 bp, Mus musculus
aaaggttctacattccaccgtgtgg

SEQ ID NO: 779 - DNA, 25 bp, Mus musculus
aaagtaaagaacaaggctatggcaa

SEQ ID NO: 780 - DNA, 25 bp, Mus musculus
aaagtaaatgaaatcgtggagacca

SEQ ID NO: 781 - DNA, 25 bp, Mus musculus
aaagtaatcttcttctccgatgtac

SEQ ID NO: 782 - DNA, 25 bp, Mus musculus
aaagtaccaagagactgccttggcg

SEQ ID NO: 783 - DNA, 25 bp, Mus musculus
aaagtaccaggccatgctgagtgtg

SEQ ID NO: 784 - DNA, 25 bp, Mus musculus
aaagtactaatggaggcctgcccct

SEQ ID NO: 785 - DNA, 25 bp, Mus musculus
aaagtagccatgctgacccaaattt

SEQ ID NO: 786 - DNA, 25 bp, Mus musculus
aaagtataacttcttgggcatctcc

SEQ ID NO: 787 - DNA, 25 bp, Mus musculus
aaagtatctggacctgttattgaag

SEQ ID NO: 788 - DNA, 25 bp, Mus musculus
aaagtattacgtccttcctgggcag

SEQ ID NO: 789 - DNA, 25 bp, Mus musculus
aaagtattgtaacagctgaagtctc

SEQ ID NO: 790 - DNA, 25 bp, Mus musculus
aaagtcaccaatcatgtgtgcagcc

SEQ ID NO: 791 - DNA, 25 bp, Mus musculus
aaagtcaccaatgatgtgtgcagcc

SEQ ID NO: 792 - DNA, 25 bp, Mus musculus
aaagtcagagatggctcctgcccag

SEQ ID NO: 793 - DNA, 25 bp, Mus musculus
aaagtcagcagttgccgggactgta

SEQ ID NO: 794 - DNA, 25 bp, Mus musculus
aaagtcagcgttcacctctggtgct

SEQ ID NO: 795 - DNA, 25 bp, Mus musculus
aaagtcatatttcccacgttgttca

SEQ ID NO: 796 - DNA, 25 bp, Mus musculus
aaagtccagaaatgagtggcaagtg

SEQ ID NO: 797 - DNA, 25 bp, Mus musculus
aaagtcccaccgtacacagagcagg

SEQ ID NO: 798 - DNA, 25 bp, Mus musculus
aaagtcccgggataccgacagacat

SEQ ID NO: 799 - DNA, 25 bp, Mus musculus
aaagtccctaagcaggataacagca

SEQ ID NO: 800 - DNA, 25 bp, Mus musculus
aaagtccctgagtacagactgaccg

SEQ ID NO: 801 - DNA, 25 bp, Mus musculus
aaagtcctactccagcagccgagag

SEQ ID NO: 802 - DNA, 25 bp, Mus musculus
aaagtcctctgccacgctctggaac

SEQ ID NO: 803 - DNA, 25 bp, Mus musculus
aaagtccttcgatgggaaagagcct

SEQ ID NO: 804 - DNA, 25 bp, Mus musculus
aaagtcgctctaattcttggtctcc

SEQ ID NO: 805 - DNA, 25 bp, Mus musculus
aaagtcggttgtctgtttacagaag

SEQ ID NO: 806 - DNA, 25 bp, Mus musculus
aaagtctacaggaatgcctgggagc

SEQ ID NO: 807 - DNA, 25 bp, Mus musculus
aaagtctcacttctgaatgccacct

SEQ ID NO: 808 - DNA, 25 bp, Mus musculus
aaagtctctgttgttctatgctcaa

SEQ ID NO: 809 - DNA, 25 bp, Mus musculus
aaagtctggatcctgttctcacatt

SEQ ID NO: 810 - DNA, 25 bp, Mus musculus
aaagtctgtatactctgtgtgagcc

SEQ ID NO: 811 - DNA, 25 bp, Mus musculus
aaagtctgtgctgatcatggacggg

SEQ ID NO: 812 - DNA, 25 bp, Mus musculus
aaagtcttgagaacaccttgtggcg

SEQ ID NO: 813 - DNA, 25 bp, Mus musculus
aaagtgaagcacaccggccagatct

SEQ ID NO: 814 - DNA, 25 bp, Mus musculus
aaagtgactcctctttgtccgaggt

SEQ ID NO: 815 - DNA, 25 bp, Mus musculus
aaagtgagcaagcacctgctgtgtg

SEQ ID NO: 816 - DNA, 25 bp, Mus musculus
aaagtgatctttccgagacaggacg

SEQ ID NO: 817 - DNA, 25 bp, Mus musculus
aaagtgcaagaaacttcaatctgcc

SEQ ID NO: 818 - DNA, 25 bp, Mus musculus
aaagtgcactacagcccattccagt

SEQ ID NO: 819 - DNA, 25 bp, Mus musculus
aaagtgcaggccatgtttacagcca

SEQ ID NO: 820 - DNA, 25 bp, Mus musculus
aaagtgcagtcatggctgtgtcctg

SEQ ID NO: 821 - DNA, 25 bp, Mus musculus
aaagtgccgcaaggtgaaacatgag

SEQ ID NO: 822 - DNA, 25 bp, Mus musculus
aaagtgccttcactgctcgattcag

SEQ ID NO: 823 - DNA, 25 bp, Mus musculus
aaagtgccttcagtgctcgattcag

SEQ ID NO: 824 - DNA, 25 bp, Mus musculus
aaagtggactttctgaagggcatgc

SEQ ID NO: 825 - DNA, 25 bp, Mus musculus
aaagtggagctggacgcggaaacct

SEQ ID NO: 826 - DNA, 25 bp, Mus musculus
aaagtggatgcagctgccaatcagg

SEQ ID NO: 827 - DNA, 25 bp, Mus musculus
aaagtggccatcagcaccgtgaaca

SEQ ID NO: 828 - DNA, 25 bp, Mus musculus
aaagtggcccaccagcctccatata

SEQ ID NO: 829 - DNA, 25 bp, Mus musculus
aaagtgtatatcaaccacagggcag

SEQ ID NO: 830 - DNA, 25 bp, Mus musculus
aaagtgtccctctccatgaaagttg

SEQ ID NO: 831 - DNA, 25 bp, Mus musculus
aaagtgtgagcgctactggcctttg

SEQ ID NO: 832 - DNA, 25 bp, Mus musculus
aaagtgtgcgctcactggccagagt

SEQ ID NO: 833 - DNA, 25 bp, Mus musculus
aaagttacagacattctggcccata

SEQ ID NO: 834 - DNA, 25 bp, Mus musculus
aaagttcaagttaagagctcagaca

SEQ ID NO: 835 - DNA, 25 bp, Mus musculus
aaagttcagtgtagcgtcagcacag

SEQ ID NO: 836 - DNA, 25 bp, Mus musculus
aaagttcattgttgagggcttaaga

SEQ ID NO: 837 - DNA, 25 bp, Mus musculus
aaagttcgagaaattcaagccgcca

SEQ ID NO: 838 - DNA, 25 bp, Mus musculus
aaagttgcagcagaaatcctgggaa

SEQ ID NO: 839 - DNA, 25 bp, Mus musculus
aaagttggtgggaagaagatgttct

SEQ ID NO: 840 - DNA, 25 bp, Mus musculus
aaagttgttcaagtttatgcagaca

SEQ ID NO: 841 - DNA, 25 bp, Mus musculus
aaagtttatgagtgcgaggtcgtcc

SEQ ID NO: 842 - DNA, 25 bp, Mus musculus
aaagtttctgctataacctgctgcg

SEQ ID NO: 843 - DNA, 25 bp, Mus musculus
aaagttttgctcttgtcaaccacag

SEQ ID NO: 844 - DNA, 25 bp, Mus musculus
aaataaaggtggacagcattcttaa

SEQ ID NO: 845 - DNA, 25 bp, Mus musculus
aaataacgccaggttcttggacttg

SEQ ID NO: 846 - DNA, 25 bp, Mus musculus
aaataaggatgcaactaaaatcagc

SEQ ID NO: 847 - DNA, 25 bp, Mus musculus
aaataatgaagaaaatgttctggcc

SEQ ID NO: 848 - DNA, 25 bp, Mus musculus
aaataatgaagataatgttctggcc

SEQ ID NO: 849 - DNA, 25 bp, Mus musculus
aaataattcccgtgaagacagtgaa

SEQ ID NO: 850 - DNA, 25 bp, Mus musculus
aaatacaaacgtgggcaagaagaat

SEQ ID NO: 851 - DNA, 25 bp, Mus musculus
aaatacaacaccagagtaggagaca

SEQ ID NO: 852 - DNA, 25 bp, Mus musculus
aaatacatgcatggaacaaaactca

SEQ ID NO: 853 - DNA, 25 bp, Mus musculus
aaatactcggaaaagaatcttgtgt

SEQ ID NO: 854 - DNA, 25 bp, Mus musculus
aaatagggaagaagtgagcctcagc

SEQ ID NO: 855 - DNA, 25 bp, Mus musculus
aaatagggcacagtggctggaaaag

SEQ ID NO: 856 - DNA, 25 bp, Mus musculus
aaatagtcaattttctgctgcagca

SEQ ID NO: 857 - DNA, 25 bp, Mus musculus
aaatataaatacacagcctctgtcc

SEQ ID NO: 858 - DNA, 25 bp, Mus musculus
aaatatacaggcctgcaaggagctt

SEQ ID NO: 859 - DNA, 25 bp, Mus musculus
aaatatatccagatcgcttgcagag

SEQ ID NO: 860 - DNA, 25 bp, Mus musculus
aaatatatccagttcgcttgcagag

SEQ ID NO: 861 - DNA, 25 bp, Mus musculus
aaatatcaggaggtgaaaggagttg

SEQ ID NO: 862 - DNA, 25 bp, Mus musculus
aaatatccaaaatatggcggtgttc

SEQ ID NO: 863 - DNA, 25 bp, Mus musculus
aaatatccaaagagtagctgcaggg

SEQ ID NO: 864 - DNA, 25 bp, Mus musculus
aaatatccgctcttttgaagtgctg

SEQ ID NO: 865 - DNA, 25 bp, Mus musculus
aaatatcctgttgggccatggctgc

SEQ ID NO: 866 - DNA, 25 bp, Mus musculus
aaatatcgccggaatcccttctgct

SEQ ID NO: 867 - DNA, 25 bp, Mus musculus
aaatatctatgcgaaaaccaagaga

SEQ ID NO: 868 - DNA, 25 bp, Mus musculus
aaatatctgaagacccacgtgggac

SEQ ID NO: 869 - DNA, 25 bp, Mus musculus
aaatatgaggatgcacttcgcctgc

SEQ ID NO: 870 - DNA, 25 bp, Mus musculus
aaatatgaggccttagatgtccccg

SEQ ID NO: 871 - DNA, 25 bp, Mus musculus
aaatatgatcttattgagcagggaa

SEQ ID NO: 872 - DNA, 25 bp, Mus musculus
aaatatgatctttttgagcagggaa

SEQ ID NO: 873 - DNA, 25 bp, Mus musculus
aaatatgggaaaagtctgttgaaca

SEQ ID NO: 874 - DNA, 25 bp, Mus musculus
aaatattaacaatgcagcctctgtc

SEQ ID NO: 875 - DNA, 25 bp, Mus musculus
aaatattcttctgggtgaggatggc

SEQ ID NO: 876 - DNA, 25 bp, Mus musculus
aaatattttctacttggcagttgat

SEQ ID NO: 877 - DNA, 25 bp, Mus musculus
aaatcaaaatgtggcccgaccttct

SEQ ID NO: 878 - DNA, 25 bp, Mus musculus
aaatcaaagcatcaatgaatttggg

SEQ ID NO: 879 - DNA, 25 bp, Mus musculus
aaatcaaattcaagcaattccaagg

SEQ ID NO: 880 - DNA, 25 bp, Mus musculus
aaatcaacagtgcagtggagaaagc

SEQ ID NO: 881 - DNA, 25 bp, Mus musculus
aaatcaactctttccacctatcggc

SEQ ID NO: 882 - DNA, 25 bp, Mus musculus
aaatcaagagcggagcggaagctaa

SEQ ID NO: 883 - DNA, 25 bp, Mus musculus
aaatcaaggattcagtcaaactaag

SEQ ID NO: 884 - DNA, 25 bp, Mus musculus
aaatcaatctttccaagaccaggca

SEQ ID NO: 885 - DNA, 25 bp, Mus musculus
aaatcacactgtggaccgtggtgcc

SEQ ID NO: 886 - DNA, 25 bp, Mus musculus
aaatcaccaggacagacaatacaag

SEQ ID NO: 887 - DNA, 25 bp, Mus musculus
aaatcacctcgtttaatggcacaag

SEQ ID NO: 888 - DNA, 25 bp, Mus musculus
aaatcacctgccatgaagagcctgt

SEQ ID NO: 889 - DNA, 25 bp, Mus musculus
aaatcagaaccaattgggccacacg

SEQ ID NO: 890 - DNA, 25 bp, Mus musculus
aaatcagaagaaaagtattagctac

SEQ ID NO: 891 - DNA, 25 bp, Mus musculus
aaatcagatgcagagtgagcattcg

SEQ ID NO: 892 - DNA, 25 bp, Mus musculus
aaatcagcaaagaagaaaagactcc

SEQ ID NO: 893 - DNA, 25 bp, Mus musculus
aaatcagcttctgctatatcatcag

SEQ ID NO: 894 - DNA, 25 bp, Mus musculus
aaatcatcagctggcagccaccaga

SEQ ID NO: 895 - DNA, 25 bp, Mus musculus
aaatcatcctccctttggctcagat

SEQ ID NO: 896 - DNA, 25 bp, Mus musculus
aaatcatggagaaatgtacactacc

SEQ ID NO: 897 - DNA, 25 bp, Mus musculus
aaatcatgtcttgtccaactgtgag

SEQ ID NO: 898 - DNA, 25 bp, Mus musculus
aaatccagagaggaactttgtcctt

SEQ ID NO: 899 - DNA, 25 bp, Mus musculus
aaatccaggagaccaaccaactcct

SEQ ID NO: 900 - DNA, 25 bp, Mus musculus
aaatccaggatgtccccgagtgccc

SEQ ID NO: 901 - DNA, 25 bp, Mus musculus
aaatccaggcgtcctcctgggcggc

SEQ ID NO: 902 - DNA, 25 bp, Mus musculus
aaatccaggcgtgctcctgggcggc

SEQ ID NO: 903 - DNA, 25 bp, Mus musculus
aaatccatgtttcacacgcagatga

SEQ ID NO: 904 - DNA, 25 bp, Mus musculus
aaatccattggtcttctgccatccg

SEQ ID NO: 905 - DNA, 25 bp, Mus musculus
aaatcccaaatgatctccagtgtgg

SEQ ID NO: 906 - DNA, 25 bp, Mus musculus
aaatcccacagagccaggaccaaag

SEQ ID NO: 907 - DNA, 25 bp, Mus musculus
aaatcccagagccaccaaaacataa

SEQ ID NO: 908 - DNA, 25 bp, Mus musculus
aaatcccaggctcatatagcttcac

SEQ ID NO: 909 - DNA, 25 bp, Mus musculus
aaatccctcgattctgttaccatga

SEQ ID NO: 910 - DNA, 25 bp, Mus musculus
aaatccgacggacaaagttatcagc

SEQ ID NO: 911 - DNA, 25 bp, Mus musculus
aaatccgccgcagctgcgagcggga

SEQ ID NO: 912 - DNA, 25 bp, Mus musculus
aaatcctaagtggactgcagctggg

SEQ ID NO: 913 - DNA, 25 bp, Mus musculus
aaatcctcaaggattcaaccagggc

SEQ ID NO: 914 - DNA, 25 bp, Mus musculus
aaatcctccatacaaccacacaatg

SEQ ID NO: 915 - DNA, 25 bp, Mus musculus
aaatcctccatagaaccacacaatg

SEQ ID NO: 916 - DNA, 25 bp, Mus musculus
aaatcctgaggcttatcttaaaatg

SEQ ID NO: 917 - DNA, 25 bp, Mus musculus
aaatcctggccgcacttgagaaggg

SEQ ID NO: 918 - DNA, 25 bp, Mus musculus
aaatccttctcccttcgacagagtg

SEQ ID NO: 919 - DNA, 25 bp, Mus musculus
aaatcgacagcacggtttactctga

SEQ ID NO: 920 - DNA, 25 bp, Mus musculus
aaatcgagaaggtgcgggtcctcag

SEQ ID NO: 921 - DNA, 25 bp, Mus musculus
aaatcgagcgaacatggcagcccga

SEQ ID NO: 922 - DNA, 25 bp, Mus musculus
aaatcgagcgaagatggcagcccga

SEQ ID NO: 923 - DNA, 25 bp, Mus musculus
aaatcgccaagtctgcagaggctgc

SEQ ID NO: 924 - DNA, 25 bp, Mus musculus
aaatcgctcaaggaacccagtcagg

SEQ ID NO: 925 - DNA, 25 bp, Mus musculus
aaatcggaaatgtgtgcagtgccag

SEQ ID NO: 926 - DNA, 25 bp, Mus musculus
aaatctaacactcgccagtgccagg

SEQ ID NO: 927 - DNA, 25 bp, Mus musculus
aaatctactccctgaaggcaaaatg

SEQ ID NO: 928 - DNA, 25 bp, Mus musculus
aaatctatctgcagaggcgggcaga

SEQ ID NO: 929 - DNA, 25 bp, Mus musculus
aaatctcactgtgactgaggccggc

SEQ ID NO: 930 - DNA, 25 bp, Mus musculus
aaatctcagaaatcaaagaggaggg

SEQ ID NO: 931 - DNA, 25 bp, Mus musculus
aaatctcatgcataatcttggtggg

SEQ ID NO: 932 - DNA, 25 bp, Mus musculus
aaatctcccagccaagccagctgaa

SEQ ID NO: 933 - DNA, 25 bp, Mus musculus
aaatctccggtgattctctgcgcca

SEQ ID NO: 934 - DNA, 25 bp, Mus musculus
aaatctccggtgtttctctgcgcca

SEQ ID NO: 935 - DNA, 25 bp, Mus musculus
aaatctccttttgggcttctggtga

SEQ ID NO: 936 - DNA, 25 bp, Mus musculus
aaatctgcagcctgtgcatatgatc

SEQ ID NO: 937 - DNA, 25 bp, Mus musculus
aaatctggaagagaactactgccgg

SEQ ID NO: 938 - DNA, 25 bp, Mus musculus
aaatctgggcccagtccaggagcat

SEQ ID NO: 939 - DNA, 25 bp, Mus musculus
aaatctggttctcttgcactaatat

SEQ ID NO: 940 - DNA, 25 bp, Mus musculus
aaatcttcactgcagttcttaacag

SEQ ID NO: 941 - DNA, 25 bp, Mus musculus
aaatcttcgagtgacaggactgacc

SEQ ID NO: 942 - DNA, 25 bp, Mus musculus
aaatcttggtaagcgaaacagactc

SEQ ID NO: 943 - DNA, 25 bp, Mus musculus
aaatctttacagagcggtgatgaga

SEQ ID NO: 944 - DNA, 25 bp, Mus musculus
aaatgaaaatggaaaagctgtcttc

SEQ ID NO: 945 - DNA, 25 bp, Mus musculus
aaatgaaacggaggaagcaagatga

SEQ ID NO: 946 - DNA, 25 bp, Mus musculus
aaatgaagaatactttgatctcagc

SEQ ID NO: 947 - DNA, 25 bp, Mus musculus
aaatgaagccagagtttgagagtgc

SEQ ID NO: 948 - DNA, 25 bp, Mus musculus
aaatgaaggccctctggcaggctgc

SEQ ID NO: 949 - DNA, 25 bp, Mus musculus
aaatgaatgaggaaacggccagtct

SEQ ID NO: 950 - DNA, 25 bp, Mus musculus
aaatgaatggtaaagagatgtcacc

SEQ ID NO: 951 - DNA, 25 bp, Mus musculus
aaatgaccacaaaatctttgcaagc

SEQ ID NO: 952 - DNA, 25 bp, Mus musculus
aaatgacctgcatgggttaccctgg

SEQ ID NO: 953 - DNA, 25 bp, Mus musculus
aaatgacgtggacttctttgacatc

SEQ ID NO: 954 - DNA, 25 bp, Mus musculus
aaatgacgtggagttctttgacatc

SEQ ID NO: 955 - DNA, 25 bp, Mus musculus
aaatgactgagctcttccaatccct

SEQ ID NO: 956 - DNA, 25 bp, Mus musculus
aaatgagaatgtcaagattctgagc

SEQ ID NO: 957 - DNA, 25 bp, Mus musculus
aaatgagactcctcacctttatggg

SEQ ID NO: 958 - DNA, 25 bp, Mus musculus
aaatgagatgctgcaggcaaagctg

SEQ ID NO: 959 - DNA, 25 bp, Mus musculus
aaatgagcctttgatagaccctgtg

SEQ ID NO: 960 - DNA, 25 bp, Mus musculus
aaatgaggagatcgcccaggtacac

SEQ ID NO: 961 - DNA, 25 bp, Mus musculus
aaatgagtaagcgagaggctagtct

SEQ ID NO: 962 - DNA, 25 bp, Mus musculus
aaatgagttagctgcagggtgcgtg

SEQ ID NO: 963 - DNA, 25 bp, Mus musculus
aaatgatgatagagaattgaccaag

SEQ ID NO: 964 - DNA, 25 bp, Mus musculus
aaatgatgcaaatcaacctgactgg

SEQ ID NO: 965 - DNA, 25 bp, Mus musculus
aaatgatgggaaagaaccacctcct

SEQ ID NO: 966 - DNA, 25 bp, Mus musculus
aaatgatgtcatccaaaacagtaaa

SEQ ID NO: 967 - DNA, 25 bp, Mus musculus
aaatgatgtgcactgccctgagccc

SEQ ID NO: 968 - DNA, 25 bp, Mus musculus
aaatgatgttggttgattgcctgac

SEQ ID NO: 969 - DNA, 25 bp, Mus musculus
aaatgcaaatgtgaacagcttccag

SEQ ID NO: 970 - DNA, 25 bp, Mus musculus
aaatgcaagttcttccagaaagcca

SEQ ID NO: 971 - DNA, 25 bp, Mus musculus
aaatgcacatggttcaaaattccca

SEQ ID NO: 972 - DNA, 25 bp, Mus musculus
aaatgcagagaagagctcatacctc

SEQ ID NO: 973 - DNA, 25 bp, Mus musculus
aaatgcaggctctgcagtgcgccgc

SEQ ID NO: 974 - DNA, 25 bp, Mus musculus
aaatgccaagtacatttctcggttg

SEQ ID NO: 975 - DNA, 25 bp, Mus musculus
aaatgccagcactgataacactgtc

SEQ ID NO: 976 - DNA, 25 bp, Mus musculus
aaatgccatacctcaaacaggaaag

SEQ ID NO: 977 - DNA, 25 bp, Mus musculus
aaatgccatcgatccaacggtacca

SEQ ID NO: 978 - DNA, 25 bp, Mus musculus
aaatgccctgaaaggaatgctgcgg

SEQ ID NO: 979 - DNA, 25 bp, Mus musculus
aaatgccctgaatggaatgctgcgg

SEQ ID NO: 980 - DNA, 25 bp, Mus musculus
aaatgcctacccctgcagctcggag

SEQ ID NO: 981 - DNA, 25 bp, Mus musculus
aaatgcctacccgtgcagctcggag

SEQ ID NO: 982 - DNA, 25 bp, Mus musculus
aaatgcctgagccaagattcatgta

SEQ ID NO: 983 - DNA, 25 bp, Mus musculus
aaatgcctgccctttcaatactaag

SEQ ID NO: 984 - DNA, 25 bp, Mus musculus
aaatgcgcaaggtcacagacagggt

SEQ ID NO: 985 - DNA, 25 bp, Mus musculus
aaatgcgtatcacatggaagccgag

SEQ ID NO: 986 - DNA, 25 bp, Mus musculus
aaatgctccagcaaagagtgaaacg

SEQ ID NO: 987 - DNA, 25 bp, Mus musculus
aaatgctgccgcgtttctgaaggag

SEQ ID NO: 988 - DNA, 25 bp, Mus musculus
aaatgctggattcgcccatgaatca

SEQ ID NO: 989 - DNA, 25 bp, Mus musculus
aaatgctggattggcccatgaatca

SEQ ID NO: 990 - DNA, 25 bp, Mus musculus
aaatgctggctagggctgctcccgc

SEQ ID NO: 991 - DNA, 25 bp, Mus musculus
aaatgcttattcgtactcctattac

SEQ ID NO: 992 - DNA, 25 bp, Mus musculus
aaatgcttcctggagtccttcacca

SEQ ID NO: 993 - DNA, 25 bp, Mus musculus
aaatgcttgacagtgctgagcggga

SEQ ID NO: 994 - DNA, 25 bp, Mus musculus
aaatggaagatcttcctggagagaa

SEQ ID NO: 995 - DNA, 25 bp, Mus musculus
aaatggacttgctgtcaaacttcag

SEQ ID NO: 996 - DNA, 25 bp, Mus musculus
aaatggagacaatgtgtttgctgcc

SEQ ID NO: 997 - DNA, 25 bp, Mus musculus
aaatggagcattcctagcagaggag

SEQ ID NO: 998 - DNA, 25 bp, Mus musculus
aaatggagccaataaacactttgca

SEQ ID NO: 999 - DNA, 25 bp, Mus musculus
aaatggagcccttcccgttgagtgg

SEQ ID NO: 1000 - DNA, 25 bp, Mus musculus
aaatggaggtgagagtttcacagct

SEQ ID NO: 1001 - DNA, 25 bp, Mus musculus
aaatggagtatgtctttgaactgga

SEQ ID NO: 1002 - DNA, 25 bp, Mus musculus
aaatggatattctttcttcaagctc

SEQ ID NO: 1003 - DNA, 25 bp, Mus musculus
aaatggattcataaggccctggagc

SEQ ID NO: 1004 - DNA, 25 bp, Mus musculus
aaatggattctcagttgttcgaagc

SEQ ID NO: 1005 - DNA, 25 bp, Mus musculus
aaatggcaaatggtggcgatcagaa

SEQ ID NO: 1006 - DNA, 25 bp, Mus musculus
aaatggcaagaaggcctccaggttt

SEQ ID NO: 1007 - DNA, 25 bp, Mus musculus
aaatggccaaggagggccccaggct

SEQ ID NO: 1008 - DNA, 25 bp, Mus musculus
aaatggccagagtttttgacagaca

SEQ ID NO: 1009 - DNA, 25 bp, Mus musculus
aaatggccgaaaaaggcagaagcag

SEQ ID NO: 1010 - DNA, 25 bp, Mus musculus
aaatggctacaaactttctagcgca

SEQ ID NO: 1011 - DNA, 25 bp, Mus musculus
aaatggctatgcagatcgcctggtc

SEQ ID NO: 1012 - DNA, 25 bp, Mus musculus
aaatggctgcaaagacaagtccgtg

SEQ ID NO: 1013 - DNA, 25 bp, Mus musculus
aaatggctgcagctgattctgtgca

SEQ ID NO: 1014 - DNA, 25 bp, Mus musculus
aaatgggaaaccgtatgagcctgtg

SEQ ID NO: 1015 - DNA, 25 bp, Mus musculus
aaatgggaaacggaagatctggaga

SEQ ID NO: 1016 - DNA, 25 bp, Mus musculus
aaatggtccttctcgctcgtcgtgg

SEQ ID NO: 1017 - DNA, 25 bp, Mus musculus
aaatggttctcgaagcttctttggg

SEQ ID NO: 1018 - DNA, 25 bp, Mus musculus
aaatggtttttcattggtgcggctg

SEQ ID NO: 1019 - DNA, 25 bp, Mus musculus
aaatgtaaactgcttgacaaagtca

SEQ ID NO: 1020 - DNA, 25 bp, Mus musculus
aaatgtaattcaagagagaagccta

SEQ ID NO: 1021 - DNA, 25 bp, Mus musculus
aaatgtacagacacaagcgggccag

SEQ ID NO: 1022 - DNA, 25 bp, Mus musculus
aaatgtatgagctttagttctgaac

SEQ ID NO: 1023 - DNA, 25 bp, Mus musculus
aaatgtccagagatgcccaacaaga

SEQ ID NO: 1024 - DNA, 25 bp, Mus musculus
aaatgtctaccctctcctgtaagaa

SEQ ID NO: 1025 - DNA, 25 bp, Mus musculus
aaatgtgaacagcttccagaggaag

SEQ ID NO: 1026 - DNA, 25 bp, Mus musculus
aaatgtgaccttcatcggctagaag

SEQ ID NO: 1027 - DNA, 25 bp, Mus musculus
aaatgtgaccttgaccttggcggag

SEQ ID NO: 1028 - DNA, 25 bp, Mus musculus
aaatgtgatctcaacgggaagcccc

SEQ ID NO: 1029 - DNA, 25 bp, Mus musculus
aaatgtggcaaaacgacttgagacc

SEQ ID NO: 1030 - DNA, 25 bp, Mus musculus
aaatgttgcaatcaagaagctcagc

SEQ ID NO: 1031 - DNA, 25 bp, Mus musculus
aaatgtttcacgtcactcagactga

SEQ ID NO: 1032 - DNA, 25 bp, Mus musculus
aaattaaggcatctcaattagcacc

SEQ ID NO: 1033 - DNA, 25 bp, Mus musculus
aaattaaggcatgtcaattagcacc

SEQ ID NO: 1034 - DNA, 25 bp, Mus musculus
aaattaatgcccgttggaccacaga

SEQ ID NO: 1035 - DNA, 25 bp, Mus musculus
aaattagtcctgctacaatcagtgg

SEQ ID NO: 1036 - DNA, 25 bp, Mus musculus
aaattatacagggatgtgacattgg

SEQ ID NO: 1037 - DNA, 25 bp, Mus musculus
aaattatggcccacgagaggcggga

SEQ ID NO: 1038 - DNA, 25 bp, Mus musculus
aaattatttgatgacgatgctacgg

SEQ ID NO: 1039 - DNA, 25 bp, Mus musculus
aaattattttgttcagcctgtgacc

SEQ ID NO: 1040 - DNA, 25 bp, Mus musculus
aaattcaacgccaagattcagacag

SEQ ID NO: 1041 - DNA, 25 bp, Mus musculus
aaattcagcattggctcagagagtc

SEQ ID NO: 1042 - DNA, 25 bp, Mus musculus
aaattcatcaggatccactttggag

SEQ ID NO: 1043 - DNA, 25 bp, Mus musculus
aaattccagtaaggtggactgcacc

SEQ ID NO: 1044 - DNA, 25 bp, Mus musculus
aaattccatcacctcagctaaccag

SEQ ID NO: 1045 - DNA, 25 bp, Mus musculus
aaattccgttccatcctactcagtg

SEQ ID NO: 1046 - DNA, 25 bp, Mus musculus
aaattctgctgagacctggagcgtc

SEQ ID NO: 1047 - DNA, 25 bp, Mus musculus
aaattctggatgaagctgaacgatc

SEQ ID NO: 1048 - DNA, 25 bp, Mus musculus
aaattctgggcaggtattacgagac

SEQ ID NO: 1049 - DNA, 25 bp, Mus musculus
aaattctgggccaactttgctcgaa

SEQ ID NO: 1050 - DNA, 25 bp, Mus musculus
aaattcttcatttggctcaaagtca

SEQ ID NO: 1051 - DNA, 25 bp, Mus musculus
aaattgagcaggtggacatgctaga

SEQ ID NO: 1052 - DNA, 25 bp, Mus musculus
aaattgcaactaggaggccggccta

SEQ ID NO: 1053 - DNA, 25 bp, Mus musculus
aaattgcacggtaccgtggtagagg

SEQ ID NO: 1054 - DNA, 25 bp, Mus musculus
aaattgcatagtagacctcgtaaac

SEQ ID NO: 1055 - DNA, 25 bp, Mus musculus
aaattgccaacttctcacagagctg

SEQ ID NO: 1056 - DNA, 25 bp, Mus musculus
aaattgcccattcttgctgaagctg

SEQ ID NO: 1057 - DNA, 25 bp, Mus musculus
aaattgctcacgaaagggggccgcg

SEQ ID NO: 1058 - DNA, 25 bp, Mus musculus
aaattgctccaaagagcttgaggaa

SEQ ID NO: 1059 - DNA, 25 bp, Mus musculus
aaattgctgaaggtttcccgagaca

SEQ ID NO: 1060 - DNA, 25 bp, Mus musculus
aaattggagtttgcccttctgccta

SEQ ID NO: 1061 - DNA, 25 bp, Mus musculus
aaattggcaccaccgtgcacttcaa

SEQ ID NO: 1062 - DNA, 25 bp, Mus musculus
aaattggttagtattgtagctgagc

SEQ ID NO: 1063 - DNA, 25 bp, Mus musculus
aaattggttattgttagactcactg

SEQ ID NO: 1064 - DNA, 25 bp, Mus musculus
aaattgtcacaattgagcgtctacg

SEQ ID NO: 1065 - DNA, 25 bp, Mus musculus
aaattgtcggtgatctggcctccgc

SEQ ID NO: 1066 - DNA, 25 bp, Mus musculus
aaatttacattccaccagctcagag

SEQ ID NO: 1067 - DNA, 25 bp, Mus musculus
aaatttagccacttcaaatgctgag

SEQ ID NO: 1068 - DNA, 25 bp, Mus musculus
aaatttcagtgtataggagatgccg

SEQ ID NO: 1069 - DNA, 25 bp, Mus musculus
aaatttccaggccaaccaatccaca

SEQ ID NO: 1070 - DNA, 25 bp, Mus musculus
aaatttccaggcgaaccaatccaca

SEQ ID NO: 1071 - DNA, 25 bp, Mus musculus
aaatttcgactgaaggtcaccagcc

SEQ ID NO: 1072 - DNA, 25 bp, Mus musculus
aaatttggctgcagccaggctgaca

SEQ ID NO: 1073 - DNA, 25 bp, Mus musculus
aaatttggctttaccgctctcatgg

SEQ ID NO: 1074 - DNA, 25 bp, Mus musculus
aaattttgtgccaggaaaacacact

SEQ ID NO: 1075 - DNA, 25 bp, Mus musculus
aacaaaaacagtctcgtaagcccag

SEQ ID NO: 1076 - DNA, 25 bp, Mus musculus
aacaaaaagaagtgaatgtcaccac

SEQ ID NO: 1077 - DNA, 25 bp, Mus musculus
aacaaaaatcagatgcagagtgagc

SEQ ID NO: 1078 - DNA, 25 bp, Mus musculus
aacaaagaggtccttacacatacag

SEQ ID NO: 1079 - DNA, 25 bp, Mus musculus
aacaaagatactggagtactgactc

SEQ ID NO: 1080 - DNA, 25 bp, Mus musculus
aacaaagtttcagccgtgtcttgca

SEQ ID NO: 1081 - DNA, 25 bp, Mus musculus
aacaaatgttatttccatcactgac

SEQ ID NO: 1082 - DNA, 25 bp, Mus musculus
aacaacaacgaacccctgcagtttg

SEQ ID NO: 1083 - DNA, 25 bp, Mus musculus
aacaacaggcttcttgcaattctgg

SEQ ID NO: 1084 - DNA, 25 bp, Mus musculus
aacaaccaaaaggaaacagtgccag

SEQ ID NO: 1085 - DNA, 25 bp, Mus musculus
aacaaccaaggcattccaactccag

SEQ ID NO: 1086 - DNA, 25 bp, Mus musculus
aacaaccatatttttgagtccccag

SEQ ID NO: 1087 - DNA, 25 bp, Mus musculus
aacaacccctttctctaagctgaag

SEQ ID NO: 1088 - DNA, 25 bp, Mus musculus
aacaacccgagccacccgatgatgt

SEQ ID NO: 1089 - DNA, 25 bp, Mus musculus
aacaacccgtgtgtgtcgccgataa

SEQ ID NO: 1090 - DNA, 25 bp, Mus musculus
aacaacccttcgctgacctgattgg

SEQ ID NO: 1091 - DNA, 25 bp, Mus musculus
aacaaccggattgatctttccagag

SEQ ID NO: 1092 - DNA, 25 bp, Mus musculus
aacaaccgttcacattgggcccact

SEQ ID NO: 1093 - DNA, 25 bp, Mus musculus
aacaacgcatttttgagccaccacc

SEQ ID NO: 1094 - DNA, 25 bp, Mus musculus
aacaacgtgagcactggctgtatcc

SEQ ID NO: 1095 - DNA, 25 bp, Mus musculus
aacaactatgaaatccttacaatgc

SEQ ID NO: 1096 - DNA, 25 bp, Mus musculus
aacaagaaggacatggatgccgacc

SEQ ID NO: 1097 - DNA, 25 bp, Mus musculus
aacaagaaggacttggatgccgacc

SEQ ID NO: 1098 - DNA, 25 bp, Mus musculus
aacaagaagtcagatggcggtgtca

SEQ ID NO: 1099 - DNA, 25 bp, Mus musculus
aacaagacatgtcccgacgatatgg

SEQ ID NO: 1100 - DNA, 25 bp, Mus musculus
aacaagacatgtgccgacgatatgg

SEQ ID NO: 1101 - DNA, 25 bp, Mus musculus
aacaagactgttggccaagtgaaga

SEQ ID NO: 1102 - DNA, 25 bp, Mus musculus
aacaagaggcccagtttgagaagct

SEQ ID NO: 1103 - DNA, 25 bp, Mus musculus
aacaagatggtgtatcagagctgtc

SEQ ID NO: 1104 - DNA, 25 bp, Mus musculus
aacaagcagaccttcgtctgcctac

SEQ ID NO: 1105 - DNA, 25 bp, Mus musculus
aacaagcaggaaacctggatgaaga

SEQ ID NO: 1106 - DNA, 25 bp, Mus musculus
aacaagcccgtgagtgtcaaggtgt

SEQ ID NO: 1107 - DNA, 25 bp, Mus musculus
aacaagcccgtgtgtgtcaaggtgt

SEQ ID NO: 1108 - DNA, 25 bp, Mus musculus
aacaagccgatggattcctctcata

SEQ ID NO: 1109 - DNA, 25 bp, Mus musculus
aacaagccggccattgtagaagctg

SEQ ID NO: 1110 - DNA, 25 bp, Mus musculus
aacaagcctcactctgaggaatttc

SEQ ID NO: 1111 - DNA, 25 bp, Mus musculus
aacaagcctgtatttttccagcaag

SEQ ID NO: 1112 - DNA, 25 bp, Mus musculus
aacaagccttcaccgatgtggccac

SEQ ID NO: 1113 - DNA, 25 bp, Mus musculus
aacaagcggctctcaaagtcctctg

SEQ ID NO: 1114 - DNA, 25 bp, Mus musculus
aacaagctccgggtgaaggtcagct

SEQ ID NO: 1115 - DNA, 25 bp, Mus musculus
aacaagctgagtggaggcggcgggc

SEQ ID NO: 1116 - DNA, 25 bp, Mus musculus
aacaagctgatactgcctggtctca

SEQ ID NO: 1117 - DNA, 25 bp, Mus musculus
aacaagctgctggagaccaagtggc

SEQ ID NO: 1118 - DNA, 25 bp, Mus musculus
aacaagcttgcgctgcagacagtgt

SEQ ID NO: 1119 - DNA, 25 bp, Mus musculus
aacaagcttggcactcagtctcaaa

SEQ ID NO: 1120 - DNA, 25 bp, Mus musculus
aacaaggacccactcaatgagacgg

SEQ ID NO: 1121 - DNA, 25 bp, Mus musculus
aacaaggagtgctgccatggtgacc

SEQ ID NO: 1122 - DNA, 25 bp, Mus musculus
aacaaggatgactagaatgggccaa

SEQ ID NO: 1123 - DNA, 25 bp, Mus musculus
aacaaggctggagccgagaaggaac

SEQ ID NO: 1124 - DNA, 25 bp, Mus musculus
aacaagggactactgcactccttcg

SEQ ID NO: 1125 - DNA, 25 bp, Mus musculus
aacaaggtcagcactaagaggcctc

SEQ ID NO: 1126 - DNA, 25 bp, Mus musculus
aacaaggtttgtgcttcaggaatga

SEQ ID NO: 1127 - DNA, 25 bp, Mus musculus
aacaagtagaccagcgtgatctgct

SEQ ID NO: 1128 - DNA, 25 bp, Mus musculus
aacaagtggtattcccgtgatcaac

SEQ ID NO: 1129 - DNA, 25 bp, Mus musculus
aacaagtggtggaatagcctaagtg

SEQ ID NO: 1130 - DNA, 25 bp, Mus musculus
aacaagtggttcacagacacatcta

SEQ ID NO: 1131 - DNA, 25 bp, Mus musculus
aacaagtgtccccttcgcagcaaca

SEQ ID NO: 1132 - DNA, 25 bp, Mus musculus
aacaatacgggaaccgagtccgcat

SEQ ID NO: 1133 - DNA, 25 bp, Mus musculus
aacaatatttggtgcagtaacgtac

SEQ ID NO: 1134 - DNA, 25 bp, Mus musculus
aacaatctggaacttgaacttttga

SEQ ID NO: 1135 - DNA, 25 bp, Mus musculus
aacaatcttgattcctgttgccggc

SEQ ID NO: 1136 - DNA, 25 bp, Mus musculus
aacaatgatgtcaaaccgcagggag

SEQ ID NO: 1137 - DNA, 25 bp, Mus musculus
aacaatggaggaggccagttcatgg

SEQ ID NO: 1138 - DNA, 25 bp, Mus musculus
aacaatgtaaacaaagccctggact

SEQ ID NO: 1139 - DNA, 25 bp, Mus musculus
aacaattaggcgagttcattttggc

SEQ ID NO: 1140 - DNA, 25 bp, Mus musculus
aacaattaggcgtgttcattttggc

SEQ ID NO: 1141 - DNA, 25 bp, Mus musculus
aacaattggatttcatgatggagac

SEQ ID NO: 1142 - DNA, 25 bp, Mus musculus
aacaattggctcagtcattcttggt

SEQ ID NO: 1143 - DNA, 25 bp, Mus musculus
aacacaaatgcaccttctgggacag

SEQ ID NO: 1144 - DNA, 25 bp, Mus musculus
aacacaactggagggggatcgaaga

SEQ ID NO: 1145 - DNA, 25 bp, Mus musculus
aacacaagcacaatattcggcccaa

SEQ ID NO: 1146 - DNA, 25 bp, Mus musculus
aacacaagccgtggtcttggcccag

SEQ ID NO: 1147 - DNA, 25 bp, Mus musculus
aacacaagctatgatgtagctaccc

SEQ ID NO: 1148 - DNA, 25 bp, Mus musculus
aacacaagctcagcagggaccagtg

SEQ ID NO: 1149 - DNA, 25 bp, Mus musculus
aacacaaggcgcttctcactcacga

SEQ ID NO: 1150 - DNA, 25 bp, Mus musculus
aacacaagtagcgagacagccagga

SEQ ID NO: 1151 - DNA, 25 bp, Mus musculus
aacacaatggctacccttctgaagc

SEQ ID NO: 1152 - DNA, 25 bp, Mus musculus
aacacaattactagatagctcaggg

SEQ ID NO: 1153 - DNA, 25 bp, Mus musculus
aacacaattacttgatagctcaggg

SEQ ID NO: 1154 - DNA, 25 bp, Mus musculus
aacacacccaagacgctgctggaaa

SEQ ID NO: 1155 - DNA, 25 bp, Mus musculus
aacacacccactggctaaggacaaa

SEQ ID NO: 1156 - DNA, 25 bp, Mus musculus
aacacaccccatccaaggagatgaa

SEQ ID NO: 1157 - DNA, 25 bp, Mus musculus
aacacaccgtgcaggtctcccgagg

SEQ ID NO: 1158 - DNA, 25 bp, Mus musculus
aacacacggtgccagaagatctgcg

SEQ ID NO: 1159 - DNA, 25 bp, Mus musculus
aacacactggaagttacttttcaca

SEQ ID NO: 1160 - DNA, 25 bp, Mus musculus
aacacactgtgggaactgccacgct

SEQ ID NO: 1161 - DNA, 25 bp, Mus musculus
aacacagaaggcaccttccattgcc

SEQ ID NO: 1162 - DNA, 25 bp, Mus musculus
aacacagaaggctccttccattgcc

SEQ ID NO: 1163 - DNA, 25 bp, Mus musculus
aacacagaaggtacctaccaatgcc

SEQ ID NO: 1164 - DNA, 25 bp, Mus musculus
aacacagaaggttcctaccaatgcc

SEQ ID NO: 1165 - DNA, 25 bp, Mus musculus
aacacagacaagaaatcctatgaac

SEQ ID NO: 1166 - DNA, 25 bp, Mus musculus
aacacagagaagtcggcgaagtgga

SEQ ID NO: 1167 - DNA, 25 bp, Mus musculus
aacacagagggcaccttcagctgtc

SEQ ID NO: 1168 - DNA, 25 bp, Mus musculus
aacacagagggctccttcagctgtc

SEQ ID NO: 1169 - DNA, 25 bp, Mus musculus
aacacagccaaaagatacaacataa

SEQ ID NO: 1170 - DNA, 25 bp, Mus musculus
aacacaggaggtgggcatcctttct

SEQ ID NO: 1171 - DNA, 25 bp, Mus musculus
aacacagtccggtgctgcagagcat

SEQ ID NO: 1172 - DNA, 25 bp, Mus musculus
aacacagtcttttcattcttaggcc

SEQ ID NO: 1173 - DNA, 25 bp, Mus musculus
aacacagtgtgtgatttctggcaga

SEQ ID NO: 1174 - DNA, 25 bp, Mus musculus
aacacagttataaaactggcccaca

SEQ ID NO: 1175 - DNA, 25 bp, Mus musculus
aacacatatctagcctcatcaaact

SEQ ID NO: 1176 - DNA, 25 bp, Mus musculus
aacacatgtcggaggcgagacttat

SEQ ID NO: 1177 - DNA, 25 bp, Mus musculus
aacacattcagctcccagatgtcca

SEQ ID NO: 1178 - DNA, 25 bp, Mus musculus
aacaccaagaagctttcagccagag

SEQ ID NO: 1179 - DNA, 25 bp, Mus musculus
aacaccaggtggctgtccaaatgac

SEQ ID NO: 1180 - DNA, 25 bp, Mus musculus
aacaccatgggtaagagatctgacc

SEQ ID NO: 1181 - DNA, 25 bp, Mus musculus
aacaccattgaaggagagccggagt

SEQ ID NO: 1182 - DNA, 25 bp, Mus musculus
aacaccattgtggagcatgattctg

SEQ ID NO: 1183 - DNA, 25 bp, Mus musculus
aacaccattgtgtctgggtcctgga

SEQ ID NO: 1184 - DNA, 25 bp, Mus musculus
aacaccctgcgctgccagcttggag

SEQ ID NO: 1185 - DNA, 25 bp, Mus musculus
aacaccggccgcacgaggtgggctc

SEQ ID NO: 1186 - DNA, 25 bp, Mus musculus
aacaccgtgctgcacgctcgggaca

SEQ ID NO: 1187 - DNA, 25 bp, Mus musculus
aacaccgtggactgcgctccagagt

SEQ ID NO: 1188 - DNA, 25 bp, Mus musculus
aacacctatgacatccatcggctgg

SEQ ID NO: 1189 - DNA, 25 bp, Mus musculus
aacacctccagaagtttccactgtt

SEQ ID NO: 1190 - DNA, 25 bp, Mus musculus
aacacctgcatggtttagagacaag

SEQ ID NO: 1191 - DNA, 25 bp, Mus musculus
aacacctgccagttatcacttgaag

SEQ ID NO: 1192 - DNA, 25 bp, Mus musculus
aacacgcttagggaacaagtccaag

SEQ ID NO: 1193 - DNA, 25 bp, Mus musculus
aacacggagggcaccttcacctgct

SEQ ID NO: 1194 - DNA, 25 bp, Mus musculus
aacacggagggcacgtaccactgcg

SEQ ID NO: 1195 - DNA, 25 bp, Mus musculus
aacacggagggctccttcacctgct

SEQ ID NO: 1196 - DNA, 25 bp, Mus musculus
aacacggagggctcgtaccactgcg

SEQ ID NO: 1197 - DNA, 25 bp, Mus musculus
aacacggcacgtgatctgagtgtca

SEQ ID NO: 1198 - DNA, 25 bp, Mus musculus
aacacggctaaacctctgcttgagg

SEQ ID NO: 1199 - DNA, 25 bp, Mus musculus
aacacgggcgagatcaaagcactgg

SEQ ID NO: 1200 - DNA, 25 bp, Mus musculus
aacacggtacaaccttcatccctgg

SEQ ID NO: 1201 - DNA, 25 bp, Mus musculus
aacacgtcgggaattgaatcccaga

SEQ ID NO: 1202 - DNA, 25 bp, Mus musculus
aacactatctcttctatgatggcga

SEQ ID NO: 1203 - DNA, 25 bp, Mus musculus
aacactccccagtttccagtgaagg

SEQ ID NO: 1204 - DNA, 25 bp, Mus musculus
aacactccttcgctgcagctggtga

SEQ ID NO: 1205 - DNA, 25 bp, Mus musculus
aacactccttcggtgcagctggtga

SEQ ID NO: 1206 - DNA, 25 bp, Mus musculus
aacactcgccagtgccaggctctgt

SEQ ID NO: 1207 - DNA, 25 bp, Mus musculus
aacactctaaaggagatgcaggatg

SEQ ID NO: 1208 - DNA, 25 bp, Mus musculus
aacactctgttcctggttctggtta

SEQ ID NO: 1209 - DNA, 25 bp, Mus musculus
aacactgaggagttccgtgaccagt

SEQ ID NO: 1210 - DNA, 25 bp, Mus musculus
aacactgccaccacggacagcgtga

SEQ ID NO: 1211 - DNA, 25 bp, Mus musculus
aacactggtagtaagccagccctga

SEQ ID NO: 1212 - DNA, 25 bp, Mus musculus
aacactggtagttagccagccctga

SEQ ID NO: 1213 - DNA, 25 bp, Mus musculus
aacactggtcctgtaaacaagattc

SEQ ID NO: 1214 - DNA, 25 bp, Mus musculus
aacactgtctgccaggcactgtgct

SEQ ID NO: 1215 - DNA, 25 bp, Mus musculus
aacacttaaccacagagagaacacc

SEQ ID NO: 1216 - DNA, 25 bp, Mus musculus
aacacttcagggtcaggttgccaca

SEQ ID NO: 1217 - DNA, 25 bp, Mus musculus
aacacttcagttatggaagatcaaa

SEQ ID NO: 1218 - DNA, 25 bp, Mus musculus
aacagaaacttgacttagggtgtgc

SEQ ID NO: 1219 - DNA, 25 bp, Mus musculus
aacagaaaggtgctcctgtcaaaca

SEQ ID NO: 1220 - DNA, 25 bp, Mus musculus
aacagaacagcaccaccaccggggt

SEQ ID NO: 1221 - DNA, 25 bp, Mus musculus
aacagaagccggatggtgtctttca

SEQ ID NO: 1222 - DNA, 25 bp, Mus musculus
aacagaatactgtttgacatgacgg

SEQ ID NO: 1223 - DNA, 25 bp, Mus musculus
aacagaatccccttctagcagaagc

SEQ ID NO: 1224 - DNA, 25 bp, Mus musculus
aacagacaccttcaaactgcactgc

SEQ ID NO: 1225 - DNA, 25 bp, Mus musculus
aacagaccagacctctatgacgtgt

SEQ ID NO: 1226 - DNA, 25 bp, Mus musculus
aacagactccactctgcagataaag

SEQ ID NO: 1227 - DNA, 25 bp, Mus musculus
aacagacttcacattcatggtgaag

SEQ ID NO: 1228 - DNA, 25 bp, Mus musculus
aacagagaaagcacgggatctgcac

SEQ ID NO: 1229 - DNA, 25 bp, Mus musculus
aacagagaatcggtgccagcaagaa

SEQ ID NO: 1230 - DNA, 25 bp, Mus musculus
aacagagactttaggcagcatcact

SEQ ID NO: 1231 - DNA, 25 bp, Mus musculus
aacagagagtacctgatcgagaagc

SEQ ID NO: 1232 - DNA, 25 bp, Mus musculus
aacagagccatcgatgctgccttgg

SEQ ID NO: 1233 - DNA, 25 bp, Mus musculus
aacagaggccatctctcacagagta

SEQ ID NO: 1234 - DNA, 25 bp, Mus musculus
aacagatcagctccagccaggagca

SEQ ID NO: 1235 - DNA, 25 bp, Mus musculus
aacagatcagtggaggacaggaatt

SEQ ID NO: 1236 - DNA, 25 bp, Mus musculus
aacagatcctggctctagaggcgga

SEQ ID NO: 1237 - DNA, 25 bp, Mus musculus
aacagatggcagagttccggaagca

SEQ ID NO: 1238 - DNA, 25 bp, Mus musculus
aacagattgccgtttgtcctgctgg

SEQ ID NO: 1239 - DNA, 25 bp, Mus musculus
aacagcaaccaccactgctcttaag

SEQ ID NO: 1240 - DNA, 25 bp, Mus musculus
aacagcaagtgaaggcaagaaatgg

SEQ ID NO: 1241 - DNA, 25 bp, Mus musculus
aacagcaagtgatggctgcagccca

SEQ ID NO: 1242 - DNA, 25 bp, Mus musculus
aacagcacagaacccagcggtggca

SEQ ID NO: 1243 - DNA, 25 bp, Mus musculus
aacagcacgtttccctcttgcagct

SEQ ID NO: 1244 - DNA, 25 bp, Mus musculus
aacagcattcacacagcatcaccga

SEQ ID NO: 1245 - DNA, 25 bp, Mus musculus
aacagccagtcctacgaggagatgg

SEQ ID NO: 1246 - DNA, 25 bp, Mus musculus
aacagccgggacctgaacatggact

SEQ ID NO: 1247 - DNA, 25 bp, Mus musculus
aacagcctgctttctactaaaaggg

SEQ ID NO: 1248 - DNA, 25 bp, Mus musculus
aacagcgcaagccatcaagtgcaga

SEQ ID NO: 1249 - DNA, 25 bp, Mus musculus
aacagcgtgcacctcggcatcttct

SEQ ID NO: 1250 - DNA, 25 bp, Mus musculus
aacagctaaaccagactgcttccgc

SEQ ID NO: 1251 - DNA, 25 bp, Mus musculus
aacagctagttcagctacttcttga

SEQ ID NO: 1252 - DNA, 25 bp, Mus musculus
aacagctcatctcgatttgactgca

SEQ ID NO: 1253 - DNA, 25 bp, Mus musculus
aacagctgccagttcctctcggagt

SEQ ID NO: 1254 - DNA, 25 bp, Mus musculus
aacagcttgtaaaactcaaagagcc

SEQ ID NO: 1255 - DNA, 25 bp, Mus musculus
aacaggaacaatctcttcaagtgat

SEQ ID NO: 1256 - DNA, 25 bp, Mus musculus
aacaggaacagagtcgaggcgcttt

SEQ ID NO: 1257 - DNA, 25 bp, Mus musculus
aacaggaagcagagtggcgatgaca

SEQ ID NO: 1258 - DNA, 25 bp, Mus musculus
aacaggacaacttattcaatatgac

SEQ ID NO: 1259 - DNA, 25 bp, Mus musculus
aacaggacgcgggtcttgatgccct

SEQ ID NO: 1260 - DNA, 25 bp, Mus musculus
aacaggaggcccgtttcgagcggct

SEQ ID NO: 1261 - DNA, 25 bp, Mus musculus
aacaggaggtatactacctaattcg

SEQ ID NO: 1262 - DNA, 25 bp, Mus musculus
aacaggaggtattctacctaattcg

SEQ ID NO: 1263 - DNA, 25 bp, Mus musculus
aacaggagtgactctcacgggagag

SEQ ID NO: 1264 - DNA, 25 bp, Mus musculus
aacaggagttcatggttacgcatgc

SEQ ID NO: 1265 - DNA, 25 bp, Mus musculus
aacaggatagacttgatgagtggcc

SEQ ID NO: 1266 - DNA, 25 bp, Mus musculus
aacaggccaggttctggaacgtgca

SEQ ID NO: 1267 - DNA, 25 bp, Mus musculus
aacaggccatctagccttctccttg

SEQ ID NO: 1268 - DNA, 25 bp, Mus musculus
aacaggctatccctgtgcggcagca

SEQ ID NO: 1269 - DNA, 25 bp, Mus musculus
aacaggctatggtgctccaagaggc

SEQ ID NO: 1270 - DNA, 25 bp, Mus musculus
aacaggcttcttgcaattctggagg

SEQ ID NO: 1271 - DNA, 25 bp, Mus musculus
aacagggcgcaaagtctgcagagga

SEQ ID NO: 1272 - DNA, 25 bp, Mus musculus
aacaggtgaccgtggaaacagtcct

SEQ ID NO: 1273 - DNA, 25 bp, Mus musculus
aacaggtgctgtagatctctccgat

SEQ ID NO: 1274 - DNA, 25 bp, Mus musculus
aacaggtggagatcagagctgtctc

SEQ ID NO: 1275 - DNA, 25 bp, Mus musculus
aacaggtggcctgggagtagatatt

SEQ ID NO: 1276 - DNA, 25 bp, Mus musculus
aacaggtggcggtgcagagacccac

SEQ ID NO: 1277 - DNA, 25 bp, Mus musculus
aacagtacaagaaggagcgaaaggg

SEQ ID NO: 1278 - DNA, 25 bp, Mus musculus
aacagtactctgatcatcagcaaca

SEQ ID NO: 1279 - DNA, 25 bp, Mus musculus
aacagtagccagaggacaccctctc

SEQ ID NO: 1280 - DNA, 25 bp, Mus musculus
aacagtatgacaacaaaattataga

SEQ ID NO: 1281 - DNA, 25 bp, Mus musculus
aacagtattcccagcatggtctaga

SEQ ID NO: 1282 - DNA, 25 bp, Mus musculus
aacagtccaagctcctcatttccaa

SEQ ID NO: 1283 - DNA, 25 bp, Mus musculus
aacagtcctttccacgtctctcagt

SEQ ID NO: 1284 - DNA, 25 bp, Mus musculus
aacagtctatttcggcgaatcttga

SEQ ID NO: 1285 - DNA, 25 bp, Mus musculus
aacagtctgcgagagatccaagcac

SEQ ID NO: 1286 - DNA, 25 bp, Mus musculus
aacagtcttcaagagagccttgatg

SEQ ID NO: 1287 - DNA, 25 bp, Mus musculus
aacagtgatgctagtttgccatcag

SEQ ID NO: 1288 - DNA, 25 bp, Mus musculus
aacagtgctaatcgagatatttccg

SEQ ID NO: 1289 - DNA, 25 bp, Mus musculus
aacagtgctacagtttgaaggccaa

SEQ ID NO: 1290 - DNA, 25 bp, Mus musculus
aacagtggccggactgactcagaac

SEQ ID NO: 1291 - DNA, 25 bp, Mus musculus
aacagtgtgtcaaccgcatcattac

SEQ ID NO: 1292 - DNA, 25 bp, Mus musculus
aacagtttacagtcatcacatgtcc

SEQ ID NO: 1293 - DNA, 25 bp, Mus musculus
aacagtttgcttccagcctcccttg

SEQ ID NO: 1294 - DNA, 25 bp, Mus musculus
aacagtttgtctgtgcacacacggg

SEQ ID NO: 1295 - DNA, 25 bp, Mus musculus
aacataaacattaccccactcctag

SEQ ID NO: 1296 - DNA, 25 bp, Mus musculus
aacataaggatgactaaccaggcca

SEQ ID NO: 1297 - DNA, 25 bp, Mus musculus
aacataaggatgtctaaccaggcca

SEQ ID NO: 1298 - DNA, 25 bp, Mus musculus
aacataatccagtttgtgccagccg

SEQ ID NO: 1299 - DNA, 25 bp, Mus musculus
aacataggacttgaatgtgacagag

SEQ ID NO: 1300 - DNA, 25 bp, Mus musculus
aacatatccccaagtgggaactgtt

SEQ ID NO: 1301 - DNA, 25 bp, Mus musculus
aacatatgttcaagcagttctgcca

SEQ ID NO: 1302 - DNA, 25 bp, Mus musculus
aacatattgggtaccgcttgacaac

SEQ ID NO: 1303 - DNA, 25 bp, Mus musculus
aacatattgggttccgcttgacaac

SEQ ID NO: 1304 - DNA, 25 bp, Mus musculus
aacatcaagagggttgccaaggagc

SEQ ID NO: 1305 - DNA, 25 bp, Mus musculus
aacatcacagtgcacattggacagc

SEQ ID NO: 1306 - DNA, 25 bp, Mus musculus
aacatcacagtggacattggacagc

SEQ ID NO: 1307 - DNA, 25 bp, Mus musculus
aacatcactgtgtttgtcccacagt

SEQ ID NO: 1308 - DNA, 25 bp, Mus musculus
aacatcagagagaggctcattttcc

SEQ ID NO: 1309 - DNA, 25 bp, Mus musculus
aacatcatcacacttgcagacattg

SEQ ID NO: 1310 - DNA, 25 bp, Mus musculus
aacatcatcccattgagaaccccag

SEQ ID NO: 1311 - DNA, 25 bp, Mus musculus
aacatcatgcgacgctgtttggcca

SEQ ID NO: 1312 - DNA, 25 bp, Mus musculus
aacatcatgcgaggctgtttggcca

SEQ ID NO: 1313 - DNA, 25 bp, Mus musculus
aacatcatggctgccagaggctgca

SEQ ID NO: 1314 - DNA, 25 bp, Mus musculus
aacatccgtggtactttcggagtgc

SEQ ID NO: 1315 - DNA, 25 bp, Mus musculus
aacatcctatagatgtaagcaggga

SEQ ID NO: 1316 - DNA, 25 bp, Mus musculus
aacatccttcctagtcgcccgtttg

SEQ ID NO: 1317 - DNA, 25 bp, Mus musculus
aacatcgatgctggaactttctcac

SEQ ID NO: 1318 - DNA, 25 bp, Mus musculus
aacatcgatgttcttttcccgcaca

SEQ ID NO: 1319 - DNA, 25 bp, Mus musculus
aacatctacagccttaatgagggtt

SEQ ID NO: 1320 - DNA, 25 bp, Mus musculus
aacatctaccctaagtgccttgggt

SEQ ID NO: 1321 - DNA, 25 bp, Mus musculus
aacatctcaccgtccatccaggaga

SEQ ID NO: 1322 - DNA, 25 bp, Mus musculus
aacatcttttctccctacacagcga

SEQ ID NO: 1323 - DNA, 25 bp, Mus musculus
aacatgacactgcttttctccttcg

SEQ ID NO: 1324 - DNA, 25 bp, Mus musculus
aacatgaccaaacaaggaacctgga

SEQ ID NO: 1325 - DNA, 25 bp, Mus musculus
aacatggagactgccgcccgatgca

SEQ ID NO: 1326 - DNA, 25 bp, Mus musculus
aacatggagggtgtcattacaccac

SEQ ID NO: 1327 - DNA, 25 bp, Mus musculus
aacatggccgttcctaactttgaag

SEQ ID NO: 1328 - DNA, 25 bp, Mus musculus
aacatggcgcactgtgagtttcttc

SEQ ID NO: 1329 - DNA, 25 bp, Mus musculus
aacatgggcagtccccgaccaaaga

SEQ ID NO: 1330 - DNA, 25 bp, Mus musculus
aacatggtgatagctcccaagggtg

SEQ ID NO: 1331 - DNA, 25 bp, Mus musculus
aacatgtacctgaactttgccgaga

SEQ ID NO: 1332 - DNA, 25 bp, Mus musculus
aacatgtccgagtttgtctgtgacc

SEQ ID NO: 1333 - DNA, 25 bp, Mus musculus
aacatgtgcatcgtaggtggattca

SEQ ID NO: 1334 - DNA, 25 bp, Mus musculus
aacatgttccagaccctcaagtacc

SEQ ID NO: 1335 - DNA, 25 bp, Mus musculus
aacatgttggaaagatagcgggaga

SEQ ID NO: 1336 - DNA, 25 bp, Mus musculus
aacattaggtgtatctgcatggtcc

SEQ ID NO: 1337 - DNA, 25 bp, Mus musculus
aacattaggtgtttctgcatggtcc

SEQ ID NO: 1338 - DNA, 25 bp, Mus musculus
aacattccttgcttgccctttggct

SEQ ID NO: 1339 - DNA, 25 bp, Mus musculus
aacattgagtcccttatggatccca

SEQ ID NO: 1340 - DNA, 25 bp, Mus musculus
aacattgagtccgttatggatccca

SEQ ID NO: 1341 - DNA, 25 bp, Mus musculus
aacattgccaatgcaaggacctact

SEQ ID NO: 1342 - DNA, 25 bp, Mus musculus
aacattgtccttagaacctggagca

SEQ ID NO: 1343 - DNA, 25 bp, Mus musculus
aacattgtggcaccgtataagatag

SEQ ID NO: 1344 - DNA, 25 bp, Mus musculus
aacatttccccacaagaactgagag

SEQ ID NO: 1345 - DNA, 25 bp, Mus musculus
aacatttgacacacaaaggcaggaa

SEQ ID NO: 1346 - DNA, 25 bp, Mus musculus
aacattttacagtcaccggcctgca

SEQ ID NO: 1347 - DNA, 25 bp, Mus musculus
aacattttctctctaggtgaagccg

SEQ ID NO: 1348 - DNA, 25 bp, Mus musculus
aaccaaaagagaagacgtcttcaag

SEQ ID NO: 1349 - DNA, 25 bp, Mus musculus
aaccaaatatggatcagaacagcag

SEQ ID NO: 1350 - DNA, 25 bp, Mus musculus
aaccaacatgtcagagtgggagtcc

SEQ ID NO: 1351 - DNA, 25 bp, Mus musculus
aaccaacgcagacatggccatccag

SEQ ID NO: 1352 - DNA, 25 bp, Mus musculus
aaccaactgtgagagcggagctgat

SEQ ID NO: 1353 - DNA, 25 bp, Mus musculus
aaccaactgtgtttgacttggagaa

SEQ ID NO: 1354 - DNA, 25 bp, Mus musculus
aaccaagaattgtcaccagtgaaga

SEQ ID NO: 1355 - DNA, 25 bp, Mus musculus
aaccaagagttgtctcttcaggagg

SEQ ID NO: 1356 - DNA, 25 bp, Mus musculus
aaccaagggccaggaagtacaaatg

SEQ ID NO: 1357 - DNA, 25 bp, Mus musculus
aaccaatctcttccggagtcccaga

SEQ ID NO: 1358 - DNA, 25 bp, Mus musculus
aaccacacaatgcaagtggaaatag

SEQ ID NO: 1359 - DNA, 25 bp, Mus musculus
aaccacacaatggaagtggaaatag

SEQ ID NO: 1360 - DNA, 25 bp, Mus musculus
aaccacacggctgacaatggcgtgg

SEQ ID NO: 1361 - DNA, 25 bp, Mus musculus
aaccacactgaccaccggtggtggg

SEQ ID NO: 1362 - DNA, 25 bp, Mus musculus
aaccaccacatgttcgtgctggagc

SEQ ID NO: 1363 - DNA, 25 bp, Mus musculus
aaccaccactgagtccgtggaggag

SEQ ID NO: 1364 - DNA, 25 bp, Mus musculus
aaccacccagattggctgcttgttg

SEQ ID NO: 1365 - DNA, 25 bp, Mus musculus
aaccaccgttatccataacccagtg

SEQ ID NO: 1366 - DNA, 25 bp, Mus musculus
aaccacctcgaaggcagggaggctg

SEQ ID NO: 1367 - DNA, 25 bp, Mus musculus
aaccacgaaatgactaatcaggagt

SEQ ID NO: 1368 - DNA, 25 bp, Mus musculus
aaccacgaggatcctaagacgcatc

SEQ ID NO: 1369 - DNA, 25 bp, Mus musculus
aaccacgtcaaccttgtgcaccgaa

SEQ ID NO: 1370 - DNA, 25 bp, Mus musculus
aaccactctatgctaaccggtgcca

SEQ ID NO: 1371 - DNA, 25 bp, Mus musculus
aaccagaagctacggctctctccta

SEQ ID NO: 1372 - DNA, 25 bp, Mus musculus
aaccagacagtaacagcggccaaat

SEQ ID NO: 1373 - DNA, 25 bp, Mus musculus
aaccagactggcctgtttcctgcca

SEQ ID NO: 1374 - DNA, 25 bp, Mus musculus
aaccagactggcgtgtttcctgcca

SEQ ID NO: 1375 - DNA, 25 bp, Mus musculus
aaccagagctgcgagtggtgccaga

SEQ ID NO: 1376 - DNA, 25 bp, Mus musculus
aaccagagtttgttctcttgtcaca

SEQ ID NO: 1377 - DNA, 25 bp, Mus musculus
aaccagataaacctgcaagtcccaa

SEQ ID NO: 1378 - DNA, 25 bp, Mus musculus
aaccagatgtggactgcctagaacc

SEQ ID NO: 1379 - DNA, 25 bp, Mus musculus
aaccagatttctcatcagccgaaag

SEQ ID NO: 1380 - DNA, 25 bp, Mus musculus
aaccagcaataacttacagagctat

SEQ ID NO: 1381 - DNA, 25 bp, Mus musculus
aaccagcaggcttgtgcagtcccag

SEQ ID NO: 1382 - DNA, 25 bp, Mus musculus
aaccagcattttgacggttttgtgg

SEQ ID NO: 1383 - DNA, 25 bp, Mus musculus
aaccagcgggccacacgcggtttgt

SEQ ID NO: 1384 - DNA, 25 bp, Mus musculus
aaccagctgctgattcacgcggcca

SEQ ID NO: 1385 - DNA, 25 bp, Mus musculus
aaccagctgtaaagttacatctgcc

SEQ ID NO: 1386 - DNA, 25 bp, Mus musculus
aaccagcttcagcagataatgcgtc

SEQ ID NO: 1387 - DNA, 25 bp, Mus musculus
aaccagggtcttcagtgggtgccca

SEQ ID NO: 1388 - DNA, 25 bp, Mus musculus
aaccaggtggcagaaaaggtggcct

SEQ ID NO: 1389 - DNA, 25 bp, Mus musculus
aaccagtcgctatgcagtgatgtcc

SEQ ID NO: 1390 - DNA, 25 bp, Mus musculus
aaccagtgaggaccccgaagttgag

SEQ ID NO: 1391 - DNA, 25 bp, Mus musculus
aaccagtgttccctactacgtcgag

SEQ ID NO: 1392 - DNA, 25 bp, Mus musculus
aaccatatttttgagtccccagtca

SEQ ID NO: 1393 - DNA, 25 bp, Mus musculus
aaccatcaagcgagggcctggatct

SEQ ID NO: 1394 - DNA, 25 bp, Mus musculus
aaccatcacatatgagtctccacag

SEQ ID NO: 1395 - DNA, 25 bp, Mus musculus
aaccatcatggcagtggagtttgac

SEQ ID NO: 1396 - DNA, 25 bp, Mus musculus
aaccatccgagtatggctgaaaaga

SEQ ID NO: 1397 - DNA, 25 bp, Mus musculus
aaccatccttgctacagcctagaac

SEQ ID NO: 1398 - DNA, 25 bp, Mus musculus
aaccatcttctttatggtaaccgag

SEQ ID NO: 1399 - DNA, 25 bp, Mus musculus
aaccatcttgcatctttgcccattg

SEQ ID NO: 1400 - DNA, 25 bp, Mus musculus
aaccatgatcaatgttggctctggc

SEQ ID NO: 1401 - DNA, 25 bp, Mus musculus
aaccatgcacacaaggtggccaagt

SEQ ID NO: 1402 - DNA, 25 bp, Mus musculus
aaccatggaccaagccctcaagtcg

SEQ ID NO: 1403 - DNA, 25 bp, Mus musculus
aaccatggcgtctggagatgacagt

SEQ ID NO: 1404 - DNA, 25 bp, Mus musculus
aaccattgtttattgggtcacatac

SEQ ID NO: 1405 - DNA, 25 bp, Mus musculus
aaccatttggcgctgagctatgaca

SEQ ID NO: 1406 - DNA, 25 bp, Mus musculus
aacccaagaagatggccagtctcgg

SEQ ID NO: 1407 - DNA, 25 bp, Mus musculus
aacccaagagatcttcctgaccacg

SEQ ID NO: 1408 - DNA, 25 bp, Mus musculus
aacccaagagatgaagggtctcctc

SEQ ID NO: 1409 - DNA, 25 bp, Mus musculus
aacccacacatgaggaggacctcac

SEQ ID NO: 1410 - DNA, 25 bp, Mus musculus
aacccactgatgagctaaccaagga

SEQ ID NO: 1411 - DNA, 25 bp, Mus musculus
aacccagaagactggcgcattgact

SEQ ID NO: 1412 - DNA, 25 bp, Mus musculus
aacccagcatgtacctgttaccaag

SEQ ID NO: 1413 - DNA, 25 bp, Mus musculus
aacccagcgctctgacctaaagtgc

SEQ ID NO: 1414 - DNA, 25 bp, Mus musculus
aacccagcggcccaagaacctgatg

SEQ ID NO: 1415 - DNA, 25 bp, Mus musculus
aacccagtgtccagcaagaattgcc

SEQ ID NO: 1416 - DNA, 25 bp, Mus musculus
aacccagtgtcctgcaagaattgcc

SEQ ID NO: 1417 - DNA, 25 bp, Mus musculus
aacccatgtcttcttgttgatgcaa

SEQ ID NO: 1418 - DNA, 25 bp, Mus musculus
aaccccaaaggtactgcggcattgc

SEQ ID NO: 1419 - DNA, 25 bp, Mus musculus
aaccccaccgtgaccttcagtgaga

SEQ ID NO: 1420 - DNA, 25 bp, Mus musculus
aaccccagacagacctttggagcta

SEQ ID NO: 1421 - DNA, 25 bp, Mus musculus
aaccccagagcccagaaattcacgt

SEQ ID NO: 1422 - DNA, 25 bp, Mus musculus
aaccccagaggaaagcatcggcttg

SEQ ID NO: 1423 - DNA, 25 bp, Mus musculus
aaccccagcgtcctgaaggactcag

SEQ ID NO: 1424 - DNA, 25 bp, Mus musculus
aaccccattggcctgtactcagcag

SEQ ID NO: 1425 - DNA, 25 bp, Mus musculus
aaccccctgggcaacagatgcgaag

SEQ ID NO: 1426 - DNA, 25 bp, Mus musculus
aaccccctgggctacagatgcgaag

SEQ ID NO: 1427 - DNA, 25 bp, Mus musculus
aaccccggcgaatggaggagtcact

SEQ ID NO: 1428 - DNA, 25 bp, Mus musculus
aacccctgcagtttggtagtgccag

SEQ ID NO: 1429 - DNA, 25 bp, Mus musculus
aacccctggtagtcagctctctact

SEQ ID NO: 1430 - DNA, 25 bp, Mus musculus
aacccctgtctacccagaatggatc

SEQ ID NO: 1431 - DNA, 25 bp, Mus musculus
aacccctttctctaagctgaaggtg

SEQ ID NO: 1432 - DNA, 25 bp, Mus musculus
aacccctttctgctgtatcagcttc

SEQ ID NO: 1433 - DNA, 25 bp, Mus musculus
aacccctttctggtgtatcagcttc

SEQ ID NO: 1434 - DNA, 25 bp, Mus musculus
aacccgactaatggcagtagctcag

SEQ ID NO: 1435 - DNA, 25 bp, Mus musculus
aacccggaggagaactaatgcttgg

SEQ ID NO: 1436 - DNA, 25 bp, Mus musculus
aacccggatgatggagatatttttt

SEQ ID NO: 1437 - DNA, 25 bp, Mus musculus
aacccgtcatggtccaccaggaaca

SEQ ID NO: 1438 - DNA, 25 bp, Mus musculus
aacccgttgatgacacatgctggcc

SEQ ID NO: 1439 - DNA, 25 bp, Mus musculus
aaccctccaagctggaatgggcgca

SEQ ID NO: 1440 - DNA, 25 bp, Mus musculus
aaccctccttgttactgcagacaga

SEQ ID NO: 1441 - DNA, 25 bp, Mus musculus
aaccctctgagaggagtcttaagag

SEQ ID NO: 1442 - DNA, 25 bp, Mus musculus
aaccctctggatggttcagtgctga

SEQ ID NO: 1443 - DNA, 25 bp, Mus musculus
aaccctcttgcctcaaagctgtgcg

SEQ ID NO: 1444 - DNA, 25 bp, Mus musculus
aaccctgtctgacactgcagctgca

SEQ ID NO: 1445 - DNA, 25 bp, Mus musculus
aaccctgtctgagattgttcccgag

SEQ ID NO: 1446 - DNA, 25 bp, Mus musculus
aaccctgtctgccagacaatgctgt

SEQ ID NO: 1447 - DNA, 25 bp, Mus musculus
aaccctgtgatcgtgcctggtcaga

SEQ ID NO: 1448 - DNA, 25 bp, Mus musculus
aacccttaaagaatgcagcagctta

SEQ ID NO: 1449 - DNA, 25 bp, Mus musculus
aacccttcgctgacctgattggtta

SEQ ID NO: 1450 - DNA, 25 bp, Mus musculus
aacccttggagacagaatacccagc

SEQ ID NO: 1451 - DNA, 25 bp, Mus musculus
aaccgacactgtgaatccagtggca

SEQ ID NO: 1452 - DNA, 25 bp, Mus musculus
aaccgacctggactgcatttttgga

SEQ ID NO: 1453 - DNA, 25 bp, Mus musculus
aaccgactcatcatgaactacctag

SEQ ID NO: 1454 - DNA, 25 bp, Mus musculus
aaccgagccatgagagaactggaca

SEQ ID NO: 1455 - DNA, 25 bp, Mus musculus
aaccgagctctctgttttcttcgta

SEQ ID NO: 1456 - DNA, 25 bp, Mus musculus
aaccgcagcgtgtcagaccagttct

SEQ ID NO: 1457 - DNA, 25 bp, Mus musculus
aaccgcgtagccatccggtggcgca

SEQ ID NO: 1458 - DNA, 25 bp, Mus musculus
aaccgcgtgtgccacctgctgaagg

SEQ ID NO: 1459 - DNA, 25 bp, Mus musculus
aaccgcgtgtgcgacctgctgaagg

SEQ ID NO: 1460 - DNA, 25 bp, Mus musculus
aaccgctatggctctcgccctgttt

SEQ ID NO: 1461 - DNA, 25 bp, Mus musculus
aaccgctgctactgacactatgttt

SEQ ID NO: 1462 - DNA, 25 bp, Mus musculus
aaccgcttcatttggcaacattctg

SEQ ID NO: 1463 - DNA, 25 bp, Mus musculus
aaccggagtggtgaagaggcatcta

SEQ ID NO: 1464 - DNA, 25 bp, Mus musculus
aaccggcacggcagcttgcctgtgc

SEQ ID NO: 1465 - DNA, 25 bp, Mus musculus
aaccggctctgaaatcaggctcagc

SEQ ID NO: 1466 - DNA, 25 bp, Mus musculus
aaccggcttgattcggtggaatctg

SEQ ID NO: 1467 - DNA, 25 bp, Mus musculus
aaccgggaagactttgccaaagcag

SEQ ID NO: 1468 - DNA, 25 bp, Mus musculus
aaccgggaggcctgaattagagagc

SEQ ID NO: 1469 - DNA, 25 bp, Mus musculus
aacctaagcttccaggtatccagcc

SEQ ID NO: 1470 - DNA, 25 bp, Mus musculus
aacctagccagctatgatgtctgca

SEQ ID NO: 1471 - DNA, 25 bp, Mus musculus
aacctaggctatgccaaaggccgga

SEQ ID NO: 1472 - DNA, 25 bp, Mus musculus
aacctcaagaagtggagtttctcca

SEQ ID NO: 1473 - DNA, 25 bp, Mus musculus
aacctcaaggccctcaggaccattg

SEQ ID NO: 1474 - DNA, 25 bp, Mus musculus
aacctcaaggccgtcaggaccattg

SEQ ID NO: 1475 - DNA, 25 bp, Mus musculus
aacctcacgggtctccctggtacag

SEQ ID NO: 1476 - DNA, 25 bp, Mus musculus
aacctcagaggttgcggaaggagac

SEQ ID NO: 1477 - DNA, 25 bp, Mus musculus
aacctcaggactttgatgtggctaa

SEQ ID NO: 1478 - DNA, 25 bp, Mus musculus
aacctcatcgtctggcacgtgcgga

SEQ ID NO: 1479 - DNA, 25 bp, Mus musculus
aacctccaggtctgcgtgggcagtc

SEQ ID NO: 1480 - DNA, 25 bp, Mus musculus
aacctccccagatgggtcgtcagca

SEQ ID NO: 1481 - DNA, 25 bp, Mus musculus
aacctcctctaccagttcagaatga

SEQ ID NO: 1482 - DNA, 25 bp, Mus musculus
aacctcggccgggttgagcaagtct

SEQ ID NO: 1483 - DNA, 25 bp, Mus musculus
aacctctgttttgggctgggctgag

SEQ ID NO: 1484 - DNA, 25 bp, Mus musculus
aacctcttacatatggcagggatcg

SEQ ID NO: 1485 - DNA, 25 bp, Mus musculus
aacctgaatcagctgggccgcccat

SEQ ID NO: 1486 - DNA, 25 bp, Mus musculus
aacctgacgcccagagtttgagtcc

SEQ ID NO: 1487 - DNA, 25 bp, Mus musculus
aacctgagctttaattgtgccaaca

SEQ ID NO: 1488 - DNA, 25 bp, Mus musculus
aacctgaggacccacggaagtgaca

SEQ ID NO: 1489 - DNA, 25 bp, Mus musculus
aacctgaggaccgacggaagtgaca

SEQ ID NO: 1490 - DNA, 25 bp, Mus musculus
aacctgagttcaagctctggaaccc

SEQ ID NO: 1491 - DNA, 25 bp, Mus musculus
aacctgatctacttcctcatgggca

SEQ ID NO: 1492 - DNA, 25 bp, Mus musculus
aacctgatgggcaacgccatggtga

SEQ ID NO: 1493 - DNA, 25 bp, Mus musculus
aacctgatgtgatgtctcctgctgg

SEQ ID NO: 1494 - DNA, 25 bp, Mus musculus
aacctgcagggccaggttcccggca

SEQ ID NO: 1495 - DNA, 25 bp, Mus musculus
aacctgcagggcgaggttcccggca

SEQ ID NO: 1496 - DNA, 25 bp, Mus musculus
aacctgcctcttcttggtggcgtgt

SEQ ID NO: 1497 - DNA, 25 bp, Mus musculus
aacctgctatacattgaacccggtg

SEQ ID NO: 1498 - DNA, 25 bp, Mus musculus
aacctgctgatagagcctgctcgca

SEQ ID NO: 1499 - DNA, 25 bp, Mus musculus
aacctgctgccccactttgtggatg

SEQ ID NO: 1500 - DNA, 25 bp, Mus musculus
aacctgctgcggagcaattctagga

SEQ ID NO: 1501 - DNA, 25 bp, Mus musculus
aacctgctgggtcccgcctgcattt

SEQ ID NO: 1502 - DNA, 25 bp, Mus musculus
aacctggagaatgaagtctgtgagg

SEQ ID NO: 1503 - DNA, 25 bp, Mus musculus
aacctggcagtgttaaaactgaacg

SEQ ID NO: 1504 - DNA, 25 bp, Mus musculus
aacctggcccagaaccaaatgtaca

SEQ ID NO: 1505 - DNA, 25 bp, Mus musculus
aacctggctggagagaatatcctca

SEQ ID NO: 1506 - DNA, 25 bp, Mus musculus
aacctgggtcttccgcaggattgcg

SEQ ID NO: 1507 - DNA, 25 bp, Mus musculus
aacctgggtgctgcagccccagaaa

SEQ ID NO: 1508 - DNA, 25 bp, Mus musculus
aacctgtctgaggaagtggcccggc

SEQ ID NO: 1509 - DNA, 25 bp, Mus musculus
aacctgtgcgcctgggtactgggat

SEQ ID NO: 1510 - DNA, 25 bp, Mus musculus
aacctgtgttattgtcagttgggaa

SEQ ID NO: 1511 - DNA, 25 bp, Mus musculus
aaccttacaaccagagccagtacag

SEQ ID NO: 1512 - DNA, 25 bp, Mus musculus
aaccttacagcactcgcccgtggga

SEQ ID NO: 1513 - DNA, 25 bp, Mus musculus
aaccttacggttgtggcattgaatg

SEQ ID NO: 1514 - DNA, 25 bp, Mus musculus
aaccttatagacagcctcacagaca

SEQ ID NO: 1515 - DNA, 25 bp, Mus musculus
aaccttcatccctggactgcaatga

SEQ ID NO: 1516 - DNA, 25 bp, Mus musculus
aaccttctcccgatcctggatctga

SEQ ID NO: 1517 - DNA, 25 bp, Mus musculus
aaccttctctgacaagttgtgagag

SEQ ID NO: 1518 - DNA, 25 bp, Mus musculus
aaccttctgaatcttgatgttatca

SEQ ID NO: 1519 - DNA, 25 bp, Mus musculus
aaccttgagtatggtggacctgggc

SEQ ID NO: 1520 - DNA, 25 bp, Mus musculus
aaccttgctcagaagcttccaaacc

SEQ ID NO: 1521 - DNA, 25 bp, Mus musculus
aaccttgggctctctggcgtgaaca

SEQ ID NO: 1522 - DNA, 25 bp, Mus musculus
aaccttggtgctgccgtgtctccta

SEQ ID NO: 1523 - DNA, 25 bp, Mus musculus
aacctttgagcagccagggcggcag

SEQ ID NO: 1524 - DNA, 25 bp, Mus musculus
aacctttggaattcctgcttgtgag

SEQ ID NO: 1525 - DNA, 25 bp, Mus musculus
aacctttggtgtacatgaggaaagc

SEQ ID NO: 1526 - DNA, 25 bp, Mus musculus
aacgaaccaccagatctgcttcggg

SEQ ID NO: 1527 - DNA, 25 bp, Mus musculus
aacgaagagctctagaaagaagaat

SEQ ID NO: 1528 - DNA, 25 bp, Mus musculus
aacgaagatggcactgcctgtgaag

SEQ ID NO: 1529 - DNA, 25 bp, Mus musculus
aacgaagatggctctgcctgtgaag

SEQ ID NO: 1530 - DNA, 25 bp, Mus musculus
aacgaatgatctcctcatatgtggg

SEQ ID NO: 1531 - DNA, 25 bp, Mus musculus
aacgacacaaggctgataatgctgt

SEQ ID NO: 1532 - DNA, 25 bp, Mus musculus
aacgacatcatggtgtccctgggcc

SEQ ID NO: 1533 - DNA, 25 bp, Mus musculus
aacgacatgtggacaattggcctcc

SEQ ID NO: 1534 - DNA, 25 bp, Mus musculus
aacgacccagccagtgaagcaggag

SEQ ID NO: 1535 - DNA, 25 bp, Mus musculus
aacgacgtagccattgtgaaggagg

SEQ ID NO: 1536 - DNA, 25 bp, Mus musculus
aacgagaaagctcacagtgccggtg

SEQ ID NO: 1537 - DNA, 25 bp, Mus musculus
aacgagaaagctgacagtgccggtg

SEQ ID NO: 1538 - DNA, 25 bp, Mus musculus
aacgagaccgtgtgcagaagaaaac

SEQ ID NO: 1539 - DNA, 25 bp, Mus musculus
aacgagagaagcatttccagaaaga

SEQ ID NO: 1540 - DNA, 25 bp, Mus musculus
aacgagccaccaagcggaagctgcc

SEQ ID NO: 1541 - DNA, 25 bp, Mus musculus
aacgagcgacataagccagagcatc

SEQ ID NO: 1542 - DNA, 25 bp, Mus musculus
aacgagcgacattagccagagcatc

SEQ ID NO: 1543 - DNA, 25 bp, Mus musculus
aacgaggcatcgatccgactgtaca

SEQ ID NO: 1544 - DNA, 25 bp, Mus musculus
aacgaggcatcgttccgactgtaca

SEQ ID NO: 1545 - DNA, 25 bp, Mus musculus
aacgaggtgcacaccatgctgggcc

SEQ ID NO: 1546 - DNA, 25 bp, Mus musculus
aacgatagcatttttcaagatgtaa

SEQ ID NO: 1547 - DNA, 25 bp, Mus musculus
aacgatgaccagtcctttcatgctg

SEQ ID NO: 1548 - DNA, 25 bp, Mus musculus
aacgatgatcaattttatgggtgca

SEQ ID NO: 1549 - DNA, 25 bp, Mus musculus
aacgatgtcagcgaggaggccttga

SEQ ID NO: 1550 - DNA, 25 bp, Mus musculus
aacgcaacgaggagcttcggaggca

SEQ ID NO: 1551 - DNA, 25 bp, Mus musculus
aacgcaatacaagtttggccacacc

SEQ ID NO: 1552 - DNA, 25 bp, Mus musculus
aacgcagcaacggttatgcgggagc

SEQ ID NO: 1553 - DNA, 25 bp, Mus musculus
aacgcatgcgttaactctccagagg

SEQ ID NO: 1554 - DNA, 25 bp, Mus musculus
aacgccaagattcagacagaaaaaa

SEQ ID NO: 1555 - DNA, 25 bp, Mus musculus
aacgcccaggtacctttggctctca

SEQ ID NO: 1556 - DNA, 25 bp, Mus musculus
aacgcccttttcgactacgcagtga

SEQ ID NO: 1557 - DNA, 25 bp, Mus musculus
aacgccgggcacaactgaaactgat

SEQ ID NO: 1558 - DNA, 25 bp, Mus musculus
aacgcctatcagtacatgctgacag

SEQ ID NO: 1559 - DNA, 25 bp, Mus musculus
aacgcctcgatgctgctacagggat

SEQ ID NO: 1560 - DNA, 25 bp, Mus musculus
aacgccttcataccaaaggatctac

SEQ ID NO: 1561 - DNA, 25 bp, Mus musculus
aacgccttcgtcagcactgccaaat

SEQ ID NO: 1562 - DNA, 25 bp, Mus musculus
aacgcgcaggccagatgggtccagc

SEQ ID NO: 1563 - DNA, 25 bp, Mus musculus
aacgctacaagaattccttggagac

SEQ ID NO: 1564 - DNA, 25 bp, Mus musculus
aacgctgaatagaagtggtgaacac

SEQ ID NO: 1565 - DNA, 25 bp, Mus musculus
aacgctgcagtaatgtcaatgtgac

SEQ ID NO: 1566 - DNA, 25 bp, Mus musculus
aacgctgctcagcacgtccgggctt

SEQ ID NO: 1567 - DNA, 25 bp, Mus musculus
aacgctgctcaggacgtccgggctt

SEQ ID NO: 1568 - DNA, 25 bp, Mus musculus
aacgctgtggagctggaactcgcca

SEQ ID NO: 1569 - DNA, 25 bp, Mus musculus
aacgctgttgctcagaagcaggcag

SEQ ID NO: 1570 - DNA, 25 bp, Mus musculus
aacgcttctgtacaccagttccctg

SEQ ID NO: 1571 - DNA, 25 bp, Mus musculus
aacgctttagcagttttggcttgga

SEQ ID NO: 1572 - DNA, 25 bp, Mus musculus
aacgctttgtgcagtggcagtcttc

SEQ ID NO: 1573 - DNA, 25 bp, Mus musculus
aacggaaactagaagcattgccacc

SEQ ID NO: 1574 - DNA, 25 bp, Mus musculus
aacggaacttgaagcgtctcaaaga

SEQ ID NO: 1575 - DNA, 25 bp, Mus musculus
aacggaacttggacttctggcgcca

SEQ ID NO: 1576 - DNA, 25 bp, Mus musculus
aacggaagtggaagtgccagcagaa

SEQ ID NO: 1577 - DNA, 25 bp, Mus musculus
aacggaagtgtcttcagtggcatcc

SEQ ID NO: 1578 - DNA, 25 bp, Mus musculus
aacggacacacaggccagctttcag

SEQ ID NO: 1579 - DNA, 25 bp, Mus musculus
aacggactcacacctcttctgattg

SEQ ID NO: 1580 - DNA, 25 bp, Mus musculus
aacggagggcgcctcatgcgttcct

SEQ ID NO: 1581 - DNA, 25 bp, Mus musculus
aacggatagcttgcgatgaagagtt

SEQ ID NO: 1582 - DNA, 25 bp, Mus musculus
aacggatgcaaaacgtctgcatggc

SEQ ID NO: 1583 - DNA, 25 bp, Mus musculus
aacggattctaacggaagacactga

SEQ ID NO: 1584 - DNA, 25 bp, Mus musculus
aacggccacctgcactcctatgaga

SEQ ID NO: 1585 - DNA, 25 bp, Mus musculus
aacggccacctggactcctatgaga

SEQ ID NO: 1586 - DNA, 25 bp, Mus musculus
aacggccagtcttctcttgaggagg

SEQ ID NO: 1587 - DNA, 25 bp, Mus musculus
aacggcctccgtcaagatgctgcca

SEQ ID NO: 1588 - DNA, 25 bp, Mus musculus
aacggcgacctgtacatctgggatg

SEQ ID NO: 1589 - DNA, 25 bp, Mus musculus
aacggctgcagtacacctatgagga

SEQ ID NO: 1590 - DNA, 25 bp, Mus musculus
aacgggaaccggtatgagggcatct

SEQ ID NO: 1591 - DNA, 25 bp, Mus musculus
aacgggaccgtgcagctaacgacta

SEQ ID NO: 1592 - DNA, 25 bp, Mus musculus
aacgggagagagaagcaaaggataa

SEQ ID NO: 1593 - DNA, 25 bp, Mus musculus
aacgggagatctatgaccgctatgg

SEQ ID NO: 1594 - DNA, 25 bp, Mus musculus
aacgggcatgtttaaggaactctgg

SEQ ID NO: 1595 - DNA, 25 bp, Mus musculus
aacgggtccttcctaactgatagca

SEQ ID NO: 1596 - DNA, 25 bp, Mus musculus
aacgggtgatcaacgaggagtacaa

SEQ ID NO: 1597 - DNA, 25 bp, Mus musculus
aacggtgacgaacaacttgaagtca

SEQ ID NO: 1598 - DNA, 25 bp, Mus musculus
aacggtgagtgtctgaacacagaag

SEQ ID NO: 1599 - DNA, 25 bp, Mus musculus
aacggtgagtgtgtgaacacagaag

SEQ ID NO: 1600 - DNA, 25 bp, Mus musculus
aacggtggcacctgcttgacgggcc

SEQ ID NO: 1601 - DNA, 25 bp, Mus musculus
aacggtgtggacctcctaatgaagt

SEQ ID NO: 1602 - DNA, 25 bp, Mus musculus
aacggttcatctgggagtacgatcc

SEQ ID NO: 1603 - DNA, 25 bp, Mus musculus
aacgtatttctgctttacatttaag

SEQ ID NO: 1604 - DNA, 25 bp, Mus musculus
aacgtcaacgtccagaacttccata

SEQ ID NO: 1605 - DNA, 25 bp, Mus musculus
aacgtctagattccgactggtaccg

SEQ ID NO: 1606 - DNA, 25 bp, Mus musculus
aacgtctagattgcgactggtaccg

SEQ ID NO: 1607 - DNA, 25 bp, Mus musculus
aacgtctgctgttcaagggcaaggc

SEQ ID NO: 1608 - DNA, 25 bp, Mus musculus
aacgtgaccccacctcctatagagg

SEQ ID NO: 1609 - DNA, 25 bp, Mus musculus
aacgtgaccctccaagtggccaatg

SEQ ID NO: 1610 - DNA, 25 bp, Mus musculus
aacgtgatcgcgtccctcctctatg

SEQ ID NO: 1611 - DNA, 25 bp, Mus musculus
aacgtgccaatagaagcattcacca

SEQ ID NO: 1612 - DNA, 25 bp, Mus musculus
aacgtgcccagaagcagatgtttcg

SEQ ID NO: 1613 - DNA, 25 bp, Mus musculus
aacgtgcctgtcattggcggccacg

SEQ ID NO: 1614 - DNA, 25 bp, Mus musculus
aacgtgctcttcttatgcgaccctg

SEQ ID NO: 1615 - DNA, 25 bp, Mus musculus
aacgtggcattcctacccctcagag

SEQ ID NO: 1616 - DNA, 25 bp, Mus musculus
aacgtggtccacaccgtcaacactg

SEQ ID NO: 1617 - DNA, 25 bp, Mus musculus
aacgtgtctgtgttcctggctccca

SEQ ID NO: 1618 - DNA, 25 bp, Mus musculus
aacgtgtgaaattgcttaaggaact

SEQ ID NO: 1619 - DNA, 25 bp, Mus musculus
aacgtgttggtaacagaaaacaatg

SEQ ID NO: 1620 - DNA, 25 bp, Mus musculus
aacgtgtttctgcacctgctgccgg

SEQ ID NO: 1621 - DNA, 25 bp, Mus musculus
aacgttctttcagccagacgacgaa

SEQ ID NO: 1622 - DNA, 25 bp, Mus musculus
aacgtttattcatcccagatagggc

SEQ ID NO: 1623 - DNA, 25 bp, Mus musculus
aacgttttacgggtgctgtgccgtg

SEQ ID NO: 1624 - DNA, 25 bp, Mus musculus
aactaaaaggattcaaggccagcag

SEQ ID NO: 1625 - DNA, 25 bp, Mus musculus
aactaaatggacttgctgtcaaact

SEQ ID NO: 1626 - DNA, 25 bp, Mus musculus
aactaacgaagcagatgaacgccat

SEQ ID NO: 1627 - DNA, 25 bp, Mus musculus
aactaagtggtaaagggctgctgct

SEQ ID NO: 1628 - DNA, 25 bp, Mus musculus
aactacagacggagataaagatcac

SEQ ID NO: 1629 - DNA, 25 bp, Mus musculus
aactaccacaatgtggcctcgctag

SEQ ID NO: 1630 - DNA, 25 bp, Mus musculus
aactaccagaacacctcaactgatg

SEQ ID NO: 1631 - DNA, 25 bp, Mus musculus
aactaccgcacacattgttgtcaag

SEQ ID NO: 1632 - DNA, 25 bp, Mus musculus
aactacgagacgttggtgtctgtgg

SEQ ID NO: 1633 - DNA, 25 bp, Mus musculus
aactacgtggcagcatttgtcctgg

SEQ ID NO: 1634 - DNA, 25 bp, Mus musculus
aactactacaacctggatggagaat

SEQ ID NO: 1635 - DNA, 25 bp, Mus musculus
aactactttgagagctacctggcag

SEQ ID NO: 1636 - DNA, 25 bp, Mus musculus
aactagaacgatccctggttgaagg

SEQ ID NO: 1637 - DNA, 25 bp, Mus musculus
aactagatgatcagaccaagcccgg

SEQ ID NO: 1638 - DNA, 25 bp, Mus musculus
aactagttacggtggcttcagagca

SEQ ID NO: 1639 - DNA, 25 bp, Mus musculus
aactatagagttagatgggaaaaca

SEQ ID NO: 1640 - DNA, 25 bp, Mus musculus
aactatccatcatggcacagacaca

SEQ ID NO: 1641 - DNA, 25 bp, Mus musculus
aactatcttcttgcatttggaagac

SEQ ID NO: 1642 - DNA, 25 bp, Mus musculus
aactatgccgagtggctacaggaat

SEQ ID NO: 1643 - DNA, 25 bp, Mus musculus
aactatggacagcaagatacagccc

SEQ ID NO: 1644 - DNA, 25 bp, Mus musculus
aactatggaggtgccggcccgtgcc

SEQ ID NO: 1645 - DNA, 25 bp, Mus musculus
aactatgggtttggatgtggtgatt

SEQ ID NO: 1646 - DNA, 25 bp, Mus musculus
aactattaccccaacagcttcagcg

SEQ ID NO: 1647 - DNA, 25 bp, Mus musculus
aactattccggaaggcctctgtctg

SEQ ID NO: 1648 - DNA, 25 bp, Mus musculus
aactatttccttagtcccagaacag

SEQ ID NO: 1649 - DNA, 25 bp, Mus musculus
aactattttggtatgctttagacca

SEQ ID NO: 1650 - DNA, 25 bp, Mus musculus
aactattttggtttgctttagacca

SEQ ID NO: 1651 - DNA, 25 bp, Mus musculus
aactcaaaaggatgagcaagtccgt

SEQ ID NO: 1652 - DNA, 25 bp, Mus musculus
aactcaacctaggacttctgcaaga

SEQ ID NO: 1653 - DNA, 25 bp, Mus musculus
aactcaagatgtctgccagggcgga

SEQ ID NO: 1654 - DNA, 25 bp, Mus musculus
aactcaaggcttatggatgaaggcc

SEQ ID NO: 1655 - DNA, 25 bp, Mus musculus
aactcaaggcttttggatgaaggcc

SEQ ID NO: 1656 - DNA, 25 bp, Mus musculus
aactcacggtttgccaaagtacaca

SEQ ID NO: 1657 - DNA, 25 bp, Mus musculus
aactcactcgagtcagtggccagga

SEQ ID NO: 1658 - DNA, 25 bp, Mus musculus
aactcacttcgtaggccagactgga

SEQ ID NO: 1659 - DNA, 25 bp, Mus musculus
aactcagaacagcttgcccatgtcc

SEQ ID NO: 1660 - DNA, 25 bp, Mus musculus
aactcagaaccacagaaaacggagg

SEQ ID NO: 1661 - DNA, 25 bp, Mus musculus
aactcagatcaaaacatactcttgg

SEQ ID NO: 1662 - DNA, 25 bp, Mus musculus
aactcagattgcagagagctggact

SEQ ID NO: 1663 - DNA, 25 bp, Mus musculus
aactcagcattcctaaagttagctg

SEQ ID NO: 1664 - DNA, 25 bp, Mus musculus
aactcagcatttagaccgggttgtc

SEQ ID NO: 1665 - DNA, 25 bp, Mus musculus
aactcagccaccttcaagtcatttg

SEQ ID NO: 1666 - DNA, 25 bp, Mus musculus
aactcagcctccagcgaggagctct

SEQ ID NO: 1667 - DNA, 25 bp, Mus musculus
aactcagcgagatcaccctgcctgt

SEQ ID NO: 1668 - DNA, 25 bp, Mus musculus
aactcaggaatctgctcaactgctg

SEQ ID NO: 1669 - DNA, 25 bp, Mus musculus
aactcagggcggtgtccatgtacac

SEQ ID NO: 1670 - DNA, 25 bp, Mus musculus
aactcatcctggcttctgtgctggg

SEQ ID NO: 1671 - DNA, 25 bp, Mus musculus
aactcattgagttgcgcgtgcggcc

SEQ ID NO: 1672 - DNA, 25 bp, Mus musculus
aactccacggacaatgaatgtctat

SEQ ID NO: 1673 - DNA, 25 bp, Mus musculus
aactccagaacagattatgcaagaa

SEQ ID NO: 1674 - DNA, 25 bp, Mus musculus
aactccagcgtggtgaggaaccctg

SEQ ID NO: 1675 - DNA, 25 bp, Mus musculus
aactccatgcagttcggaaccagaa

SEQ ID NO: 1676 - DNA, 25 bp, Mus musculus
aactcccagcttccagtagatcaca

SEQ ID NO: 1677 - DNA, 25 bp, Mus musculus
aactcccgtgtgtgcattcgaatgg

SEQ ID NO: 1678 - DNA, 25 bp, Mus musculus
aactccctgaccattttgggccagc

SEQ ID NO: 1679 - DNA, 25 bp, Mus musculus
aactccgcctggcaaatctatctgc

SEQ ID NO: 1680 - DNA, 25 bp, Mus musculus
aactccggcagcacgtcatggtaga

SEQ ID NO: 1681 - DNA, 25 bp, Mus musculus
aactccggctccactggaggaggcc

SEQ ID NO: 1682 - DNA, 25 bp, Mus musculus
aactcctagcctcagctctgttcaa

SEQ ID NO: 1683 - DNA, 25 bp, Mus musculus
aactcctggcctaacacgaagcgtg

SEQ ID NO: 1684 - DNA, 25 bp, Mus musculus
aactcctggccttacacgaagcgtg

SEQ ID NO: 1685 - DNA, 25 bp, Mus musculus
aactccttccaactgggctcacaag

SEQ ID NO: 1686 - DNA, 25 bp, Mus musculus
aactccttccaagtgggctcacaag

SEQ ID NO: 1687 - DNA, 25 bp, Mus musculus
aactcctttgtggtcaaggcttgcc

SEQ ID NO: 1688 - DNA, 25 bp, Mus musculus
aactccttttgaagcacggtgcatc

SEQ ID NO: 1689 - DNA, 25 bp, Mus musculus
aactccttttgaagttatgtgcgcc

SEQ ID NO: 1690 - DNA, 25 bp, Mus musculus
aactcgacactctcgtgctgctgtg

SEQ ID NO: 1691 - DNA, 25 bp, Mus musculus
aactcgactgtatatggatgacttc

SEQ ID NO: 1692 - DNA, 25 bp, Mus musculus
aactcgagaatttgaggatagagac

SEQ ID NO: 1693 - DNA, 25 bp, Mus musculus
aactcgcacttgcatcgctcttcag

SEQ ID NO: 1694 - DNA, 25 bp, Mus musculus
aactcgctgagtcgtaagaaataca

SEQ ID NO: 1695 - DNA, 25 bp, Mus musculus
aactcgctgagtggtaagaaataca

SEQ ID NO: 1696 - DNA, 25 bp, Mus musculus
aactcggccagagcccggaagcatg

SEQ ID NO: 1697 - DNA, 25 bp, Mus musculus
aactcgggatgcaggcttcactgtg

SEQ ID NO: 1698 - DNA, 25 bp, Mus musculus
aactcgggcctgcaactgctgggct

SEQ ID NO: 1699 - DNA, 25 bp, Mus musculus
aactcggttgtcacagacctgttag

SEQ ID NO: 1700 - DNA, 25 bp, Mus musculus
aactcgtttgctgtcacgtgcctgt

SEQ ID NO: 1701 - DNA, 25 bp, Mus musculus
aactctccagctagcttcagtggac

SEQ ID NO: 1702 - DNA, 25 bp, Mus musculus
aactctgaaagacacgaccattagg

SEQ ID NO: 1703 - DNA, 25 bp, Mus musculus
aactctgaagcatctgtggagcgac

SEQ ID NO: 1704 - DNA, 25 bp, Mus musculus
aactctgaaggcatgacggtttgag

SEQ ID NO: 1705 - DNA, 25 bp, Mus musculus
aactctgagaagtcgtcctcttcag

SEQ ID NO: 1706 - DNA, 25 bp, Mus musculus
aactctgagagcgtacgtggactta

SEQ ID NO: 1707 - DNA, 25 bp, Mus musculus
aactctgatgcctttatctaaaacc

SEQ ID NO: 1708 - DNA, 25 bp, Mus musculus
aactctgctccacagtgatcatggg

SEQ ID NO: 1709 - DNA, 25 bp, Mus musculus
aactctgctgtttgctgcatgctgc

SEQ ID NO: 1710 - DNA, 25 bp, Mus musculus
aactctggcctggagtaatatcgcc

SEQ ID NO: 1711 - DNA, 25 bp, Mus musculus
aactcttagcttccttcctctgctg

SEQ ID NO: 1712 - DNA, 25 bp, Mus musculus
aactcttcactcaatccgtccttgg

SEQ ID NO: 1713 - DNA, 25 bp, Mus musculus
aactctttatatatcagaagctggc

SEQ ID NO: 1714 - DNA, 25 bp, Mus musculus
aactctttcacaggctggacagaaa

SEQ ID NO: 1715 - DNA, 25 bp, Mus musculus
aactctttgcacaacggatggtaca

SEQ ID NO: 1716 - DNA, 25 bp, Mus musculus
aactctttgtaacaccgcctgaggg

SEQ ID NO: 1717 - DNA, 25 bp, Mus musculus
aactgaaactgatggatgaccttga

SEQ ID NO: 1718 - DNA, 25 bp, Mus musculus
aactgaaagctttgttgcgtcaaca

SEQ ID NO: 1719 - DNA, 25 bp, Mus musculus
aactgaacacaggaactgggtgcct

SEQ ID NO: 1720 - DNA, 25 bp, Mus musculus
aactgaactccagtctggaaacagc

SEQ ID NO: 1721 - DNA, 25 bp, Mus musculus
aactgaagaggcagcgagaggacac

SEQ ID NO: 1722 - DNA, 25 bp, Mus musculus
aactgaagattgcaggagccattgg

SEQ ID NO: 1723 - DNA, 25 bp, Mus musculus
aactgaagcggcaagaagaggaaca

SEQ ID NO: 1724 - DNA, 25 bp, Mus musculus
aactgaagttctaggcgcctgtgaa

SEQ ID NO: 1725 - DNA, 25 bp, Mus musculus
aactgaatatgagaggaacgggaga

SEQ ID NO: 1726 - DNA, 25 bp, Mus musculus
aactgaatccagaaagcctatgatg

SEQ ID NO: 1727 - DNA, 25 bp, Mus musculus
aactgacaaactcatgatggatggc

SEQ ID NO: 1728 - DNA, 25 bp, Mus musculus
aactgacctcagtacatgccgatct

SEQ ID NO: 1729 - DNA, 25 bp, Mus musculus
aactgacctgatttctgtactgtgg

SEQ ID NO: 1730 - DNA, 25 bp, Mus musculus
aactgacctggctctgaccttctct

SEQ ID NO: 1731 - DNA, 25 bp, Mus musculus
aactgactagttccctacctgatgt

SEQ ID NO: 1732 - DNA, 25 bp, Mus musculus
aactgactgattacagagggatccc

SEQ ID NO: 1733 - DNA, 25 bp, Mus musculus
aactgactgtatgggaccgggagcc

SEQ ID NO: 1734 - DNA, 25 bp, Mus musculus
aactgactgtggcttctggtcttgc

SEQ ID NO: 1735 - DNA, 25 bp, Mus musculus
aactgagactcagaatggtgaagta

SEQ ID NO: 1736 - DNA, 25 bp, Mus musculus
aactgagaggccaccgtggagctgc

SEQ ID NO: 1737 - DNA, 25 bp, Mus musculus
aactgagcgtgctctgcaaggctgt

SEQ ID NO: 1738 - DNA, 25 bp, Mus musculus
aactgcaaggaaaggaagtcggtgt

SEQ ID NO: 1739 - DNA, 25 bp, Mus musculus
aactgcaattttggagcaactcctt

SEQ ID NO: 1740 - DNA, 25 bp, Mus musculus
aactgcacgggccttgtctttcctg

SEQ ID NO: 1741 - DNA, 25 bp, Mus musculus
aactgcaggctatgaccacacggtg

SEQ ID NO: 1742 - DNA, 25 bp, Mus musculus
aactgcagtagctctgttgtcacac

SEQ ID NO: 1743 - DNA, 25 bp, Mus musculus
aactgcagtcgccttcgttgcttcc

SEQ ID NO: 1744 - DNA, 25 bp, Mus musculus
aactgcagtgctgaagagttggacc

SEQ ID NO: 1745 - DNA, 25 bp, Mus musculus
aactgcataaagagattggtcaact

SEQ ID NO: 1746 - DNA, 25 bp, Mus musculus
aactgcatccagttgaaaacctcgg

SEQ ID NO: 1747 - DNA, 25 bp, Mus musculus
aactgcatgagtgagttcatgggcc

SEQ ID NO: 1748 - DNA, 25 bp, Mus musculus
aactgcatttgcttaatcacggtag

SEQ ID NO: 1749 - DNA, 25 bp, Mus musculus
aactgccactgagatttctgctaag

SEQ ID NO: 1750 - DNA, 25 bp, Mus musculus
aactgccagtgtcctccgccgggag

SEQ ID NO: 1751 - DNA, 25 bp, Mus musculus
aactgccccacttgggtggaagtca

SEQ ID NO: 1752 - DNA, 25 bp, Mus musculus
aactgccccatccagaaagacaagg

SEQ ID NO: 1753 - DNA, 25 bp, Mus musculus
aactgccgtatggtgcacatgccag

SEQ ID NO: 1754 - DNA, 25 bp, Mus musculus
aactgccgttattacaatccccgtg

SEQ ID NO: 1755 - DNA, 25 bp, Mus musculus
aactgcctcgtcatgtatgtcatcc

SEQ ID NO: 1756 - DNA, 25 bp, Mus musculus
aactgccttctcctgtcaggccggg

SEQ ID NO: 1757 - DNA, 25 bp, Mus musculus
aactgcgaggccaaaccgaagctct

SEQ ID NO: 1758 - DNA, 25 bp, Mus musculus
aactgcggaggctccctggtggcca

SEQ ID NO: 1759 - DNA, 25 bp, Mus musculus
aactgcgtagatgcgtaccccactt

SEQ ID NO: 1760 - DNA, 25 bp, Mus musculus
aactgctcataaacgactttgggag

SEQ ID NO: 1761 - DNA, 25 bp, Mus musculus
aactgctggagcttgtgtctggcct

SEQ ID NO: 1762 - DNA, 25 bp, Mus musculus
aactgcttgacaaagtcagcattgt

SEQ ID NO: 1763 - DNA, 25 bp, Mus musculus
aactgctttgagctggtgggaatca

SEQ ID NO: 1764 - DNA, 25 bp, Mus musculus
aactggaaagtgacaaagagctcgc

SEQ ID NO: 1765 - DNA, 25 bp, Mus musculus
aactggaaattcagagaaagaagca

SEQ ID NO: 1766 - DNA, 25 bp, Mus musculus
aactggacaggcattcacacttctc

SEQ ID NO: 1767 - DNA, 25 bp, Mus musculus
aactggaccccgagaggatgggctc

SEQ ID NO: 1768 - DNA, 25 bp, Mus musculus
aactggaccccgtgaggatgggctc

SEQ ID NO: 1769 - DNA, 25 bp, Mus musculus
aactggactgcaatgccaagcagtg

SEQ ID NO: 1770 - DNA, 25 bp, Mus musculus
aactggagcagtgaccacactgaag

SEQ ID NO: 1771 - DNA, 25 bp, Mus musculus
aactggagcggatgactcagaagcc

SEQ ID NO: 1772 - DNA, 25 bp, Mus musculus
aactggaggagtgtcagcggaacca

SEQ ID NO: 1773 - DNA, 25 bp, Mus musculus
aactggcatgttgggccgtatcatc

SEQ ID NO: 1774 - DNA, 25 bp, Mus musculus
aactggctcacagtattggtattgc

SEQ ID NO: 1775 - DNA, 25 bp, Mus musculus
aactggctgctcaacgtatacgaca

SEQ ID NO: 1776 - DNA, 25 bp, Mus musculus
aactgggagagacatacaaggatca

SEQ ID NO: 1777 - DNA, 25 bp, Mus musculus
aactgggcatgctcacatagacgct

SEQ ID NO: 1778 - DNA, 25 bp, Mus musculus
aactgggccaagagttgcttgtcgc

SEQ ID NO: 1779 - DNA, 25 bp, Mus musculus
aactgggcccaggagctaggagtcc

SEQ ID NO: 1780 - DNA, 25 bp, Mus musculus
aactgggttaaaacaggcaccactg

SEQ ID NO: 1781 - DNA, 25 bp, Mus musculus
aactggtccacgatgtataattcct

SEQ ID NO: 1782 - DNA, 25 bp, Mus musculus
aactggtgcatgacatgagccaccc

SEQ ID NO: 1783 - DNA, 25 bp, Mus musculus
aactggtggatattgagctctcccc

SEQ ID NO: 1784 - DNA, 25 bp, Mus musculus
aactggtggatggtttcctagcctt

SEQ ID NO: 1785 - DNA, 25 bp, Mus musculus
aactggtggtcagtacttgaacctc

SEQ ID NO: 1786 - DNA, 25 bp, Mus musculus
aactggtgtgcctacgtggtgactc

SEQ ID NO: 1787 - DNA, 25 bp, Mus musculus
aactggttgcgctcctcaaggatga

SEQ ID NO: 1788 - DNA, 25 bp, Mus musculus
aactggttgctgaaagtcatctgtg

SEQ ID NO: 1789 - DNA, 25 bp, Mus musculus
aactgtagcctaccacgaggctggg

SEQ ID NO: 1790 - DNA, 25 bp, Mus musculus
aactgtcctcatttcaagagcccag

SEQ ID NO: 1791 - DNA, 25 bp, Mus musculus
aactgtcgggcctggaccctcgcag

SEQ ID NO: 1792 - DNA, 25 bp, Mus musculus
aactgtctgaccaccacttacgatg

SEQ ID NO: 1793 - DNA, 25 bp, Mus musculus
aactgtgaaaatttaggtctcaatg

SEQ ID NO: 1794 - DNA, 25 bp, Mus musculus
aactgtgacaaacggaagcgcatgc

SEQ ID NO: 1795 - DNA, 25 bp, Mus musculus
aactgtgacaatgcagtcctcagag

SEQ ID NO: 1796 - DNA, 25 bp, Mus musculus
aactgtgagactggaagactacacc

SEQ ID NO: 1797 - DNA, 25 bp, Mus musculus
aactgtgcacagttttgcccagcgc

SEQ ID NO: 1798 - DNA, 25 bp, Mus musculus
aactgtgcccagctaaccttgtaag

SEQ ID NO: 1799 - DNA, 25 bp, Mus musculus
aactgtgcggtcatgcacaacctgc

SEQ ID NO: 1800 - DNA, 25 bp, Mus musculus
aactgtgggaatgtatgatttgcca

SEQ ID NO: 1801 - DNA, 25 bp, Mus musculus
aactgtgggacaacgtggtgcctac

SEQ ID NO: 1802 - DNA, 25 bp, Mus musculus
aactgtgtttgacttggagaaggaa

SEQ ID NO: 1803 - DNA, 25 bp, Mus musculus
aactgttaaatttggtcctgagcgc

SEQ ID NO: 1804 - DNA, 25 bp, Mus musculus
aactgttagcaatgacgccgactgg

SEQ ID NO: 1805 - DNA, 25 bp, Mus musculus
aactgttccctgagtcagtcatcag

SEQ ID NO: 1806 - DNA, 25 bp, Mus musculus
aactgttccggcatcggcttctctg

SEQ ID NO: 1807 - DNA, 25 bp, Mus musculus
aactgtttgattctacaattgctga

SEQ ID NO: 1808 - DNA, 25 bp, Mus musculus
aactgtttggatggtgcaacggatt

SEQ ID NO: 1809 - DNA, 25 bp, Mus musculus
aacttaagcctgactttcctgatgc

SEQ ID NO: 1810 - DNA, 25 bp, Mus musculus
aacttactctgagtactaggctggc

SEQ ID NO: 1811 - DNA, 25 bp, Mus musculus
aacttagcatttatacgagggcagc

SEQ ID NO: 1812 - DNA, 25 bp, Mus musculus
aacttagctctccttttgtggtcca

SEQ ID NO: 1813 - DNA, 25 bp, Mus musculus
aacttatccaaacctgtggctggta

SEQ ID NO: 1814 - DNA, 25 bp, Mus musculus
aacttatccaaagctgtggctggta

SEQ ID NO: 1815 - DNA, 25 bp, Mus musculus
aacttatggaacgaattcagaatcc

SEQ ID NO: 1816 - DNA, 25 bp, Mus musculus
aacttcacccacatcatcgtggtca

SEQ ID NO: 1817 - DNA, 25 bp, Mus musculus
aacttcaccgcgattggaggcaacc

SEQ ID NO: 1818 - DNA, 25 bp, Mus musculus
aacttcagagccctatgcactggtg

SEQ ID NO: 1819 - DNA, 25 bp, Mus musculus
aacttcagatacgaaatatcccgcc

SEQ ID NO: 1820 - DNA, 25 bp, Mus musculus
aacttccatggtgaatacccagcca

SEQ ID NO: 1821 - DNA, 25 bp, Mus musculus
aacttcccaaagaactcctgttgag

SEQ ID NO: 1822 - DNA, 25 bp, Mus musculus
aacttcctattgaggatggccttga

SEQ ID NO: 1823 - DNA, 25 bp, Mus musculus
aacttcctgaaatggaggcgccagc

SEQ ID NO: 1824 - DNA, 25 bp, Mus musculus
aacttcctgtcaacaatcttggcag

SEQ ID NO: 1825 - DNA, 25 bp, Mus musculus
aacttcgcacttgtagactccatag

SEQ ID NO: 1826 - DNA, 25 bp, Mus musculus
aacttcgtctacaggcctgctgtga

SEQ ID NO: 1827 - DNA, 25 bp, Mus musculus
aacttcgtggcagcggtgttgctgt

SEQ ID NO: 1828 - DNA, 25 bp, Mus musculus
aacttctaaggactacaacagtctc

SEQ ID NO: 1829 - DNA, 25 bp, Mus musculus
aacttctgcaatagcaacaaacggg

SEQ ID NO: 1830 - DNA, 25 bp, Mus musculus
aacttctgtcatgagaaataagctg

SEQ ID NO: 1831 - DNA, 25 bp, Mus musculus
aacttcttgggcatctccattgtgg

SEQ ID NO: 1832 - DNA, 25 bp, Mus musculus
aacttgaagatcttcccatactgaa

SEQ ID NO: 1833 - DNA, 25 bp, Mus musculus
aacttgacatggaattccggaaaca

SEQ ID NO: 1834 - DNA, 25 bp, Mus musculus
aacttgaggaaagcggtcgagaaga

SEQ ID NO: 1835 - DNA, 25 bp, Mus musculus
aacttgatgggaccttgcgtctttg

SEQ ID NO: 1836 - DNA, 25 bp, Mus musculus
aacttgcaagaactccaagctgaac

SEQ ID NO: 1837 - DNA, 25 bp, Mus musculus
aacttgcacagtgacatcatctggg

SEQ ID NO: 1838 - DNA, 25 bp, Mus musculus
aacttgcatcaagatcaggcctgaa

SEQ ID NO: 1839 - DNA, 25 bp, Mus musculus
aacttgcctgcactgtatactattt

SEQ ID NO: 1840 - DNA, 25 bp, Mus musculus
aacttgcgatgtagctaagggatgg

SEQ ID NO: 1841 - DNA, 25 bp, Mus musculus
aacttgcgccggcagctctatgggc

SEQ ID NO: 1842 - DNA, 25 bp, Mus musculus
aacttgctcttgagctttctgcact

SEQ ID NO: 1843 - DNA, 25 bp, Mus musculus
aacttgctgcaactgcagtaggtgg

SEQ ID NO: 1844 - DNA, 25 bp, Mus musculus
aacttggaacccgacaatgttggag

SEQ ID NO: 1845 - DNA, 25 bp, Mus musculus
aacttggacaactctgtggtggacc

SEQ ID NO: 1846 - DNA, 25 bp, Mus musculus
aacttgggcaaggtcaagcataagc

SEQ ID NO: 1847 - DNA, 25 bp, Mus musculus
aacttgtaccacgagctgatgaagc

SEQ ID NO: 1848 - DNA, 25 bp, Mus musculus
aacttgttcctagcgttctgcatca

SEQ ID NO: 1849 - DNA, 25 bp, Mus musculus
aactttacaggcagtgccctgaaaa

SEQ ID NO: 1850 - DNA, 25 bp, Mus musculus
aactttcaatgtcatttttccgacg

SEQ ID NO: 1851 - DNA, 25 bp, Mus musculus
aactttcgaaaatagtgcggatgcg

SEQ ID NO: 1852 - DNA, 25 bp, Mus musculus
aactttctcaagtgctgacccagcg

SEQ ID NO: 1853 - DNA, 25 bp, Mus musculus
aactttctgagcaacgccttcgtca

SEQ ID NO: 1854 - DNA, 25 bp, Mus musculus
aactttgaaggctgagtcaacgggc

SEQ ID NO: 1855 - DNA, 25 bp, Mus musculus
aactttgacatctcagttgattcca

SEQ ID NO: 1856 - DNA, 25 bp, Mus musculus
aactttgactatcatgttctgcatg

SEQ ID NO: 1857 - DNA, 25 bp, Mus musculus
aactttgactatgatgttctgcatg

SEQ ID NO: 1858 - DNA, 25 bp, Mus musculus
aactttgagaaacctgtggtcatga

SEQ ID NO: 1859 - DNA, 25 bp, Mus musculus
aactttgccatgctgggacttggag

SEQ ID NO: 1860 - DNA, 25 bp, Mus musculus
aactttgtgaggctgtacatccgca

SEQ ID NO: 1861 - DNA, 25 bp, Mus musculus
aactttgtggaagccactgctctgc

SEQ ID NO: 1862 - DNA, 25 bp, Mus musculus
aactttgtggctgagagcacaagag

SEQ ID NO: 1863 - DNA, 25 bp, Mus musculus
aactttgtgggtgctggaatcatcc

SEQ ID NO: 1864 - DNA, 25 bp, Mus musculus
aacttttagcggaccagagacgact

SEQ ID NO: 1865 - DNA, 25 bp, Mus musculus
aacttttcagatccttggccatccg

SEQ ID NO: 1866 - DNA, 25 bp, Mus musculus
aacttttgtcacagaagccaaaggg

SEQ ID NO: 1867 - DNA, 25 bp, Mus musculus
aactttttcaccttcggctgcctct

SEQ ID NO: 1868 - DNA, 25 bp, Mus musculus
aagaaaacacttcagtgcttggaag

SEQ ID NO: 1869 - DNA, 25 bp, Mus musculus
aagaaaacggctcaaagatgagggt

SEQ ID NO: 1870 - DNA, 25 bp, Mus musculus
aagaaaagcaagcacaggaagatcc

SEQ ID NO: 1871 - DNA, 25 bp, Mus musculus
aagaaaatgctgagccggatctcga

SEQ ID NO: 1872 - DNA, 25 bp, Mus musculus
aagaaacagcaagtgaaggcaagaa

SEQ ID NO: 1873 - DNA, 25 bp, Mus musculus
aagaaacatctgcagatctcccagg

SEQ ID NO: 1874 - DNA, 25 bp, Mus musculus
aagaaactggcgcacatgtacggcg

SEQ ID NO: 1875 - DNA, 25 bp, Mus musculus
aagaaactggcggacatgtacggcg

SEQ ID NO: 1876 - DNA, 25 bp, Mus musculus
aagaaactggctccttccttgatgg

SEQ ID NO: 1877 - DNA, 25 bp, Mus musculus
aagaaagaactgaaagacctgctac

SEQ ID NO: 1878 - DNA, 25 bp, Mus musculus
aagaaagaggacaccacctttgatg

SEQ ID NO: 1879 - DNA, 25 bp, Mus musculus
aagaaagccgaagccgcacaccgga

SEQ ID NO: 1880 - DNA, 25 bp, Mus musculus
aagaaagccggaatgaagggctcca

SEQ ID NO: 1881 - DNA, 25 bp, Mus musculus
aagaaaggatgctgtcccacaggca

SEQ ID NO: 1882 - DNA, 25 bp, Mus musculus
aagaaaggtctagctcccgaggtgg

SEQ ID NO: 1883 - DNA, 25 bp, Mus musculus
aagaaaggtgcctcctggcctacct

SEQ ID NO: 1884 - DNA, 25 bp, Mus musculus
aagaaagtaagaaaggtgcctcctg

SEQ ID NO: 1885 - DNA, 25 bp, Mus musculus
aagaaagtcttctgagtctcacagg

SEQ ID NO: 1886 - DNA, 25 bp, Mus musculus
aagaaagtgggtttgccagatacct

SEQ ID NO: 1887 - DNA, 25 bp, Mus musculus
aagaaatccagcagtgtcttgtggg

SEQ ID NO: 1888 - DNA, 25 bp, Mus musculus
aagaaatccccacaaccagtcagat

SEQ ID NO: 1889 - DNA, 25 bp, Mus musculus
aagaaatccccagaaccagtcagat

SEQ ID NO: 1890 - DNA, 25 bp, Mus musculus
aagaaatcctatgaaccccaggagg

SEQ ID NO: 1891 - DNA, 25 bp, Mus musculus
aagaaatctccttttgggcttctgg

SEQ ID NO: 1892 - DNA, 25 bp, Mus musculus
aagaaatctttctggaatacctgtc

SEQ ID NO: 1893 - DNA, 25 bp, Mus musculus
aagaaatgatagaaaaccttgagcc

SEQ ID NO: 1894 - DNA, 25 bp, Mus musculus
aagaaatgcttattcgtactcctat

SEQ ID NO: 1895 - DNA, 25 bp, Mus musculus
aagaaatggaagatcttcctggaga

SEQ ID NO: 1896 - DNA, 25 bp, Mus musculus
aagaaattccaatgagcaatatggg

SEQ ID NO: 1897 - DNA, 25 bp, Mus musculus
aagaaattcgagctggtgccgtcgc

SEQ ID NO: 1898 - DNA, 25 bp, Mus musculus
aagaaattcggtcatgccaggcatg

SEQ ID NO: 1899 - DNA, 25 bp, Mus musculus
aagaacaaactacaggcgattgcca

SEQ ID NO: 1900 - DNA, 25 bp, Mus musculus
aagaacatcaaacctcagtgcccca

SEQ ID NO: 1901 - DNA, 25 bp, Mus musculus
aagaaccctgataccgtcctctgct

SEQ ID NO: 1902 - DNA, 25 bp, Mus musculus
aagaacgggtgatcaacgaggagta

SEQ ID NO: 1903 - DNA, 25 bp, Mus musculus
aagaactcacggctacagttcaaca

SEQ ID NO: 1904 - DNA, 25 bp, Mus musculus
aagaactcttcaggcacatatggaa

SEQ ID NO: 1905 - DNA, 25 bp, Mus musculus
aagaacttcaaatgtggagagaaaa

SEQ ID NO: 1906 - DNA, 25 bp, Mus musculus
aagaacttgcatcaagatcaggcct

SEQ ID NO: 1907 - DNA, 25 bp, Mus musculus
aagaagaaagctgcagtgaggcaag

SEQ ID NO: 1908 - DNA, 25 bp, Mus musculus
aagaagaaaggctaccgctgccgca

SEQ ID NO: 1909 - DNA, 25 bp, Mus musculus
aagaagaaatggaggccaaggctga

SEQ ID NO: 1910 - DNA, 25 bp, Mus musculus
aagaagaacaaaccatcccacggct

SEQ ID NO: 1911 - DNA, 25 bp, Mus musculus
aagaagaagggatacacagttgggt

SEQ ID NO: 1912 - DNA, 25 bp, Mus musculus
aagaagaaggtagctgagcaaacag

SEQ ID NO: 1913 - DNA, 25 bp, Mus musculus
aagaagaatttgagctccatcccca

SEQ ID NO: 1914 - DNA, 25 bp, Mus musculus
aagaagacaagaaggagacagagga

SEQ ID NO: 1915 - DNA, 25 bp, Mus musculus
aagaagacagagaggccttgtggcc

SEQ ID NO: 1916 - DNA, 25 bp, Mus musculus
aagaagacagctcagaagcttcaag

SEQ ID NO: 1917 - DNA, 25 bp, Mus musculus
aagaagaccgagtgaatgtggccga

SEQ ID NO: 1918 - DNA, 25 bp, Mus musculus
aagaagacctttccatgggagtaga

SEQ ID NO: 1919 - DNA, 25 bp, Mus musculus
aagaagacgggcatgatggacacag

SEQ ID NO: 1920 - DNA, 25 bp, Mus musculus
aagaagagacccagaaagaaatggc

SEQ ID NO: 1921 - DNA, 25 bp, Mus musculus
aagaagagagtacctttatcagctc

SEQ ID NO: 1922 - DNA, 25 bp, Mus musculus
aagaagagagttggacagccaatgg

SEQ ID NO: 1923 - DNA, 25 bp, Mus musculus
aagaagagctgaacttcacacacat

SEQ ID NO: 1924 - DNA, 25 bp, Mus musculus
aagaagatatccgagcaactgaaaa

SEQ ID NO: 1925 - DNA, 25 bp, Mus musculus
aagaagatgctccatcctcgcttcc

SEQ ID NO: 1926 - DNA, 25 bp, Mus musculus
aagaagatgttctgcggaggcttcc

SEQ ID NO: 1927 - DNA, 25 bp, Mus musculus
aagaagattctgtccagaggtgccg

SEQ ID NO: 1928 - DNA, 25 bp, Mus musculus
aagaagcagcgcaggaaacgccagg

SEQ ID NO: 1929 - DNA, 25 bp, Mus musculus
aagaagcaggcatcggagacacccc

SEQ ID NO: 1930 - DNA, 25 bp, Mus musculus
aagaagccagacttcagcagccagc

SEQ ID NO: 1931 - DNA, 25 bp, Mus musculus
aagaagcccagcgtcggaggaagca

SEQ ID NO: 1932 - DNA, 25 bp, Mus musculus
aagaagcccgtggtcttcacccgtg

SEQ ID NO: 1933 - DNA, 25 bp, Mus musculus
aagaagccggcaaggctcccagcaa

SEQ ID NO: 1934 - DNA, 25 bp, Mus musculus
aagaagcgagcaaataaagcagcac

SEQ ID NO: 1935 - DNA, 25 bp, Mus musculus
aagaagcgcacgttgaagggctcca

SEQ ID NO: 1936 - DNA, 25 bp, Mus musculus
aagaagcgcgttcccagaggcacca

SEQ ID NO: 1937 - DNA, 25 bp, Mus musculus
aagaagcggtgaaccactgatattc

SEQ ID NO: 1938 - DNA, 25 bp, Mus musculus
aagaagcggtgctgtgccagcgcct

SEQ ID NO: 1939 - DNA, 25 bp, Mus musculus
aagaagcgtgctgcacagcggagca

SEQ ID NO: 1940 - DNA, 25 bp, Mus musculus
aagaagctctttgtcaagcagctaa

SEQ ID NO: 1941 - DNA, 25 bp, Mus musculus
aagaagcttccggtttgagcagcca

SEQ ID NO: 1942 - DNA, 25 bp, Mus musculus
aagaaggagtgaggccagctgacaa

SEQ ID NO: 1943 - DNA, 25 bp, Mus musculus
aagaaggatcctgctttaaatgatg

SEQ ID NO: 1944 - DNA, 25 bp, Mus musculus
aagaaggctaggattgaagaagaca

SEQ ID NO: 1945 - DNA, 25 bp, Mus musculus
aagaagggcactaccagccgtttgg

SEQ ID NO: 1946 - DNA, 25 bp, Mus musculus
aagaagggtttcaacggctgtgaca

SEQ ID NO: 1947 - DNA, 25 bp, Mus musculus
aagaaggtggcagtggtccgcactc

SEQ ID NO: 1948 - DNA, 25 bp, Mus musculus
aagaagtcagctgtggcggataagc

SEQ ID NO: 1949 - DNA, 25 bp, Mus musculus
aagaagtccttcgaggctccgtgga

SEQ ID NO: 1950 - DNA, 25 bp, Mus musculus
aagaagtctgatcccagggacccca

SEQ ID NO: 1951 - DNA, 25 bp, Mus musculus
aagaagtgaaattccaaaagacaga

SEQ ID NO: 1952 - DNA, 25 bp, Mus musculus
aagaagtgctactgggtggtgcttt

SEQ ID NO: 1953 - DNA, 25 bp, Mus musculus
aagaagtgctttgccctgcgcatcg

SEQ ID NO: 1954 - DNA, 25 bp, Mus musculus
aagaagttcttctcccttgctgcaa

SEQ ID NO: 1955 - DNA, 25 bp, Mus musculus
aagaagttgcagctcgtctagcgca

SEQ ID NO: 1956 - DNA, 25 bp, Mus musculus
aagaagttgtgattcatccctggcc

SEQ ID NO: 1957 - DNA, 25 bp, Mus musculus
aagaagtttgactacagggccttcg

SEQ ID NO: 1958 - DNA, 25 bp, Mus musculus
aagaataaagacgagaaaatggcgt

SEQ ID NO: 1959 - DNA, 25 bp, Mus musculus
aagaatagacttttcgccattggta

SEQ ID NO: 1960 - DNA, 25 bp, Mus musculus
aagaatatgacgacgagcagcgcgc

SEQ ID NO: 1961 - DNA, 25 bp, Mus musculus
aagaatatgacgtcgagcagcgcgc

SEQ ID NO: 1962 - DNA, 25 bp, Mus musculus
aagaatatgtgagcaggccatggga

SEQ ID NO: 1963 - DNA, 25 bp, Mus musculus
aagaatccgctttttgtgcaaatgc

SEQ ID NO: 1964 - DNA, 25 bp, Mus musculus
aagaatcgtgaacctgtcagacaaa

SEQ ID NO: 1965 - DNA, 25 bp, Mus musculus
aagaatctgagtccactcagaaggc

SEQ ID NO: 1966 - DNA, 25 bp, Mus musculus
aagaatcttagacatctacctgagc

SEQ ID NO: 1967 - DNA, 25 bp, Mus musculus
aagaatcttgtgtcctttagatcca

SEQ ID NO: 1968 - DNA, 25 bp, Mus musculus
aagaatgaccacaacctcttcagtg

SEQ ID NO: 1969 - DNA, 25 bp, Mus musculus
aagaatgagaccatctggtacgtgc

SEQ ID NO: 1970 - DNA, 25 bp, Mus musculus
aagaatgcccgattgttgggttcag

SEQ ID NO: 1971 - DNA, 25 bp, Mus musculus
aagaatgctggaaatgatggcaagc

SEQ ID NO: 1972 - DNA, 25 bp, Mus musculus
aagaatggacgatggagcaggtatc

SEQ ID NO: 1973 - DNA, 25 bp, Mus musculus
aagaatggagagagaactgagccag

SEQ ID NO: 1974 - DNA, 25 bp, Mus musculus
aagaatggcctcttttctactttgg

SEQ ID NO: 1975 - DNA, 25 bp, Mus musculus
aagaatgtgcccatccaagcagcct

SEQ ID NO: 1976 - DNA, 25 bp, Mus musculus
aagaatgttgtcttctaactctgac

SEQ ID NO: 1977 - DNA, 25 bp, Mus musculus
aagaattagaaagtcgagctctcag

SEQ ID NO: 1978 - DNA, 25 bp, Mus musculus
aagaattagccgattagctgatgac

SEQ ID NO: 1979 - DNA, 25 bp, Mus musculus
aagaattcaactcccttcatggcag

SEQ ID NO: 1980 - DNA, 25 bp, Mus musculus
aagaattcgcctggaagatgggcag

SEQ ID NO: 1981 - DNA, 25 bp, Mus musculus
aagaattgccttccccaaacctacg

SEQ ID NO: 1982 - DNA, 25 bp, Mus musculus
aagaattgccttgcccaaacctacg

SEQ ID NO: 1983 - DNA, 25 bp, Mus musculus
aagaattgctgctagagatcagtcg

SEQ ID NO: 1984 - DNA, 25 bp, Mus musculus
aagacaaagtagtagaagtcgccga

SEQ ID NO: 1985 - DNA, 25 bp, Mus musculus
aagacaacaaccgttcacattgggc

SEQ ID NO: 1986 - DNA, 25 bp, Mus musculus
aagacaaccccaggcgcggcttgtg

SEQ ID NO: 1987 - DNA, 25 bp, Mus musculus
aagacaactgtagcctaccacgagg

SEQ ID NO: 1988 - DNA, 25 bp, Mus musculus
aagacaagaaccactgctgccccat

SEQ ID NO: 1989 - DNA, 25 bp, Mus musculus
aagacaaggaggaggctaagccaga

SEQ ID NO: 1990 - DNA, 25 bp, Mus musculus
aagacaaggtcttccagcctcctct

SEQ ID NO: 1991 - DNA, 25 bp, Mus musculus
aagacaatcggtcagaagcctggtg

SEQ ID NO: 1992 - DNA, 25 bp, Mus musculus
aagacacatccctaagcagaaacta

SEQ ID NO: 1993 - DNA, 25 bp, Mus musculus
aagacacgcgaggaggagcgcctta

SEQ ID NO: 1994 - DNA, 25 bp, Mus musculus
aagacacgctggagttcgacatggt

SEQ ID NO: 1995 - DNA, 25 bp, Mus musculus
aagacacggtttccaagacttgccc

SEQ ID NO: 1996 - DNA, 25 bp, Mus musculus
aagacacggtttgcaagacttgccc

SEQ ID NO: 1997 - DNA, 25 bp, Mus musculus
aagacagaacagctgctcagtgtga

SEQ ID NO: 1998 - DNA, 25 bp, Mus musculus
aagacagaattatggtacttcacca

SEQ ID NO: 1999 - DNA, 25 bp, Mus musculus
aagacagagaatgaccacatcaacc

SEQ ID NO: 2000 - DNA, 25 bp, Mus musculus
aagacagagtcggtgcagtatgacc

SEQ ID NO: 2001 - DNA, 25 bp, Mus musculus
aagacagatagagcaagggatggac

SEQ ID NO: 2002 - DNA, 25 bp, Mus musculus
aagacagatccgcaaccaacaagcc

SEQ ID NO: 2003 - DNA, 25 bp, Mus musculus
aagacagatccggaaccaacaagcc

SEQ ID NO: 2004 - DNA, 25 bp, Mus musculus
aagacagatcggcttgccaaagggt

SEQ ID NO: 2005 - DNA, 25 bp, Mus musculus
aagacagcacttacacgtatgtcag

SEQ ID NO: 2006 - DNA, 25 bp, Mus musculus
aagacagcatcccacggacacaagt

SEQ ID NO: 2007 - DNA, 25 bp, Mus musculus
aagacagccagaatagctcccagca

SEQ ID NO: 2008 - DNA, 25 bp, Mus musculus
aagacagggacatcgcacttctgga

SEQ ID NO: 2009 - DNA, 25 bp, Mus musculus
aagacagtgaccctccgatcagtga

SEQ ID NO: 2010 - DNA, 25 bp, Mus musculus
aagacatgctaaggctagaccgtag

SEQ ID NO: 2011 - DNA, 25 bp, Mus musculus
aagacatggaggtgttcggcagcac

SEQ ID NO: 2012 - DNA, 25 bp, Mus musculus
aagacatgtaccatcatcctccgtg

SEQ ID NO: 2013 - DNA, 25 bp, Mus musculus
aagacattcacacttataccagcct

SEQ ID NO: 2014 - DNA, 25 bp, Mus musculus
aagaccaaagtgtgtcctcaccctg

SEQ ID NO: 2015 - DNA, 25 bp, Mus musculus
aagaccaccttaggaacagattgga

SEQ ID NO: 2016 - DNA, 25 bp, Mus musculus
aagaccagagcatccgcatccagag

SEQ ID NO: 2017 - DNA, 25 bp, Mus musculus
aagaccagctgtgcgcaggaactcc

SEQ ID NO: 2018 - DNA, 25 bp, Mus musculus
aagaccattataaaaatccctggag

SEQ ID NO: 2019 - DNA, 25 bp, Mus musculus
aagacccccacaaggctggactgag

SEQ ID NO: 2020 - DNA, 25 bp, Mus musculus
aagaccccgggctctgtgaggttat

SEQ ID NO: 2021 - DNA, 25 bp, Mus musculus
aagacccctctgatggcgtttctca

SEQ ID NO: 2022 - DNA, 25 bp, Mus musculus
aagaccctccaaaagaaattctctg

SEQ ID NO: 2023 - DNA, 25 bp, Mus musculus
aagaccctcttctatctgattgcca

SEQ ID NO: 2024 - DNA, 25 bp, Mus musculus
aagaccctggcaaggccacccaggg

SEQ ID NO: 2025 - DNA, 25 bp, Mus musculus
aagaccctgtccctgaactctatca

SEQ ID NO: 2026 - DNA, 25 bp, Mus musculus
aagacctacagaacagtggccggac

SEQ ID NO: 2027 - DNA, 25 bp, Mus musculus
aagacctatctgcatttgagtcctc

SEQ ID NO: 2028 - DNA, 25 bp, Mus musculus
aagacctatcttctggcctgggagt

SEQ ID NO: 2029 - DNA, 25 bp, Mus musculus
aagacctccgtgatggccacaacct

SEQ ID NO: 2030 - DNA, 25 bp, Mus musculus
aagacctcggatgttaggatgaaat

SEQ ID NO: 2031 - DNA, 25 bp, Mus musculus
aagacctcttcctccggctttgccg

SEQ ID NO: 2032 - DNA, 25 bp, Mus musculus
aagacctgcgcttctgactatctcc

SEQ ID NO: 2033 - DNA, 25 bp, Mus musculus
aagacctggtgcgtacccggagata

SEQ ID NO: 2034 - DNA, 25 bp, Mus musculus
aagaccttagcccagaggctggccc

SEQ ID NO: 2035 - DNA, 25 bp, Mus musculus
aagaccttcaaggtggcttacagcc

SEQ ID NO: 2036 - DNA, 25 bp, Mus musculus
aagacgaagctgatgcggatctcat

SEQ ID NO: 2037 - DNA, 25 bp, Mus musculus
aagacgacctgtgtgtgccacagct

SEQ ID NO: 2038 - DNA, 25 bp, Mus musculus
aagacgatgacgtgaatgaggacac

SEQ ID NO: 2039 - DNA, 25 bp, Mus musculus
aagacgcacttaactatggattcag

SEQ ID NO: 2040 - DNA, 25 bp, Mus musculus
aagacgccttgaagcttcagaaaca

SEQ ID NO: 2041 - DNA, 25 bp, Mus musculus
aagacgcgctccacggacagctacg

SEQ ID NO: 2042 - DNA, 25 bp, Mus musculus
aagacgctgcctcccaggattgaaa

SEQ ID NO: 2043 - DNA, 25 bp, Mus musculus
aagacggcaccacgactaagtactt

SEQ ID NO: 2044 - DNA, 25 bp, Mus musculus
aagacgggacagtcacagcagggaa

SEQ ID NO: 2045 - DNA, 25 bp, Mus musculus
aagacggttatcaggttgttggcag

SEQ ID NO: 2046 - DNA, 25 bp, Mus musculus
aagactaaaatagggcacagtggct

SEQ ID NO: 2047 - DNA, 25 bp, Mus musculus
aagactagactccttcttcagcctc

SEQ ID NO: 2048 - DNA, 25 bp, Mus musculus
aagactagatctgaggagctgtgat

SEQ ID NO: 2049 - DNA, 25 bp, Mus musculus
aagactatatctaaagctccatcag

SEQ ID NO: 2050 - DNA, 25 bp, Mus musculus
aagactcaaaagagtactgtgctgc

SEQ ID NO: 2051 - DNA, 25 bp, Mus musculus
aagactcaggtttgggtgttttgct

SEQ ID NO: 2052 - DNA, 25 bp, Mus musculus
aagactcatccacgagccccattaa

SEQ ID NO: 2053 - DNA, 25 bp, Mus musculus
aagactcctgattttgagtctacag

SEQ ID NO: 2054 - DNA, 25 bp, Mus musculus
aagactctcacctttgcttccaggg

SEQ ID NO: 2055 - DNA, 25 bp, Mus musculus
aagactctgcagaagctagtgcagc

SEQ ID NO: 2056 - DNA, 25 bp, Mus musculus
aagactcttcaatcagctcatcaag

SEQ ID NO: 2057 - DNA, 25 bp, Mus musculus
aagactgagaccatagagttctaag

SEQ ID NO: 2058 - DNA, 25 bp, Mus musculus
aagactgccctgatggaggcaaatt

SEQ ID NO: 2059 - DNA, 25 bp, Mus musculus
aagactgctagctactttgggacaa

SEQ ID NO: 2060 - DNA, 25 bp, Mus musculus
aagactgctgcaaacttgaggccag

SEQ ID NO: 2061 - DNA, 25 bp, Mus musculus
aagactgctgtcagatagcacctgc

SEQ ID NO: 2062 - DNA, 25 bp, Mus musculus
aagactgggctgctcagtaccgcga

SEQ ID NO: 2063 - DNA, 25 bp, Mus musculus
aagactggttctcatcttttctgcg

SEQ ID NO: 2064 - DNA, 25 bp, Mus musculus
aagactgtggcaagattgcattcta

SEQ ID NO: 2065 - DNA, 25 bp, Mus musculus
aagacttccaaaacctgatgtgatg

SEQ ID NO: 2066 - DNA, 25 bp, Mus musculus
aagacttccaaggtctcccggctgt

SEQ ID NO: 2067 - DNA, 25 bp, Mus musculus
aagacttcgttgacatggtagagac

SEQ ID NO: 2068 - DNA, 25 bp, Mus musculus
aagacttctacaagctggagctgag

SEQ ID NO: 2069 - DNA, 25 bp, Mus musculus
aagacttctgtccacctcatcatag

SEQ ID NO: 2070 - DNA, 25 bp, Mus musculus
aagactttgtttgggctcagtggga

SEQ ID NO: 2071 - DNA, 25 bp, Mus musculus
aagagaaagcactgctgtcccagca

SEQ ID NO: 2072 - DNA, 25 bp, Mus musculus
aagagaacccggatgatggagatat

SEQ ID NO: 2073 - DNA, 25 bp, Mus musculus
aagagaactactgccggaacccaga

SEQ ID NO: 2074 - DNA, 25 bp, Mus musculus
aagagaacttcctgttggcacaagc

SEQ ID NO: 2075 - DNA, 25 bp, Mus musculus
aagagaacttctcaggaggcacctc

SEQ ID NO: 2076 - DNA, 25 bp, Mus musculus
aagagaaggaatcagagctctggaa

SEQ ID NO: 2077 - DNA, 25 bp, Mus musculus
aagagaatgatattccagcaaacca

SEQ ID NO: 2078 - DNA, 25 bp, Mus musculus
aagagacaaccaccaaacatgacca

SEQ ID NO: 2079 - DNA, 25 bp, Mus musculus
aagagacagatttctaccagagggc

SEQ ID NO: 2080 - DNA, 25 bp, Mus musculus
aagagaccatcactagccccaagaa

SEQ ID NO: 2081 - DNA, 25 bp, Mus musculus
aagagacccagaaagaaatggctgg

SEQ ID NO: 2082 - DNA, 25 bp, Mus musculus
aagagacctgtcacttctgaggaac

SEQ ID NO: 2083 - DNA, 25 bp, Mus musculus
aagagacgcctgcagaagaacagcc

SEQ ID NO: 2084 - DNA, 25 bp, Mus musculus
aagagacggccatgacagagcatca

SEQ ID NO: 2085 - DNA, 25 bp, Mus musculus
aagagacgttcttgcccctacatta

SEQ ID NO: 2086 - DNA, 25 bp, Mus musculus
aagagagactctattgggtggatgt

SEQ ID NO: 2087 - DNA, 25 bp, Mus musculus
aagagagcattggactccccaggac

SEQ ID NO: 2088 - DNA, 25 bp, Mus musculus
aagagaggctcctgttcctgctggc

SEQ ID NO: 2089 - DNA, 25 bp, Mus musculus
aagagagggaagagccacagcagta

SEQ ID NO: 2090 - DNA, 25 bp, Mus musculus
aagagagggaagcaattaaatcgtc

SEQ ID NO: 2091 - DNA, 25 bp, Mus musculus
aagagagtacctttatcagctccag

SEQ ID NO: 2092 - DNA, 25 bp, Mus musculus
aagagagtcttctttggagtgggca

SEQ ID NO: 2093 - DNA, 25 bp, Mus musculus
aagagatctacatgcctctgcattc

SEQ ID NO: 2094 - DNA, 25 bp, Mus musculus
aagagatggtgctgcaggccaagaa

SEQ ID NO: 2095 - DNA, 25 bp, Mus musculus
aagagatgtcatcatgagggaattc

SEQ ID NO: 2096 - DNA, 25 bp, Mus musculus
aagagattatgagaagaaccaggag

SEQ ID NO: 2097 - DNA, 25 bp, Mus musculus
aagagattggtcaactaattgtgca

SEQ ID NO: 2098 - DNA, 25 bp, Mus musculus
aagagcaagcccctggaccagtctg

SEQ ID NO: 2099 - DNA, 25 bp, Mus musculus
aagagcaagccgcacgtcaagaggc

SEQ ID NO: 2100 - DNA, 25 bp, Mus musculus
aagagcacacgcaggagcactcgga

SEQ ID NO: 2101 - DNA, 25 bp, Mus musculus
aagagcaccactacattaacatgag

SEQ ID NO: 2102 - DNA, 25 bp, Mus musculus
aagagcaccagtctgccctggaact

SEQ ID NO: 2103 - DNA, 25 bp, Mus musculus
aagagcactgaatctcctggcactg

SEQ ID NO: 2104 - DNA, 25 bp, Mus musculus
aagagcaggaagacatacctgtact

SEQ ID NO: 2105 - DNA, 25 bp, Mus musculus
aagagccatccgagtgaagcgcgtg

SEQ ID NO: 2106 - DNA, 25 bp, Mus musculus
aagagcccgatttctgaagatcccg

SEQ ID NO: 2107 - DNA, 25 bp, Mus musculus
aagagccctgggtgatgaagacaga

SEQ ID NO: 2108 - DNA, 25 bp, Mus musculus
aagagccctgtctgaaatgcgtgga

SEQ ID NO: 2109 - DNA, 25 bp, Mus musculus
aagagcctgaggaacgacattggtg

SEQ ID NO: 2110 - DNA, 25 bp, Mus musculus
aagagcctgccaaccacaggagagg

SEQ ID NO: 2111 - DNA, 25 bp, Mus musculus
aagagccttaatgccttcaacgtgg

SEQ ID NO: 2112 - DNA, 25 bp, Mus musculus
aagagcgcatgaggatacagaaagc

SEQ ID NO: 2113 - DNA, 25 bp, Mus musculus
aagagcggcaccaagaagagcgact

SEQ ID NO: 2114 - DNA, 25 bp, Mus musculus
aagagcggtcgagaagtgagcacaa

SEQ ID NO: 2115 - DNA, 25 bp, Mus musculus
aagagcgtttgccaagtccaggaac

SEQ ID NO: 2116 - DNA, 25 bp, Mus musculus
aagagcgtttgcgaagtccaggaac

SEQ ID NO: 2117 - DNA, 25 bp, Mus musculus
aagagctagaggtccagagagactg

SEQ ID NO: 2118 - DNA, 25 bp, Mus musculus
aagagctcagacatacaagttggag

SEQ ID NO: 2119 - DNA, 25 bp, Mus musculus
aagagctcagtgctggaaagcctag

SEQ ID NO: 2120 - DNA, 25 bp, Mus musculus
aagagctccacctaccctggctgta

SEQ ID NO: 2121 - DNA, 25 bp, Mus musculus
aagagctggaagaagcactgagaga

SEQ ID NO: 2122 - DNA, 25 bp, Mus musculus
aagagctggcgatgtgcttcttgca

SEQ ID NO: 2123 - DNA, 25 bp, Mus musculus
aagagctggtgttcctgcgcaaccg

SEQ ID NO: 2124 - DNA, 25 bp, Mus musculus
aagagctgttctacaagggaccaag

SEQ ID NO: 2125 - DNA, 25 bp, Mus musculus
aagagcttcaatctctcctggacag

SEQ ID NO: 2126 - DNA, 25 bp, Mus musculus
aagagcttcatctgcgatggtcaga

SEQ ID NO: 2127 - DNA, 25 bp, Mus musculus
aagagcttggctttgagcgatttca

SEQ ID NO: 2128 - DNA, 25 bp, Mus musculus
aagagcttgtgcgagcctccagtca

SEQ ID NO: 2129 - DNA, 25 bp, Mus musculus
aagaggaaattcagcatggagcccg

SEQ ID NO: 2130 - DNA, 25 bp, Mus musculus
aagaggaagcacgttgccttgtgga

SEQ ID NO: 2131 - DNA, 25 bp, Mus musculus
aagaggacagcgacctgtccgatta

SEQ ID NO: 2132 - DNA, 25 bp, Mus musculus
aagaggacgctccacttatcctgtg

SEQ ID NO: 2133 - DNA, 25 bp, Mus musculus
aagaggacgctcgacttatcctgtg

SEQ ID NO: 2134 - DNA, 25 bp, Mus musculus
aagaggactccttgtctccctgacc

SEQ ID NO: 2135 - DNA, 25 bp, Mus musculus
aagaggagctcatcaaagcccagaa

SEQ ID NO: 2136 - DNA, 25 bp, Mus musculus
aagaggaggcttctctcaacctcaa

SEQ ID NO: 2137 - DNA, 25 bp, Mus musculus
aagaggaggtgcatgacctgacaaa

SEQ ID NO: 2138 - DNA, 25 bp, Mus musculus
aagaggagtttgagtgctatccacc

SEQ ID NO: 2139 - DNA, 25 bp, Mus musculus
aagaggatgctttatacgctgccca

SEQ ID NO: 2140 - DNA, 25 bp, Mus musculus
aagaggatgtccttccagaaatggg

SEQ ID NO: 2141 - DNA, 25 bp, Mus musculus
aagaggcagctcagccgaatagacc

SEQ ID NO: 2142 - DNA, 25 bp, Mus musculus
aagaggcattgaatcccatgtgagc

SEQ ID NO: 2143 - DNA, 25 bp, Mus musculus
aagaggccaacatcctgggcaggaa

SEQ ID NO: 2144 - DNA, 25 bp, Mus musculus
aagaggccaaggaagaggaccgcct

SEQ ID NO: 2145 - DNA, 25 bp, Mus musculus
aagaggcccgggttcccatcataag

SEQ ID NO: 2146 - DNA, 25 bp, Mus musculus
aagaggccgccctccggctgagaag

SEQ ID NO: 2147 - DNA, 25 bp, Mus musculus
aagaggccgcttcgccctatccaag

SEQ ID NO: 2148 - DNA, 25 bp, Mus musculus
aagaggcctcaaagaacgaagtgat

SEQ ID NO: 2149 - DNA, 25 bp, Mus musculus
aagaggcctgttccagcatccggga

SEQ ID NO: 2150 - DNA, 25 bp, Mus musculus
aagaggcgctctagcagctccagtt

SEQ ID NO: 2151 - DNA, 25 bp, Mus musculus
aagaggcgtctagccagagagcaga

SEQ ID NO: 2152 - DNA, 25 bp, Mus musculus
aagaggctcgacaagcatgtgatgg

SEQ ID NO: 2153 - DNA, 25 bp, Mus musculus
aagaggcttactctgtcacctgtgg

SEQ ID NO: 2154 - DNA, 25 bp, Mus musculus
aagagggaccagcagccactacctc

SEQ ID NO: 2155 - DNA, 25 bp, Mus musculus
aagagggaccctccgtctgagatcg

SEQ ID NO: 2156 - DNA, 25 bp, Mus musculus
aagagggagaccaaagttatcaagg

SEQ ID NO: 2157 - DNA, 25 bp, Mus musculus
aagagggcccctggatcacaggact

SEQ ID NO: 2158 - DNA, 25 bp, Mus musculus
aagagggcgtccgatccccaggatt

SEQ ID NO: 2159 - DNA, 25 bp, Mus musculus
aagagggcgttggaccacttagtgc

SEQ ID NO: 2160 - DNA, 25 bp, Mus musculus
aagagggctggccactccagtgcct

SEQ ID NO: 2161 - DNA, 25 bp, Mus musculus
aagagggctttggtttgagagcaac

SEQ ID NO: 2162 - DNA, 25 bp, Mus musculus
aagagggtccaccagactggcagct

SEQ ID NO: 2163 - DNA, 25 bp, Mus musculus
aagagggtctttgccaactcctttg

SEQ ID NO: 2164 - DNA, 25 bp, Mus musculus
aagagggtgtccatcagctggagaa

SEQ ID NO: 2165 - DNA, 25 bp, Mus musculus
aagagggtgtctcaaaccaggtgaa

SEQ ID NO: 2166 - DNA, 25 bp, Mus musculus
aagaggtgactttcatctatcagaa

SEQ ID NO: 2167 - DNA, 25 bp, Mus musculus
aagaggttcttacgagccgcttgga

SEQ ID NO: 2168 - DNA, 25 bp, Mus musculus
aagaggtttatgaccactgtttgtc

SEQ ID NO: 2169 - DNA, 25 bp, Mus musculus
aagaggtttatgtccactgtttgtc

SEQ ID NO: 2170 - DNA, 25 bp, Mus musculus
aagagtacaccagcacactgaaggt

SEQ ID NO: 2171 - DNA, 25 bp, Mus musculus
aagagtatatacctgctgacactgt

SEQ ID NO: 2172 - DNA, 25 bp, Mus musculus
aagagtatggacaagtagaatccgt

SEQ ID NO: 2173 - DNA, 25 bp, Mus musculus
aagagtcaagcagacatctctatgt

SEQ ID NO: 2174 - DNA, 25 bp, Mus musculus
aagagtccaaagctctgattccaag

SEQ ID NO: 2175 - DNA, 25 bp, Mus musculus
aagagtccggcgcttccagatcgcc

SEQ ID NO: 2176 - DNA, 25 bp, Mus musculus
aagagtcctggcatcaacagtatgg

SEQ ID NO: 2177 - DNA, 25 bp, Mus musculus
aagagtctaaggctctcctggaagg

SEQ ID NO: 2178 - DNA, 25 bp, Mus musculus
aagagtctgtcctcaggcacattcc

SEQ ID NO: 2179 - DNA, 25 bp, Mus musculus
aagagtgagcttatcctggacatgt

SEQ ID NO: 2180 - DNA, 25 bp, Mus musculus
aagagtgatgccctcctcatgcagg

SEQ ID NO: 2181 - DNA, 25 bp, Mus musculus
aagagtggagtcagaccatcccgga

SEQ ID NO: 2182 - DNA, 25 bp, Mus musculus
aagagtgggcaccaagtgttgtaca

SEQ ID NO: 2183 - DNA, 25 bp, Mus musculus
aagagtggtagagcagagcccgacc

SEQ ID NO: 2184 - DNA, 25 bp, Mus musculus
aagagttcgacatcagtcagcagaa

SEQ ID NO: 2185 - DNA, 25 bp, Mus musculus
aagagtttcaacactgtcccctaca

SEQ ID NO: 2186 - DNA, 25 bp, Mus musculus
aagataaaccagaaggcagcgctag

SEQ ID NO: 2187 - DNA, 25 bp, Mus musculus
aagataacttcaccttcaaatgcca

SEQ ID NO: 2188 - DNA, 25 bp, Mus musculus
aagataaggttttcaacactgcctg

SEQ ID NO: 2189 - DNA, 25 bp, Mus musculus
aagataatgagcaccccttggttgc

SEQ ID NO: 2190 - DNA, 25 bp, Mus musculus
aagatacaaggaacaaaacatccag

SEQ ID NO: 2191 - DNA, 25 bp, Mus musculus
aagatacactgaagctttgtccacg

SEQ ID NO: 2192 - DNA, 25 bp, Mus musculus
aagatacactgatgctttgtccacg

SEQ ID NO: 2193 - DNA, 25 bp, Mus musculus
aagatacagcccacacttcgtcctg

SEQ ID NO: 2194 - DNA, 25 bp, Mus musculus
aagatactacggaggcggctatggc

SEQ ID NO: 2195 - DNA, 25 bp, Mus musculus
aagatagcactatcctgggcccaga

SEQ ID NO: 2196 - DNA, 25 bp, Mus musculus
aagatagtagcttggcgttggagcc

SEQ ID NO: 2197 - DNA, 25 bp, Mus musculus
aagatatcacggagtatcagagcat

SEQ ID NO: 2198 - DNA, 25 bp, Mus musculus
aagatatccgagcaactgaaaaaga

SEQ ID NO: 2199 - DNA, 25 bp, Mus musculus
aagatatcggactttggcttcgcca

SEQ ID NO: 2200 - DNA, 25 bp, Mus musculus
aagatatgactccaggaccacaata

SEQ ID NO: 2201 - DNA, 25 bp, Mus musculus
aagatcacctaccacccagatgggc

SEQ ID NO: 2202 - DNA, 25 bp, Mus musculus
aagatcacgtctacctgcagttgca

SEQ ID NO: 2203 - DNA, 25 bp, Mus musculus
aagatcacgttcaatcggcccacca

SEQ ID NO: 2204 - DNA, 25 bp, Mus musculus
aagatccagacgctcaagctggccg

SEQ ID NO: 2205 - DNA, 25 bp, Mus musculus
aagatccagacggtcaagctggccg

SEQ ID NO: 2206 - DNA, 25 bp, Mus musculus
aagatccgaagtcaagccgtccagc

SEQ ID NO: 2207 - DNA, 25 bp, Mus musculus
aagatcctcatgaaagttggacaag

SEQ ID NO: 2208 - DNA, 25 bp, Mus musculus
aagatcctgtttggtgcgctggtgg

SEQ ID NO: 2209 - DNA, 25 bp, Mus musculus
aagatccttactcccacgtcaacga

SEQ ID NO: 2210 - DNA, 25 bp, Mus musculus
aagatctaggacttgggagcccggc

SEQ ID NO: 2211 - DNA, 25 bp, Mus musculus
aagatcttgaagcttactgctgatg

SEQ ID NO: 2212 - DNA, 25 bp, Mus musculus
aagatcttgtggagtgggttctcca

SEQ ID NO: 2213 - DNA, 25 bp, Mus musculus
aagatctttcatctctgtgatggtg

SEQ ID NO: 2214 - DNA, 25 bp, Mus musculus
aagatgaagggcaggtatgtcccct

SEQ ID NO: 2215 - DNA, 25 bp, Mus musculus
aagatgacaaggagggccacctggt

SEQ ID NO: 2216 - DNA, 25 bp, Mus musculus
aagatgacacctttctaacagctca

SEQ ID NO: 2217 - DNA, 25 bp, Mus musculus
aagatgacatcacttttgtgtctgg

SEQ ID NO: 2218 - DNA, 25 bp, Mus musculus
aagatgacctctccccaactgctga

SEQ ID NO: 2219 - DNA, 25 bp, Mus musculus
aagatgagagcatccggcccttcaa

SEQ ID NO: 2220 - DNA, 25 bp, Mus musculus
aagatgagtccccaaagaaaagtgc

SEQ ID NO: 2221 - DNA, 25 bp, Mus musculus
aagatgagtcctccgttccatccca

SEQ ID NO: 2222 - DNA, 25 bp, Mus musculus
aagatgattggactggaagatctca

SEQ ID NO: 2223 - DNA, 25 bp, Mus musculus
aagatgcagacggtgttatatgccc

SEQ ID NO: 2224 - DNA, 25 bp, Mus musculus
aagatgcagagcagtctgaagtcgg

SEQ ID NO: 2225 - DNA, 25 bp, Mus musculus
aagatgcgcctagagccatccaggg

SEQ ID NO: 2226 - DNA, 25 bp, Mus musculus
aagatgctaaagtctaagaatgctg

SEQ ID NO: 2227 - DNA, 25 bp, Mus musculus
aagatgctcagcctggtgtccacgc

SEQ ID NO: 2228 - DNA, 25 bp, Mus musculus
aagatgctcggcttcagagactcag

SEQ ID NO: 2229 - DNA, 25 bp, Mus musculus
aagatgctgccaacctttgtccggt

SEQ ID NO: 2230 - DNA, 25 bp, Mus musculus
aagatgcttataaaacccaggtgag

SEQ ID NO: 2231 - DNA, 25 bp, Mus musculus
aagatgcttctggaacgcaacgagg

SEQ ID NO: 2232 - DNA, 25 bp, Mus musculus
aagatggaatgatttgaaggcaaaa

SEQ ID NO: 2233 - DNA, 25 bp, Mus musculus
aagatggacaacagccgggacctga

SEQ ID NO: 2234 - DNA, 25 bp, Mus musculus
aagatggatcttgggaccggccgat

SEQ ID NO: 2235 - DNA, 25 bp, Mus musculus
aagatggatgcaaagcaggagccca

SEQ ID NO: 2236 - DNA, 25 bp, Mus musculus
aagatggccacaggactctggatgc

SEQ ID NO: 2237 - DNA, 25 bp, Mus musculus
aagatggcggcttcgagattcgtac

SEQ ID NO: 2238 - DNA, 25 bp, Mus musculus
aagatggcttccttgtttactcaag

SEQ ID NO: 2239 - DNA, 25 bp, Mus musculus
aagatgggaaaaccccactacatat

SEQ ID NO: 2240 - DNA, 25 bp, Mus musculus
aagatggtaccttggatgatggtga

SEQ ID NO: 2241 - DNA, 25 bp, Mus musculus
aagatgtataccgaggcccagccat

SEQ ID NO: 2242 - DNA, 25 bp, Mus musculus
aagatgtcaaagagatctttgcccg

SEQ ID NO: 2243 - DNA, 25 bp, Mus musculus
aagatgtcactgaagcacaaatagg

SEQ ID NO: 2244 - DNA, 25 bp, Mus musculus
aagatgtctcagagccagcagagtc

SEQ ID NO: 2245 - DNA, 25 bp, Mus musculus
aagatgtgatggagaagttatcagc

SEQ ID NO: 2246 - DNA, 25 bp, Mus musculus
aagatgtggccacgtgtcctagctg

SEQ ID NO: 2247 - DNA, 25 bp, Mus musculus
aagatgttcctcagttccggatatt

SEQ ID NO: 2248 - DNA, 25 bp, Mus musculus
aagatgttgtggagacattgctaca

SEQ ID NO: 2249 - DNA, 25 bp, Mus musculus
aagattccctcctcgatctacgatg

SEQ ID NO: 2250 - DNA, 25 bp, Mus musculus
aagattcctttcacaagtttgtggc

SEQ ID NO: 2251 - DNA, 25 bp, Mus musculus
aagattcgggagatgattctgaagg

SEQ ID NO: 2252 - DNA, 25 bp, Mus musculus
aagattcgtgtcagcgcggcgtcta

SEQ ID NO: 2253 - DNA, 25 bp, Mus musculus
aagattctacgtgcctcaaggaacc

SEQ ID NO: 2254 - DNA, 25 bp, Mus musculus
aagattctgagtttggcccaggaac

SEQ ID NO: 2255 - DNA, 25 bp, Mus musculus
aagattctggtcactggatcctctg

SEQ ID NO: 2256 - DNA, 25 bp, Mus musculus
aagattgagacggaccactggccgg

SEQ ID NO: 2257 - DNA, 25 bp, Mus musculus
aagattgtcactcccctggacgagc

SEQ ID NO: 2258 - DNA, 25 bp, Mus musculus
aagattgtcactgccctggacgagc

SEQ ID NO: 2259 - DNA, 25 bp, Mus musculus
aagattgtcctgatcagcaggtccc

SEQ ID NO: 2260 - DNA, 25 bp, Mus musculus
aagattgtgaacgatgaccagtcct

SEQ ID NO: 2261 - DNA, 25 bp, Mus musculus
aagattgtgagatcaagcaccttgg

SEQ ID NO: 2262 - DNA, 25 bp, Mus musculus
aagattgtggagaggaatggcttca

SEQ ID NO: 2263 - DNA, 25 bp, Mus musculus
aagatttatcccacagccactggag

SEQ ID NO: 2264 - DNA, 25 bp, Mus musculus
aagcaaaaagggagtgaggccatag

SEQ ID NO: 2265 - DNA, 25 bp, Mus musculus
aagcaaacgaagaagagttgaaacg

SEQ ID NO: 2266 - DNA, 25 bp, Mus musculus
aagcaactaggaacaatgaggtccc

SEQ ID NO: 2267 - DNA, 25 bp, Mus musculus
aagcaactcgcaagcgggagctgag

SEQ ID NO: 2268 - DNA, 25 bp, Mus musculus
aagcaagaacaagttgagatggagt

SEQ ID NO: 2269 - DNA, 25 bp, Mus musculus
aagcaagattcagacattaaacaag

SEQ ID NO: 2270 - DNA, 25 bp, Mus musculus
aagcaagcctgagatctctgctgtc

SEQ ID NO: 2271 - DNA, 25 bp, Mus musculus
aagcaagggtccgtccctttgctgc

SEQ ID NO: 2272 - DNA, 25 bp, Mus musculus
aagcaaggtatccatctgtccccaa

SEQ ID NO: 2273 - DNA, 25 bp, Mus musculus
aagcaagtgttctgagctgcccatc

SEQ ID NO: 2274 - DNA, 25 bp, Mus musculus
aagcaataaggacaaggttgctcaa

SEQ ID NO: 2275 - DNA, 25 bp, Mus musculus
aagcaataaggagaaggttgctcaa

SEQ ID NO: 2276 - DNA, 25 bp, Mus musculus
aagcaatgtggccacggagaccacc

SEQ ID NO: 2277 - DNA, 25 bp, Mus musculus
aagcacagacagtgtggcctctggt

SEQ ID NO: 2278 - DNA, 25 bp, Mus musculus
aagcacaggcccaggaggtgcagaa

SEQ ID NO: 2279 - DNA, 25 bp, Mus musculus
aagcacaggctggtgctgctcgaga

SEQ ID NO: 2280 - DNA, 25 bp, Mus musculus
aagcacaggtcctacttgggaacga

SEQ ID NO: 2281 - DNA, 25 bp, Mus musculus
aagcacatggcagcggccagtgcag

SEQ ID NO: 2282 - DNA, 25 bp, Mus musculus
aagcacatgtgtaacaaagactcgg

SEQ ID NO: 2283 - DNA, 25 bp, Mus musculus
aagcaccaagagactggctgctccg

SEQ ID NO: 2284 - DNA, 25 bp, Mus musculus
aagcaccaagagtctggctgctccg

SEQ ID NO: 2285 - DNA, 25 bp, Mus musculus
aagcaccattcattgcagagagaat

SEQ ID NO: 2286 - DNA, 25 bp, Mus musculus
aagcacccacctaacagacgaggaa

SEQ ID NO: 2287 - DNA, 25 bp, Mus musculus
aagcaccctacccaccatgagaagg

SEQ ID NO: 2288 - DNA, 25 bp, Mus musculus
aagcaccgcgggaaaaagagcaccg

SEQ ID NO: 2289 - DNA, 25 bp, Mus musculus
aagcaccttgagatacacacagcca

SEQ ID NO: 2290 - DNA, 25 bp, Mus musculus
aagcacctttctcctgatggccagt

SEQ ID NO: 2291 - DNA, 25 bp, Mus musculus
aagcacgctttgatcatctatgacg

SEQ ID NO: 2292 - DNA, 25 bp, Mus musculus
aagcacggccgccttgtctggagac

SEQ ID NO: 2293 - DNA, 25 bp, Mus musculus
aagcacgtctgtgatgcggctgaag

SEQ ID NO: 2294 - DNA, 25 bp, Mus musculus
aagcacgttgccttgtggaggaact

SEQ ID NO: 2295 - DNA, 25 bp, Mus musculus
aagcactacaagtccaccgtgggag

SEQ ID NO: 2296 - DNA, 25 bp, Mus musculus
aagcactccactgaggtgacagtcg

SEQ ID NO: 2297 - DNA, 25 bp, Mus musculus
aagcactgaagcaacacaaaaccct

SEQ ID NO: 2298 - DNA, 25 bp, Mus musculus
aagcactggccttcaaagaatcacg

SEQ ID NO: 2299 - DNA, 25 bp, Mus musculus
aagcagaaggtctcccggattgagc

SEQ ID NO: 2300 - DNA, 25 bp, Mus musculus
aagcagaatgtagagagcagcaatt

SEQ ID NO: 2301 - DNA, 25 bp, Mus musculus
aagcagaatgtagaggatagcactt

SEQ ID NO: 2302 - DNA, 25 bp, Mus musculus
aagcagacaactttgccatgctggg

SEQ ID NO: 2303 - DNA, 25 bp, Mus musculus
aagcagacaccagcagccatagttg

SEQ ID NO: 2304 - DNA, 25 bp, Mus musculus
aagcagacacgaccacagggactaa

SEQ ID NO: 2305 - DNA, 25 bp, Mus musculus
aagcagactgctgccaggtgggcct

SEQ ID NO: 2306 - DNA, 25 bp, Mus musculus
aagcagagaaaatgttcaagggcaa

SEQ ID NO: 2307 - DNA, 25 bp, Mus musculus
aagcagagagtgtgtggagcccttc

SEQ ID NO: 2308 - DNA, 25 bp, Mus musculus
aagcagagcgcacatttgcatggat

SEQ ID NO: 2309 - DNA, 25 bp, Mus musculus
aagcagagctatggaatcccaacat

SEQ ID NO: 2310 - DNA, 25 bp, Mus musculus
aagcagagctgcagtcaatgttgga

SEQ ID NO: 2311 - DNA, 25 bp, Mus musculus
aagcagagctgctgtcaatgttgga

SEQ ID NO: 2312 - DNA, 25 bp, Mus musculus
aagcagaggaaatacgcaagcaact

SEQ ID NO: 2313 - DNA, 25 bp, Mus musculus
aagcagagggacctggcttctgatt

SEQ ID NO: 2314 - DNA, 25 bp, Mus musculus
aagcagagtggcgatgacagcttcg

SEQ ID NO: 2315 - DNA, 25 bp, Mus musculus
aagcagcaagttggcgcaggaacct

SEQ ID NO: 2316 - DNA, 25 bp, Mus musculus
aagcagcacaacagtcttgaacggg

SEQ ID NO: 2317 - DNA, 25 bp, Mus musculus
aagcagcacaagaagctgacccagg

SEQ ID NO: 2318 - DNA, 25 bp, Mus musculus
aagcagccaagagaccgtccggtct

SEQ ID NO: 2319 - DNA, 25 bp, Mus musculus
aagcagccaagcctattcactgagg

SEQ ID NO: 2320 - DNA, 25 bp, Mus musculus
aagcagcggtttaccctgcagccag

SEQ ID NO: 2321 - DNA, 25 bp, Mus musculus
aagcagctaaagcacagacctcctg

SEQ ID NO: 2322 - DNA, 25 bp, Mus musculus
aagcagctggctgggatgagcctca

SEQ ID NO: 2323 - DNA, 25 bp, Mus musculus
aagcaggaagcccacttctccttgg

SEQ ID NO: 2324 - DNA, 25 bp, Mus musculus
aagcaggaggacttcaagacgacag

SEQ ID NO: 2325 - DNA, 25 bp, Mus musculus
aagcaggcatcggagacaccccgaa

SEQ ID NO: 2326 - DNA, 25 bp, Mus musculus
aagcaggccatagacagggccctgg

SEQ ID NO: 2327 - DNA, 25 bp, Mus musculus
aagcaggctccacggaagtgtccct

SEQ ID NO: 2328 - DNA, 25 bp, Mus musculus
aagcaggtcatgaaggtgggccact

SEQ ID NO: 2329 - DNA, 25 bp, Mus musculus
aagcagtacagtgtgcaccgagcaa

SEQ ID NO: 2330 - DNA, 25 bp, Mus musculus
aagcagtcctcgtcctcaaagagca

SEQ ID NO: 2331 - DNA, 25 bp, Mus musculus
aagcagtgcccgtgttgttatgtac

SEQ ID NO: 2332 - DNA, 25 bp, Mus musculus
aagcagtttccaggtgatgagggcc

SEQ ID NO: 2333 - DNA, 25 bp, Mus musculus
aagcatagtaaggtatcggatctca

SEQ ID NO: 2334 - DNA, 25 bp, Mus musculus
aagcatatctccctcctccatgagt

SEQ ID NO: 2335 - DNA, 25 bp, Mus musculus
aagcatatcttactgtcggagcagc

SEQ ID NO: 2336 - DNA, 25 bp, Mus musculus
aagcatctaaagacattcgacaggg

SEQ ID NO: 2337 - DNA, 25 bp, Mus musculus
aagcatctgagagagcccagtgaag

SEQ ID NO: 2338 - DNA, 25 bp, Mus musculus
aagcatgacatgctggacaaggaga

SEQ ID NO: 2339 - DNA, 25 bp, Mus musculus
aagcatgcatcttctattctgccaa

SEQ ID NO: 2340 - DNA, 25 bp, Mus musculus
aagcatgctagtgattcaagttcat

SEQ ID NO: 2341 - DNA, 25 bp, Mus musculus
aagcatggaccctgggtatgggaca

SEQ ID NO: 2342 - DNA, 25 bp, Mus musculus
aagcatggctccaggagtgaaggca

SEQ ID NO: 2343 - DNA, 25 bp, Mus musculus
aagcatggtccagagccaggaggca

SEQ ID NO: 2344 - DNA, 25 bp, Mus musculus
aagcatgtctcagccagcggcgggc

SEQ ID NO: 2345 - DNA, 25 bp, Mus musculus
aagcatgtgattacctttgtatctc

SEQ ID NO: 2346 - DNA, 25 bp, Mus musculus
aagcattccagttgtcctgaggtgc

SEQ ID NO: 2347 - DNA, 25 bp, Mus musculus
aagccaagaaccaggaactggccga

SEQ ID NO: 2348 - DNA, 25 bp, Mus musculus
aagccaatatttcagcagcttattg

SEQ ID NO: 2349 - DNA, 25 bp, Mus musculus
aagccacagtcactgggaactacaa

SEQ ID NO: 2350 - DNA, 25 bp, Mus musculus
aagccacagtcagtgggaactacaa

SEQ ID NO: 2351 - DNA, 25 bp, Mus musculus
aagccacccggattttctcctatgg

SEQ ID NO: 2352 - DNA, 25 bp, Mus musculus
aagccacgttcccttctagacacag

SEQ ID NO: 2353 - DNA, 25 bp, Mus musculus
aagccactgcgcatgtcggacctga

SEQ ID NO: 2354 - DNA, 25 bp, Mus musculus
aagccactgtgtttggtctttggcc

SEQ ID NO: 2355 - DNA, 25 bp, Mus musculus
aagccagaaggcattagacttcctg

SEQ ID NO: 2356 - DNA, 25 bp, Mus musculus
aagccagagccctggtttgtggtag

SEQ ID NO: 2357 - DNA, 25 bp, Mus musculus
aagccagcaactctgggaaagagtc

SEQ ID NO: 2358 - DNA, 25 bp, Mus musculus
aagccagcaagcactctcgagcgca

SEQ ID NO: 2359 - DNA, 25 bp, Mus musculus
aagccagcacccatttggagccatg

SEQ ID NO: 2360 - DNA, 25 bp, Mus musculus
aagccagcccaacccgaaaactgtg

SEQ ID NO: 2361 - DNA, 25 bp, Mus musculus
aagccagcgccgtgagcattccggt

SEQ ID NO: 2362 - DNA, 25 bp, Mus musculus
aagccagctgaagaagctcaaaagc

SEQ ID NO: 2363 - DNA, 25 bp, Mus musculus
aagccagcttacaaccagagaccct

SEQ ID NO: 2364 - DNA, 25 bp, Mus musculus
aagccaggaacctctcagccaatgg

SEQ ID NO: 2365 - DNA, 25 bp, Mus musculus
aagccaggatcctcttgatcaagct

SEQ ID NO: 2366 - DNA, 25 bp, Mus musculus
aagccatcaacctgtcgggaggtga

SEQ ID NO: 2367 - DNA, 25 bp, Mus musculus
aagccatcactcctcagaaggcaac

SEQ ID NO: 2368 - DNA, 25 bp, Mus musculus
aagccatgctgctgcacagagagaa

SEQ ID NO: 2369 - DNA, 25 bp, Mus musculus
aagccattaagggagtatactcatc

SEQ ID NO: 2370 - DNA, 25 bp, Mus musculus
aagcccacagagattttgggccatc

SEQ ID NO: 2371 - DNA, 25 bp, Mus musculus
aagcccagaaagatgcatccatcca

SEQ ID NO: 2372 - DNA, 25 bp, Mus musculus
aagcccagaagaaagctgggtagtt

SEQ ID NO: 2373 - DNA, 25 bp, Mus musculus
aagcccagagtgaaccccaccgtga

SEQ ID NO: 2374 - DNA, 25 bp, Mus musculus
aagcccaggcctacctgtcagtcag

SEQ ID NO: 2375 - DNA, 25 bp, Mus musculus
aagcccagtggaggtgctgttccaa

SEQ ID NO: 2376 - DNA, 25 bp, Mus musculus
aagccccacaacaatcacaatacgt

SEQ ID NO: 2377 - DNA, 25 bp, Mus musculus
aagccccacaactatcacaatacgt

SEQ ID NO: 2378 - DNA, 25 bp, Mus musculus
aagccccggagcacatcgaagagtg

SEQ ID NO: 2379 - DNA, 25 bp, Mus musculus
aagccccggcattcactgtacttca

SEQ ID NO: 2380 - DNA, 25 bp, Mus musculus
aagcccctcagacaatgaactcaca

SEQ ID NO: 2381 - DNA, 25 bp, Mus musculus
aagcccctcctatgattcatctaga

SEQ ID NO: 2382 - DNA, 25 bp, Mus musculus
aagcccgctgctcctctgtgattta

SEQ ID NO: 2383 - DNA, 25 bp, Mus musculus
aagcccgtgagtctcaaggtgtatg

SEQ ID NO: 2384 - DNA, 25 bp, Mus musculus
aagcccgtgagtgtcaaggtgtatg

SEQ ID NO: 2385 - DNA, 25 bp, Mus musculus
aagccctgcaggcacaggattaggc

SEQ ID NO: 2386 - DNA, 25 bp, Mus musculus
aagccctgctaaggcggctggtagc

SEQ ID NO: 2387 - DNA, 25 bp, Mus musculus
aagccctggagaccctcggagtaag

SEQ ID NO: 2388 - DNA, 25 bp, Mus musculus
aagccctgtgcttggcaacattccc

SEQ ID NO: 2389 - DNA, 25 bp, Mus musculus
aagccctgtgtcctatgtgcccaga

SEQ ID NO: 2390 - DNA, 25 bp, Mus musculus
aagccgaagttcgaggacacagagc

SEQ ID NO: 2391 - DNA, 25 bp, Mus musculus
aagccgaccaagaaccagatacaaa

SEQ ID NO: 2392 - DNA, 25 bp, Mus musculus
aagccgactcgcttatgctggctga

SEQ ID NO: 2393 - DNA, 25 bp, Mus musculus
aagccgcagcaacatggatgcccag

SEQ ID NO: 2394 - DNA, 25 bp, Mus musculus
aagccggaatgaagggctccacact

SEQ ID NO: 2395 - DNA, 25 bp, Mus musculus
aagccggatgaaataaccaaagatg

SEQ ID NO: 2396 - DNA, 25 bp, Mus musculus
aagccggcaaggctcccagcaaaac

SEQ ID NO: 2397 - DNA, 25 bp, Mus musculus
aagcctagagtctcacctaaaagtg

SEQ ID NO: 2398 - DNA, 25 bp, Mus musculus
aagcctattccattctttctgcggg

SEQ ID NO: 2399 - DNA, 25 bp, Mus musculus
aagcctcgggatgacaagcctgcct

SEQ ID NO: 2400 - DNA, 25 bp, Mus musculus
aagcctgagatctctgctgtcagac

SEQ ID NO: 2401 - DNA, 25 bp, Mus musculus
aagcctgcctcatcagcttgggtta

SEQ ID NO: 2402 - DNA, 25 bp, Mus musculus
aagcctgcctggaaagacgggtcca

SEQ ID NO: 2403 - DNA, 25 bp, Mus musculus
aagcctgctaccctgcagtttaaaa

SEQ ID NO: 2404 - DNA, 25 bp, Mus musculus
aagcctggttgttcccaccaagcgg

SEQ ID NO: 2405 - DNA, 25 bp, Mus musculus
aagcctgtcatgattgtgatagagt

SEQ ID NO: 2406 - DNA, 25 bp, Mus musculus
aagcctgtccaaagcgtggccctta

SEQ ID NO: 2407 - DNA, 25 bp, Mus musculus
aagcctgtctgcagttttcacaaat

SEQ ID NO: 2408 - DNA, 25 bp, Mus musculus
aagcctgtggcttgaatacccttac

SEQ ID NO: 2409 - DNA, 25 bp, Mus musculus
aagcctgtggtgaggttctggatcc

SEQ ID NO: 2410 - DNA, 25 bp, Mus musculus
aagcctgtggtgtggttctggatcc

SEQ ID NO: 2411 - DNA, 25 bp, Mus musculus
aagccttcaccgatgtggccactgg

SEQ ID NO: 2412 - DNA, 25 bp, Mus musculus
aagccttcagggagatctgccctgc

SEQ ID NO: 2413 - DNA, 25 bp, Mus musculus
aagccttcagggtgatctgccctgc

SEQ ID NO: 2414 - DNA, 25 bp, Mus musculus
aagccttggagcctgagttgcctgc

SEQ ID NO: 2415 - DNA, 25 bp, Mus musculus
aagcctttcgcagagggaccactgg

SEQ ID NO: 2416 - DNA, 25 bp, Mus musculus
aagcctttctcatcagttaagtaca

SEQ ID NO: 2417 - DNA, 25 bp, Mus musculus
aagcctttctgaggccatggaagcc

SEQ ID NO: 2418 - DNA, 25 bp, Mus musculus
aagcctttgctgagctctttcctca

SEQ ID NO: 2419 - DNA, 25 bp, Mus musculus
aagccttttcaagagtacctggagg

SEQ ID NO: 2420 - DNA, 25 bp, Mus musculus
aagcgaaatcagaggagatgtaacc

SEQ ID NO: 2421 - DNA, 25 bp, Mus musculus
aagcgaagggcatcaccatctccac

SEQ ID NO: 2422 - DNA, 25 bp, Mus musculus
aagcgactctcgcagcctgctggag

SEQ ID NO: 2423 - DNA, 25 bp, Mus musculus
aagcgaggcacagcaaggttccgct

SEQ ID NO: 2424 - DNA, 25 bp, Mus musculus
aagcgagtaccacctggtggtgaac

SEQ ID NO: 2425 - DNA, 25 bp, Mus musculus
aagcgagtaccagctggtggtgaac

SEQ ID NO: 2426 - DNA, 25 bp, Mus musculus
aagcgagtgtcatcctcagaaaact

SEQ ID NO: 2427 - DNA, 25 bp, Mus musculus
aagcgatcgatgtgatggcgccctc

SEQ ID NO: 2428 - DNA, 25 bp, Mus musculus
aagcgatggcagtcaccagtgacta

SEQ ID NO: 2429 - DNA, 25 bp, Mus musculus
aagcgattggccagcctctggctct

SEQ ID NO: 2430 - DNA, 25 bp, Mus musculus
aagcgcaagctgaagcgggtccgaa

SEQ ID NO: 2431 - DNA, 25 bp, Mus musculus
aagcgcagtggctcctttagcaaac

SEQ ID NO: 2432 - DNA, 25 bp, Mus musculus
aagcgcatccgagtgaccaccattg

SEQ ID NO: 2433 - DNA, 25 bp, Mus musculus
aagcgcgtggtggacaagaaaagac

SEQ ID NO: 2434 - DNA, 25 bp, Mus musculus
aagcgctgcacgggccgcaaactgg

SEQ ID NO: 2435 - DNA, 25 bp, Mus musculus
aagcgcttccctcacgggattgcct

SEQ ID NO: 2436 - DNA, 25 bp, Mus musculus
aagcggaattccagacagagtcaga

SEQ ID NO: 2437 - DNA, 25 bp, Mus musculus
aagcggcagaaaatacagagagaat

SEQ ID NO: 2438 - DNA, 25 bp, Mus musculus
aagcggctaggatttctgggagtcc

SEQ ID NO: 2439 - DNA, 25 bp, Mus musculus
aagcggctctcaaagtcctctgcca

SEQ ID NO: 2440 - DNA, 25 bp, Mus musculus
aagcggctttcagtcgagctgacca

SEQ ID NO: 2441 - DNA, 25 bp, Mus musculus
aagcggttggcacagcagaacccag

SEQ ID NO: 2442 - DNA, 25 bp, Mus musculus
aagcgtagcaagcccgtcctgggca

SEQ ID NO: 2443 - DNA, 25 bp, Mus musculus
aagcgtcacatgattacccactcag

SEQ ID NO: 2444 - DNA, 25 bp, Mus musculus
aagcgtcttctttccgacgacagaa

SEQ ID NO: 2445 - DNA, 25 bp, Mus musculus
aagcgtcttggcatagcagtgaggc

SEQ ID NO: 2446 - DNA, 25 bp, Mus musculus
aagcgtgaaccaagagacttctgga

SEQ ID NO: 2447 - DNA, 25 bp, Mus musculus
aagcgtgaaccatgagacttctgga

SEQ ID NO: 2448 - DNA, 25 bp, Mus musculus
aagcgtgaagttgatgatttgggcc

SEQ ID NO: 2449 - DNA, 25 bp, Mus musculus
aagcgtgagcatgcccgtcaggacc

SEQ ID NO: 2450 - DNA, 25 bp, Mus musculus
aagcgtgcggcctttgctaacttcg

SEQ ID NO: 2451 - DNA, 25 bp, Mus musculus
aagctaagcagtgacgaggacctgg

SEQ ID NO: 2452 - DNA, 25 bp, Mus musculus
aagctaatgagcgtgtgaaggatgc

SEQ ID NO: 2453 - DNA, 25 bp, Mus musculus
aagctacacccgcatgacaaacgca

SEQ ID NO: 2454 - DNA, 25 bp, Mus musculus
aagctacggttcacagtggataaat

SEQ ID NO: 2455 - DNA, 25 bp, Mus musculus
aagctactacagaggtgcagctggg

SEQ ID NO: 2456 - DNA, 25 bp, Mus musculus
aagctactacagtggtgcagctggg

SEQ ID NO: 2457 - DNA, 25 bp, Mus musculus
aagctaggtcgcgaccacgagctcg

SEQ ID NO: 2458 - DNA, 25 bp, Mus musculus
aagctataagcagcaaagtcatagt

SEQ ID NO: 2459 - DNA, 25 bp, Mus musculus
aagctcaaaggctacaccaactggg

SEQ ID NO: 2460 - DNA, 25 bp, Mus musculus
aagctcaagtgggacctggctgccg

SEQ ID NO: 2461 - DNA, 25 bp, Mus musculus
aagctcacacagtttctcatctgtg

SEQ ID NO: 2462 - DNA, 25 bp, Mus musculus
aagctcacctcggacggagtgggct

SEQ ID NO: 2463 - DNA, 25 bp, Mus musculus
aagctccaagaaagccaaggaccct

SEQ ID NO: 2464 - DNA, 25 bp, Mus musculus
aagctccagtcggatgtggtcgtgc

SEQ ID NO: 2465 - DNA, 25 bp, Mus musculus
aagctccgaatgaggtcccattctg

SEQ ID NO: 2466 - DNA, 25 bp, Mus musculus
aagctcctgttcatggagagttcga

SEQ ID NO: 2467 - DNA, 25 bp, Mus musculus
aagctcctgtttgaagaccttggaa

SEQ ID NO: 2468 - DNA, 25 bp, Mus musculus
aagctcgactacagccgggaccgct

SEQ ID NO: 2469 - DNA, 25 bp, Mus musculus
aagctcgatgtctctgtgaagtcaa

SEQ ID NO: 2470 - DNA, 25 bp, Mus musculus
aagctcgggaagaaggtgatcctcc

SEQ ID NO: 2471 - DNA, 25 bp, Mus musculus
aagctcgggctggttaaatgacttg

SEQ ID NO: 2472 - DNA, 25 bp, Mus musculus
aagctctcgtagactgctataaacc

SEQ ID NO: 2473 - DNA, 25 bp, Mus musculus
aagctctgctgtggagtttcctttg

SEQ ID NO: 2474 - DNA, 25 bp, Mus musculus
aagctctgttgttgccgtcattggc

SEQ ID NO: 2475 - DNA, 25 bp, Mus musculus
aagctgaagcctcaggcacagcctg

SEQ ID NO: 2476 - DNA, 25 bp, Mus musculus
aagctgaagcgggtccgaatctccc

SEQ ID NO: 2477 - DNA, 25 bp, Mus musculus
aagctgaagttcattgaccccaaga

SEQ ID NO: 2478 - DNA, 25 bp, Mus musculus
aagctgacatgttggaatcaatagc

SEQ ID NO: 2479 - DNA, 25 bp, Mus musculus
aagctgagttctactctctcatggg

SEQ ID NO: 2480 - DNA, 25 bp, Mus musculus
aagctgatattggaccctgggcaaa

SEQ ID NO: 2481 - DNA, 25 bp, Mus musculus
aagctgatgacaaacctgaagacca

SEQ ID NO: 2482 - DNA, 25 bp, Mus musculus
aagctgatgcggatctcatcaatgc

SEQ ID NO: 2483 - DNA, 25 bp, Mus musculus
aagctgatggatggctcggagatcc

SEQ ID NO: 2484 - DNA, 25 bp, Mus musculus
aagctgattggctgacgagcagaga

SEQ ID NO: 2485 - DNA, 25 bp, Mus musculus
aagctgatttggacggcccgctctc

SEQ ID NO: 2486 - DNA, 25 bp, Mus musculus
aagctgcagcgctgcaaggagaagt

SEQ ID NO: 2487 - DNA, 25 bp, Mus musculus
aagctgccatggaattcttacaaga

SEQ ID NO: 2488 - DNA, 25 bp, Mus musculus
aagctgccatttgacacgtgtacgg

SEQ ID NO: 2489 - DNA, 25 bp, Mus musculus
aagctgcccagtaacttccataagg

SEQ ID NO: 2490 - DNA, 25 bp, Mus musculus
aagctgcctggactctggagcacaa

SEQ ID NO: 2491 - DNA, 25 bp, Mus musculus
aagctgcctgtgctgattgtgcaga

SEQ ID NO: 2492 - DNA, 25 bp, Mus musculus
aagctgcgggatacccaggaggaac

SEQ ID NO: 2493 - DNA, 25 bp, Mus musculus
aagctgcgttggacacaaaaggaca

SEQ ID NO: 2494 - DNA, 25 bp, Mus musculus
aagctgctcaaagaccgtggcatgg

SEQ ID NO: 2495 - DNA, 25 bp, Mus musculus
aagctgctcagactgcctgctcaca

SEQ ID NO: 2496 - DNA, 25 bp, Mus musculus
aagctgctgatacgatgagatctcc

SEQ ID NO: 2497 - DNA, 25 bp, Mus musculus
aagctgctgtatgagcaagcgatgg

SEQ ID NO: 2498 - DNA, 25 bp, Mus musculus
aagctgcttataagactcacgggca

SEQ ID NO: 2499 - DNA, 25 bp, Mus musculus
aagctgcttgaagggcaagtgatcc

SEQ ID NO: 2500 - DNA, 25 bp, Mus musculus
aagctggaacagatctatgaatgca

SEQ ID NO: 2501 - DNA, 25 bp, Mus musculus
aagctggagttcaacaaggcggaga

SEQ ID NO: 2502 - DNA, 25 bp, Mus musculus
aagctggatgcttccgatgaagagg

SEQ ID NO: 2503 - DNA, 25 bp, Mus musculus
aagctggatgggaaccaggacctta

SEQ ID NO: 2504 - DNA, 25 bp, Mus musculus
aagctggcagtctagcagatgttta

SEQ ID NO: 2505 - DNA, 25 bp, Mus musculus
aagctggctccacaagggacacggt

SEQ ID NO: 2506 - DNA, 25 bp, Mus musculus
aagctggctccagaagggacacggt

SEQ ID NO: 2507 - DNA, 25 bp, Mus musculus
aagctggtgcaccactacatgccgc

SEQ ID NO: 2508 - DNA, 25 bp, Mus musculus
aagctggtgcacgactacatgccgc

SEQ ID NO: 2509 - DNA, 25 bp, Mus musculus
aagctggtgcccttgaaggagacca

SEQ ID NO: 2510 - DNA, 25 bp, Mus musculus
aagctggtggactatgacagtgccc

SEQ ID NO: 2511 - DNA, 25 bp, Mus musculus
aagctgtatgacaaccacctgggca

SEQ ID NO: 2512 - DNA, 25 bp, Mus musculus
aagctgtcctgcacatgccaggtgc

SEQ ID NO: 2513 - DNA, 25 bp, Mus musculus
aagctgtcgggcagcaatccctaca

SEQ ID NO: 2514 - DNA, 25 bp, Mus musculus
aagctgtgccacagtgaaatgtgcc

SEQ ID NO: 2515 - DNA, 25 bp, Mus musculus
aagctgtggcatgtttatttctact

SEQ ID NO: 2516 - DNA, 25 bp, Mus musculus
aagctgtgggcacaatgtctcaccc

SEQ ID NO: 2517 - DNA, 25 bp, Mus musculus
aagctgtgtccctcaagatacagac

SEQ ID NO: 2518 - DNA, 25 bp, Mus musculus
aagctgttccgacattactacgtca

SEQ ID NO: 2519 - DNA, 25 bp, Mus musculus
aagctgttccgtaatctcaccccaa

SEQ ID NO: 2520 - DNA, 25 bp, Mus musculus
aagctgttgctgagctggatgcctc

SEQ ID NO: 2521 - DNA, 25 bp, Mus musculus
aagctgttgtccgacggacgatgga

SEQ ID NO: 2522 - DNA, 25 bp, Mus musculus
aagctgtttacatcgatgagacaag

SEQ ID NO: 2523 - DNA, 25 bp, Mus musculus
aagcttaattaacctcctactgacg

SEQ ID NO: 2524 - DNA, 25 bp, Mus musculus
aagcttactgctgatgccaagtttg

SEQ ID NO: 2525 - DNA, 25 bp, Mus musculus
aagcttatttcagaagtctagggag

SEQ ID NO: 2526 - DNA, 25 bp, Mus musculus
aagcttccagtagaacgatagctcc

SEQ ID NO: 2527 - DNA, 25 bp, Mus musculus
aagcttccattctaaaggtgccagg

SEQ ID NO: 2528 - DNA, 25 bp, Mus musculus
aagcttcccttagctcgggccaaga

SEQ ID NO: 2529 - DNA, 25 bp, Mus musculus
aagcttccggtgaagaatgaatacc

SEQ ID NO: 2530 - DNA, 25 bp, Mus musculus
aagcttcgaggcctctacacaaccg

SEQ ID NO: 2531 - DNA, 25 bp, Mus musculus
aagcttctatttctggaggcctggg

SEQ ID NO: 2532 - DNA, 25 bp, Mus musculus
aagcttggagctgggacaccccact

SEQ ID NO: 2533 - DNA, 25 bp, Mus musculus
aagcttggatctggactctgttgca

SEQ ID NO: 2534 - DNA, 25 bp, Mus musculus
aagctttggacaggcgaattcatgg

SEQ ID NO: 2535 - DNA, 25 bp, Mus musculus
aagctttgtgatggacggtggcacc

SEQ ID NO: 2536 - DNA, 25 bp, Mus musculus
aaggaaaagacagtgtagtcctgca

SEQ ID NO: 2537 - DNA, 25 bp, Mus musculus
aaggaaacattcagtgggagagccg

SEQ ID NO: 2538 - DNA, 25 bp, Mus musculus
aaggaaatacaaggctttttcagct

SEQ ID NO: 2539 - DNA, 25 bp, Mus musculus
aaggaaatctcagtctcctggaggg

SEQ ID NO: 2540 - DNA, 25 bp, Mus musculus
aaggaaattgcagccatacatccgg

SEQ ID NO: 2541 - DNA, 25 bp, Mus musculus
aaggaacaactgtgagtgacaccac

SEQ ID NO: 2542 - DNA, 25 bp, Mus musculus
aaggaacagccagcgggagttgaaa

SEQ ID NO: 2543 - DNA, 25 bp, Mus musculus
aaggaacagctgacccacctggcct

SEQ ID NO: 2544 - DNA, 25 bp, Mus musculus
aaggaacagtacaagaaggagcgaa

SEQ ID NO: 2545 - DNA, 25 bp, Mus musculus
aaggaacccggaaagacatgccagg

SEQ ID NO: 2546 - DNA, 25 bp, Mus musculus
aaggaacgcctcgacttctcctgtg

SEQ ID NO: 2547 - DNA, 25 bp, Mus musculus
aaggaactcctcgtgcctgtagaca

SEQ ID NO: 2548 - DNA, 25 bp, Mus musculus
aaggaagaagacaaatccaaggaca

SEQ ID NO: 2549 - DNA, 25 bp, Mus musculus
aaggaagagaaggaatcagagctct

SEQ ID NO: 2550 - DNA, 25 bp, Mus musculus
aaggaagagagaacacacttgcgat

SEQ ID NO: 2551 - DNA, 25 bp, Mus musculus
aaggaagaggcgctctagcagctcc

SEQ ID NO: 2552 - DNA, 25 bp, Mus musculus
aaggaagctctggtttcagacggag

SEQ ID NO: 2553 - DNA, 25 bp, Mus musculus
aaggaaggagtgctcttattctcca

SEQ ID NO: 2554 - DNA, 25 bp, Mus musculus
aaggaaggtatcagtggctgatcgc

SEQ ID NO: 2555 - DNA, 25 bp, Mus musculus
aaggaaggtcctggaaacacctgca

SEQ ID NO: 2556 - DNA, 25 bp, Mus musculus
aaggaagtcgagttccagcgtgcac

SEQ ID NO: 2557 - DNA, 25 bp, Mus musculus
aaggaagtgcatcttcatacaccac

SEQ ID NO: 2558 - DNA, 25 bp, Mus musculus
aaggaagtggacactccccacgcta

SEQ ID NO: 2559 - DNA, 25 bp, Mus musculus
aaggaatacactcagaagcttgcca

SEQ ID NO: 2560 - DNA, 25 bp, Mus musculus
aaggaatactaccagcccatgcacg

SEQ ID NO: 2561 - DNA, 25 bp, Mus musculus
aaggaatactacgagcccatgcacg

SEQ ID NO: 2562 - DNA, 25 bp, Mus musculus
aaggaatctttgttggtctcagtac

SEQ ID NO: 2563 - DNA, 25 bp, Mus musculus
aaggaatgccttgttcatcaaagtg

SEQ ID NO: 2564 - DNA, 25 bp, Mus musculus
aaggaattttggcattcttcctcca

SEQ ID NO: 2565 - DNA, 25 bp, Mus musculus
aaggacacgactctatggtgaggac

SEQ ID NO: 2566 - DNA, 25 bp, Mus musculus
aaggacatgagtggccattatcaga

SEQ ID NO: 2567 - DNA, 25 bp, Mus musculus
aaggacattgaaaatccacaggcag

SEQ ID NO: 2568 - DNA, 25 bp, Mus musculus
aaggaccacccctcaaatgacctgg

SEQ ID NO: 2569 - DNA, 25 bp, Mus musculus
aaggaccaggacatacaggaacatc

SEQ ID NO: 2570 - DNA, 25 bp, Mus musculus
aaggaccagtctcactgcatggagc

SEQ ID NO: 2571 - DNA, 25 bp, Mus musculus
aaggaccattgctgtcgacttttca

SEQ ID NO: 2572 - DNA, 25 bp, Mus musculus
aaggacccaaacaggagacattcac

SEQ ID NO: 2573 - DNA, 25 bp, Mus musculus
aaggacctatgcgtttcttgtgaac

SEQ ID NO: 2574 - DNA, 25 bp, Mus musculus
aaggacctgagttcacaagagaatt

SEQ ID NO: 2575 - DNA, 25 bp, Mus musculus
aaggacctgtccctggaatatgact

SEQ ID NO: 2576 - DNA, 25 bp, Mus musculus
aaggacctgtccgtggaatatgact

SEQ ID NO: 2577 - DNA, 25 bp, Mus musculus
aaggacctgtctgatctggtatcag

SEQ ID NO: 2578 - DNA, 25 bp, Mus musculus
aaggacgaggctaggaataagcacg

SEQ ID NO: 2579 - DNA, 25 bp, Mus musculus
aaggacgatgggatgctcagcaagc

SEQ ID NO: 2580 - DNA, 25 bp, Mus musculus
aaggacgccggcgtgtgttcagcct

SEQ ID NO: 2581 - DNA, 25 bp, Mus musculus
aaggacgtttcagtgctttgggaat

SEQ ID NO: 2582 - DNA, 25 bp, Mus musculus
aaggactcggagagcgtgaacacca

SEQ ID NO: 2583 - DNA, 25 bp, Mus musculus
aaggactcggagtgcgtgaacacca

SEQ ID NO: 2584 - DNA, 25 bp, Mus musculus
aaggactctacgcttttcgagctca

SEQ ID NO: 2585 - DNA, 25 bp, Mus musculus
aaggactctctccagttgcctctaa

SEQ ID NO: 2586 - DNA, 25 bp, Mus musculus
aaggactgcccttggtatgaccgcg

SEQ ID NO: 2587 - DNA, 25 bp, Mus musculus
aaggactggcattcactgatgtgga

SEQ ID NO: 2588 - DNA, 25 bp, Mus musculus
aaggactggtggacatatgaattct

SEQ ID NO: 2589 - DNA, 25 bp, Mus musculus
aaggacttcaccctgaagctgccct

SEQ ID NO: 2590 - DNA, 25 bp, Mus musculus
aaggacttccgggaccatgctgagc

SEQ ID NO: 2591 - DNA, 25 bp, Mus musculus
aaggacttggctgtgcggttctctg

SEQ ID NO: 2592 - DNA, 25 bp, Mus musculus
aaggagaaccaggatatccggctgc

SEQ ID NO: 2593 - DNA, 25 bp, Mus musculus
aaggagaagtccaaactcgagatga

SEQ ID NO: 2594 - DNA, 25 bp, Mus musculus
aaggagaccattcaggccctccgag

SEQ ID NO: 2595 - DNA, 25 bp, Mus musculus
aaggagacctctggcctgatgctgg

SEQ ID NO: 2596 - DNA, 25 bp, Mus musculus
aaggagatacattcccagcaagtga

SEQ ID NO: 2597 - DNA, 25 bp, Mus musculus
aaggagatgttcctggactacagag

SEQ ID NO: 2598 - DNA, 25 bp, Mus musculus
aaggagcacaacattgtggcaccgt

SEQ ID NO: 2599 - DNA, 25 bp, Mus musculus
aaggagcactatcacctctgcgacg

SEQ ID NO: 2600 - DNA, 25 bp, Mus musculus
aaggagcactatgacctctgcgacg

SEQ ID NO: 2601 - DNA, 25 bp, Mus musculus
aaggagccaaagtctgcctgatgtc

SEQ ID NO: 2602 - DNA, 25 bp, Mus musculus
aaggagcgctttgcagcaaatgccc

SEQ ID NO: 2603 - DNA, 25 bp, Mus musculus
aaggagcgctttttgaaggttccag

SEQ ID NO: 2604 - DNA, 25 bp, Mus musculus
aaggagctatgatggcgattttgtc

SEQ ID NO: 2605 - DNA, 25 bp, Mus musculus
aaggagctatgctaacccatgaaaa

SEQ ID NO: 2606 - DNA, 25 bp, Mus musculus
aaggagctccttgcctctgttactg

SEQ ID NO: 2607 - DNA, 25 bp, Mus musculus
aaggagctcggagaagactctgctt

SEQ ID NO: 2608 - DNA, 25 bp, Mus musculus
aaggagctcttcaatgagaaatacg

SEQ ID NO: 2609 - DNA, 25 bp, Mus musculus
aaggagcttgcagaaatcacgctgg

SEQ ID NO: 2610 - DNA, 25 bp, Mus musculus
aaggagcttgcctctcagcaagaaa

SEQ ID NO: 2611 - DNA, 25 bp, Mus musculus
aaggaggaaacagggcgcaaagtct

SEQ ID NO: 2612 - DNA, 25 bp, Mus musculus
aaggaggacattccaggagcctgca

SEQ ID NO: 2613 - DNA, 25 bp, Mus musculus
aaggaggaccattcatggactagcg

SEQ ID NO: 2614 - DNA, 25 bp, Mus musculus
aaggaggacccctcagtgactccta

SEQ ID NO: 2615 - DNA, 25 bp, Mus musculus
aaggaggagaattccttatagtctg

SEQ ID NO: 2616 - DNA, 25 bp, Mus musculus
aaggaggcagatgtgtcactcacag

SEQ ID NO: 2617 - DNA, 25 bp, Mus musculus
aaggaggcattgatttcccagctga

SEQ ID NO: 2618 - DNA, 25 bp, Mus musculus
aaggaggccatgcatatcttaagga

SEQ ID NO: 2619 - DNA, 25 bp, Mus musculus
aaggaggctatggaacaacagaagg

SEQ ID NO: 2620 - DNA, 25 bp, Mus musculus
aaggagggacatgtatcaacacccc

SEQ ID NO: 2621 - DNA, 25 bp, Mus musculus
aaggagggcaggtagcctttctcca

SEQ ID NO: 2622 - DNA, 25 bp, Mus musculus
aaggaggtcgccttgctcacacggg

SEQ ID NO: 2623 - DNA, 25 bp, Mus musculus
aaggaggtgtatttcatgggcctca

SEQ ID NO: 2624 - DNA, 25 bp, Mus musculus
aaggaggttcgctggccaacgactc

SEQ ID NO: 2625 - DNA, 25 bp, Mus musculus
aaggagtaccaggaggtgatgaact

SEQ ID NO: 2626 - DNA, 25 bp, Mus musculus
aaggagtcatcaggacttcactaca

SEQ ID NO: 2627 - DNA, 25 bp, Mus musculus
aaggagtcccgacagatgcgcctac

SEQ ID NO: 2628 - DNA, 25 bp, Mus musculus
aaggagtcccgagagatgcgcctac

SEQ ID NO: 2629 - DNA, 25 bp, Mus musculus
aaggagtgagttctttctgcactgg

SEQ ID NO: 2630 - DNA, 25 bp, Mus musculus
aaggagtgctcttattctccacagt

SEQ ID NO: 2631 - DNA, 25 bp, Mus musculus
aaggagtgcttctccctgtacgaca

SEQ ID NO: 2632 - DNA, 25 bp, Mus musculus
aaggagtggtgctttggtacaacac

SEQ ID NO: 2633 - DNA, 25 bp, Mus musculus
aaggagtgtacctccctacacaggg

SEQ ID NO: 2634 - DNA, 25 bp, Mus musculus
aaggagttgggcatttctagagtgc

SEQ ID NO: 2635 - DNA, 25 bp, Mus musculus
aaggataaagttcaagaatgtgccc

SEQ ID NO: 2636 - DNA, 25 bp, Mus musculus
aaggatacagcagatcttattcatc

SEQ ID NO: 2637 - DNA, 25 bp, Mus musculus
aaggatacattccagcaactcctgc

SEQ ID NO: 2638 - DNA, 25 bp, Mus musculus
aaggatatggaaattataatagtgc

SEQ ID NO: 2639 - DNA, 25 bp, Mus musculus
aaggatattgccaggagaagcaaaa

SEQ ID NO: 2640 - DNA, 25 bp, Mus musculus
aaggatcaggtgtgtgagtcccagt

SEQ ID NO: 2641 - DNA, 25 bp, Mus musculus
aaggatccatgtgggaccagctaga

SEQ ID NO: 2642 - DNA, 25 bp, Mus musculus
aaggatccctgtggccttctgatag

SEQ ID NO: 2643 - DNA, 25 bp, Mus musculus
aaggatgaacaggagaaagtccggc

SEQ ID NO: 2644 - DNA, 25 bp, Mus musculus
aaggatgagaatgaccctgagctgc

SEQ ID NO: 2645 - DNA, 25 bp, Mus musculus
aaggatgagcaagtccgtgccagca

SEQ ID NO: 2646 - DNA, 25 bp, Mus musculus
aaggatgggactgagaagcgaggcc

SEQ ID NO: 2647 - DNA, 25 bp, Mus musculus
aaggatgtactcatgatctccctga

SEQ ID NO: 2648 - DNA, 25 bp, Mus musculus
aaggatttgaacagcctgtggccgt

SEQ ID NO: 2649 - DNA, 25 bp, Mus musculus
aaggatttggacaatagccaccagt

SEQ ID NO: 2650 - DNA, 25 bp, Mus musculus
aaggcaaactacaggctcatcttgt

SEQ ID NO: 2651 - DNA, 25 bp, Mus musculus
aaggcaagaccctgtccctgaactc

SEQ ID NO: 2652 - DNA, 25 bp, Mus musculus
aaggcaagcatcacctttgagcaca

SEQ ID NO: 2653 - DNA, 25 bp, Mus musculus
aaggcaagcatggtccagagccagg

SEQ ID NO: 2654 - DNA, 25 bp, Mus musculus
aaggcaagctctaagttctattcag

SEQ ID NO: 2655 - DNA, 25 bp, Mus musculus
aaggcacaaacaaagaccctcaaga

SEQ ID NO: 2656 - DNA, 25 bp, Mus musculus
aaggcacagatcaattcctcaatga

SEQ ID NO: 2657 - DNA, 25 bp, Mus musculus
aaggcacgggagtctgggctccctt

SEQ ID NO: 2658 - DNA, 25 bp, Mus musculus
aaggcagacatgtggaaacaaaacc

SEQ ID NO: 2659 - DNA, 25 bp, Mus musculus
aaggcagactcaatcaaaatttgcc

SEQ ID NO: 2660 - DNA, 25 bp, Mus musculus
aaggcagatgtcgtgccaaagactg

SEQ ID NO: 2661 - DNA, 25 bp, Mus musculus
aaggcagcagccgtatatcttgcct

SEQ ID NO: 2662 - DNA, 25 bp, Mus musculus
aaggcagcagcttggtgtcctctgg

SEQ ID NO: 2663 - DNA, 25 bp, Mus musculus
aaggcagcatggagggcttgtccaa

SEQ ID NO: 2664 - DNA, 25 bp, Mus musculus
aaggcagcccagtccgtatgtcatg

SEQ ID NO: 2665 - DNA, 25 bp, Mus musculus
aaggcaggagcctcagaaccaggag

SEQ ID NO: 2666 - DNA, 25 bp, Mus musculus
aaggcagtcttcagcctattatcaa

SEQ ID NO: 2667 - DNA, 25 bp, Mus musculus
aaggcagtgaacagcctcttttcca

SEQ ID NO: 2668 - DNA, 25 bp, Mus musculus
aaggcagttcccatgactcttgcaa

SEQ ID NO: 2669 - DNA, 25 bp, Mus musculus
aaggcatccacactccctgtctgtt

SEQ ID NO: 2670 - DNA, 25 bp, Mus musculus
aaggcatcggacagtgggccttcct

SEQ ID NO: 2671 - DNA, 25 bp, Mus musculus
aaggccaaaaatacgctgacgcagg

SEQ ID NO: 2672 - DNA, 25 bp, Mus musculus
aaggccaagctccatgtgatgcaag

SEQ ID NO: 2673 - DNA, 25 bp, Mus musculus
aaggccacagtgatccggcatggag

SEQ ID NO: 2674 - DNA, 25 bp, Mus musculus
aaggccacggtggacctgaagatct

SEQ ID NO: 2675 - DNA, 25 bp, Mus musculus
aaggccacgtcccagcagtttgaag

SEQ ID NO: 2676 - DNA, 25 bp, Mus musculus
aaggccactatcatccacgctcagt

SEQ ID NO: 2677 - DNA, 25 bp, Mus musculus
aaggccagcacgttcaatatttgat

SEQ ID NO: 2678 - DNA, 25 bp, Mus musculus
aaggccagcagtccacagcccaggt

SEQ ID NO: 2679 - DNA, 25 bp, Mus musculus
aaggccataatatttctgaaggaca

SEQ ID NO: 2680 - DNA, 25 bp, Mus musculus
aaggccatggagaacagcgagtgct

SEQ ID NO: 2681 - DNA, 25 bp, Mus musculus
aaggcccacatctctcaagcagcaa

SEQ ID NO: 2682 - DNA, 25 bp, Mus musculus
aaggcccagagacgccactgtccag

SEQ ID NO: 2683 - DNA, 25 bp, Mus musculus
aaggcccatcgcaatcagtgccagg

SEQ ID NO: 2684 - DNA, 25 bp, Mus musculus
aaggcccatgtgcagacagatttca

SEQ ID NO: 2685 - DNA, 25 bp, Mus musculus
aaggcccatgtggagacagatttca

SEQ ID NO: 2686 - DNA, 25 bp, Mus musculus
aaggcccctgtggtgaaggctaaag

SEQ ID NO: 2687 - DNA, 25 bp, Mus musculus
aaggcccgtgtctttcgctcaaagt

SEQ ID NO: 2688 - DNA, 25 bp, Mus musculus
aaggccgccatttctctgggtctcc

SEQ ID NO: 2689 - DNA, 25 bp, Mus musculus
aaggccggatggtggtgctatccct

SEQ ID NO: 2690 - DNA, 25 bp, Mus musculus
aaggccggtgtcagagatgttctcc

SEQ ID NO: 2691 - DNA, 25 bp, Mus musculus
aaggcctcaggtgctggactcctag

SEQ ID NO: 2692 - DNA, 25 bp, Mus musculus
aaggcctctccacaatgcttgccaa

SEQ ID NO: 2693 - DNA, 25 bp, Mus musculus
aaggcctgcctcatcagcctgggct

SEQ ID NO: 2694 - DNA, 25 bp, Mus musculus
aaggcctgtctcatctctcgcatca

SEQ ID NO: 2695 - DNA, 25 bp, Mus musculus
aaggcgaaggtctccttctccagcc

SEQ ID NO: 2696 - DNA, 25 bp, Mus musculus
aaggcgaagtgcaccaccattgaac

SEQ ID NO: 2697 - DNA, 25 bp, Mus musculus
aaggcgacctccaagatcctggaga

SEQ ID NO: 2698 - DNA, 25 bp, Mus musculus
aaggcgactatctggatgactggac

SEQ ID NO: 2699 - DNA, 25 bp, Mus musculus
aaggcgagttccagattcttcttga

SEQ ID NO: 2700 - DNA, 25 bp, Mus musculus
aaggcgatcattattagcctttgag

SEQ ID NO: 2701 - DNA, 25 bp, Mus musculus
aaggcgatttaccagtgacttctgg

SEQ ID NO: 2702 - DNA, 25 bp, Mus musculus
aaggcgcttctcactcacgactctg

SEQ ID NO: 2703 - DNA, 25 bp, Mus musculus
aaggcgcttgcataccacttgaagg

SEQ ID NO: 2704 - DNA, 25 bp, Mus musculus
aaggcggagcaggagtcccagccaa

SEQ ID NO: 2705 - DNA, 25 bp, Mus musculus
aaggcggcgttcagcacatcagctg

SEQ ID NO: 2706 - DNA, 25 bp, Mus musculus
aaggcgggcatcatggcctcggatt

SEQ ID NO: 2707 - DNA, 25 bp, Mus musculus
aaggcgtgaggagacaaagccgtca

SEQ ID NO: 2708 - DNA, 25 bp, Mus musculus
aaggcgtttgcttcaagagtagata

SEQ ID NO: 2709 - DNA, 25 bp, Mus musculus
aaggctacaccaactgggccatcgg

SEQ ID NO: 2710 - DNA, 25 bp, Mus musculus
aaggctacagcagcaattacagaag

SEQ ID NO: 2711 - DNA, 25 bp, Mus musculus
aaggctcagctaagaaatacgtccc

SEQ ID NO: 2712 - DNA, 25 bp, Mus musculus
aaggctccatattacacagtatgcg

SEQ ID NO: 2713 - DNA, 25 bp, Mus musculus
aaggctcccacaccgcagatttctt

SEQ ID NO: 2714 - DNA, 25 bp, Mus musculus
aaggctccgctgtacctggacgtga

SEQ ID NO: 2715 - DNA, 25 bp, Mus musculus
aaggctcgagtccagcaagttcagg

SEQ ID NO: 2716 - DNA, 25 bp, Mus musculus
aaggctctccgcacggctgcctttg

SEQ ID NO: 2717 - DNA, 25 bp, Mus musculus
aaggctctgggcttccagttccact

SEQ ID NO: 2718 - DNA, 25 bp, Mus musculus
aaggctctttcttgtggatatatca

SEQ ID NO: 2719 - DNA, 25 bp, Mus musculus
aaggctgaaggcctcactggaccgc

SEQ ID NO: 2720 - DNA, 25 bp, Mus musculus
aaggctgacactaacggaccaaggc

SEQ ID NO: 2721 - DNA, 25 bp, Mus musculus
aaggctgacacttacggaccaaggc

SEQ ID NO: 2722 - DNA, 25 bp, Mus musculus
aaggctgacatcaatgcagtgaatg

SEQ ID NO: 2723 - DNA, 25 bp, Mus musculus
aaggctgataatgctgtgaacaaga

SEQ ID NO: 2724 - DNA, 25 bp, Mus musculus
aaggctgctattgaaagagagtatg

SEQ ID NO: 2725 - DNA, 25 bp, Mus musculus
aaggctgctcttgctcttctttctg

SEQ ID NO: 2726 - DNA, 25 bp, Mus musculus
aaggctggaagggatcgatcacaac

SEQ ID NO: 2727 - DNA, 25 bp, Mus musculus
aaggctggagcctcaaatatcgggc

SEQ ID NO: 2728 - DNA, 25 bp, Mus musculus
aaggctggagcctcacgcagccagt

SEQ ID NO: 2729 - DNA, 25 bp, Mus musculus
aaggctggctttgcaggagaccaga

SEQ ID NO: 2730 - DNA, 25 bp, Mus musculus
aaggctgtccctgtaatactcatga

SEQ ID NO: 2731 - DNA, 25 bp, Mus musculus
aaggctgtcgaacccttgtatacag

SEQ ID NO: 2732 - DNA, 25 bp, Mus musculus
aaggctgtggccctccgaagcctct

SEQ ID NO: 2733 - DNA, 25 bp, Mus musculus
aaggctgtggccgtccgaagcctct

SEQ ID NO: 2734 - DNA, 25 bp, Mus musculus
aaggctgtgtccatcagcacagagc

SEQ ID NO: 2735 - DNA, 25 bp, Mus musculus
aaggctgttgaagactatatagatg

SEQ ID NO: 2736 - DNA, 25 bp, Mus musculus
aaggctgtttatttcgttcatccaa

SEQ ID NO: 2737 - DNA, 25 bp, Mus musculus
aaggcttaatgcttccagttctggg

SEQ ID NO: 2738 - DNA, 25 bp, Mus musculus
aaggcttcagcttgggagagaaatt

SEQ ID NO: 2739 - DNA, 25 bp, Mus musculus
aaggcttccatccacgaggcctgga

SEQ ID NO: 2740 - DNA, 25 bp, Mus musculus
aaggcttccccacagtcagattgct

SEQ ID NO: 2741 - DNA, 25 bp, Mus musculus
aaggcttgtggcaggctccttggcc

SEQ ID NO: 2742 - DNA, 25 bp, Mus musculus
aaggctttcagatcagttcggatgg

SEQ ID NO: 2743 - DNA, 25 bp, Mus musculus
aaggctttcctttgggtactgcatt

SEQ ID NO: 2744 - DNA, 25 bp, Mus musculus
aaggctttgctgcagttcatcttcc

SEQ ID NO: 2745 - DNA, 25 bp, Mus musculus
aaggctttgtggctgtgctgtcatc

SEQ ID NO: 2746 - DNA, 25 bp, Mus musculus
aaggcttttggtgtcagctactaga

SEQ ID NO: 2747 - DNA, 25 bp, Mus musculus
aagggaaactgatcatgagatttga

SEQ ID NO: 2748 - DNA, 25 bp, Mus musculus
aagggacaaaggatccatgtgggac

SEQ ID NO: 2749 - DNA, 25 bp, Mus musculus
aagggacaggagtgtgcgttctcac

SEQ ID NO: 2750 - DNA, 25 bp, Mus musculus
aagggaccctgcagttttggctggc

SEQ ID NO: 2751 - DNA, 25 bp, Mus musculus
aagggactgtcctcgttcatgcgcg

SEQ ID NO: 2752 - DNA, 25 bp, Mus musculus
aagggagacctaacagctgaagagg

SEQ ID NO: 2753 - DNA, 25 bp, Mus musculus
aagggagcagacagagcagagcact

SEQ ID NO: 2754 - DNA, 25 bp, Mus musculus
aagggagcagactgagcagagcact

SEQ ID NO: 2755 - DNA, 25 bp, Mus musculus
aagggagctccagaattttgtctgc

SEQ ID NO: 2756 - DNA, 25 bp, Mus musculus
aagggaggagacaggacaagcatta

SEQ ID NO: 2757 - DNA, 25 bp, Mus musculus
aagggagttgcagaaaagcctcatg

SEQ ID NO: 2758 - DNA, 25 bp, Mus musculus
aagggatggcatgctgtgatagaaa

SEQ ID NO: 2759 - DNA, 25 bp, Mus musculus
aagggcaaattagctctttcctcca

SEQ ID NO: 2760 - DNA, 25 bp, Mus musculus
aagggcaaccgtcctgtcatcctca

SEQ ID NO: 2761 - DNA, 25 bp, Mus musculus
aagggcagagccaagacgccagtca

SEQ ID NO: 2762 - DNA, 25 bp, Mus musculus
aagggcagagtctgcagcgacagca

SEQ ID NO: 2763 - DNA, 25 bp, Mus musculus
aagggcagctgaacggtctccagag

SEQ ID NO: 2764 - DNA, 25 bp, Mus musculus
aagggcattctttcagaagcaccgg

SEQ ID NO: 2765 - DNA, 25 bp, Mus musculus
aagggccagccacattctagaagtg

SEQ ID NO: 2766 - DNA, 25 bp, Mus musculus
aagggccagccagattctagaagtg

SEQ ID NO: 2767 - DNA, 25 bp, Mus musculus
aagggccatcacgtgccttgtgtgg

SEQ ID NO: 2768 - DNA, 25 bp, Mus musculus
aagggccatgataggacacaccgac

SEQ ID NO: 2769 - DNA, 25 bp, Mus musculus
aagggccccagtcttccactcttgg

SEQ ID NO: 2770 - DNA, 25 bp, Mus musculus
aagggcctttgttaccatgttggat

SEQ ID NO: 2771 - DNA, 25 bp, Mus musculus
aagggcggtacatgcagggccttaa

SEQ ID NO: 2772 - DNA, 25 bp, Mus musculus
aagggctaccaggaaacggactctg

SEQ ID NO: 2773 - DNA, 25 bp, Mus musculus
aagggcttcacaatcaatgagtaca

SEQ ID NO: 2774 - DNA, 25 bp, Mus musculus
aagggcttcatgtccaacaagcacg

SEQ ID NO: 2775 - DNA, 25 bp, Mus musculus
aagggtcccaagtcggagccaatgt

SEQ ID NO: 2776 - DNA, 25 bp, Mus musculus
aagggtccgtccctttgctgcctca

SEQ ID NO: 2777 - DNA, 25 bp, Mus musculus
aagggtcctcagagagcagtgatga

SEQ ID NO: 2778 - DNA, 25 bp, Mus musculus
aagggtctccatctgtgccttgtat

SEQ ID NO: 2779 - DNA, 25 bp, Mus musculus
aagggtctcctcacactggcttggt

SEQ ID NO: 2780 - DNA, 25 bp, Mus musculus
aaggtaacgttctttcagccagacg

SEQ ID NO: 2781 - DNA, 25 bp, Mus musculus
aaggtaatcctgcttttgtcctgag

SEQ ID NO: 2782 - DNA, 25 bp, Mus musculus
aaggtaccaggtgattgagggcatc

SEQ ID NO: 2783 - DNA, 25 bp, Mus musculus
aaggtactgctctgaggtctcccca

SEQ ID NO: 2784 - DNA, 25 bp, Mus musculus
aaggtagaagatggctgggcccaga

SEQ ID NO: 2785 - DNA, 25 bp, Mus musculus
aaggtatgccctccaggaattgctg

SEQ ID NO: 2786 - DNA, 25 bp, Mus musculus
aaggtattagatatcttggaactgg

SEQ ID NO: 2787 - DNA, 25 bp, Mus musculus
aaggtattagatttcttggaactgg

SEQ ID NO: 2788 - DNA, 25 bp, Mus musculus
aaggtatttctgtccagctgctcca

SEQ ID NO: 2789 - DNA, 25 bp, Mus musculus
aaggtcaagctggagtgcaacccca

SEQ ID NO: 2790 - DNA, 25 bp, Mus musculus
aaggtcagcactaagaggcctcccc

SEQ ID NO: 2791 - DNA, 25 bp, Mus musculus
aaggtcccgctctgcagggagcaga

SEQ ID NO: 2792 - DNA, 25 bp, Mus musculus
aaggtcgcctccttgactgtgtggt

SEQ ID NO: 2793 - DNA, 25 bp, Mus musculus
aaggtcgtctcggagactagaggct

SEQ ID NO: 2794 - DNA, 25 bp, Mus musculus
aaggtctcccggctgtttgcctata

SEQ ID NO: 2795 - DNA, 25 bp, Mus musculus
aaggtctccttctgcttgaagcgca

SEQ ID NO: 2796 - DNA, 25 bp, Mus musculus
aaggtctgccggcaggacagcttcc

SEQ ID NO: 2797 - DNA, 25 bp, Mus musculus
aaggtcttccatctgcaggctgcgt

SEQ ID NO: 2798 - DNA, 25 bp, Mus musculus
aaggtcttcccagtctattttcacg

SEQ ID NO: 2799 - DNA, 25 bp, Mus musculus
aaggtcttccccactagccctagtg

SEQ ID NO: 2800 - DNA, 25 bp, Mus musculus
aaggtcttccttctcttcgccatgg

SEQ ID NO: 2801 - DNA, 25 bp, Mus musculus
aaggtgaactcatccatcctaaggc

SEQ ID NO: 2802 - DNA, 25 bp, Mus musculus
aaggtgaagcagtttgacttcctct

SEQ ID NO: 2803 - DNA, 25 bp, Mus musculus
aaggtgaaggcgactatctggatga

SEQ ID NO: 2804 - DNA, 25 bp, Mus musculus
aaggtgacgactgaagttcttctca

SEQ ID NO: 2805 - DNA, 25 bp, Mus musculus
aaggtgacgtcctctatcttggcca

SEQ ID NO: 2806 - DNA, 25 bp, Mus musculus
aaggtgactctgattctcatagctg

SEQ ID NO: 2807 - DNA, 25 bp, Mus musculus
aaggtgatgcaaaacagcaggcatg

SEQ ID NO: 2808 - DNA, 25 bp, Mus musculus
aaggtgcaagatacaggcttggacc

SEQ ID NO: 2809 - DNA, 25 bp, Mus musculus
aaggtgccgaagtccagggagctca

SEQ ID NO: 2810 - DNA, 25 bp, Mus musculus
aaggtgcctctgatgctggctttcc

SEQ ID NO: 2811 - DNA, 25 bp, Mus musculus
aaggtggcgatggtcacttatttga

SEQ ID NO: 2812 - DNA, 25 bp, Mus musculus
aaggtggctgccttcttcgtggccg

SEQ ID NO: 2813 - DNA, 25 bp, Mus musculus
aaggtgtacctggagccggagcaca

SEQ ID NO: 2814 - DNA, 25 bp, Mus musculus
aaggtgtgatggagttcttattagc

SEQ ID NO: 2815 - DNA, 25 bp, Mus musculus
aaggtgtgccctgtcctcatagacc

SEQ ID NO: 2816 - DNA, 25 bp, Mus musculus
aaggtgtggaacaaccaattccttg

SEQ ID NO: 2817 - DNA, 25 bp, Mus musculus
aaggtgtggaccacctagtgctgac

SEQ ID NO: 2818 - DNA, 25 bp, Mus musculus
aaggtgtggcttccgcaataccgaa

SEQ ID NO: 2819 - DNA, 25 bp, Mus musculus
aaggtgtggcttgcgcaataccgaa

SEQ ID NO: 2820 - DNA, 25 bp, Mus musculus
aaggttacagctccgtggtccaggc

SEQ ID NO: 2821 - DNA, 25 bp, Mus musculus
aaggttacagttagaggcttgtgga

SEQ ID NO: 2822 - DNA, 25 bp, Mus musculus
aaggttctacattccaccgtgtggt

SEQ ID NO: 2823 - DNA, 25 bp, Mus musculus
aaggttctccttggaccgccacaag

SEQ ID NO: 2824 - DNA, 25 bp, Mus musculus
aaggttgcagttatctgtccagaaa

SEQ ID NO: 2825 - DNA, 25 bp, Mus musculus
aaggttgcgcttccacaaagtcaag

SEQ ID NO: 2826 - DNA, 25 bp, Mus musculus
aaggttgggatgacagcttctggaa

SEQ ID NO: 2827 - DNA, 25 bp, Mus musculus
aaggttgtgatctggaatatgtctc

SEQ ID NO: 2828 - DNA, 25 bp, Mus musculus
aaggtttcctctggatgctgccata

SEQ ID NO: 2829 - DNA, 25 bp, Mus musculus
aaggtttggccaaggacatgctgga

SEQ ID NO: 2830 - DNA, 25 bp, Mus musculus
aaggtttggccatggacatgctgga

SEQ ID NO: 2831 - DNA, 25 bp, Mus musculus
aagtaaacaggacactcctgctctg

SEQ ID NO: 2832 - DNA, 25 bp, Mus musculus
aagtaaagaagaaagctgcagtgag

SEQ ID NO: 2833 - DNA, 25 bp, Mus musculus
aagtaaagggccttcggcctctgca

SEQ ID NO: 2834 - DNA, 25 bp, Mus musculus
aagtaaatgaaatcgtggagaccaa

SEQ ID NO: 2835 - DNA, 25 bp, Mus musculus
aagtaacctcagcattgacatagcg

SEQ ID NO: 2836 - DNA, 25 bp, Mus musculus
aagtaacgtgaaagactccagctgc

SEQ ID NO: 2837 - DNA, 25 bp, Mus musculus
aagtaactggttcagcctctgtgcc

SEQ ID NO: 2838 - DNA, 25 bp, Mus musculus
aagtaagaaaggtgcctcctggcct

SEQ ID NO: 2839 - DNA, 25 bp, Mus musculus
aagtaagctgaagccaggaaccaga

SEQ ID NO: 2840 - DNA, 25 bp, Mus musculus
aagtaatcacggcaacagcaaggaa

SEQ ID NO: 2841 - DNA, 25 bp, Mus musculus
aagtaatgatggcttcgtccccacg

SEQ ID NO: 2842 - DNA, 25 bp, Mus musculus
aagtaatgcagcagcagggaagaga

SEQ ID NO: 2843 - DNA, 25 bp, Mus musculus
aagtacaacttctattccaatctcc

SEQ ID NO: 2844 - DNA, 25 bp, Mus musculus
aagtacaagagaagagaactgcccc

SEQ ID NO: 2845 - DNA, 25 bp, Mus musculus
aagtacaaggagctgcggacaccca

SEQ ID NO: 2846 - DNA, 25 bp, Mus musculus
aagtacctaacccatcttggatgca

SEQ ID NO: 2847 - DNA, 25 bp, Mus musculus
aagtacctagccacctcgcaggtgt

SEQ ID NO: 2848 - DNA, 25 bp, Mus musculus
aagtacctgcactgccgtgtatggc

SEQ ID NO: 2849 - DNA, 25 bp, Mus musculus
aagtacgggattctggccgatgccc

SEQ ID NO: 2850 - DNA, 25 bp, Mus musculus
aagtactgggattctgagcatgtat

SEQ ID NO: 2851 - DNA, 25 bp, Mus musculus
aagtactgggccaatttcgcaagaa

SEQ ID NO: 2852 - DNA, 25 bp, Mus musculus
aagtactggtgcaggaatgaggtcc

SEQ ID NO: 2853 - DNA, 25 bp, Mus musculus
aagtacttcaccagttctaccaggg

SEQ ID NO: 2854 - DNA, 25 bp, Mus musculus
aagtagacatgaaacagcccctgat

SEQ ID NO: 2855 - DNA, 25 bp, Mus musculus
aagtagaccagcgtgatctgctccg

SEQ ID NO: 2856 - DNA, 25 bp, Mus musculus
aagtagcacccatgccacgtctggt

SEQ ID NO: 2857 - DNA, 25 bp, Mus musculus
aagtagtagaagtcgccgaagagga

SEQ ID NO: 2858 - DNA, 25 bp, Mus musculus
aagtatccagcgtccacagtacaga

SEQ ID NO: 2859 - DNA, 25 bp, Mus musculus
aagtatccaggcgaggtggacatca

SEQ ID NO: 2860 - DNA, 25 bp, Mus musculus
aagtatccagtgtagccagctcagc

SEQ ID NO: 2861 - DNA, 25 bp, Mus musculus
aagtatcccattggtgtacacacag

SEQ ID NO: 2862 - DNA, 25 bp, Mus musculus
aagtatgaaccccagctccttgcag

SEQ ID NO: 2863 - DNA, 25 bp, Mus musculus
aagtatgcacagatgaagatggagc

SEQ ID NO: 2864 - DNA, 25 bp, Mus musculus
aagtatgcgccctcttagggttggc

SEQ ID NO: 2865 - DNA, 25 bp, Mus musculus
aagtatggatgtgcagtattactgc

SEQ ID NO: 2866 - DNA, 25 bp, Mus musculus
aagtatgtccctgccggctcagagg

SEQ ID NO: 2867 - DNA, 25 bp, Mus musculus
aagtatgttggatgtttgaacacca

SEQ ID NO: 2868 - DNA, 25 bp, Mus musculus
aagtattatgcactgtgtggctttg

SEQ ID NO: 2869 - DNA, 25 bp, Mus musculus
aagtattccacaaggcctcggtgcc

SEQ ID NO: 2870 - DNA, 25 bp, Mus musculus
aagtattccaccagcctctatgcct

SEQ ID NO: 2871 - DNA, 25 bp, Mus musculus
aagtatttatcccagcatggaccag

SEQ ID NO: 2872 - DNA, 25 bp, Mus musculus
aagtcaaacactaagctgatcgaag

SEQ ID NO: 2873 - DNA, 25 bp, Mus musculus
aagtcaacaaaaggctctgttgtcc

SEQ ID NO: 2874 - DNA, 25 bp, Mus musculus
aagtcaactgaaatgaactggcccc

SEQ ID NO: 2875 - DNA, 25 bp, Mus musculus
aagtcaagccgtccagcagctgaag

SEQ ID NO: 2876 - DNA, 25 bp, Mus musculus
aagtcacagctagtaaatggagcca

SEQ ID NO: 2877 - DNA, 25 bp, Mus musculus
aagtcacgacctaaaacttcagcag

SEQ ID NO: 2878 - DNA, 25 bp, Mus musculus
aagtcacgtgacaagagtgatgccc

SEQ ID NO: 2879 - DNA, 25 bp, Mus musculus
aagtcacttattggcccctgctgag

SEQ ID NO: 2880 - DNA, 25 bp, Mus musculus
aagtcagacatatgaaactgaggag

SEQ ID NO: 2881 - DNA, 25 bp, Mus musculus
aagtcagcatccagtggcacagctg

SEQ ID NO: 2882 - DNA, 25 bp, Mus musculus
aagtcagccgcctggtggtgtacgt

SEQ ID NO: 2883 - DNA, 25 bp, Mus musculus
aagtcaggaaagctggacttctgca

SEQ ID NO: 2884 - DNA, 25 bp, Mus musculus
aagtcaggaaatgatgccaccgtcc

SEQ ID NO: 2885 - DNA, 25 bp, Mus musculus
aagtcaggaccaaatgacagaggac

SEQ ID NO: 2886 - DNA, 25 bp, Mus musculus
aagtcaggtcctccctatcagctga

SEQ ID NO: 2887 - DNA, 25 bp, Mus musculus
aagtcaggtcctgcctatcagctga

SEQ ID NO: 2888 - DNA, 25 bp, Mus musculus
aagtcatagccggtgcaagcaaaaa

SEQ ID NO: 2889 - DNA, 25 bp, Mus musculus
aagtcatgtgacctggattctctca

SEQ ID NO: 2890 - DNA, 25 bp, Mus musculus
aagtcattaacaagcactccactga

SEQ ID NO: 2891 - DNA, 25 bp, Mus musculus
aagtccaacattaccatcctgcgtg

SEQ ID NO: 2892 - DNA, 25 bp, Mus musculus
aagtccaacatttccatcctgcgtg

SEQ ID NO: 2893 - DNA, 25 bp, Mus musculus
aagtccaagagctgatagacataag

SEQ ID NO: 2894 - DNA, 25 bp, Mus musculus
aagtccaaggccgaggtggcctgca

SEQ ID NO: 2895 - DNA, 25 bp, Mus musculus
aagtccaccctctgcctgctgtgaa

SEQ ID NO: 2896 - DNA, 25 bp, Mus musculus
aagtccacgaatacctgggctggca

SEQ ID NO: 2897 - DNA, 25 bp, Mus musculus
aagtccagcaggctggttctgagac

SEQ ID NO: 2898 - DNA, 25 bp, Mus musculus
aagtccaggacacagaccgccaagt

SEQ ID NO: 2899 - DNA, 25 bp, Mus musculus
aagtccatgctgtctcttcattgaa

SEQ ID NO: 2900 - DNA, 25 bp, Mus musculus
aagtccattgtgtaccttgtcacca

SEQ ID NO: 2901 - DNA, 25 bp, Mus musculus
aagtcccactcgagcgcatgcgctg

SEQ ID NO: 2902 - DNA, 25 bp, Mus musculus
aagtcccagggcttcgagattccta

SEQ ID NO: 2903 - DNA, 25 bp, Mus musculus
aagtcccgggtgatcttccagctaa

SEQ ID NO: 2904 - DNA, 25 bp, Mus musculus
aagtccctattgctcagtgtctgcc

SEQ ID NO: 2905 - DNA, 25 bp, Mus musculus
aagtccctgcactcttgttctatgg

SEQ ID NO: 2906 - DNA, 25 bp, Mus musculus
aagtccctgtggttcctggcttgtc

SEQ ID NO: 2907 - DNA, 25 bp, Mus musculus
aagtccgcgggcacgccttgtcgtc

SEQ ID NO: 2908 - DNA, 25 bp, Mus musculus
aagtccggcctgtgaagccacgttc

SEQ ID NO: 2909 - DNA, 25 bp, Mus musculus
aagtccgggcacaggatgagaataa

SEQ ID NO: 2910 - DNA, 25 bp, Mus musculus
aagtccgggtcctgctcttcagaag

SEQ ID NO: 2911 - DNA, 25 bp, Mus musculus
aagtcctagaagtttctgaggccct

SEQ ID NO: 2912 - DNA, 25 bp, Mus musculus
aagtcctcagctaccccgagaggtc

SEQ ID NO: 2913 - DNA, 25 bp, Mus musculus
aagtcctcgcggctgcttcacatta

SEQ ID NO: 2914 - DNA, 25 bp, Mus musculus
aagtcctctattgggcagctacttg

SEQ ID NO: 2915 - DNA, 25 bp, Mus musculus
aagtcctgaagaagtatcttgacag

SEQ ID NO: 2916 - DNA, 25 bp, Mus musculus
aagtcctgcttgctgtggaaaagtc

SEQ ID NO: 2917 - DNA, 25 bp, Mus musculus
aagtccttcgcaagccttatgaaaa

SEQ ID NO: 2918 - DNA, 25 bp, Mus musculus
aagtcgaggaaaggccaacaatcct

SEQ ID NO: 2919 - DNA, 25 bp, Mus musculus
aagtcgagttccagcgtgcacctaa

SEQ ID NO: 2920 - DNA, 25 bp, Mus musculus
aagtcgtggccaacgctgctcagga

SEQ ID NO: 2921 - DNA, 25 bp, Mus musculus
aagtcgtggccatcgctgctcagga

SEQ ID NO: 2922 - DNA, 25 bp, Mus musculus
aagtcgtgtccctcctgctcgagaa

SEQ ID NO: 2923 - DNA, 25 bp, Mus musculus
aagtcgtgtttctgtgtctccagga

SEQ ID NO: 2924 - DNA, 25 bp, Mus musculus
aagtctcaactgaactgccttctcc

SEQ ID NO: 2925 - DNA, 25 bp, Mus musculus
aagtctccaagacagtaaagatgca

SEQ ID NO: 2926 - DNA, 25 bp, Mus musculus
aagtctccaggagctgaagtcggtg

SEQ ID NO: 2927 - DNA, 25 bp, Mus musculus
aagtctcccaagtgcagtgactcag

SEQ ID NO: 2928 - DNA, 25 bp, Mus musculus
aagtctctgcccctgaggagggaaa

SEQ ID NO: 2929 - DNA, 25 bp, Mus musculus
aagtctctggtgtttgaggagagca

SEQ ID NO: 2930 - DNA, 25 bp, Mus musculus
aagtctgacggtctgtccactcaca

SEQ ID NO: 2931 - DNA, 25 bp, Mus musculus
aagtctgcaatgaccccaaggtgcc

SEQ ID NO: 2932 - DNA, 25 bp, Mus musculus
aagtctgccggctggagagcacaac

SEQ ID NO: 2933 - DNA, 25 bp, Mus musculus
aagtctgtatactctgtgtgagcct

SEQ ID NO: 2934 - DNA, 25 bp, Mus musculus
aagtctgtcctctccagcggtggct

SEQ ID NO: 2935 - DNA, 25 bp, Mus musculus
aagtcttgccgtcccaacgatgagg

SEQ ID NO: 2936 - DNA, 25 bp, Mus musculus
aagtcttgcggtttttgaatgtggc

SEQ ID NO: 2937 - DNA, 25 bp, Mus musculus
aagtcttggacaggcgaactcagag

SEQ ID NO: 2938 - DNA, 25 bp, Mus musculus
aagtcttttctgctacaatgggtag

SEQ ID NO: 2939 - DNA, 25 bp, Mus musculus
aagtgaaattcacaggcccctaggg

SEQ ID NO: 2940 - DNA, 25 bp, Mus musculus
aagtgaaggcaagaaatggctcaag

SEQ ID NO: 2941 - DNA, 25 bp, Mus musculus
aagtgaataatccaggtggctgcag

SEQ ID NO: 2942 - DNA, 25 bp, Mus musculus
aagtgacgcagacccaaccagagaa

SEQ ID NO: 2943 - DNA, 25 bp, Mus musculus
aagtgactcctctttgtccgaggtg

SEQ ID NO: 2944 - DNA, 25 bp, Mus musculus
aagtgactggccacgctcatgtgct

SEQ ID NO: 2945 - DNA, 25 bp, Mus musculus
aagtgagcaagcacctgctgtgtga

SEQ ID NO: 2946 - DNA, 25 bp, Mus musculus
aagtgagcctcagcaatgctctgcc

SEQ ID NO: 2947 - DNA, 25 bp, Mus musculus
aagtgaggatgcaagcaactcctat

SEQ ID NO: 2948 - DNA, 25 bp, Mus musculus
aagtgagtcgccttgtgatcccagc

SEQ ID NO: 2949 - DNA, 25 bp, Mus musculus
aagtgatccggctggctggcttagc

SEQ ID NO: 2950 - DNA, 25 bp, Mus musculus
aagtgatcttacctgctctggaggg

SEQ ID NO: 2951 - DNA, 25 bp, Mus musculus
aagtgcactgcatatcacccttgct

SEQ ID NO: 2952 - DNA, 25 bp, Mus musculus
aagtgcagcccctgcgccacgaagt

SEQ ID NO: 2953 - DNA, 25 bp, Mus musculus
aagtgcagctggcttcagaattagc

SEQ ID NO: 2954 - DNA, 25 bp, Mus musculus
aagtgcatcttcatacaccaccaca

SEQ ID NO: 2955 - DNA, 25 bp, Mus musculus
aagtgcccttaaccaatgaatcacc

SEQ ID NO: 2956 - DNA, 25 bp, Mus musculus
aagtgcctggtaaccaccagcaacc

SEQ ID NO: 2957 - DNA, 25 bp, Mus musculus
aagtgcgagacttctgcctacctcc

SEQ ID NO: 2958 - DNA, 25 bp, Mus musculus
aagtgctaaaacagttaacagaaga

SEQ ID NO: 2959 - DNA, 25 bp, Mus musculus
aagtgctcagctcccggaaattcca

SEQ ID NO: 2960 - DNA, 25 bp, Mus musculus
aagtgctctgttttgggcagacaag

SEQ ID NO: 2961 - DNA, 25 bp, Mus musculus
aagtgctgaaatagccggagttcgc

SEQ ID NO: 2962 - DNA, 25 bp, Mus musculus
aagtgctgtagatgaggaccggaaa

SEQ ID NO: 2963 - DNA, 25 bp, Mus musculus
aagtgcttagctgtgctccctaaag

SEQ ID NO: 2964 - DNA, 25 bp, Mus musculus
aagtgcttagttcaaaccattcatc

SEQ ID NO: 2965 - DNA, 25 bp, Mus musculus
aagtggaaactgacctggctctgac

SEQ ID NO: 2966 - DNA, 25 bp, Mus musculus
aagtggaggtactgctgagtgaaaa

SEQ ID NO: 2967 - DNA, 25 bp, Mus musculus
aagtggatcagctggagaaagtgct

SEQ ID NO: 2968 - DNA, 25 bp, Mus musculus
aagtggatcaggacaaggaaggcaa

SEQ ID NO: 2969 - DNA, 25 bp, Mus musculus
aagtggatcgcaagactccgccaca

SEQ ID NO: 2970 - DNA, 25 bp, Mus musculus
aagtggatgacctgcctccattgtc

SEQ ID NO: 2971 - DNA, 25 bp, Mus musculus
aagtggcatccacgcttaaacaggt

SEQ ID NO: 2972 - DNA, 25 bp, Mus musculus
aagtggcattgctcagccttggatg

SEQ ID NO: 2973 - DNA, 25 bp, Mus musculus
aagtggccagattttgagctgcccc

SEQ ID NO: 2974 - DNA, 25 bp, Mus musculus
aagtggcctctgcttccgcctaaga

SEQ ID NO: 2975 - DNA, 25 bp, Mus musculus
aagtggctgtggtatggaaacagaa

SEQ ID NO: 2976 - DNA, 25 bp, Mus musculus
aagtgggagacgtgaatccttctca

SEQ ID NO: 2977 - DNA, 25 bp, Mus musculus
aagtgggatttcctactgcatcatg

SEQ ID NO: 2978 - DNA, 25 bp, Mus musculus
aagtgggcgcccacaaagtgatcca

SEQ ID NO: 2979 - DNA, 25 bp, Mus musculus
aagtgggtctgcctattggcttctc

SEQ ID NO: 2980 - DNA, 25 bp, Mus musculus
aagtggtcaaccaagcccctcctat

SEQ ID NO: 2981 - DNA, 25 bp, Mus musculus
aagtggtggaatagcctaagtgatg

SEQ ID NO: 2982 - DNA, 25 bp, Mus musculus
aagtggtgtagtggatcagaccaaa

SEQ ID NO: 2983 - DNA, 25 bp, Mus musculus
aagtggttactgactgctgtgcccc

SEQ ID NO: 2984 - DNA, 25 bp, Mus musculus
aagtggttctactgcggtctgtgga

SEQ ID NO: 2985 - DNA, 25 bp, Mus musculus
aagtggttgctccaaaatcacaaag

SEQ ID NO: 2986 - DNA, 25 bp, Mus musculus
aagtgtccctccgacacagagggtc

SEQ ID NO: 2987 - DNA, 25 bp, Mus musculus
aagtgtccttcgagataccactgca

SEQ ID NO: 2988 - DNA, 25 bp, Mus musculus
aagtgtgtcccattcttttacggcg

SEQ ID NO: 2989 - DNA, 25 bp, Mus musculus
aagtgtgtcctcaccctggctgtgg

SEQ ID NO: 2990 - DNA, 25 bp, Mus musculus
aagtgtgtgccttatgctgtcatcg

SEQ ID NO: 2991 - DNA, 25 bp, Mus musculus
aagtgttccaaatccaggagaccaa

SEQ ID NO: 2992 - DNA, 25 bp, Mus musculus
aagtgttctgagctgcccatcttcc

SEQ ID NO: 2993 - DNA, 25 bp, Mus musculus
aagtgttggcccattcccacctggt

SEQ ID NO: 2994 - DNA, 25 bp, Mus musculus
aagtgttggcgaaccctcaagatgc

SEQ ID NO: 2995 - DNA, 25 bp, Mus musculus
aagtgtttaactggactcactggag

SEQ ID NO: 2996 - DNA, 25 bp, Mus musculus
aagtgtttccggaagtgcatcggga

SEQ ID NO: 2997 - DNA, 25 bp, Mus musculus
aagttaaccctatcggctgtcctgc

SEQ ID NO: 2998 - DNA, 25 bp, Mus musculus
aagttacataagtttgagttggcct

SEQ ID NO: 2999 - DNA, 25 bp, Mus musculus
aagttatggaatactctgggtgtct

SEQ ID NO: 3000 - DNA, 25 bp, Mus musculus
aagttatggtgtgatggctgatgac

SEQ ID NO: 3001 - DNA, 25 bp, Mus musculus
aagttcaagaatgtgcccatccaag

SEQ ID NO: 3002 - DNA, 25 bp, Mus musculus
aagttcaagctctcatgattttaag

SEQ ID NO: 3003 - DNA, 25 bp, Mus musculus
aagttcaaggccctgccttccctgt

SEQ ID NO: 3004 - DNA, 25 bp, Mus musculus
aagttcaccagtactttaatgtggg

SEQ ID NO: 3005 - DNA, 25 bp, Mus musculus
aagttcacctccaagtttgtccgca

SEQ ID NO: 3006 - DNA, 25 bp, Mus musculus
aagttcaggcgtgatactgctttcc

SEQ ID NO: 3007 - DNA, 25 bp, Mus musculus
aagttcagtgaaatggacacacttc

SEQ ID NO: 3008 - DNA, 25 bp, Mus musculus
aagttccacgtggacatctcactca

SEQ ID NO: 3009 - DNA, 25 bp, Mus musculus
aagttccccgtgtgcatccgcgagg

SEQ ID NO: 3010 - DNA, 25 bp, Mus musculus
aagttcctcattgtacgaacgaggg

SEQ ID NO: 3011 - DNA, 25 bp, Mus musculus
aagttcgacagctggaagaacagtt

SEQ ID NO: 3012 - DNA, 25 bp, Mus musculus
aagttcgagaaattcaagccgccat

SEQ ID NO: 3013 - DNA, 25 bp, Mus musculus
aagttctaggcactttcccaaagag

SEQ ID NO: 3014 - DNA, 25 bp, Mus musculus
aagttctaggcagtttcccaaagag

SEQ ID NO: 3015 - DNA, 25 bp, Mus musculus
aagttctcaattctttgtgcctcca

SEQ ID NO: 3016 - DNA, 25 bp, Mus musculus
aagttctcacaatcaaggtcaccaa

SEQ ID NO: 3017 - DNA, 25 bp, Mus musculus
aagttctccgagcacttcagcatcc

SEQ ID NO: 3018 - DNA, 25 bp, Mus musculus
aagttctgacgcctggagccatgga

SEQ ID NO: 3019 - DNA, 25 bp, Mus musculus
aagttctggatcagtcagcccgggc

SEQ ID NO: 3020 - DNA, 25 bp, Mus musculus
aagttctggatctgtcagcccgggc

SEQ ID NO: 3021 - DNA, 25 bp, Mus musculus
aagttcttacaacagagctaatgag

SEQ ID NO: 3022 - DNA, 25 bp, Mus musculus
aagttcttagcggactgctttgcct

SEQ ID NO: 3023 - DNA, 25 bp, Mus musculus
aagttgaacagatggcttttgaccc

SEQ ID NO: 3024 - DNA, 25 bp, Mus musculus
aagttgcagcagaaatcctgggaat

SEQ ID NO: 3025 - DNA, 25 bp, Mus musculus
aagttgcatacatcctcagtctggg

SEQ ID NO: 3026 - DNA, 25 bp, Mus musculus
aagttgctgtttgaagtggagaaaa

SEQ ID NO: 3027 - DNA, 25 bp, Mus musculus
aagttgtgattcatccctggcctcg

SEQ ID NO: 3028 - DNA, 25 bp, Mus musculus
aagttgttacatcgtgttgtggaac

SEQ ID NO: 3029 - DNA, 25 bp, Mus musculus
aagttgttcaagtttatgcagacac

SEQ ID NO: 3030 - DNA, 25 bp, Mus musculus
aagttgttgcaagtgattcttctga

SEQ ID NO: 3031 - DNA, 25 bp, Mus musculus
aagttgttgggctgcaagcagaaga

SEQ ID NO: 3032 - DNA, 25 bp, Mus musculus
aagtttaataggatatggccgaata

SEQ ID NO: 3033 - DNA, 25 bp, Mus musculus
aagtttatgagtgcgaggtcgtccc

SEQ ID NO: 3034 - DNA, 25 bp, Mus musculus
aagtttatgctattcttacccatgg

SEQ ID NO: 3035 - DNA, 25 bp, Mus musculus
aagtttcttcaggatatcctctggg

SEQ ID NO: 3036 - DNA, 25 bp, Mus musculus
aagtttgacatcatcccaaccatga

SEQ ID NO: 3037 - DNA, 25 bp, Mus musculus
aagtttgacccgcagctgctgttcc

SEQ ID NO: 3038 - DNA, 25 bp, Mus musculus
aagtttgacccggagctgctgttcc

SEQ ID NO: 3039 - DNA, 25 bp, Mus musculus
aagtttgactacagggccttcgcag

SEQ ID NO: 3040 - DNA, 25 bp, Mus musculus
aagtttgactacctttttgatagag

SEQ ID NO: 3041 - DNA, 25 bp, Mus musculus
aagtttgactacgtttttgatagag

SEQ ID NO: 3042 - DNA, 25 bp, Mus musculus
aagtttgcagccaatcccaaccaga

SEQ ID NO: 3043 - DNA, 25 bp, Mus musculus
aagtttgggcctcactgacacccga

SEQ ID NO: 3044 - DNA, 25 bp, Mus musculus
aagtttgtcacacagtgctgtcagg

SEQ ID NO: 3045 - DNA, 25 bp, Mus musculus
aagttttctctcacccatccatggg

SEQ ID NO: 3046 - DNA, 25 bp, Mus musculus
aataaaaggacacatgacaatagcc

SEQ ID NO: 3047 - DNA, 25 bp, Mus musculus
aataaaagtggccatcagcaccgtg

SEQ ID NO: 3048 - DNA, 25 bp, Mus musculus
aataaacaaactttcagaccaggca

SEQ ID NO: 3049 - DNA, 25 bp, Mus musculus
aataaacgccttcataccaaaggat

SEQ ID NO: 3050 - DNA, 25 bp, Mus musculus
aataaagaaatctgttaacaggcca

SEQ ID NO: 3051 - DNA, 25 bp, Mus musculus
aataaagagccccaggctctgctgt

SEQ ID NO: 3052 - DNA, 25 bp, Mus musculus
aataaagcgcacagtgggcgaatcc

SEQ ID NO: 3053 - DNA, 25 bp, Mus musculus
aataaagcttgcctccgccttccgg

SEQ ID NO: 3054 - DNA, 25 bp, Mus musculus
aataaaggtggacagcattcttaat

SEQ ID NO: 3055 - DNA, 25 bp, Mus musculus
aataaagttgctgggaatccttgcc

SEQ ID NO: 3056 - DNA, 25 bp, Mus musculus
aataaatattggcttgtcaagaaca

SEQ ID NO: 3057 - DNA, 25 bp, Mus musculus
aataacaatgatgtcaaaccgcagg

SEQ ID NO: 3058 - DNA, 25 bp, Mus musculus
aataacactgtcctggcaacgtggc

SEQ ID NO: 3059 - DNA, 25 bp, Mus musculus
aataacaggccggtcgagtgcagtt

SEQ ID NO: 3060 - DNA, 25 bp, Mus musculus
aataacagttcactcaactctccag

SEQ ID NO: 3061 - DNA, 25 bp, Mus musculus
aataaccaagataatgagcacccct

SEQ ID NO: 3062 - DNA, 25 bp, Mus musculus
aataaccgctggttcaacgggcagg

SEQ ID NO: 3063 - DNA, 25 bp, Mus musculus
aataacgatgtcagcgaggaggcct

SEQ ID NO: 3064 - DNA, 25 bp, Mus musculus
aataacgccaggttcttggacttgc

SEQ ID NO: 3065 - DNA, 25 bp, Mus musculus
aataacgctgctcccactccaagga

SEQ ID NO: 3066 - DNA, 25 bp, Mus musculus
aataacgctgctgccactccaagga

SEQ ID NO: 3067 - DNA, 25 bp, Mus musculus
aataactccgtaccatcagccactg

SEQ ID NO: 3068 - DNA, 25 bp, Mus musculus
aataactccgtagcatcagccactg

SEQ ID NO: 3069 - DNA, 25 bp, Mus musculus
aataactggagatactttgagcaaa

SEQ ID NO: 3070 - DNA, 25 bp, Mus musculus
aataagaaattggtgactcggcctc

SEQ ID NO: 3071 - DNA, 25 bp, Mus musculus
aataagagtcgccagcgtgtgcgct

SEQ ID NO: 3072 - DNA, 25 bp, Mus musculus
aataagcgaaagaaagcccaggcct

SEQ ID NO: 3073 - DNA, 25 bp, Mus musculus
aataagcgtcaggatgtggattctg

SEQ ID NO: 3074 - DNA, 25 bp, Mus musculus
aataaggactctgcttgccccaagg

SEQ ID NO: 3075 - DNA, 25 bp, Mus musculus
aataagtgggcgctaagtcgtggga

SEQ ID NO: 3076 - DNA, 25 bp, Mus musculus
aataagtgggcggtaagtcgtggga

SEQ ID NO: 3077 - DNA, 25 bp, Mus musculus
aataagttattctctcgagcagtcg

SEQ ID NO: 3078 - DNA, 25 bp, Mus musculus
aataataatgagcaaatgtggcagg

SEQ ID NO: 3079 - DNA, 25 bp, Mus musculus
aataatcacgaacagctagttcagc

SEQ ID NO: 3080 - DNA, 25 bp, Mus musculus
aataattacttgcaatgccaacggg

SEQ ID NO: 3081 - DNA, 25 bp, Mus musculus
aataattacttggaatgccaacggg

SEQ ID NO: 3082 - DNA, 25 bp, Mus musculus
aataatttagtaatccactctatgg

SEQ ID NO: 3083 - DNA, 25 bp, Mus musculus
aatacaaggctgacatcaatgcagt

SEQ ID NO: 3084 - DNA, 25 bp, Mus musculus
aatacacaattcaggcattagtttc

SEQ ID NO: 3085 - DNA, 25 bp, Mus musculus
aatacactgacgctgagctgtcctc

SEQ ID NO: 3086 - DNA, 25 bp, Mus musculus
aatacagagaaagctctgacttctg

SEQ ID NO: 3087 - DNA, 25 bp, Mus musculus
aatacagcgctctgggggcatagag

SEQ ID NO: 3088 - DNA, 25 bp, Mus musculus
aatacagggagcatcggagagaatg

SEQ ID NO: 3089 - DNA, 25 bp, Mus musculus
aatacatatgtgtgaagaggaggaa

SEQ ID NO: 3090 - DNA, 25 bp, Mus musculus
aatacatcgttaatcgaggagaaca

SEQ ID NO: 3091 - DNA, 25 bp, Mus musculus
aatacatggacttggaggaattcct

SEQ ID NO: 3092 - DNA, 25 bp, Mus musculus
aatacattagggaactggaacaagc

SEQ ID NO: 3093 - DNA, 25 bp, Mus musculus
aatacattgcacagacacccggaag

SEQ ID NO: 3094 - DNA, 25 bp, Mus musculus
aatacattgtgggtttgtgcatgga

SEQ ID NO: 3095 - DNA, 25 bp, Mus musculus
aataccacaaggatcattaagaagg

SEQ ID NO: 3096 - DNA, 25 bp, Mus musculus
aataccagagtccttccgtgggtca

SEQ ID NO: 3097 - DNA, 25 bp, Mus musculus
aataccaggaatgcccgggacaaag

SEQ ID NO: 3098 - DNA, 25 bp, Mus musculus
aataccagttgtacttcacgcagcc

SEQ ID NO: 3099 - DNA, 25 bp, Mus musculus
aataccattgttgctggaggtctta

SEQ ID NO: 3100 - DNA, 25 bp, Mus musculus
aatacccagatgagctccagtgtgt

SEQ ID NO: 3101 - DNA, 25 bp, Mus musculus
aataccccgggttcagcaaggctct

SEQ ID NO: 3102 - DNA, 25 bp, Mus musculus
aatacccctcagttaaatcgcagct

SEQ ID NO: 3103 - DNA, 25 bp, Mus musculus
aataccgacggcagaaccagcagtc

SEQ ID NO: 3104 - DNA, 25 bp, Mus musculus
aataccgctcctggttggcggagag

SEQ ID NO: 3105 - DNA, 25 bp, Mus musculus
aataccgttctgtatggctactata

SEQ ID NO: 3106 - DNA, 25 bp, Mus musculus
aatacctgtgtattccagcggcaga

SEQ ID NO: 3107 - DNA, 25 bp, Mus musculus
aataccttgtttgagattttggctc

SEQ ID NO: 3108 - DNA, 25 bp, Mus musculus
aatacgaatcccagccaaaccagga

SEQ ID NO: 3109 - DNA, 25 bp, Mus musculus
aatacgaatccctgccaaaccagga

SEQ ID NO: 3110 - DNA, 25 bp, Mus musculus
aatacgagcctcgaaatttgctgca

SEQ ID NO: 3111 - DNA, 25 bp, Mus musculus
aatacgaggagttttcagcaacaaa

SEQ ID NO: 3112 - DNA, 25 bp, Mus musculus
aatacgccaggacagtgtcacccgg

SEQ ID NO: 3113 - DNA, 25 bp, Mus musculus
aatacggaatatcaatcccagcaca

SEQ ID NO: 3114 - DNA, 25 bp, Mus musculus
aatacgggaaccgagtccgcatcag

SEQ ID NO: 3115 - DNA, 25 bp, Mus musculus
aatacgtgtattctaagctgcttgc

SEQ ID NO: 3116 - DNA, 25 bp, Mus musculus
aatactaagggtcttatgcgtcttc

SEQ ID NO: 3117 - DNA, 25 bp, Mus musculus
aatactacaagatccgaagtcaagc

SEQ ID NO: 3118 - DNA, 25 bp, Mus musculus
aatactccgaggctctcaaagatgc

SEQ ID NO: 3119 - DNA, 25 bp, Mus musculus
aatactcgccgaggcgggacctcgg

SEQ ID NO: 3120 - DNA, 25 bp, Mus musculus
aatactcggaaaagaatcttgtgtc

SEQ ID NO: 3121 - DNA, 25 bp, Mus musculus
aatactctgggtgtctgcaagtaca

SEQ ID NO: 3122 - DNA, 25 bp, Mus musculus
aatactgccgcactccatgcactgt

SEQ ID NO: 3123 - DNA, 25 bp, Mus musculus
aatactgccttgtggttcttaatca

SEQ ID NO: 3124 - DNA, 25 bp, Mus musculus
aatagaaattttagcatctccttgg

SEQ ID NO: 3125 - DNA, 25 bp, Mus musculus
aatagagagatgctagacccagaca

SEQ ID NO: 3126 - DNA, 25 bp, Mus musculus
aatagagctgaagcttgagaagagg

SEQ ID NO: 3127 - DNA, 25 bp, Mus musculus
aatagatggcatcgacttatagacg

SEQ ID NO: 3128 - DNA, 25 bp, Mus musculus
aatagcagcgtttacggcctcacag

SEQ ID NO: 3129 - DNA, 25 bp, Mus musculus
aatagcattcctttcgaacaccacg

SEQ ID NO: 3130 - DNA, 25 bp, Mus musculus
aatagccggagttcgctcggagacc

SEQ ID NO: 3131 - DNA, 25 bp, Mus musculus
aatagcgatgtctctggaagttttg

SEQ ID NO: 3132 - DNA, 25 bp, Mus musculus
aataggaaagacactggcagagaag

SEQ ID NO: 3133 - DNA, 25 bp, Mus musculus
aataggcccgtgttcctggacgcca

SEQ ID NO: 3134 - DNA, 25 bp, Mus musculus
aataggttgactggaaatttcaagc

SEQ ID NO: 3135 - DNA, 25 bp, Mus musculus
aataggttgctgcaaacagcagaac

SEQ ID NO: 3136 - DNA, 25 bp, Mus musculus
aatagtaattgtcgtcactgtggcc

SEQ ID NO: 3137 - DNA, 25 bp, Mus musculus
aatagtcttggctacttccctacag

SEQ ID NO: 3138 - DNA, 25 bp, Mus musculus
aatagtgctgcctaaggacctgcag

SEQ ID NO: 3139 - DNA, 25 bp, Mus musculus
aatataaatggtaaccaggcatggt

SEQ ID NO: 3140 - DNA, 25 bp, Mus musculus
aatataagggcaggacggcactggt

SEQ ID NO: 3141 - DNA, 25 bp, Mus musculus
aatataccaggatttccacaggagg

SEQ ID NO: 3142 - DNA, 25 bp, Mus musculus
aatatactgatgcaacttggtgtgc

SEQ ID NO: 3143 - DNA, 25 bp, Mus musculus
aatatcagtttcaacagaaggcgca

SEQ ID NO: 3144 - DNA, 25 bp, Mus musculus
aatatccaactaccgcacacattgt

SEQ ID NO: 3145 - DNA, 25 bp, Mus musculus
aatatccagcaagacaacagtgaag

SEQ ID NO: 3146 - DNA, 25 bp, Mus musculus
aatatccagcctcgccctggatgag

SEQ ID NO: 3147 - DNA, 25 bp, Mus musculus
aatatcccgccccacttacaatggg

SEQ ID NO: 3148 - DNA, 25 bp, Mus musculus
aatatccctgacctgcaaaacccag

SEQ ID NO: 3149 - DNA, 25 bp, Mus musculus
aatatccctgcctctccatttatgc

SEQ ID NO: 3150 - DNA, 25 bp, Mus musculus
aatatcctgaagcagattgacatcc

SEQ ID NO: 3151 - DNA, 25 bp, Mus musculus
aatatcctgaaggagattgacatcc

SEQ ID NO: 3152 - DNA, 25 bp, Mus musculus
aatatccttccaagagtttgtagcc

SEQ ID NO: 3153 - DNA, 25 bp, Mus musculus
aatatcgagccaaaaaactctccag

SEQ ID NO: 3154 - DNA, 25 bp, Mus musculus
aatatcgccaagctgcagctacatg

SEQ ID NO: 3155 - DNA, 25 bp, Mus musculus
aatatcgccggaatcccttctgctt

SEQ ID NO: 3156 - DNA, 25 bp, Mus musculus
aatatcgggccatgagccagtacca

SEQ ID NO: 3157 - DNA, 25 bp, Mus musculus
aatatctcgtgaaatggaagggctg

SEQ ID NO: 3158 - DNA, 25 bp, Mus musculus
aatatctgattcaccatgcgcttgg

SEQ ID NO: 3159 - DNA, 25 bp, Mus musculus
aatatctggtgaggtgacactggaa

SEQ ID NO: 3160 - DNA, 25 bp, Mus musculus
aatatcttctttgggatggtgagca

SEQ ID NO: 3161 - DNA, 25 bp, Mus musculus
aatatcttgaaaggcctggaagaag

SEQ ID NO: 3162 - DNA, 25 bp, Mus musculus
aatatgaagatgtgtccggaagtgg

SEQ ID NO: 3163 - DNA, 25 bp, Mus musculus
aatatgaaggcacacccctgaaatg

SEQ ID NO: 3164 - DNA, 25 bp, Mus musculus
aatatgaatgtagccagactggtat

SEQ ID NO: 3165 - DNA, 25 bp, Mus musculus
aatatgacaggacggcatccctttg

SEQ ID NO: 3166 - DNA, 25 bp, Mus musculus
aatatgacggcgagttttctgcaga

SEQ ID NO: 3167 - DNA, 25 bp, Mus musculus
aatatgagaggaacgggagatatga

SEQ ID NO: 3168 - DNA, 25 bp, Mus musculus
aatatgagtgatgacaaaccctttc

SEQ ID NO: 3169 - DNA, 25 bp, Mus musculus
aatatgcaaggatgatattagttcc

SEQ ID NO: 3170 - DNA, 25 bp, Mus musculus
aatatgcaggataatagtgttcaag

SEQ ID NO: 3171 - DNA, 25 bp, Mus musculus
aatatgcaggattatagtgttcaag

SEQ ID NO: 3172 - DNA, 25 bp, Mus musculus
aatatgctctacatccggcagatgg

SEQ ID NO: 3173 - DNA, 25 bp, Mus musculus
aatatggcagccacctcaactccag

SEQ ID NO: 3174 - DNA, 25 bp, Mus musculus
aatatggtcgacctgtgccccaaag

SEQ ID NO: 3175 - DNA, 25 bp, Mus musculus
aatatggtctgaacccacagtgaac

SEQ ID NO: 3176 - DNA, 25 bp, Mus musculus
aatatgtctccagtcctccaggagg

SEQ ID NO: 3177 - DNA, 25 bp, Mus musculus
aatatgttccccatactcctgcgca

SEQ ID NO: 3178 - DNA, 25 bp, Mus musculus
aatattaacagggttgcagcgcagg

SEQ ID NO: 3179 - DNA, 25 bp, Mus musculus
aatattaagaaattcggtcatgcca

SEQ ID NO: 3180 - DNA, 25 bp, Mus musculus
aatattatctttaactcctgcccgg

SEQ ID NO: 3181 - DNA, 25 bp, Mus musculus
aatattatgggctggatacaaaatg

SEQ ID NO: 3182 - DNA, 25 bp, Mus musculus
aatattcctgtagatcaatgttaag

SEQ ID NO: 3183 - DNA, 25 bp, Mus musculus
aatattgaagtgcagctggcttcag

SEQ ID NO: 3184 - DNA, 25 bp, Mus musculus
aatattgggcgccaggttccatcca

SEQ ID NO: 3185 - DNA, 25 bp, Mus musculus
aatatttctgtgactttggccgacc

SEQ ID NO: 3186 - DNA, 25 bp, Mus musculus
aatatttgggctgtacgggcagacc

SEQ ID NO: 3187 - DNA, 25 bp, Mus musculus
aatattttcaagttggcacaaggag

SEQ ID NO: 3188 - DNA, 25 bp, Mus musculus
aatcaaaagcatctctatggaagag

SEQ ID NO: 3189 - DNA, 25 bp, Mus musculus
aatcaaagcaccgaagcctggtcca

SEQ ID NO: 3190 - DNA, 25 bp, Mus musculus
aatcaaatgctatgccccagtaagg

SEQ ID NO: 3191 - DNA, 25 bp, Mus musculus
aatcaaattcaagcaattccaagga

SEQ ID NO: 3192 - DNA, 25 bp, Mus musculus
aatcaacagctgagagaccagcaga

SEQ ID NO: 3193 - DNA, 25 bp, Mus musculus
aatcaagaaaatcaaagtcgtcttc

SEQ ID NO: 3194 - DNA, 25 bp, Mus musculus
aatcaagaaaatgaaagtcgtcttc

SEQ ID NO: 3195 - DNA, 25 bp, Mus musculus
aatcaagaagggaacatcaccttgg

SEQ ID NO: 3196 - DNA, 25 bp, Mus musculus
aatcaagagtgaaaaacctgaagag

SEQ ID NO: 3197 - DNA, 25 bp, Mus musculus
aatcaagctcccttcttcgaataag

SEQ ID NO: 3198 - DNA, 25 bp, Mus musculus
aatcaaggaggatacgggtctgttg

SEQ ID NO: 3199 - DNA, 25 bp, Mus musculus
aatcaagttctgagcagccaccacc

SEQ ID NO: 3200 - DNA, 25 bp, Mus musculus
aatcaatctttccaagaccaggcat

SEQ ID NO: 3201 - DNA, 25 bp, Mus musculus
aatcaatgatggttctgagattcac

SEQ ID NO: 3202 - DNA, 25 bp, Mus musculus
aatcacaatggacagtcttgacctg

SEQ ID NO: 3203 - DNA, 25 bp, Mus musculus
aatcacacagaccagctccacaggt

SEQ ID NO: 3204 - DNA, 25 bp, Mus musculus
aatcacagcgaggttaaacactcgg

SEQ ID NO: 3205 - DNA, 25 bp, Mus musculus
aatcacaggccgatgactgcggtgg

SEQ ID NO: 3206 - DNA, 25 bp, Mus musculus
aatcacaggtttcatattgccagag

SEQ ID NO: 3207 - DNA, 25 bp, Mus musculus
aatcaccagaacaattaccagccct

SEQ ID NO: 3208 - DNA, 25 bp, Mus musculus
aatcactatcagtgacccctgagga

SEQ ID NO: 3209 - DNA, 25 bp, Mus musculus
aatcactgatattgtggtgttacag

SEQ ID NO: 3210 - DNA, 25 bp, Mus musculus
aatcactgcaacaaaccccatttgg

SEQ ID NO: 3211 - DNA, 25 bp, Mus musculus
aatcactgtatccaacggagggcgc

SEQ ID NO: 3212 - DNA, 25 bp, Mus musculus
aatcagaagtgtacagtgcctgcca

SEQ ID NO: 3213 - DNA, 25 bp, Mus musculus
aatcagaagtgttcagtgcctgcca

SEQ ID NO: 3214 - DNA, 25 bp, Mus musculus
aatcagagcgaaccccacattcgtg

SEQ ID NO: 3215 - DNA, 25 bp, Mus musculus
aatcagagcgaagcccacattcgtg

SEQ ID NO: 3216 - DNA, 25 bp, Mus musculus
aatcagagttcaatcagaacaacgg

SEQ ID NO: 3217 - DNA, 25 bp, Mus musculus
aatcagatgcagagtgagcattcgg

SEQ ID NO: 3218 - DNA, 25 bp, Mus musculus
aatcagattctcagctatggagccg

SEQ ID NO: 3219 - DNA, 25 bp, Mus musculus
aatcagcagcctccctgagacagag

SEQ ID NO: 3220 - DNA, 25 bp, Mus musculus
aatcagccagagtgcacagaagcag

SEQ ID NO: 3221 - DNA, 25 bp, Mus musculus
aatcagcgcctccagcagaaagtag

SEQ ID NO: 3222 - DNA, 25 bp, Mus musculus
aatcagcttctgctatatcatcaga

SEQ ID NO: 3223 - DNA, 25 bp, Mus musculus
aatcagcttggtggtgtctttgtca

SEQ ID NO: 3224 - DNA, 25 bp, Mus musculus
aatcaggatctggagttccaaacag

SEQ ID NO: 3225 - DNA, 25 bp, Mus musculus
aatcagggactatttttggaagcca

SEQ ID NO: 3226 - DNA, 25 bp, Mus musculus
aatcagtcaagcctgcaatgctaag

SEQ ID NO: 3227 - DNA, 25 bp, Mus musculus
aatcagtgatttttgaaccagatgc

SEQ ID NO: 3228 - DNA, 25 bp, Mus musculus
aatcagtttggagaatcggagccca

SEQ ID NO: 3229 - DNA, 25 bp, Mus musculus
aatcataaaccacgaggatcctaag

SEQ ID NO: 3230 - DNA, 25 bp, Mus musculus
aatcatagagttaataggaaaccgc

SEQ ID NO: 3231 - DNA, 25 bp, Mus musculus
aatcatatttgtcgactggaaaaag

SEQ ID NO: 3232 - DNA, 25 bp, Mus musculus
aatcatccagacgaaggccctgcag

SEQ ID NO: 3233 - DNA, 25 bp, Mus musculus
aatcatcttcgccttcatggaagtg

SEQ ID NO: 3234 - DNA, 25 bp, Mus musculus
aatcatgactattgtagatgagctg

SEQ ID NO: 3235 - DNA, 25 bp, Mus musculus
aatcatgtcactttctgcagctacc

SEQ ID NO: 3236 - DNA, 25 bp, Mus musculus
aatcatgtgcagttacttccaggag

SEQ ID NO: 3237 - DNA, 25 bp, Mus musculus
aatcattgtcacctaaatggcatag

SEQ ID NO: 3238 - DNA, 25 bp, Mus musculus
aatccacacacctggacaagcttct

SEQ ID NO: 3239 - DNA, 25 bp, Mus musculus
aatccacagaaggagagcaggccgg

SEQ ID NO: 3240 - DNA, 25 bp, Mus musculus
aatccacgcagactgaacttctagg

SEQ ID NO: 3241 - DNA, 25 bp, Mus musculus
aatccactccagctggtgtgttgtg

SEQ ID NO: 3242 - DNA, 25 bp, Mus musculus
aatccagatctccatctcctaaaag

SEQ ID NO: 3243 - DNA, 25 bp, Mus musculus
aatccaggcgattgcaattgcttac

SEQ ID NO: 3244 - DNA, 25 bp, Mus musculus
aatccagtctgggaatctgtaagtg

SEQ ID NO: 3245 - DNA, 25 bp, Mus musculus
aatccatcaagctcgggccagtgct

SEQ ID NO: 3246 - DNA, 25 bp, Mus musculus
aatccatgcgtacagccagctgctg

SEQ ID NO: 3247 - DNA, 25 bp, Mus musculus
aatccatgtttcacacgcagatgag

SEQ ID NO: 3248 - DNA, 25 bp, Mus musculus
aatcccaacatttgacacacaaagg

SEQ ID NO: 3249 - DNA, 25 bp, Mus musculus
aatcccaggatccacctgctcagaa

SEQ ID NO: 3250 - DNA, 25 bp, Mus musculus
aatcccagtggcctaggactcattg

SEQ ID NO: 3251 - DNA, 25 bp, Mus musculus
aatcccctttggtacagctcttgtg

SEQ ID NO: 3252 - DNA, 25 bp, Mus musculus
aatccctcaaagagaagcctccaag

SEQ ID NO: 3253 - DNA, 25 bp, Mus musculus
aatccctctgcgcaagttcacatct

SEQ ID NO: 3254 - DNA, 25 bp, Mus musculus
aatccctgccggtgctacagagtga

SEQ ID NO: 3255 - DNA, 25 bp, Mus musculus
aatcccttgtagacccattcctgtg

SEQ ID NO: 3256 - DNA, 25 bp, Mus musculus
aatccgagcagtaccacacactggg

SEQ ID NO: 3257 - DNA, 25 bp, Mus musculus
aatccgaggacttggttttgatgcc

SEQ ID NO: 3258 - DNA, 25 bp, Mus musculus
aatccgggctgaatctggcaccagg

SEQ ID NO: 3259 - DNA, 25 bp, Mus musculus
aatccgtagctctgctgcaatgtgc

SEQ ID NO: 3260 - DNA, 25 bp, Mus musculus
aatcctaaacttctgactctcctga

SEQ ID NO: 3261 - DNA, 25 bp, Mus musculus
aatcctcaaggattcaaccagggcc

SEQ ID NO: 3262 - DNA, 25 bp, Mus musculus
aatcctcagcttcaagaacaaatga

SEQ ID NO: 3263 - DNA, 25 bp, Mus musculus
aatcctccataggaatggcctgtag

SEQ ID NO: 3264 - DNA, 25 bp, Mus musculus
aatcctctggaactggcaatgttgt

SEQ ID NO: 3265 - DNA, 25 bp, Mus musculus
aatcctgaaccgtgtgtgtctgctg

SEQ ID NO: 3266 - DNA, 25 bp, Mus musculus
aatcctgactcttggaatgccccag

SEQ ID NO: 3267 - DNA, 25 bp, Mus musculus
aatcctgagaacttggctaccctgg

SEQ ID NO: 3268 - DNA, 25 bp, Mus musculus
aatcctgagtatggcacacacaggg

SEQ ID NO: 3269 - DNA, 25 bp, Mus musculus
aatcctgcgggtgcaggtgaaccac

SEQ ID NO: 3270 - DNA, 25 bp, Mus musculus
aatcctgctgatggaccctcagaga

SEQ ID NO: 3271 - DNA, 25 bp, Mus musculus
aatcctggaccggatgcgctccttt

SEQ ID NO: 3272 - DNA, 25 bp, Mus musculus
aatcctggagcagtgtagctggcgt

SEQ ID NO: 3273 - DNA, 25 bp, Mus musculus
aatcctgtaagcagcaagaacgaca

SEQ ID NO: 3274 - DNA, 25 bp, Mus musculus
aatcctgtatcagctctggaatgga

SEQ ID NO: 3275 - DNA, 25 bp, Mus musculus
aatcctgtcatgcagtgtcccaaac

SEQ ID NO: 3276 - DNA, 25 bp, Mus musculus
aatcctgtccatgcacttgtctcta

SEQ ID NO: 3277 - DNA, 25 bp, Mus musculus
aatcctgtgacaagcgcaagctgaa

SEQ ID NO: 3278 - DNA, 25 bp, Mus musculus
aatccttaccaaaggacgtatctga

SEQ ID NO: 3279 - DNA, 25 bp, Mus musculus
aatccttcccttattgacagaacca

SEQ ID NO: 3280 - DNA, 25 bp, Mus musculus
aatccttctcccttcgacagagtgt

SEQ ID NO: 3281 - DNA, 25 bp, Mus musculus
aatcgacgccttggccgtggcttac

SEQ ID NO: 3282 - DNA, 25 bp, Mus musculus
aatcgacttcgcagtagtagaccag

SEQ ID NO: 3283 - DNA, 25 bp, Mus musculus
aatcgagaaggtgcgggtcctcaga

SEQ ID NO: 3284 - DNA, 25 bp, Mus musculus
aatcgagtatgactatgaatatggg

SEQ ID NO: 3285 - DNA, 25 bp, Mus musculus
aatcgagttgagcagcaacttcacg

SEQ ID NO: 3286 - DNA, 25 bp, Mus musculus
aatcgcacgtccacaccggtgcgga

SEQ ID NO: 3287 - DNA, 25 bp, Mus musculus
aatcgcctacccagctgtccgagga

SEQ ID NO: 3288 - DNA, 25 bp, Mus musculus
aatcgctgggcgaattgcagaattc

SEQ ID NO: 3289 - DNA, 25 bp, Mus musculus
aatcggacgtcgctctttgtctcgt

SEQ ID NO: 3290 - DNA, 25 bp, Mus musculus
aatcggcgtaattccagtgaggaga

SEQ ID NO: 3291 - DNA, 25 bp, Mus musculus
aatcggctatgctgtgtgccgcgcc

SEQ ID NO: 3292 - DNA, 25 bp, Mus musculus
aatcggctcacaagggattcaaggg

SEQ ID NO: 3293 - DNA, 25 bp, Mus musculus
aatcggtcagaagcctggtgacaag

SEQ ID NO: 3294 - DNA, 25 bp, Mus musculus
aatcgtgaacctgtcagacaaatga

SEQ ID NO: 3295 - DNA, 25 bp, Mus musculus
aatcgtgttgcttcatgtgctgctc

SEQ ID NO: 3296 - DNA, 25 bp, Mus musculus
aatcgttcaattggagcagcagcta

SEQ ID NO: 3297 - DNA, 25 bp, Mus musculus
aatctaacaatgttaggagccatgc

SEQ ID NO: 3298 - DNA, 25 bp, Mus musculus
aatctaagagggatggaggctttaa

SEQ ID NO: 3299 - DNA, 25 bp, Mus musculus
aatctaaggaagaagatgaagtgac

SEQ ID NO: 3300 - DNA, 25 bp, Mus musculus
aatctacagaaaattgccagcctct

SEQ ID NO: 3301 - DNA, 25 bp, Mus musculus
aatctacattgctccctcaggcgtg

SEQ ID NO: 3302 - DNA, 25 bp, Mus musculus
aatctactccctgaaggcaaaatga

SEQ ID NO: 3303 - DNA, 25 bp, Mus musculus
aatctcaaagcgaggtcaccggctc

SEQ ID NO: 3304 - DNA, 25 bp, Mus musculus
aatctcccagccaagccagctgaag

SEQ ID NO: 3305 - DNA, 25 bp, Mus musculus
aatctcccgaggagctgtatacttc

SEQ ID NO: 3306 - DNA, 25 bp, Mus musculus
aatctcctgtaatcctaaacttctg

SEQ ID NO: 3307 - DNA, 25 bp, Mus musculus
aatctccttattggaacatgggaag

SEQ ID NO: 3308 - DNA, 25 bp, Mus musculus
aatctctacgaaggtcatgaacatc

SEQ ID NO: 3309 - DNA, 25 bp, Mus musculus
aatctctgcgtgacagagctcggcg

SEQ ID NO: 3310 - DNA, 25 bp, Mus musculus
aatctctggattggtcgtgtcgccg

SEQ ID NO: 3311 - DNA, 25 bp, Mus musculus
aatctctgtgtactgcacacccact

SEQ ID NO: 3312 - DNA, 25 bp, Mus musculus
aatctcttccggagtcccagaatca

SEQ ID NO: 3313 - DNA, 25 bp, Mus musculus
aatctgaagcaggtagagcaagccc

SEQ ID NO: 3314 - DNA, 25 bp, Mus musculus
aatctgaagcctgcaaagatgcggg

SEQ ID NO: 3315 - DNA, 25 bp, Mus musculus
aatctgaagtcacactggcctaggg

SEQ ID NO: 3316 - DNA, 25 bp, Mus musculus
aatctgagtccactcagaaggccga

SEQ ID NO: 3317 - DNA, 25 bp, Mus musculus
aatctgcaggtggagtatgagcagc

SEQ ID NO: 3318 - DNA, 25 bp, Mus musculus
aatctgcagtgatgcttgagcctcg

SEQ ID NO: 3319 - DNA, 25 bp, Mus musculus
aatctgccgggatcacaagttgcat

SEQ ID NO: 3320 - DNA, 25 bp, Mus musculus
aatctgctcccagttgtgctctgct

SEQ ID NO: 3321 - DNA, 25 bp, Mus musculus
aatctgctgcaaggacaagtgtcag

SEQ ID NO: 3322 - DNA, 25 bp, Mus musculus
aatctggaacttgaacttttgaagc

SEQ ID NO: 3323 - DNA, 25 bp, Mus musculus
aatctggctgataaacaaggacctg

SEQ ID NO: 3324 - DNA, 25 bp, Mus musculus
aatctgggtctttctaaaaactgct

SEQ ID NO: 3325 - DNA, 25 bp, Mus musculus
aatcttatctcaagaggattttcca

SEQ ID NO: 3326 - DNA, 25 bp, Mus musculus
aatcttcaaagccaaccacccgatg

SEQ ID NO: 3327 - DNA, 25 bp, Mus musculus
aatcttcgaaggactcctcgaagcg

SEQ ID NO: 3328 - DNA, 25 bp, Mus musculus
aatcttctattacgtttttctccag

SEQ ID NO: 3329 - DNA, 25 bp, Mus musculus
aatcttctggtcacttcctgtcatg

SEQ ID NO: 3330 - DNA, 25 bp, Mus musculus
aatcttgattcctgttgccggcctg

SEQ ID NO: 3331 - DNA, 25 bp, Mus musculus
aatcttgcttgatgtctcatgttcc

SEQ ID NO: 3332 - DNA, 25 bp, Mus musculus
aatcttgcttgcatcatcagttcat

SEQ ID NO: 3333 - DNA, 25 bp, Mus musculus
aatcttgcttgcttcatcagttcat

SEQ ID NO: 3334 - DNA, 25 bp, Mus musculus
aatcttggatccagaaatgtgacag

SEQ ID NO: 3335 - DNA, 25 bp, Mus musculus
aatcttgtcctaggaagaaagggag

SEQ ID NO: 3336 - DNA, 25 bp, Mus musculus
aatctttctgcatccagtttgaaga

SEQ ID NO: 3337 - DNA, 25 bp, Mus musculus
aatctttctggaatacctgtcctcc

SEQ ID NO: 3338 - DNA, 25 bp, Mus musculus
aatctttgcagacctgatagtcttg

SEQ ID NO: 3339 - DNA, 25 bp, Mus musculus
aatctttgcccggagactgctgaag

SEQ ID NO: 3340 - DNA, 25 bp, Mus musculus
aatgaaacactgctccaaaattcag

SEQ ID NO: 3341 - DNA, 25 bp, Mus musculus
aatgaaacggaggaagcaagatgaa

SEQ ID NO: 3342 - DNA, 25 bp, Mus musculus
aatgaaagatgcctactatcagact

SEQ ID NO: 3343 - DNA, 25 bp, Mus musculus
aatgaaagtgagcaagcacctgctg

SEQ ID NO: 3344 - DNA, 25 bp, Mus musculus
aatgaaatcagctgtggcgcccgtt

SEQ ID NO: 3345 - DNA, 25 bp, Mus musculus
aatgaaatctacattgctccctcag

SEQ ID NO: 3346 - DNA, 25 bp, Mus musculus
aatgaaatggagacatttggtgcaa

SEQ ID NO: 3347 - DNA, 25 bp, Mus musculus
aatgaaatgggagttcactagctgg

SEQ ID NO: 3348 - DNA, 25 bp, Mus musculus
aatgaacacgaaagctctgagtctg

SEQ ID NO: 3349 - DNA, 25 bp, Mus musculus
aatgaacatagtcaacttccccact

SEQ ID NO: 3350 - DNA, 25 bp, Mus musculus
aatgaaccacagaatgagataatcc

SEQ ID NO: 3351 - DNA, 25 bp, Mus musculus
aatgaagaagagcatgatgccccag

SEQ ID NO: 3352 - DNA, 25 bp, Mus musculus
aatgaagaagaggatgatgccccag

SEQ ID NO: 3353 - DNA, 25 bp, Mus musculus
aatgaagacacccaggatgagctgg

SEQ ID NO: 3354 - DNA, 25 bp, Mus musculus
aatgaagaggaaattgtgcattccc

SEQ ID NO: 3355 - DNA, 25 bp, Mus musculus
aatgaagaggaagctgagtgccaga

SEQ ID NO: 3356 - DNA, 25 bp, Mus musculus
aatgaagagttctcaaaggaaaagt

SEQ ID NO: 3357 - DNA, 25 bp, Mus musculus
aatgaagatgtatcaatgcacggcc

SEQ ID NO: 3358 - DNA, 25 bp, Mus musculus
aatgaagcactctcctgatctaatg

SEQ ID NO: 3359 - DNA, 25 bp, Mus musculus
aatgaagccaggtcggccctgctgc

SEQ ID NO: 3360 - DNA, 25 bp, Mus musculus
aatgaagcccggaaatacgttcgca

SEQ ID NO: 3361 - DNA, 25 bp, Mus musculus
aatgaagcctggcatggctcctgct

SEQ ID NO: 3362 - DNA, 25 bp, Mus musculus
aatgaagcggcagaaaatacagaga

SEQ ID NO: 3363 - DNA, 25 bp, Mus musculus
aatgaaggactgatgtggcctgagc

SEQ ID NO: 3364 - DNA, 25 bp, Mus musculus
aatgaaggatgacagctacgcacca

SEQ ID NO: 3365 - DNA, 25 bp, Mus musculus
aatgaatttaatcccctttgtggag

SEQ ID NO: 3366 - DNA, 25 bp, Mus musculus
aatgacaagcgtaaaaagaacctct

SEQ ID NO: 3367 - DNA, 25 bp, Mus musculus
aatgacacggagaccgactccttgg

SEQ ID NO: 3368 - DNA, 25 bp, Mus musculus
aatgacagcgagcagtttgcagccc

SEQ ID NO: 3369 - DNA, 25 bp, Mus musculus
aatgacagctgcctacatctgaaac

SEQ ID NO: 3370 - DNA, 25 bp, Mus musculus
aatgacagtcgattaggaacccacg

SEQ ID NO: 3371 - DNA, 25 bp, Mus musculus
aatgacatcaccaaaacctgcctgg

SEQ ID NO: 3372 - DNA, 25 bp, Mus musculus
aatgacatcactcccttacacgttg

SEQ ID NO: 3373 - DNA, 25 bp, Mus musculus
aatgacatgattttcctggttagaa

SEQ ID NO: 3374 - DNA, 25 bp, Mus musculus
aatgacatggatagtttaacctcag

SEQ ID NO: 3375 - DNA, 25 bp, Mus musculus
aatgacatggattgtttaacctcag

SEQ ID NO: 3376 - DNA, 25 bp, Mus musculus
aatgaccaatcagatgggtggagca

SEQ ID NO: 3377 - DNA, 25 bp, Mus musculus
aatgaccatgcgatacctgcctgag

SEQ ID NO: 3378 - DNA, 25 bp, Mus musculus
aatgaccatggaatctggagcagac

SEQ ID NO: 3379 - DNA, 25 bp, Mus musculus
aatgacccgcccactttagaaactg

SEQ ID NO: 3380 - DNA, 25 bp, Mus musculus
aatgacctcattactcgaaacacag

SEQ ID NO: 3381 - DNA, 25 bp, Mus musculus
aatgacctgactaacttcactagtg

SEQ ID NO: 3382 - DNA, 25 bp, Mus musculus
aatgacctgatgttactacgcctca

SEQ ID NO: 3383 - DNA, 25 bp, Mus musculus
aatgacctgcttcaagggactgtgg

SEQ ID NO: 3384 - DNA, 25 bp, Mus musculus
aatgacgccgactgggacttctgct

SEQ ID NO: 3385 - DNA, 25 bp, Mus musculus
aatgacggacaagtgtttccggaag

SEQ ID NO: 3386 - DNA, 25 bp, Mus musculus
aatgacggatgtgattattgagacc

SEQ ID NO: 3387 - DNA, 25 bp, Mus musculus
aatgacggctctcaggagcgaccct

SEQ ID NO: 3388 - DNA, 25 bp, Mus musculus
aatgacgtgccactgcactgtgtgg

SEQ ID NO: 3389 - DNA, 25 bp, Mus musculus
aatgactcctacatgtcagccaacg

SEQ ID NO: 3390 - DNA, 25 bp, Mus musculus
aatgactgcgattggtgaacaaaca

SEQ ID NO: 3391 - DNA, 25 bp, Mus musculus
aatgactggagcctcagtgatacag

SEQ ID NO: 3392 - DNA, 25 bp, Mus musculus
aatgactgttccctctactctgcct

SEQ ID NO: 3393 - DNA, 25 bp, Mus musculus
aatgagaaaacaggacaacttattc

SEQ ID NO: 3394 - DNA, 25 bp, Mus musculus
aatgagaaagtgacgcagtctgacc

SEQ ID NO: 3395 - DNA, 25 bp, Mus musculus
aatgagacatctccaccgcgaagac

SEQ ID NO: 3396 - DNA, 25 bp, Mus musculus
aatgagaccgccaagtcctactgtg

SEQ ID NO: 3397 - DNA, 25 bp, Mus musculus
aatgagagcaagacaagcggagacc

SEQ ID NO: 3398 - DNA, 25 bp, Mus musculus
aatgagagcgtcttcgtgatgggca

SEQ ID NO: 3399 - DNA, 25 bp, Mus musculus
aatgagatggtgttcaagcggctgc

SEQ ID NO: 3400 - DNA, 25 bp, Mus musculus
aatgagcaaagatactacggaggcg

SEQ ID NO: 3401 - DNA, 25 bp, Mus musculus
aatgagcaccttcgccgacagttcg

SEQ ID NO: 3402 - DNA, 25 bp, Mus musculus
aatgagcagactgtattcaaagctg

SEQ ID NO: 3403 - DNA, 25 bp, Mus musculus
aatgagcagatggaactttgaaggc

SEQ ID NO: 3404 - DNA, 25 bp, Mus musculus
aatgagccagcagcatgccgagtga

SEQ ID NO: 3405 - DNA, 25 bp, Mus musculus
aatgaggacacttactctgggtttc

SEQ ID NO: 3406 - DNA, 25 bp, Mus musculus
aatgaggactgtgccaaagcccaca

SEQ ID NO: 3407 - DNA, 25 bp, Mus musculus
aatgaggatgacagctggaatggca

SEQ ID NO: 3408 - DNA, 25 bp, Mus musculus
aatgaggatgactgctggaatggca

SEQ ID NO: 3409 - DNA, 25 bp, Mus musculus
aatgaggatgatgcaaaggcagcaa

SEQ ID NO: 3410 - DNA, 25 bp, Mus musculus
aatgaggcttgtaattcttgataac

SEQ ID NO: 3411 - DNA, 25 bp, Mus musculus
aatgagggcacctcgggatgtgacc

SEQ ID NO: 3412 - DNA, 25 bp, Mus musculus
aatgagtactcctccatcctggaag

SEQ ID NO: 3413 - DNA, 25 bp, Mus musculus
aatgagtgcatctccgggcaaaacc

SEQ ID NO: 3414 - DNA, 25 bp, Mus musculus
aatgagtgccacttctcgtaaacgg

SEQ ID NO: 3415 - DNA, 25 bp, Mus musculus
aatgagtggcctgatcaagagagga

SEQ ID NO: 3416 - DNA, 25 bp, Mus musculus
aatgagttacaaaggctccaccctg

SEQ ID NO: 3417 - DNA, 25 bp, Mus musculus
aatgagttcctgaactttaagaggc

SEQ ID NO: 3418 - DNA, 25 bp, Mus musculus
aatgatagaataaaagtgtccctct

SEQ ID NO: 3419 - DNA, 25 bp, Mus musculus
aatgatatatcctgcccagaaagct

SEQ ID NO: 3420 - DNA, 25 bp, Mus musculus
aatgatcacccaccgtgggcacggg

SEQ ID NO: 3421 - DNA, 25 bp, Mus musculus
aatgatccacttgtgccgactgccg

SEQ ID NO: 3422 - DNA, 25 bp, Mus musculus
aatgatcctcatcttttacctggtg

SEQ ID NO: 3423 - DNA, 25 bp, Mus musculus
aatgatcggcttgctgtctccaaga

SEQ ID NO: 3424 - DNA, 25 bp, Mus musculus
aatgatctaacagttcaccgggcaa

SEQ ID NO: 3425 - DNA, 25 bp, Mus musculus
aatgatgacacagccgacagggaca

SEQ ID NO: 3426 - DNA, 25 bp, Mus musculus
aatgatgagaaacctgcgcacggta

SEQ ID NO: 3427 - DNA, 25 bp, Mus musculus
aatgatgaggatcatggacctcaga

SEQ ID NO: 3428 - DNA, 25 bp, Mus musculus
aatgatgaggatgatggacctcaga

SEQ ID NO: 3429 - DNA, 25 bp, Mus musculus
aatgatggaaactttgtggaagcca

SEQ ID NO: 3430 - DNA, 25 bp, Mus musculus
aatgatggcaagatctcttttgcag

SEQ ID NO: 3431 - DNA, 25 bp, Mus musculus
aatgatgggcgatttagaccctgca

SEQ ID NO: 3432 - DNA, 25 bp, Mus musculus
aatgattttcattcaggccgcctgc

SEQ ID NO: 3433 - DNA, 25 bp, Mus musculus
aatgcaaaacattcagagaaatcac

SEQ ID NO: 3434 - DNA, 25 bp, Mus musculus
aatgcaaaccaaactcatgaccagg

SEQ ID NO: 3435 - DNA, 25 bp, Mus musculus
aatgcaaagatgaccctgggaatga

SEQ ID NO: 3436 - DNA, 25 bp, Mus musculus
aatgcaaagtccttcgcaagcctta

SEQ ID NO: 3437 - DNA, 25 bp, Mus musculus
aatgcaaatatggtgaagctattgc

SEQ ID NO: 3438 - DNA, 25 bp, Mus musculus
aatgcaaatgtgaacagcttccaga

SEQ ID NO: 3439 - DNA, 25 bp, Mus musculus
aatgcaacactacccggtttgagtt

SEQ ID NO: 3440 - DNA, 25 bp, Mus musculus
aatgcaagttcttccagaaagccaa

SEQ ID NO: 3441 - DNA, 25 bp, Mus musculus
aatgcacaggtggatgttcaattac

SEQ ID NO: 3442 - DNA, 25 bp, Mus musculus
aatgcacatggttcaaaattcccaa

SEQ ID NO: 3443 - DNA, 25 bp, Mus musculus
aatgcaccaaacaaataacgccagg

SEQ ID NO: 3444 - DNA, 25 bp, Mus musculus
aatgcactttataatgtgtctgagc

SEQ ID NO: 3445 - DNA, 25 bp, Mus musculus
aatgcagaaggctggaattccttgt

SEQ ID NO: 3446 - DNA, 25 bp, Mus musculus
aatgcagaatttgagcgacagttcc

SEQ ID NO: 3447 - DNA, 25 bp, Mus musculus
aatgcagaccaatgtttgtcagagg

SEQ ID NO: 3448 - DNA, 25 bp, Mus musculus
aatgcagactatgtcttcactagta

SEQ ID NO: 3449 - DNA, 25 bp, Mus musculus
aatgcagagaagagctcatacctct

SEQ ID NO: 3450 - DNA, 25 bp, Mus musculus
aatgcagagcacgaggcttgtgacc

SEQ ID NO: 3451 - DNA, 25 bp, Mus musculus
aatgcagccgataaagtcaactttg

SEQ ID NO: 3452 - DNA, 25 bp, Mus musculus
aatgcaggaatgagaaaatactttc

SEQ ID NO: 3453 - DNA, 25 bp, Mus musculus
aatgcaggctctgcagtgcgccgct

SEQ ID NO: 3454 - DNA, 25 bp, Mus musculus
aatgcaggtgctccaaactcagtcc

SEQ ID NO: 3455 - DNA, 25 bp, Mus musculus
aatgcatcatggagcctccccaaac

SEQ ID NO: 3456 - DNA, 25 bp, Mus musculus
aatgcatccacaaaaggcggccagg

SEQ ID NO: 3457 - DNA, 25 bp, Mus musculus
aatgcatccagtttagggcagatga

SEQ ID NO: 3458 - DNA, 25 bp, Mus musculus
aatgcatcgcctaagcaaaggaagc

SEQ ID NO: 3459 - DNA, 25 bp, Mus musculus
aatgcatcttaacagaaatacagag

SEQ ID NO: 3460 - DNA, 25 bp, Mus musculus
aatgcatggtccagcatcagtgtgg

SEQ ID NO: 3461 - DNA, 25 bp, Mus musculus
aatgcattggagattactccggacc

SEQ ID NO: 3462 - DNA, 25 bp, Mus musculus
aatgccaagccatgctgctgcacag

SEQ ID NO: 3463 - DNA, 25 bp, Mus musculus
aatgccaccagccacgtatgacggt

SEQ ID NO: 3464 - DNA, 25 bp, Mus musculus
aatgccacgccgtgcgcagtgctgc

SEQ ID NO: 3465 - DNA, 25 bp, Mus musculus
aatgccacggtcctggacctgaaga

SEQ ID NO: 3466 - DNA, 25 bp, Mus musculus
aatgccagcacggataactcagtca

SEQ ID NO: 3467 - DNA, 25 bp, Mus musculus
aatgccagcaggcacgttgtcaccc

SEQ ID NO: 3468 - DNA, 25 bp, Mus musculus
aatgccagcagggacgttgtcaccc

SEQ ID NO: 3469 - DNA, 25 bp, Mus musculus
aatgccaggactaggcctgtgagaa

SEQ ID NO: 3470 - DNA, 25 bp, Mus musculus
aatgccaggacttggcctgtgagaa

SEQ ID NO: 3471 - DNA, 25 bp, Mus musculus
aatgccatcctatccaacccagtgg

SEQ ID NO: 3472 - DNA, 25 bp, Mus musculus
aatgccatcgatccaacggtaccaa

SEQ ID NO: 3473 - DNA, 25 bp, Mus musculus
aatgcccatgactacagccagcagt

SEQ ID NO: 3474 - DNA, 25 bp, Mus musculus
aatgcccatgtcacagaccccagag

SEQ ID NO: 3475 - DNA, 25 bp, Mus musculus
aatgccccgtggagtacactcttac

SEQ ID NO: 3476 - DNA, 25 bp, Mus musculus
aatgccccgtggatcaacttcgctg

SEQ ID NO: 3477 - DNA, 25 bp, Mus musculus
aatgccctctatgatgtgtttctgg

SEQ ID NO: 3478 - DNA, 25 bp, Mus musculus
aatgccctgcacgtgcctcgggatg

SEQ ID NO: 3479 - DNA, 25 bp, Mus musculus
aatgcccttcttctgcctcaaagtg

SEQ ID NO: 3480 - DNA, 25 bp, Mus musculus
aatgcctcctccgagtatgggcggg

SEQ ID NO: 3481 - DNA, 25 bp, Mus musculus
aatgcctgatacaccggagattatg

SEQ ID NO: 3482 - DNA, 25 bp, Mus musculus
aatgcctggccgcttcctcagtgtc

SEQ ID NO: 3483 - DNA, 25 bp, Mus musculus
aatgcctgtgttgaccgcaccacaa

SEQ ID NO: 3484 - DNA, 25 bp, Mus musculus
aatgccttgcagtgggaaatggaat

SEQ ID NO: 3485 - DNA, 25 bp, Mus musculus
aatgcctttgtttagtaaatcacac

SEQ ID NO: 3486 - DNA, 25 bp, Mus musculus
aatgcgagctcttgggcatgttgtc

SEQ ID NO: 3487 - DNA, 25 bp, Mus musculus
aatgcgccaaaattctcctttgaaa

SEQ ID NO: 3488 - DNA, 25 bp, Mus musculus
aatgcgcgcacctctgtcctggcag

SEQ ID NO: 3489 - DNA, 25 bp, Mus musculus
aatgcgctccccaaacagaacagca

SEQ ID NO: 3490 - DNA, 25 bp, Mus musculus
aatgcggaagtggtggccgcctacc

SEQ ID NO: 3491 - DNA, 25 bp, Mus musculus
aatgcggacagggtacgagatgctc

SEQ ID NO: 3492 - DNA, 25 bp, Mus musculus
aatgcgggaactcgcaaatcttgct

SEQ ID NO: 3493 - DNA, 25 bp, Mus musculus
aatgcgggaactggcaaatcttgct

SEQ ID NO: 3494 - DNA, 25 bp, Mus musculus
aatgcggttgccacactagagaaag

SEQ ID NO: 3495 - DNA, 25 bp, Mus musculus
aatgctactgctcgccatcctgctg

SEQ ID NO: 3496 - DNA, 25 bp, Mus musculus
aatgctactgctggccatcctgctg

SEQ ID NO: 3497 - DNA, 25 bp, Mus musculus
aatgctagccacagtgccttcctgc

SEQ ID NO: 3498 - DNA, 25 bp, Mus musculus
aatgctaggtggattgctctttggc

SEQ ID NO: 3499 - DNA, 25 bp, Mus musculus
aatgctccagttccccagggaggca

SEQ ID NO: 3500 - DNA, 25 bp, Mus musculus
aatgctccttttgagttaccgctga

SEQ ID NO: 3501 - DNA, 25 bp, Mus musculus
aatgctctcttggatgttgtctctg

SEQ ID NO: 3502 - DNA, 25 bp, Mus musculus
aatgctgagatgaactacaagaccc

SEQ ID NO: 3503 - DNA, 25 bp, Mus musculus
aatgctgagccggatctcgatgaca

SEQ ID NO: 3504 - DNA, 25 bp, Mus musculus
aatgctgcggtacaggatcctgtcc

SEQ ID NO: 3505 - DNA, 25 bp, Mus musculus
aatgctgcggtagaggatcctgtcc

SEQ ID NO: 3506 - DNA, 25 bp, Mus musculus
aatgctgctgtcagggctgtgaccc

SEQ ID NO: 3507 - DNA, 25 bp, Mus musculus
aatgctgtgaacctgcccctggaac

SEQ ID NO: 3508 - DNA, 25 bp, Mus musculus
aatgctgtggccttttcatatgtcc

SEQ ID NO: 3509 - DNA, 25 bp, Mus musculus
aatgcttgacagtgctgagcgggaa

SEQ ID NO: 3510 - DNA, 25 bp, Mus musculus
aatgcttgccaatctcttctctatg

SEQ ID NO: 3511 - DNA, 25 bp, Mus musculus
aatgctttggtgtctcatttggatg

SEQ ID NO: 3512 - DNA, 25 bp, Mus musculus
aatggaaaatacagtctcaagagtc

SEQ ID NO: 3513 - DNA, 25 bp, Mus musculus
aatggaacaatgtcccaagtacagg

SEQ ID NO: 3514 - DNA, 25 bp, Mus musculus
aatggaaccacaaagggtgagcggc

SEQ ID NO: 3515 - DNA, 25 bp, Mus musculus
aatggaacccctggtagtcagctct

SEQ ID NO: 3516 - DNA, 25 bp, Mus musculus
aatggaacggcggtatcccaaggag

SEQ ID NO: 3517 - DNA, 25 bp, Mus musculus
aatggaagacacagtctctgcccgc

SEQ ID NO: 3518 - DNA, 25 bp, Mus musculus
aatggaagatcttcctggagagaat

SEQ ID NO: 3519 - DNA, 25 bp, Mus musculus
aatggaagcacagcgtggccaccgc

SEQ ID NO: 3520 - DNA, 25 bp, Mus musculus
aatggaagcagtggctcacccagcc

SEQ ID NO: 3521 - DNA, 25 bp, Mus musculus
aatggaatcaaatcacaaatccggg

SEQ ID NO: 3522 - DNA, 25 bp, Mus musculus
aatggacacgctggatcctgacgag

SEQ ID NO: 3523 - DNA, 25 bp, Mus musculus
aatggacagccaaggcattgccggc

SEQ ID NO: 3524 - DNA, 25 bp, Mus musculus
aatggacagccatggcattgccggc

SEQ ID NO: 3525 - DNA, 25 bp, Mus musculus
aatggacctaccaaggccttagtct

SEQ ID NO: 3526 - DNA, 25 bp, Mus musculus
aatggacctacctaggccttagtct

SEQ ID NO: 3527 - DNA, 25 bp, Mus musculus
aatggacttggcagatcttacagag

SEQ ID NO: 3528 - DNA, 25 bp, Mus musculus
aatggagacataagttctttagaac

SEQ ID NO: 3529 - DNA, 25 bp, Mus musculus
aatggagccaataaacactttgcaa

SEQ ID NO: 3530 - DNA, 25 bp, Mus musculus
aatggagcctatgggtacccttaca

SEQ ID NO: 3531 - DNA, 25 bp, Mus musculus
aatggagctacctggtgactcaggc

SEQ ID NO: 3532 - DNA, 25 bp, Mus musculus
aatggagctgcgaccctaccagtgg

SEQ ID NO: 3533 - DNA, 25 bp, Mus musculus
aatggaggcgtgtgctactacatcg

SEQ ID NO: 3534 - DNA, 25 bp, Mus musculus
aatggaggtaaaagctggattggcc

SEQ ID NO: 3535 - DNA, 25 bp, Mus musculus
aatggaggtaaatgctggattggcc

SEQ ID NO: 3536 - DNA, 25 bp, Mus musculus
aatggaggtcccagatactacgtgg

SEQ ID NO: 3537 - DNA, 25 bp, Mus musculus
aatggaggtgagagtttcacagctg

SEQ ID NO: 3538 - DNA, 25 bp, Mus musculus
aatggagtatgtctttgaactggaa

SEQ ID NO: 3539 - DNA, 25 bp, Mus musculus
aatggatacacagcactgcaccagg

SEQ ID NO: 3540 - DNA, 25 bp, Mus musculus
aatggatactctggacagcccaaga

SEQ ID NO: 3541 - DNA, 25 bp, Mus musculus
aatggatcagctttggctctctgcc

SEQ ID NO: 3542 - DNA, 25 bp, Mus musculus
aatggatccagaatatgaagagaaa

SEQ ID NO: 3543 - DNA, 25 bp, Mus musculus
aatggatccctgctgctccagaatg

SEQ ID NO: 3544 - DNA, 25 bp, Mus musculus
aatggatgtacctctggtccagaac

SEQ ID NO: 3545 - DNA, 25 bp, Mus musculus
aatggattcgagtcaaccgcagacc

SEQ ID NO: 3546 - DNA, 25 bp, Mus musculus
aatggattctctaacaactactggg

SEQ ID NO: 3547 - DNA, 25 bp, Mus musculus
aatggattgaatgcactccatcttg

SEQ ID NO: 3548 - DNA, 25 bp, Mus musculus
aatggatttgcctgtcccaccaggc

SEQ ID NO: 3549 - DNA, 25 bp, Mus musculus
aatggatttggcctctttgggatct

SEQ ID NO: 3550 - DNA, 25 bp, Mus musculus
aatggcacacgaaacttccaggact

SEQ ID NO: 3551 - DNA, 25 bp, Mus musculus
aatggcacggcccacctgttcatca

SEQ ID NO: 3552 - DNA, 25 bp, Mus musculus
aatggcacttgctttggattcagaa

SEQ ID NO: 3553 - DNA, 25 bp, Mus musculus
aatggcagcatgtcaacgaccagaa

SEQ ID NO: 3554 - DNA, 25 bp, Mus musculus
aatggcagcatttcacctgtgcaag

SEQ ID NO: 3555 - DNA, 25 bp, Mus musculus
aatggcatcattcggcgggacagtt

SEQ ID NO: 3556 - DNA, 25 bp, Mus musculus
aatggccaattcgttacgaggagaa

SEQ ID NO: 3557 - DNA, 25 bp, Mus musculus
aatggccagagtttttgacagacag

SEQ ID NO: 3558 - DNA, 25 bp, Mus musculus
aatggccagcattttccgagtactg

SEQ ID NO: 3559 - DNA, 25 bp, Mus musculus
aatggccagtacacccaagatctca

SEQ ID NO: 3560 - DNA, 25 bp, Mus musculus
aatggccattgtccatctagaaggg

SEQ ID NO: 3561 - DNA, 25 bp, Mus musculus
aatggcccagctgtgggaatctctg

SEQ ID NO: 3562 - DNA, 25 bp, Mus musculus
aatggccccatgctgcaaagagctt

SEQ ID NO: 3563 - DNA, 25 bp, Mus musculus
aatggccctgtcagcacagtgtgcg

SEQ ID NO: 3564 - DNA, 25 bp, Mus musculus
aatggccctgtggacagtgctcgca

SEQ ID NO: 3565 - DNA, 25 bp, Mus musculus
aatggccgatgcctcaacatagtgc

SEQ ID NO: 3566 - DNA, 25 bp, Mus musculus
aatggccgatgcgtcaacatagtgc

SEQ ID NO: 3567 - DNA, 25 bp, Mus musculus
aatggcctgttttgggctttgatgc

SEQ ID NO: 3568 - DNA, 25 bp, Mus musculus
aatggccttttaaattagcctgcca

SEQ ID NO: 3569 - DNA, 25 bp, Mus musculus
aatggcgaggagagcgtcatcgata

SEQ ID NO: 3570 - DNA, 25 bp, Mus musculus
aatggcgctgcaggatcttggagaa

SEQ ID NO: 3571 - DNA, 25 bp, Mus musculus
aatggcggctgttctcatcactgcg

SEQ ID NO: 3572 - DNA, 25 bp, Mus musculus
aatggcgtttggtgctacgttggat

SEQ ID NO: 3573 - DNA, 25 bp, Mus musculus
aatggctaacgaagctaacccttgc

SEQ ID NO: 3574 - DNA, 25 bp, Mus musculus
aatggctccttgctttgtgaacttt

SEQ ID NO: 3575 - DNA, 25 bp, Mus musculus
aatggctgaccatcaagccccaagg

SEQ ID NO: 3576 - DNA, 25 bp, Mus musculus
aatggctgggacgacctggagtttc

SEQ ID NO: 3577 - DNA, 25 bp, Mus musculus
aatggctggtacatcctgctggtca

SEQ ID NO: 3578 - DNA, 25 bp, Mus musculus
aatggctggttctccattaatcatg

SEQ ID NO: 3579 - DNA, 25 bp, Mus musculus
aatggctttcccaacgagtactggg

SEQ ID NO: 3580 - DNA, 25 bp, Mus musculus
aatggctttccctacgagtactggg

SEQ ID NO: 3581 - DNA, 25 bp, Mus musculus
aatggctttgctgtggtgcgacccc

SEQ ID NO: 3582 - DNA, 25 bp, Mus musculus
aatgggaaacggaagatctggagat

SEQ ID NO: 3583 - DNA, 25 bp, Mus musculus
aatgggaacatccaatgcctgcagg

SEQ ID NO: 3584 - DNA, 25 bp, Mus musculus
aatgggacaccctcttcagtttggc

SEQ ID NO: 3585 - DNA, 25 bp, Mus musculus
aatgggagaggtgtgaccatccagc

SEQ ID NO: 3586 - DNA, 25 bp, Mus musculus
aatgggagatggacacttctgaggc

SEQ ID NO: 3587 - DNA, 25 bp, Mus musculus
aatgggaggacaccagcaaaacgct

SEQ ID NO: 3588 - DNA, 25 bp, Mus musculus
aatgggagggctgattttcgagaac

SEQ ID NO: 3589 - DNA, 25 bp, Mus musculus
aatgggagtctttttctgccaggga

SEQ ID NO: 3590 - DNA, 25 bp, Mus musculus
aatgggataacattgccggtggact

SEQ ID NO: 3591 - DNA, 25 bp, Mus musculus
aatgggatttgtggccagagtccaa

SEQ ID NO: 3592 - DNA, 25 bp, Mus musculus
aatgggccagcctctcaggcctcag

SEQ ID NO: 3593 - DNA, 25 bp, Mus musculus
aatgggcctatcctggccctggacg

SEQ ID NO: 3594 - DNA, 25 bp, Mus musculus
aatgggcctgctccgacttctggtg

SEQ ID NO: 3595 - DNA, 25 bp, Mus musculus
aatgggcgcagacgtgagcctgggc

SEQ ID NO: 3596 - DNA, 25 bp, Mus musculus
aatgggcgtgcctgtgaaatgaatg

SEQ ID NO: 3597 - DNA, 25 bp, Mus musculus
aatgggctacgacttctggtaccag

SEQ ID NO: 3598 - DNA, 25 bp, Mus musculus
aatgggctttggagatcctctctca

SEQ ID NO: 3599 - DNA, 25 bp, Mus musculus
aatgggtataccaagggtgctcgga

SEQ ID NO: 3600 - DNA, 25 bp, Mus musculus
aatgggtccctctttgccttccgag

SEQ ID NO: 3601 - DNA, 25 bp, Mus musculus
aatgggtgactgtgggtgatacctc

SEQ ID NO: 3602 - DNA, 25 bp, Mus musculus
aatgggtgtctagagaggtgcatcc

SEQ ID NO: 3603 - DNA, 25 bp, Mus musculus
aatgggttcgcctggttaggcgcaa

SEQ ID NO: 3604 - DNA, 25 bp, Mus musculus
aatggtaaaggccagtgccactgta

SEQ ID NO: 3605 - DNA, 25 bp, Mus musculus
aatggtcgtcccttccatggcctat

SEQ ID NO: 3606 - DNA, 25 bp, Mus musculus
aatggtctagcagcttatcgagcct

SEQ ID NO: 3607 - DNA, 25 bp, Mus musculus
aatggtctggccactctccactaca

SEQ ID NO: 3608 - DNA, 25 bp, Mus musculus
aatggtctgtctctctaggcgcata

SEQ ID NO: 3609 - DNA, 25 bp, Mus musculus
aatggtgacatagccaaaggagttc

SEQ ID NO: 3610 - DNA, 25 bp, Mus musculus
aatggtgcatgggaaattgttcact

SEQ ID NO: 3611 - DNA, 25 bp, Mus musculus
aatggtggatgcagccagatctgtc

SEQ ID NO: 3612 - DNA, 25 bp, Mus musculus
aatggtggcagcctatctgattcag

SEQ ID NO: 3613 - DNA, 25 bp, Mus musculus
aatggtggcatctgtctgtcaggac

SEQ ID NO: 3614 - DNA, 25 bp, Mus musculus
aatggtgtccctgagcagataggcc

SEQ ID NO: 3615 - DNA, 25 bp, Mus musculus
aatggtgtgggttcctcagggccca

SEQ ID NO: 3616 - DNA, 25 bp, Mus musculus
aatggtgttcccacgcctgtccctg

SEQ ID NO: 3617 - DNA, 25 bp, Mus musculus
aatggttccagcaccgcaagctgct

SEQ ID NO: 3618 - DNA, 25 bp, Mus musculus
aatggttgtcttcctttcctgccaa

SEQ ID NO: 3619 - DNA, 25 bp, Mus musculus
aatggtttgccacaaaatcctcttt

SEQ ID NO: 3620 - DNA, 25 bp, Mus musculus
aatgtaaaaccctcccatcacctgt

SEQ ID NO: 3621 - DNA, 25 bp, Mus musculus
aatgtaattgtaagattgtactcca

SEQ ID NO: 3622 - DNA, 25 bp, Mus musculus
aatgtacacttcaactactagagag

SEQ ID NO: 3623 - DNA, 25 bp, Mus musculus
aatgtacctcagtgtcaagcctgca

SEQ ID NO: 3624 - DNA, 25 bp, Mus musculus
aatgtacttgggtctgtcgtggtcc

SEQ ID NO: 3625 - DNA, 25 bp, Mus musculus
aatgtagaatgggaaactaacagag

SEQ ID NO: 3626 - DNA, 25 bp, Mus musculus
aatgtatctcatccagcctgacacc

SEQ ID NO: 3627 - DNA, 25 bp, Mus musculus
aatgtatgagctttagttctgaaca

SEQ ID NO: 3628 - DNA, 25 bp, Mus musculus
aatgtcaagattctgagctccccat

SEQ ID NO: 3629 - DNA, 25 bp, Mus musculus
aatgtcaagtgaaagtagtaggtcg

SEQ ID NO: 3630 - DNA, 25 bp, Mus musculus
aatgtcacaggaagtttactgagtc

SEQ ID NO: 3631 - DNA, 25 bp, Mus musculus
aatgtcacaggatgtttactgagtc

SEQ ID NO: 3632 - DNA, 25 bp, Mus musculus
aatgtcaccaacaacctcaagtctc

SEQ ID NO: 3633 - DNA, 25 bp, Mus musculus
aatgtcaccagggagcgctgcagga

SEQ ID NO: 3634 - DNA, 25 bp, Mus musculus
aatgtcaccgagtacgtcgtccgag

SEQ ID NO: 3635 - DNA, 25 bp, Mus musculus
aatgtcacctggtatgtgtcctcca

SEQ ID NO: 3636 - DNA, 25 bp, Mus musculus
aatgtcacgcacctaccagcagtgc

SEQ ID NO: 3637 - DNA, 25 bp, Mus musculus
aatgtcagctctgggcgttgtgtcc

SEQ ID NO: 3638 - DNA, 25 bp, Mus musculus
aatgtcatcaatggcatcctcttca

SEQ ID NO: 3639 - DNA, 25 bp, Mus musculus
aatgtcatgatgatccagtcctgca

SEQ ID NO: 3640 - DNA, 25 bp, Mus musculus
aatgtcatgatgttccagtcctgca

SEQ ID NO: 3641 - DNA, 25 bp, Mus musculus
aatgtcattgcggatattctcttca

SEQ ID NO: 3642 - DNA, 25 bp, Mus musculus
aatgtcctgcagaaaatgaggttac

SEQ ID NO: 3643 - DNA, 25 bp, Mus musculus
aatgtcgacctcatcgctgcggcgt

SEQ ID NO: 3644 - DNA, 25 bp, Mus musculus
aatgtcgtttccctcaccctgatag

SEQ ID NO: 3645 - DNA, 25 bp, Mus musculus
aatgtctaccaaggagtagccagga

SEQ ID NO: 3646 - DNA, 25 bp, Mus musculus
aatgtctctggccagaagttctgca

SEQ ID NO: 3647 - DNA, 25 bp, Mus musculus
aatgtctgtcaacgtcaaccgcagc

SEQ ID NO: 3648 - DNA, 25 bp, Mus musculus
aatgtcttccctcttttcgcccaag

SEQ ID NO: 3649 - DNA, 25 bp, Mus musculus
aatgtgaaggctccgctgtacctgg

SEQ ID NO: 3650 - DNA, 25 bp, Mus musculus
aatgtgacagagtacatgtgtggag

SEQ ID NO: 3651 - DNA, 25 bp, Mus musculus
aatgtgacatactggcccctctggt

SEQ ID NO: 3652 - DNA, 25 bp, Mus musculus
aatgtgatgctggagttgaatgaac

SEQ ID NO: 3653 - DNA, 25 bp, Mus musculus
aatgtgattgtctttcagtctagcc

SEQ ID NO: 3654 - DNA, 25 bp, Mus musculus
aatgtgcccatccaagcagcctgtt

SEQ ID NO: 3655 - DNA, 25 bp, Mus musculus
aatgtgccttccctggagtctgccc

SEQ ID NO: 3656 - DNA, 25 bp, Mus musculus
aatgtgccttccgtggagtctgccc

SEQ ID NO: 3657 - DNA, 25 bp, Mus musculus
aatgtgcgtcttgccaaagaagagg

SEQ ID NO: 3658 - DNA, 25 bp, Mus musculus
aatgtgctcagcaaactaagtttga

SEQ ID NO: 3659 - DNA, 25 bp, Mus musculus
aatgtggaattgcttcattttcctg

SEQ ID NO: 3660 - DNA, 25 bp, Mus musculus
aatgtggaattggttcattttcctg

SEQ ID NO: 3661 - DNA, 25 bp, Mus musculus
aatgtggcagaattcgactgaagac

SEQ ID NO: 3662 - DNA, 25 bp, Mus musculus
aatgtggcatccagaatggctgtga

SEQ ID NO: 3663 - DNA, 25 bp, Mus musculus
aatgtggcatcctgaatggctgtga

SEQ ID NO: 3664 - DNA, 25 bp, Mus musculus
aatgtggccgaggtccttgtcaacc

SEQ ID NO: 3665 - DNA, 25 bp, Mus musculus
aatgtgggtttgtctgtgtcccgtg

SEQ ID NO: 3666 - DNA, 25 bp, Mus musculus
aatgtggtcaccaagcccagcttca

SEQ ID NO: 3667 - DNA, 25 bp, Mus musculus
aatgtgtagagcctgaggagaccac

SEQ ID NO: 3668 - DNA, 25 bp, Mus musculus
aatgtgtcactaccagcatgggcac

SEQ ID NO: 3669 - DNA, 25 bp, Mus musculus
aatgtgtctgagcaagcctcgcctg

SEQ ID NO: 3670 - DNA, 25 bp, Mus musculus
aatgtgtgggcgatgacattgcctg

SEQ ID NO: 3671 - DNA, 25 bp, Mus musculus
aatgtgtgtaatgccacactcacgg

SEQ ID NO: 3672 - DNA, 25 bp, Mus musculus
aatgtgtgtacatccttgagggccg

SEQ ID NO: 3673 - DNA, 25 bp, Mus musculus
aatgtgttcccgatgctcctgcgca

SEQ ID NO: 3674 - DNA, 25 bp, Mus musculus
aatgttaaccagattggctgtggcc

SEQ ID NO: 3675 - DNA, 25 bp, Mus musculus
aatgttcacaaacagagagtggctg

SEQ ID NO: 3676 - DNA, 25 bp, Mus musculus
aatgttcacaaactccgtctgtaag

SEQ ID NO: 3677 - DNA, 25 bp, Mus musculus
aatgttccatagacacaactttcaa

SEQ ID NO: 3678 - DNA, 25 bp, Mus musculus
aatgttctgcgccagcgagtggatt

SEQ ID NO: 3679 - DNA, 25 bp, Mus musculus
aatgttctgtacatgttagaaacaa

SEQ ID NO: 3680 - DNA, 25 bp, Mus musculus
aatgttgcagattcccaaggcttga

SEQ ID NO: 3681 - DNA, 25 bp, Mus musculus
aatgttgccttggaaaagcttcgag

SEQ ID NO: 3682 - DNA, 25 bp, Mus musculus
aatgttggctctggcttggcgctcc

SEQ ID NO: 3683 - DNA, 25 bp, Mus musculus
aattaaaattccaagcactttgaga

SEQ ID NO: 3684 - DNA, 25 bp, Mus musculus
aattaaagggtgaccatttggagct

SEQ ID NO: 3685 - DNA, 25 bp, Mus musculus
aattaaagttctaccagagggctgc

SEQ ID NO: 3686 - DNA, 25 bp, Mus musculus
aattaagaggagaaatagcaggacc

SEQ ID NO: 3687 - DNA, 25 bp, Mus musculus
aattaagcaagacattcttactgga

SEQ ID NO: 3688 - DNA, 25 bp, Mus musculus
aattaataatgcttgtgccactcag

SEQ ID NO: 3689 - DNA, 25 bp, Mus musculus
aattaatagtcaggagttagagaag

SEQ ID NO: 3690 - DNA, 25 bp, Mus musculus
aattaatgcccgttggaccacagag

SEQ ID NO: 3691 - DNA, 25 bp, Mus musculus
aattacatgggaatatttacagcca

SEQ ID NO: 3692 - DNA, 25 bp, Mus musculus
aattaccactacagggaagaaagca

SEQ ID NO: 3693 - DNA, 25 bp, Mus musculus
aattacctgacgctggaagctccag

SEQ ID NO: 3694 - DNA, 25 bp, Mus musculus
aattacgtcacagggaagaaatcca

SEQ ID NO: 3695 - DNA, 25 bp, Mus musculus
aattactccgagtgaaggctatgga

SEQ ID NO: 3696 - DNA, 25 bp, Mus musculus
aattacttcatgtacgtcctctggg

SEQ ID NO: 3697 - DNA, 25 bp, Mus musculus
aattacttgatacctcagggtctac

SEQ ID NO: 3698 - DNA, 25 bp, Mus musculus
aattacttgatagctcagggtctac

SEQ ID NO: 3699 - DNA, 25 bp, Mus musculus
aattagaaggcaatattcctggagc

SEQ ID NO: 3700 - DNA, 25 bp, Mus musculus
aattagaaggcattattcctggagc

SEQ ID NO: 3701 - DNA, 25 bp, Mus musculus
aattagagtctcgagtcatggctga

SEQ ID NO: 3702 - DNA, 25 bp, Mus musculus
aattagagtctgacatctcagctca

SEQ ID NO: 3703 - DNA, 25 bp, Mus musculus
aattagagtctgtgtcagaggatcc

SEQ ID NO: 3704 - DNA, 25 bp, Mus musculus
aattagcaaccggagcagcgcctta

SEQ ID NO: 3705 - DNA, 25 bp, Mus musculus
aattagcaccaaaccacgaggaagc

SEQ ID NO: 3706 - DNA, 25 bp, Mus musculus
aattagcaccaatccacgaggaagc

SEQ ID NO: 3707 - DNA, 25 bp, Mus musculus
aattagctgaacattgtgacatcac

SEQ ID NO: 3708 - DNA, 25 bp, Mus musculus
aattagcttgagtcttcagaagagc

SEQ ID NO: 3709 - DNA, 25 bp, Mus musculus
aattagtcctacatttgctgatgct

SEQ ID NO: 3710 - DNA, 25 bp, Mus musculus
aattagtctccacctgcgcagctct

SEQ ID NO: 3711 - DNA, 25 bp, Mus musculus
aattagttcgagacatttatggagg

SEQ ID NO: 3712 - DNA, 25 bp, Mus musculus
aattataagagggtcacaggcacca

SEQ ID NO: 3713 - DNA, 25 bp, Mus musculus
aattatacagggatgtgacattgga

SEQ ID NO: 3714 - DNA, 25 bp, Mus musculus
aattataggaaatggagaacagcaa

SEQ ID NO: 3715 - DNA, 25 bp, Mus musculus
aattatcaggagattacactgactg

SEQ ID NO: 3716 - DNA, 25 bp, Mus musculus
aattatcccatccattccgtggaag

SEQ ID NO: 3717 - DNA, 25 bp, Mus musculus
aattatccccgaaaatttgagactg

SEQ ID NO: 3718 - DNA, 25 bp, Mus musculus
aattatgaacttaacagtgatgctg

SEQ ID NO: 3719 - DNA, 25 bp, Mus musculus
aattatgacatgcacaacccctttg

SEQ ID NO: 3720 - DNA, 25 bp, Mus musculus
aattatgactaagccaaggaaaagg

SEQ ID NO: 3721 - DNA, 25 bp, Mus musculus
aattatgagaccaactgatgtacca

SEQ ID NO: 3722 - DNA, 25 bp, Mus musculus
aattatgctattttctctgaagacc

SEQ ID NO: 3723 - DNA, 25 bp, Mus musculus
aattatgcttccatcattcgccgtg

SEQ ID NO: 3724 - DNA, 25 bp, Mus musculus
aattatggatcccaacattgttggc

SEQ ID NO: 3725 - DNA, 25 bp, Mus musculus
aattatgggacacagcaggtcaaga

SEQ ID NO: 3726 - DNA, 25 bp, Mus musculus
aattatgtagaaaagaaaagctcac

SEQ ID NO: 3727 - DNA, 25 bp, Mus musculus
aattatttgggatagctatacgaca

SEQ ID NO: 3728 - DNA, 25 bp, Mus musculus
aattcaaaacaccagcgaaagtggg

SEQ ID NO: 3729 - DNA, 25 bp, Mus musculus
aattcaaacccattggtaccgcgca

SEQ ID NO: 3730 - DNA, 25 bp, Mus musculus
aattcaaaggcgatttaccagtgac

SEQ ID NO: 3731 - DNA, 25 bp, Mus musculus
aattcaacgccaagattcagacaga

SEQ ID NO: 3732 - DNA, 25 bp, Mus musculus
aattcaactgccataaacgctgtgc

SEQ ID NO: 3733 - DNA, 25 bp, Mus musculus
aattcaagcaattttcccaggagtc

SEQ ID NO: 3734 - DNA, 25 bp, Mus musculus
aattcaaggcccttattagcccata

SEQ ID NO: 3735 - DNA, 25 bp, Mus musculus
aattcacactggagctgtcgtcctg

SEQ ID NO: 3736 - DNA, 25 bp, Mus musculus
aattcactgtagagacgagtactcc

SEQ ID NO: 3737 - DNA, 25 bp, Mus musculus
aattcagaaggagcttgcagaaatc

SEQ ID NO: 3738 - DNA, 25 bp, Mus musculus
aattcagagaggtgacagaacttat

SEQ ID NO: 3739 - DNA, 25 bp, Mus musculus
aattcagagccaatgagcagactgt

SEQ ID NO: 3740 - DNA, 25 bp, Mus musculus
aattcagcagcatgtaaagttacaa

SEQ ID NO: 3741 - DNA, 25 bp, Mus musculus
aattcaggcattagtttctcagtta

SEQ ID NO: 3742 - DNA, 25 bp, Mus musculus
aattcagtcagcactgccccagtgg

SEQ ID NO: 3743 - DNA, 25 bp, Mus musculus
aattcagtcagctctgccccagtgg

SEQ ID NO: 3744 - DNA, 25 bp, Mus musculus
aattcagtcttcagggtctcaagat

SEQ ID NO: 3745 - DNA, 25 bp, Mus musculus
aattcagtgatgtagagagggccat

SEQ ID NO: 3746 - DNA, 25 bp, Mus musculus
aattcagttatcaaccacagcatgt

SEQ ID NO: 3747 - DNA, 25 bp, Mus musculus
aattcattaagtgcatcttcggaaa

SEQ ID NO: 3748 - DNA, 25 bp, Mus musculus
aattccaagatcctgctgcctctct

SEQ ID NO: 3749 - DNA, 25 bp, Mus musculus
aattccagacagagtcagagctggg

SEQ ID NO: 3750 - DNA, 25 bp, Mus musculus
aattccagagtaatcaattggccca

SEQ ID NO: 3751 - DNA, 25 bp, Mus musculus
aattccagtccatcgggattcaggt

SEQ ID NO: 3752 - DNA, 25 bp, Mus musculus
aattccatgttaagtgaaaatggcc

SEQ ID NO: 3753 - DNA, 25 bp, Mus musculus
aattccccgagcttccagaaatcct

SEQ ID NO: 3754 - DNA, 25 bp, Mus musculus
aattcccgccctcggatggagagcc

SEQ ID NO: 3755 - DNA, 25 bp, Mus musculus
aattcccgggcccttgctgacggca

SEQ ID NO: 3756 - DNA, 25 bp, Mus musculus
aattccgagtgcagaaaagaaaccg

SEQ ID NO: 3757 - DNA, 25 bp, Mus musculus
aattccgcggttgctgtgagcgcct

SEQ ID NO: 3758 - DNA, 25 bp, Mus musculus
aattcctcttgctatggctcctgtc

SEQ ID NO: 3759 - DNA, 25 bp, Mus musculus
aattcctgctagtctattcagtggg

SEQ ID NO: 3760 - DNA, 25 bp, Mus musculus
aattcctggtactacggctgtcaac

SEQ ID NO: 3761 - DNA, 25 bp, Mus musculus
aattcctgtcagagaatggcatccc

SEQ ID NO: 3762 - DNA, 25 bp, Mus musculus
aattccttaaggcacatacctgaag

SEQ ID NO: 3763 - DNA, 25 bp, Mus musculus
aattccttggagacggtgggcacgc

SEQ ID NO: 3764 - DNA, 25 bp, Mus musculus
aattctaccgctactaccaggtggc

SEQ ID NO: 3765 - DNA, 25 bp, Mus musculus
aattctagagcacctgcctgccaga

SEQ ID NO: 3766 - DNA, 25 bp, Mus musculus
aattctcaagcacagcccagagtcc

SEQ ID NO: 3767 - DNA, 25 bp, Mus musculus
aattctcactacaggacatgaagct

SEQ ID NO: 3768 - DNA, 25 bp, Mus musculus
aattctctgtggctgttacggtacg

SEQ ID NO: 3769 - DNA, 25 bp, Mus musculus
aattctgaggaagcaacaatgcttc

SEQ ID NO: 3770 - DNA, 25 bp, Mus musculus
aattctgatagatatcctgacacgc

SEQ ID NO: 3771 - DNA, 25 bp, Mus musculus
aattctgcgggctttgtgtgtgtcc

SEQ ID NO: 3772 - DNA, 25 bp, Mus musculus
aattctgctgagacctggagcgtca

SEQ ID NO: 3773 - DNA, 25 bp, Mus musculus
aattctgctgatggatactttcttc

SEQ ID NO: 3774 - DNA, 25 bp, Mus musculus
aattctggacatcagcaatgtggac

SEQ ID NO: 3775 - DNA, 25 bp, Mus musculus
aattcttcagctaccttttattcag

SEQ ID NO: 3776 - DNA, 25 bp, Mus musculus
aattcttccccaaaggagccacctg

SEQ ID NO: 3777 - DNA, 25 bp, Mus musculus
aattcttggtcaacggaaatgcggg

SEQ ID NO: 3778 - DNA, 25 bp, Mus musculus
aattcttggtcatcggaaatgcggg

SEQ ID NO: 3779 - DNA, 25 bp, Mus musculus
aattgaaaaaatgggaggcgcgaca

SEQ ID NO: 3780 - DNA, 25 bp, Mus musculus
aattgaaaggctatgaatccagagc

SEQ ID NO: 3781 - DNA, 25 bp, Mus musculus
aattgaaccaagcactcgtgtccga

SEQ ID NO: 3782 - DNA, 25 bp, Mus musculus
aattgaagcagatacttgtgaagtc

SEQ ID NO: 3783 - DNA, 25 bp, Mus musculus
aattgaattgactgggatgacagcc

SEQ ID NO: 3784 - DNA, 25 bp, Mus musculus
aattgacaggatcatttatgtgccc

SEQ ID NO: 3785 - DNA, 25 bp, Mus musculus
aattgaccacagcacagtacagagt

SEQ ID NO: 3786 - DNA, 25 bp, Mus musculus
aattgactgggatgacagccaccct

SEQ ID NO: 3787 - DNA, 25 bp, Mus musculus
aattgagcaggtctcatgggataac

SEQ ID NO: 3788 - DNA, 25 bp, Mus musculus
aattgatgaggcctgtaagagaata

SEQ ID NO: 3789 - DNA, 25 bp, Mus musculus
aattgattcactgagtgagcaggtg

SEQ ID NO: 3790 - DNA, 25 bp, Mus musculus
aattgattgacattttgaaaaggca

SEQ ID NO: 3791 - DNA, 25 bp, Mus musculus
aattgcacatcacgaagacctctct

SEQ ID NO: 3792 - DNA, 25 bp, Mus musculus
aattgcagccctacgatcagagctg

SEQ ID NO: 3793 - DNA, 25 bp, Mus musculus
aattgcagccttatagaaaagatcg

SEQ ID NO: 3794 - DNA, 25 bp, Mus musculus
aattgcaggatgtgcctggtagaga

SEQ ID NO: 3795 - DNA, 25 bp, Mus musculus
aattgcccatctttgcggctttgat

SEQ ID NO: 3796 - DNA, 25 bp, Mus musculus
aattgcccattcttgctgaagctgc

SEQ ID NO: 3797 - DNA, 25 bp, Mus musculus
aattgcccctactgtcactacctgg

SEQ ID NO: 3798 - DNA, 25 bp, Mus musculus
aattgccctggctaactacaagcta

SEQ ID NO: 3799 - DNA, 25 bp, Mus musculus
aattgcggctcaccaagcccttcag

SEQ ID NO: 3800 - DNA, 25 bp, Mus musculus
aattgctcactatccctccactgtg

SEQ ID NO: 3801 - DNA, 25 bp, Mus musculus
aattgctcagccaccaaaagtaact

SEQ ID NO: 3802 - DNA, 25 bp, Mus musculus
aattgctgatgaaggaacatggact

SEQ ID NO: 3803 - DNA, 25 bp, Mus musculus
aattgctttatgagcctgttttgcc

SEQ ID NO: 3804 - DNA, 25 bp, Mus musculus
aattggaaaagcatatgcagaagag

SEQ ID NO: 3805 - DNA, 25 bp, Mus musculus
aattggaaggctgggaacccgatga

SEQ ID NO: 3806 - DNA, 25 bp, Mus musculus
aattggagcaaatcaatgccttggc

SEQ ID NO: 3807 - DNA, 25 bp, Mus musculus
aattggatgcgctacacgcagacag

SEQ ID NO: 3808 - DNA, 25 bp, Mus musculus
aattggatttcatgatggagaccca

SEQ ID NO: 3809 - DNA, 25 bp, Mus musculus
aattggccctgctgaagcttaccca

SEQ ID NO: 3810 - DNA, 25 bp, Mus musculus
aattggcctccaagaccgagagctc

SEQ ID NO: 3811 - DNA, 25 bp, Mus musculus
aattggcgctttcgagctgaactgg

SEQ ID NO: 3812 - DNA, 25 bp, Mus musculus
aattggctacctctacacctactgg

SEQ ID NO: 3813 - DNA, 25 bp, Mus musculus
aattggctcagtcattcttggtgga

SEQ ID NO: 3814 - DNA, 25 bp, Mus musculus
aattggcttcaaggaatttcacgag

SEQ ID NO: 3815 - DNA, 25 bp, Mus musculus
aattggcttctatattaccatggag

SEQ ID NO: 3816 - DNA, 25 bp, Mus musculus
aattggctttgcatttggagcctta

SEQ ID NO: 3817 - DNA, 25 bp, Mus musculus
aattggctttgcttttggagcctta

SEQ ID NO: 3818 - DNA, 25 bp, Mus musculus
aattgggacagaaaaactagcccag

SEQ ID NO: 3819 - DNA, 25 bp, Mus musculus
aattgggagaacagaacactgaaaa

SEQ ID NO: 3820 - DNA, 25 bp, Mus musculus
aattgggccacacgtaaaccacctg

SEQ ID NO: 3821 - DNA, 25 bp, Mus musculus
aattgggctgacttttcttatgctg

SEQ ID NO: 3822 - DNA, 25 bp, Mus musculus
aattgggctgctaacaacttttatg

SEQ ID NO: 3823 - DNA, 25 bp, Mus musculus
aattggtggcctagcaacctccaaa

SEQ ID NO: 3824 - DNA, 25 bp, Mus musculus
aattggttattgttagactcactga

SEQ ID NO: 3825 - DNA, 25 bp, Mus musculus
aattgtaagattgtactccaagccg

SEQ ID NO: 3826 - DNA, 25 bp, Mus musculus
aattgtagacattggctcatttgcc

SEQ ID NO: 3827 - DNA, 25 bp, Mus musculus
aattgtcactctgcgccaggtgctg

SEQ ID NO: 3828 - DNA, 25 bp, Mus musculus
aattgtcggatgagcagttaaggcg

SEQ ID NO: 3829 - DNA, 25 bp, Mus musculus
aattgtcggtgatctggcctccgcg

SEQ ID NO: 3830 - DNA, 25 bp, Mus musculus
aattgtcgtcactgtggcctttgtt

SEQ ID NO: 3831 - DNA, 25 bp, Mus musculus
aattgtctccatcaccttctctgag

SEQ ID NO: 3832 - DNA, 25 bp, Mus musculus
aattgtgcagtattggcatcaaggg

SEQ ID NO: 3833 - DNA, 25 bp, Mus musculus
aattgtgcagtattttctgaatcac

SEQ ID NO: 3834 - DNA, 25 bp, Mus musculus
aattgttaaggagagaactccagaa

SEQ ID NO: 3835 - DNA, 25 bp, Mus musculus
aattgttcctgatcccaggaagctg

SEQ ID NO: 3836 - DNA, 25 bp, Mus musculus
aattgttctataaaggcatccgccc

SEQ ID NO: 3837 - DNA, 25 bp, Mus musculus
aattgttgtgtgatgcgttacacca

SEQ ID NO: 3838 - DNA, 25 bp, Mus musculus
aatttaacacatatgtgaccctgaa

SEQ ID NO: 3839 - DNA, 25 bp, Mus musculus
aatttagaggaaatgatgaggtccc

SEQ ID NO: 3840 - DNA, 25 bp, Mus musculus
aatttattgcggtagctgtaccacc

SEQ ID NO: 3841 - DNA, 25 bp, Mus musculus
aatttcaagagagtcgtggatagag

SEQ ID NO: 3842 - DNA, 25 bp, Mus musculus
aatttcagcatatgttcagcatctg

SEQ ID NO: 3843 - DNA, 25 bp, Mus musculus
aatttccagtatgtgggcgcctctg

SEQ ID NO: 3844 - DNA, 25 bp, Mus musculus
aatttccattcactccgcctttaga

SEQ ID NO: 3845 - DNA, 25 bp, Mus musculus
aatttccgtgtggacgtggtgcaaa

SEQ ID NO: 3846 - DNA, 25 bp, Mus musculus
aatttcctactcctgacatacttcg

SEQ ID NO: 3847 - DNA, 25 bp, Mus musculus
aatttctcagtgtcacaagtgccca

SEQ ID NO: 3848 - DNA, 25 bp, Mus musculus
aatttctgttcctactctagctcag

SEQ ID NO: 3849 - DNA, 25 bp, Mus musculus
aatttgataccgaggaccatcccca

SEQ ID NO: 3850 - DNA, 25 bp, Mus musculus
aatttgattatgtggcacagcagga

SEQ ID NO: 3851 - DNA, 25 bp, Mus musculus
aatttgattctaacattgcaccagc

SEQ ID NO: 3852 - DNA, 25 bp, Mus musculus
aatttgcccagaaatatggaggagc

SEQ ID NO: 3853 - DNA, 25 bp, Mus musculus
aatttgctctaggaatctaaagatg

SEQ ID NO: 3854 - DNA, 25 bp, Mus musculus
aatttgctgatcttaggcatcgact

SEQ ID NO: 3855 - DNA, 25 bp, Mus musculus
aatttggaacttggattgagtatgc

SEQ ID NO: 3856 - DNA, 25 bp, Mus musculus
aatttggctccatgaagtattatgc

SEQ ID NO: 3857 - DNA, 25 bp, Mus musculus
aatttggctcccgtattctgctgca

SEQ ID NO: 3858 - DNA, 25 bp, Mus musculus
aatttggtccagcacgtaatgacag

SEQ ID NO: 3859 - DNA, 25 bp, Mus musculus
aatttggtgtatcctgctgttatgg

SEQ ID NO: 3860 - DNA, 25 bp, Mus musculus
aatttgtaaagcattcagtttgacg

SEQ ID NO: 3861 - DNA, 25 bp, Mus musculus
aatttgttcaggacagacatagaaa

SEQ ID NO: 3862 - DNA, 25 bp, Mus musculus
aattttaattaggacatgggactag

SEQ ID NO: 3863 - DNA, 25 bp, Mus musculus
aattttagcatctccttggtcccag

SEQ ID NO: 3864 - DNA, 25 bp, Mus musculus
aattttctagacacatacaagctgc

SEQ ID NO: 3865 - DNA, 25 bp, Mus musculus
aattttctagactcatacaagctgc

SEQ ID NO: 3866 - DNA, 25 bp, Mus musculus
aattttctcaaagttttgatgcagc

SEQ ID NO: 3867 - DNA, 25 bp, Mus musculus
aattttctcagcgtgactgtggaag

SEQ ID NO: 3868 - DNA, 25 bp, Mus musculus
aattttgagacacaatctgcatcct

SEQ ID NO: 3869 - DNA, 25 bp, Mus musculus
aattttgatattgtctctggaactc

SEQ ID NO: 3870 - DNA, 25 bp, Mus musculus
aattttggtgaaccaagaattcaag

SEQ ID NO: 3871 - DNA, 25 bp, Mus musculus
aattttggtgaagcaagaattcaag

SEQ ID NO: 3872 - DNA, 25 bp, Mus musculus
acaaaaacagtctcgtaagcccagc

SEQ ID NO: 3873 - DNA, 25 bp, Mus musculus
acaaaaacttttgtagccaatcttg

SEQ ID NO: 3874 - DNA, 25 bp, Mus musculus
acaaaaagaagtgaatgtcaccaca

SEQ ID NO: 3875 - DNA, 25 bp, Mus musculus
acaaaagaaagacccgttcagccgg

SEQ ID NO: 3876 - DNA, 25 bp, Mus musculus
acaaaagaaagagccgttcagccgg

SEQ ID NO: 3877 - DNA, 25 bp, Mus musculus
acaaaatgctggctagggctgctcc

SEQ ID NO: 3878 - DNA, 25 bp, Mus musculus
acaaacaacccttcgctgacctgat

SEQ ID NO: 3879 - DNA, 25 bp, Mus musculus
acaaacaagcccctgagtgtcaagg

SEQ ID NO: 3880 - DNA, 25 bp, Mus musculus
acaaacaagcccgtgagtgtcaagg

SEQ ID NO: 3881 - DNA, 25 bp, Mus musculus
acaaacggccaatgttctctcggga

SEQ ID NO: 3882 - DNA, 25 bp, Mus musculus
acaaactttctagcgcatgagaaga

SEQ ID NO: 3883 - DNA, 25 bp, Mus musculus
acaaagagcaggcaccgtgcctcca

SEQ ID NO: 3884 - DNA, 25 bp, Mus musculus
acaaagagccatccgagtgaagcgc

SEQ ID NO: 3885 - DNA, 25 bp, Mus musculus
acaaagatactggagtactgactcc

SEQ ID NO: 3886 - DNA, 25 bp, Mus musculus
acaaagctcttcttgccaagaggaa

SEQ ID NO: 3887 - DNA, 25 bp, Mus musculus
acaaagcttttctgatatgatggga

SEQ ID NO: 3888 - DNA, 25 bp, Mus musculus
acaaaggcacagcagaaggagctgt

SEQ ID NO: 3889 - DNA, 25 bp, Mus musculus
acaaagggataactcacaccacggg

SEQ ID NO: 3890 - DNA, 25 bp, Mus musculus
acaaaggtcaccttggcacatcgac

SEQ ID NO: 3891 - DNA, 25 bp, Mus musculus
acaaagtgtggtccaggttactcca

SEQ ID NO: 3892 - DNA, 25 bp, Mus musculus
acaaataacgccaggttcttggact

SEQ ID NO: 3893 - DNA, 25 bp, Mus musculus
acaaatatggatgcctgtctgggaa

SEQ ID NO: 3894 - DNA, 25 bp, Mus musculus
acaaatccttctcccttcgacagag

SEQ ID NO: 3895 - DNA, 25 bp, Mus musculus
acaaatctgacacagagctgttggg

SEQ ID NO: 3896 - DNA, 25 bp, Mus musculus
acaaatgttcttgcaaacccttgtg

SEQ ID NO: 3897 - DNA, 25 bp, Mus musculus
acaaattagtctccacctgcgcagc

SEQ ID NO: 3898 - DNA, 25 bp, Mus musculus
acaaattccccgagcttccagaaat

SEQ ID NO: 3899 - DNA, 25 bp, Mus musculus
acaaattggcaatttaacgagccac

SEQ ID NO: 3900 - DNA, 25 bp, Mus musculus
acaacaaagccaacgtggtaaccag

SEQ ID NO: 3901 - DNA, 25 bp, Mus musculus
acaacaacaggcatgcaaccaggca

SEQ ID NO: 3902 - DNA, 25 bp, Mus musculus
acaacaagtggaggcgcatcccgtt

SEQ ID NO: 3903 - DNA, 25 bp, Mus musculus
acaacacaattcgattcaccgtatg

SEQ ID NO: 3904 - DNA, 25 bp, Mus musculus
acaacacaggtgtcacgtctcaaca

SEQ ID NO: 3905 - DNA, 25 bp, Mus musculus
acaacactgctgctaccgaggccta

SEQ ID NO: 3906 - DNA, 25 bp, Mus musculus
acaacagatctggtgcccatgcggg

SEQ ID NO: 3907 - DNA, 25 bp, Mus musculus
acaacagcagctacgacatatggag

SEQ ID NO: 3908 - DNA, 25 bp, Mus musculus
acaacagtgacaagtccagcaccta

SEQ ID NO: 3909 - DNA, 25 bp, Mus musculus
acaacagtgacgaggagagctgcga

SEQ ID NO: 3910 - DNA, 25 bp, Mus musculus
acaacagtgctacagtttgaaggcc

SEQ ID NO: 3911 - DNA, 25 bp, Mus musculus
acaacatcaaggctaaggaggagac

SEQ ID NO: 3912 - DNA, 25 bp, Mus musculus
acaacattgtgcacttggaagatct

SEQ ID NO: 3913 - DNA, 25 bp, Mus musculus
acaaccaagtaacgagtgtccctca

SEQ ID NO: 3914 - DNA, 25 bp, Mus musculus
acaaccaagtaaggagtgtccctca

SEQ ID NO: 3915 - DNA, 25 bp, Mus musculus
acaaccagataaacctgcaagtccc

SEQ ID NO: 3916 - DNA, 25 bp, Mus musculus
acaaccatatttttgagtccccagt

SEQ ID NO: 3917 - DNA, 25 bp, Mus musculus
acaaccattgtttattgggtcacat

SEQ ID NO: 3918 - DNA, 25 bp, Mus musculus
acaacccctttctctaagctgaagg

SEQ ID NO: 3919 - DNA, 25 bp, Mus musculus
acaacccttcgctgacctgattggt

SEQ ID NO: 3920 - DNA, 25 bp, Mus musculus
acaaccgtggacaacattcgctcca

SEQ ID NO: 3921 - DNA, 25 bp, Mus musculus
acaacctgagatccgctgcggaaga

SEQ ID NO: 3922 - DNA, 25 bp, Mus musculus
acaacctgagatgcgctgcggaaga

SEQ ID NO: 3923 - DNA, 25 bp, Mus musculus
acaacctgcaagagtcttccaccat

SEQ ID NO: 3924 - DNA, 25 bp, Mus musculus
acaacctggaaactacattctaaag

SEQ ID NO: 3925 - DNA, 25 bp, Mus musculus
acaacctggaaagtacattctaaag

SEQ ID NO: 3926 - DNA, 25 bp, Mus musculus
acaacgcaacacaaaaccaagcaag

SEQ ID NO: 3927 - DNA, 25 bp, Mus musculus
acaacgcaacactaaaccaagcaag

SEQ ID NO: 3928 - DNA, 25 bp, Mus musculus
acaacgggcagaacccacagcgagg

SEQ ID NO: 3929 - DNA, 25 bp, Mus musculus
acaacgggcaggagttcagtctgct

SEQ ID NO: 3930 - DNA, 25 bp, Mus musculus
acaacgggcaggtgttcagtctgct

SEQ ID NO: 3931 - DNA, 25 bp, Mus musculus
acaacgtagattataagctggagac

SEQ ID NO: 3932 - DNA, 25 bp, Mus musculus
acaacgtgtctgtgttcctggctcc

SEQ ID NO: 3933 - DNA, 25 bp, Mus musculus
acaactccgactccgtgggatccag

SEQ ID NO: 3934 - DNA, 25 bp, Mus musculus
acaactcgacttcgctggtggcagc

SEQ ID NO: 3935 - DNA, 25 bp, Mus musculus
acaactgacaagcacctttctcctg

SEQ ID NO: 3936 - DNA, 25 bp, Mus musculus
acaactgagagccttgttcactggg

SEQ ID NO: 3937 - DNA, 25 bp, Mus musculus
acaactgagagcgttgttcactggg

SEQ ID NO: 3938 - DNA, 25 bp, Mus musculus
acaactgcttcagtggcggacgacc

SEQ ID NO: 3939 - DNA, 25 bp, Mus musculus
acaactggatcgacccctggacctt

SEQ ID NO: 3940 - DNA, 25 bp, Mus musculus
acaactgtacccaggtggccacagc

SEQ ID NO: 3941 - DNA, 25 bp, Mus musculus
acaacttatcagtagtgacttacag

SEQ ID NO: 3942 - DNA, 25 bp, Mus musculus
acaacttgaaatccctggaagccca

SEQ ID NO: 3943 - DNA, 25 bp, Mus musculus
acaagaacggagagctggacttctc

SEQ ID NO: 3944 - DNA, 25 bp, Mus musculus
acaagaagctgacccaggccatcca

SEQ ID NO: 3945 - DNA, 25 bp, Mus musculus
acaagaagtagagatcgaggcgcgc

SEQ ID NO: 3946 - DNA, 25 bp, Mus musculus
acaagacatgctaaggctagaccgt

SEQ ID NO: 3947 - DNA, 25 bp, Mus musculus
acaagacctgtaaactctggagtgc

SEQ ID NO: 3948 - DNA, 25 bp, Mus musculus
acaagacgggatcctaatatcacag

SEQ ID NO: 3949 - DNA, 25 bp, Mus musculus
acaagagcactgaatctcctggcac

SEQ ID NO: 3950 - DNA, 25 bp, Mus musculus
acaagaggaatttgaaggctgttta

SEQ ID NO: 3951 - DNA, 25 bp, Mus musculus
acaagagggcccctggatcacagga

SEQ ID NO: 3952 - DNA, 25 bp, Mus musculus
acaagaggttcttcagccagagaag

SEQ ID NO: 3953 - DNA, 25 bp, Mus musculus
acaagagttgcctgttagattggca

SEQ ID NO: 3954 - DNA, 25 bp, Mus musculus
acaagatcaagttcacggtcaccag

SEQ ID NO: 3955 - DNA, 25 bp, Mus musculus
acaagatgtccactgccaaggccaa

SEQ ID NO: 3956 - DNA, 25 bp, Mus musculus
acaagatgtccagtgccaaggccaa

SEQ ID NO: 3957 - DNA, 25 bp, Mus musculus
acaagcaagtgagtttgattcttca

SEQ ID NO: 3958 - DNA, 25 bp, Mus musculus
acaagcactagtgccagtgtctcag

SEQ ID NO: 3959 - DNA, 25 bp, Mus musculus
acaagcactggctggctgagcagca

SEQ ID NO: 3960 - DNA, 25 bp, Mus musculus
acaagcaggaaacctggatgaagac

SEQ ID NO: 3961 - DNA, 25 bp, Mus musculus
acaagcccctcctacctgagttgtt

SEQ ID NO: 3962 - DNA, 25 bp, Mus musculus
acaagcccgtgactgtcaaggtgta

SEQ ID NO: 3963 - DNA, 25 bp, Mus musculus
acaagcccgtgagtgtcaaggtgta

SEQ ID NO: 3964 - DNA, 25 bp, Mus musculus
acaagccggcctcgaaatcagagcc

SEQ ID NO: 3965 - DNA, 25 bp, Mus musculus
acaagccggcctggaaatcagagcc

SEQ ID NO: 3966 - DNA, 25 bp, Mus musculus
acaagccggtgctctcctactgagc

SEQ ID NO: 3967 - DNA, 25 bp, Mus musculus
acaagcgcaagctgaagcgggtccg

SEQ ID NO: 3968 - DNA, 25 bp, Mus musculus
acaagctggatcaggcaagctccag

SEQ ID NO: 3969 - DNA, 25 bp, Mus musculus
acaaggaacgagaacggaggctacg

SEQ ID NO: 3970 - DNA, 25 bp, Mus musculus
acaaggacaaagcactgcccagctt

SEQ ID NO: 3971 - DNA, 25 bp, Mus musculus
acaaggacccagaggtgatcgtggt

SEQ ID NO: 3972 - DNA, 25 bp, Mus musculus
acaaggaggagaccgcgctcttcca

SEQ ID NO: 3973 - DNA, 25 bp, Mus musculus
acaaggatgactagaatgggccaag

SEQ ID NO: 3974 - DNA, 25 bp, Mus musculus
acaaggccatggagaacagcgagtg

SEQ ID NO: 3975 - DNA, 25 bp, Mus musculus
acaaggcccctgtggtgaaggctaa

SEQ ID NO: 3976 - DNA, 25 bp, Mus musculus
acaaggcgatttgtcggccacacca

SEQ ID NO: 3977 - DNA, 25 bp, Mus musculus
acaaggctgacatcaatgcagtgaa

SEQ ID NO: 3978 - DNA, 25 bp, Mus musculus
acaaggctggaagaccgagcaggcc

SEQ ID NO: 3979 - DNA, 25 bp, Mus musculus
acaaggtcagcactaagaggcctcc

SEQ ID NO: 3980 - DNA, 25 bp, Mus musculus
acaagtagcgagacagccaggaccc

SEQ ID NO: 3981 - DNA, 25 bp, Mus musculus
acaagtcagtgagcccaagaaatgg

SEQ ID NO: 3982 - DNA, 25 bp, Mus musculus
acaagtccagagacaacccctgatt

SEQ ID NO: 3983 - DNA, 25 bp, Mus musculus
acaagtgggagaaaaaggctagtga

SEQ ID NO: 3984 - DNA, 25 bp, Mus musculus
acaagtggtggaatagcctaagtga

SEQ ID NO: 3985 - DNA, 25 bp, Mus musculus
acaagtggttctactgcggtctgtg

SEQ ID NO: 3986 - DNA, 25 bp, Mus musculus
acaagtgtgtgagctggatgtgcac

SEQ ID NO: 3987 - DNA, 25 bp, Mus musculus
acaataagacgtgggatgaggctcc

SEQ ID NO: 3988 - DNA, 25 bp, Mus musculus
acaatacgggaaccgagtccgcatc

SEQ ID NO: 3989 - DNA, 25 bp, Mus musculus
acaatagaatctggcgaaataggac

SEQ ID NO: 3990 - DNA, 25 bp, Mus musculus
acaatcaatgagtacaccatccgcc

SEQ ID NO: 3991 - DNA, 25 bp, Mus musculus
acaatcagctgcctttggtcatcga

SEQ ID NO: 3992 - DNA, 25 bp, Mus musculus
acaatcttgattcctgttgccggcc

SEQ ID NO: 3993 - DNA, 25 bp, Mus musculus
acaatgaagccaggtcggccctgct

SEQ ID NO: 3994 - DNA, 25 bp, Mus musculus
acaatgacatgtacagagaatggct

SEQ ID NO: 3995 - DNA, 25 bp, Mus musculus
acaatgatggcaagatctcttttgc

SEQ ID NO: 3996 - DNA, 25 bp, Mus musculus
acaatgcagagtgaatttttttacc

SEQ ID NO: 3997 - DNA, 25 bp, Mus musculus
acaatgcagtgggaactgtcaccac

SEQ ID NO: 3998 - DNA, 25 bp, Mus musculus
acaatgctgtgtgcatcccggagcc

SEQ ID NO: 3999 - DNA, 25 bp, Mus musculus
acaatggaggtagagcctgcagtga

SEQ ID NO: 4000 - DNA, 25 bp, Mus musculus
acaatggcatggtcctgggagagca

SEQ ID NO: 4001 - DNA, 25 bp, Mus musculus
acaatggctgggacgacctggagtt

SEQ ID NO: 4002 - DNA, 25 bp, Mus musculus
acaatggttgtcagtggagcagcag

SEQ ID NO: 4003 - DNA, 25 bp, Mus musculus
acaatgtggaggacgagttgacccc

SEQ ID NO: 4004 - DNA, 25 bp, Mus musculus
acaatgttcacaaacagagagtggc

SEQ ID NO: 4005 - DNA, 25 bp, Mus musculus
acaatgttggagttgtcgtgtttgg

SEQ ID NO: 4006 - DNA, 25 bp, Mus musculus
acaattcaggcattagtttctcagt

SEQ ID NO: 4007 - DNA, 25 bp, Mus musculus
acaattggatttcatgatggagacc

SEQ ID NO: 4008 - DNA, 25 bp, Mus musculus
acacaaagatcgaggcagcacaacc

SEQ ID NO: 4009 - DNA, 25 bp, Mus musculus
acacaaattagtctccacctgcgca

SEQ ID NO: 4010 - DNA, 25 bp, Mus musculus
acacaaccattgtttattgggtcac

SEQ ID NO: 4011 - DNA, 25 bp, Mus musculus
acacaaggccatggagaacagcgag

SEQ ID NO: 4012 - DNA, 25 bp, Mus musculus
acacaatggctacccttctgaagct

SEQ ID NO: 4013 - DNA, 25 bp, Mus musculus
acacaattagaacgcattattcctg

SEQ ID NO: 4014 - DNA, 25 bp, Mus musculus
acacaattagaaggcattattcctg

SEQ ID NO: 4015 - DNA, 25 bp, Mus musculus
acacaattcaggcattagtttctca

SEQ ID NO: 4016 - DNA, 25 bp, Mus musculus
acacacaggccagatttctcacaga

SEQ ID NO: 4017 - DNA, 25 bp, Mus musculus
acacacatatgtggaggccctgcac

SEQ ID NO: 4018 - DNA, 25 bp, Mus musculus
acacaccaagctgtctgtttttatg

SEQ ID NO: 4019 - DNA, 25 bp, Mus musculus
acacaccctatgagccagaagatga

SEQ ID NO: 4020 - DNA, 25 bp, Mus musculus
acacaccctcagaggcaggcaatgc

SEQ ID NO: 4021 - DNA, 25 bp, Mus musculus
acacaccctctggatcctatttgag

SEQ ID NO: 4022 - DNA, 25 bp, Mus musculus
acacacggttgatgacggtctagac

SEQ ID NO: 4023 - DNA, 25 bp, Mus musculus
acacactcttacttagtgccctgga

SEQ ID NO: 4024 - DNA, 25 bp, Mus musculus
acacactgaagcagcggcggcacag

SEQ ID NO: 4025 - DNA, 25 bp, Mus musculus
acacactgaaggtcgtgacggagga

SEQ ID NO: 4026 - DNA, 25 bp, Mus musculus
acacactgcaatttctgtgtcctca

SEQ ID NO: 4027 - DNA, 25 bp, Mus musculus
acacactgtcagacaccttcttggt

SEQ ID NO: 4028 - DNA, 25 bp, Mus musculus
acacactgtcagtcaccttcttggt

SEQ ID NO: 4029 - DNA, 25 bp, Mus musculus
acacactgtggctgattccgatcac

SEQ ID NO: 4030 - DNA, 25 bp, Mus musculus
acacacttgccatggttgtgcctcc

SEQ ID NO: 4031 - DNA, 25 bp, Mus musculus
acacacttgtgttcctcagcacgcg

SEQ ID NO: 4032 - DNA, 25 bp, Mus musculus
acacacttttctttgctcaaagcac

SEQ ID NO: 4033 - DNA, 25 bp, Mus musculus
acacagacagggacacacgcagaca

SEQ ID NO: 4034 - DNA, 25 bp, Mus musculus
acacagaccgccaagtgtggagtgg

SEQ ID NO: 4035 - DNA, 25 bp, Mus musculus
acacagacctccagtcagaaccaag

SEQ ID NO: 4036 - DNA, 25 bp, Mus musculus
acacagaggacagtttctctaccag

SEQ ID NO: 4037 - DNA, 25 bp, Mus musculus
acacagagtgccctgggctctgcaa

SEQ ID NO: 4038 - DNA, 25 bp, Mus musculus
acacagctccggttcctgagaaaac

SEQ ID NO: 4039 - DNA, 25 bp, Mus musculus
acacaggaatgctgccaaggtccta

SEQ ID NO: 4040 - DNA, 25 bp, Mus musculus
acacaggtacatctggtccatcctt

SEQ ID NO: 4041 - DNA, 25 bp, Mus musculus
acacaggtcgaaacctgcacagcca

SEQ ID NO: 4042 - DNA, 25 bp, Mus musculus
acacaggtgtcatcccgactcatca

SEQ ID NO: 4043 - DNA, 25 bp, Mus musculus
acacaggttctcttcccggagccaa

SEQ ID NO: 4044 - DNA, 25 bp, Mus musculus
acacagtgtgcccactcctgtgtca

SEQ ID NO: 4045 - DNA, 25 bp, Mus musculus
acacatacaagcagccaaagttaaa

SEQ ID NO: 4046 - DNA, 25 bp, Mus musculus
acacatacaagctgccaaagttaaa

SEQ ID NO: 4047 - DNA, 25 bp, Mus musculus
acacatacacacaaggatttggaca

SEQ ID NO: 4048 - DNA, 25 bp, Mus musculus
acacatatgtggaggccctgcacgc

SEQ ID NO: 4049 - DNA, 25 bp, Mus musculus
acacatcaacacaggtcgaaacctg

SEQ ID NO: 4050 - DNA, 25 bp, Mus musculus
acacatccagagctgacggcaggga

SEQ ID NO: 4051 - DNA, 25 bp, Mus musculus
acacatccctaagcagaaactactg

SEQ ID NO: 4052 - DNA, 25 bp, Mus musculus
acacatgaggaggacctcaccaagg

SEQ ID NO: 4053 - DNA, 25 bp, Mus musculus
acacatggtcactgcccgccaggag

SEQ ID NO: 4054 - DNA, 25 bp, Mus musculus
acacatgtggtaaagatagaccctc

SEQ ID NO: 4055 - DNA, 25 bp, Mus musculus
acacatgtttgagcgcatggtgcag

SEQ ID NO: 4056 - DNA, 25 bp, Mus musculus
acacattggcaaaagaattcttggc

SEQ ID NO: 4057 - DNA, 25 bp, Mus musculus
acaccaaatcctactgcaagcgaat

SEQ ID NO: 4058 - DNA, 25 bp, Mus musculus
acaccacaggccgtttgccagagag

SEQ ID NO: 4059 - DNA, 25 bp, Mus musculus
acaccacctgctccagataatggga

SEQ ID NO: 4060 - DNA, 25 bp, Mus musculus
acaccactaactgtatggaagtgat

SEQ ID NO: 4061 - DNA, 25 bp, Mus musculus
acaccactgaggagaaagcactgaa

SEQ ID NO: 4062 - DNA, 25 bp, Mus musculus
acaccagactctcgcggatcgacat

SEQ ID NO: 4063 - DNA, 25 bp, Mus musculus
acaccagtgagatgcggagtgagct

SEQ ID NO: 4064 - DNA, 25 bp, Mus musculus
acaccatcgtggtgtcagccactgc

SEQ ID NO: 4065 - DNA, 25 bp, Mus musculus
acaccattgaaggagagccggagtc

SEQ ID NO: 4066 - DNA, 25 bp, Mus musculus
acaccattgtggagcatgattctgg

SEQ ID NO: 4067 - DNA, 25 bp, Mus musculus
acacccaagacgctgctggaaaaca

SEQ ID NO: 4068 - DNA, 25 bp, Mus musculus
acacccagattctccgtgggttctg

SEQ ID NO: 4069 - DNA, 25 bp, Mus musculus
acacccgctctgagcagtgctacag

SEQ ID NO: 4070 - DNA, 25 bp, Mus musculus
acacccgctctgtgcagtgctacag

SEQ ID NO: 4071 - DNA, 25 bp, Mus musculus
acaccctctgccactatttgctggt

SEQ ID NO: 4072 - DNA, 25 bp, Mus musculus
acaccctttctatcatgggaatctg

SEQ ID NO: 4073 - DNA, 25 bp, Mus musculus
acaccgaagaagactgcctgacctt

SEQ ID NO: 4074 - DNA, 25 bp, Mus musculus
acaccggaaagcgtgaaagtgtgtg

SEQ ID NO: 4075 - DNA, 25 bp, Mus musculus
acaccggacacagagacgctgagct

SEQ ID NO: 4076 - DNA, 25 bp, Mus musculus
acaccgggcccgacctgagtagtga

SEQ ID NO: 4077 - DNA, 25 bp, Mus musculus
acaccgtgaatgtacggcggagtgt

SEQ ID NO: 4078 - DNA, 25 bp, Mus musculus
acacctagtggcagctcaccacaga

SEQ ID NO: 4079 - DNA, 25 bp, Mus musculus
acacctatggcggttctcaggtggc

SEQ ID NO: 4080 - DNA, 25 bp, Mus musculus
acacctctaagttactgtcttgcaa

SEQ ID NO: 4081 - DNA, 25 bp, Mus musculus
acacctctgcacttggccgtgatca

SEQ ID NO: 4082 - DNA, 25 bp, Mus musculus
acacctgaaataccagcactcagca

SEQ ID NO: 4083 - DNA, 25 bp, Mus musculus
acacctgcctgttgtgctgtatgtg

SEQ ID NO: 4084 - DNA, 25 bp, Mus musculus
acacctggaccaaaggccctgagaa

SEQ ID NO: 4085 - DNA, 25 bp, Mus musculus
acacctggtttagagccaaatggat

SEQ ID NO: 4086 - DNA, 25 bp, Mus musculus
acacctgtcttaatcctggttgctc

SEQ ID NO: 4087 - DNA, 25 bp, Mus musculus
acacgaaagtgggagaacgtttgcg

SEQ ID NO: 4088 - DNA, 25 bp, Mus musculus
acacgaagtcttcttggtcactggg

SEQ ID NO: 4089 - DNA, 25 bp, Mus musculus
acacgaccttcagcagacttatcaa

SEQ ID NO: 4090 - DNA, 25 bp, Mus musculus
acacgcactactggacttggatcaa

SEQ ID NO: 4091 - DNA, 25 bp, Mus musculus
acacgccggcctcgaatgcggcata

SEQ ID NO: 4092 - DNA, 25 bp, Mus musculus
acacgccggcctggaatgcggcata

SEQ ID NO: 4093 - DNA, 25 bp, Mus musculus
acacgcgaaaagaagcacggtcacc

SEQ ID NO: 4094 - DNA, 25 bp, Mus musculus
acacggaaagcccaagaagcagaaa

SEQ ID NO: 4095 - DNA, 25 bp, Mus musculus
acacggaaggctccagcagatccag

SEQ ID NO: 4096 - DNA, 25 bp, Mus musculus
acacggagaaggcacagcgcagcct

SEQ ID NO: 4097 - DNA, 25 bp, Mus musculus
acacggcagataccaagacagcagg

SEQ ID NO: 4098 - DNA, 25 bp, Mus musculus
acacggcagccatgacaggcacctt

SEQ ID NO: 4099 - DNA, 25 bp, Mus musculus
acacggccaagatcgcactgctgga

SEQ ID NO: 4100 - DNA, 25 bp, Mus musculus
acacgggccatcgagcttgacaaga

SEQ ID NO: 4101 - DNA, 25 bp, Mus musculus
acacgggcgagatcaaagcactggc

SEQ ID NO: 4102 - DNA, 25 bp, Mus musculus
acacggtcggctgtctctgccagga

SEQ ID NO: 4103 - DNA, 25 bp, Mus musculus
acacgttccagagcatcgcgggtct

SEQ ID NO: 4104 - DNA, 25 bp, Mus musculus
acactacgacaaggacaggctctgc

SEQ ID NO: 4105 - DNA, 25 bp, Mus musculus
acactacgagaactacagggcacag

SEQ ID NO: 4106 - DNA, 25 bp, Mus musculus
acactactgggtgggcattgacatc

SEQ ID NO: 4107 - DNA, 25 bp, Mus musculus
acactagaggagctcctgaagcccc

SEQ ID NO: 4108 - DNA, 25 bp, Mus musculus
acactcacagaccagactctgagaa

SEQ ID NO: 4109 - DNA, 25 bp, Mus musculus
acactcaggagagcgtgggcctcgt

SEQ ID NO: 4110 - DNA, 25 bp, Mus musculus
acactccctgtctgttgggtcctca

SEQ ID NO: 4111 - DNA, 25 bp, Mus musculus
acactcctgatgattgtatacaaaa

SEQ ID NO: 4112 - DNA, 25 bp, Mus musculus
acactcgggaatgcaccacaggaag

SEQ ID NO: 4113 - DNA, 25 bp, Mus musculus
acactctcgtgctgctgtggccgat

SEQ ID NO: 4114 - DNA, 25 bp, Mus musculus
acactgagagctctatcatcattag

SEQ ID NO: 4115 - DNA, 25 bp, Mus musculus
acactgatgcggcagcagagcctgc

SEQ ID NO: 4116 - DNA, 25 bp, Mus musculus
acactgcagggccagatactccttc

SEQ ID NO: 4117 - DNA, 25 bp, Mus musculus
acactgcagggcgagatactccttc

SEQ ID NO: 4118 - DNA, 25 bp, Mus musculus
acactgccatgctggctagctacgc

SEQ ID NO: 4119 - DNA, 25 bp, Mus musculus
acactgccgtccacgggtggctgga

SEQ ID NO: 4120 - DNA, 25 bp, Mus musculus
acactgccgtcctcgggtggctgga

SEQ ID NO: 4121 - DNA, 25 bp, Mus musculus
acactgcggagagctacatgctgca

SEQ ID NO: 4122 - DNA, 25 bp, Mus musculus
acactgctcatgtgtctgatccaca

SEQ ID NO: 4123 - DNA, 25 bp, Mus musculus
acactgctgagcgtggagatgaccg

SEQ ID NO: 4124 - DNA, 25 bp, Mus musculus
acactggagagaagctgcttccgtc

SEQ ID NO: 4125 - DNA, 25 bp, Mus musculus
acactggcctctatctgctgtgtag

SEQ ID NO: 4126 - DNA, 25 bp, Mus musculus
acactgtaatgctcagaagggccag

SEQ ID NO: 4127 - DNA, 25 bp, Mus musculus
acactgtcctggcaacgtggcagcc

SEQ ID NO: 4128 - DNA, 25 bp, Mus musculus
acactgtgaaattccagaagaaagg

SEQ ID NO: 4129 - DNA, 25 bp, Mus musculus
acactgtgccgagagtgtttgtggt

SEQ ID NO: 4130 - DNA, 25 bp, Mus musculus
acactgtggtcaccctggatgccct

SEQ ID NO: 4131 - DNA, 25 bp, Mus musculus
acacttacctcagcatgatcctggg

SEQ ID NO: 4132 - DNA, 25 bp, Mus musculus
acacttgaaggaccgaaggctgagt

SEQ ID NO: 4133 - DNA, 25 bp, Mus musculus
acacttgtgctgaccagtgatcagt

SEQ ID NO: 4134 - DNA, 25 bp, Mus musculus
acacttgtgtgcctttgatcagcgc

SEQ ID NO: 4135 - DNA, 25 bp, Mus musculus
acagaaaagtgctggacgccgggcc

SEQ ID NO: 4136 - DNA, 25 bp, Mus musculus
acagaaaccaacttaggtgaagatt

SEQ ID NO: 4137 - DNA, 25 bp, Mus musculus
acagaaagggcatctctcctccaag

SEQ ID NO: 4138 - DNA, 25 bp, Mus musculus
acagaaaggtgctcctgtcaaacaa

SEQ ID NO: 4139 - DNA, 25 bp, Mus musculus
acagaaatcaggaggctacctctgc

SEQ ID NO: 4140 - DNA, 25 bp, Mus musculus
acagaaattgggagaacagaacact

SEQ ID NO: 4141 - DNA, 25 bp, Mus musculus
acagaacatcacctggctgcctagg

SEQ ID NO: 4142 - DNA, 25 bp, Mus musculus
acagaactctgagagctgctagaag

SEQ ID NO: 4143 - DNA, 25 bp, Mus musculus
acagaagacggcaccacgactaagt

SEQ ID NO: 4144 - DNA, 25 bp, Mus musculus
acagaagaggctgtcgagcgagggc

SEQ ID NO: 4145 - DNA, 25 bp, Mus musculus
acagaagccaccctggaggctgagc

SEQ ID NO: 4146 - DNA, 25 bp, Mus musculus
acagaagcgctgtaccagggcaaca

SEQ ID NO: 4147 - DNA, 25 bp, Mus musculus
acagaagcgtccctgcggaagcgtt

SEQ ID NO: 4148 - DNA, 25 bp, Mus musculus
acagaaggcagtggagagctttacc

SEQ ID NO: 4149 - DNA, 25 bp, Mus musculus
acagaaggcgcaaatacttcttcat

SEQ ID NO: 4150 - DNA, 25 bp, Mus musculus
acagaagtcgaggaaaggccaacaa

SEQ ID NO: 4151 - DNA, 25 bp, Mus musculus
acagaatgcacaggtggatgttcaa

SEQ ID NO: 4152 - DNA, 25 bp, Mus musculus
acagacaaacccacgggcaggtctg

SEQ ID NO: 4153 - DNA, 25 bp, Mus musculus
acagacaaaggagagcctaacacag

SEQ ID NO: 4154 - DNA, 25 bp, Mus musculus
acagacaagttttcgccgcttacct

SEQ ID NO: 4155 - DNA, 25 bp, Mus musculus
acagacacatgggagcaagcagcag

SEQ ID NO: 4156 - DNA, 25 bp, Mus musculus
acagacactgtgcagaccttcgtca

SEQ ID NO: 4157 - DNA, 25 bp, Mus musculus
acagacatgcagagcacctcggaga

SEQ ID NO: 4158 - DNA, 25 bp, Mus musculus
acagaccactgatggacagcagatt

SEQ ID NO: 4159 - DNA, 25 bp, Mus musculus
acagacccggctgcctctacttctg

SEQ ID NO: 4160 - DNA, 25 bp, Mus musculus
acagacccgtgtccgggaggacact

SEQ ID NO: 4161 - DNA, 25 bp, Mus musculus
acagacccgtgtgcgggaggacact

SEQ ID NO: 4162 - DNA, 25 bp, Mus musculus
acagaccctgctgtggtgagaagca

SEQ ID NO: 4163 - DNA, 25 bp, Mus musculus
acagacctccagtcagaaccaaggg

SEQ ID NO: 4164 - DNA, 25 bp, Mus musculus
acagacctctgtgggctggacatga

SEQ ID NO: 4165 - DNA, 25 bp, Mus musculus
acagacctttggagctacaggtgcc

SEQ ID NO: 4166 - DNA, 25 bp, Mus musculus
acagactatggagcttttatcaaaa

SEQ ID NO: 4167 - DNA, 25 bp, Mus musculus
acagactgcatttccgccatgaacc

SEQ ID NO: 4168 - DNA, 25 bp, Mus musculus
acagactgttttaactgcttgccga

SEQ ID NO: 4169 - DNA, 25 bp, Mus musculus
acagagaacttaatccctgccggtg

SEQ ID NO: 4170 - DNA, 25 bp, Mus musculus
acagagaagagtgggtcagcctggc

SEQ ID NO: 4171 - DNA, 25 bp, Mus musculus
acagagaatgaccacatcaacctga

SEQ ID NO: 4172 - DNA, 25 bp, Mus musculus
acagagacgtacgtgcgctggtccc

SEQ ID NO: 4173 - DNA, 25 bp, Mus musculus
acagagaggtccgtgtgccccgctg

SEQ ID NO: 4174 - DNA, 25 bp, Mus musculus
acagagatcaactttcagctgggaa

SEQ ID NO: 4175 - DNA, 25 bp, Mus musculus
acagagcaactccagcgttaccgct

SEQ ID NO: 4176 - DNA, 25 bp, Mus musculus
acagagcaactcgagcgttaccgct

SEQ ID NO: 4177 - DNA, 25 bp, Mus musculus
acagagcacagggtcttacctttgc

SEQ ID NO: 4178 - DNA, 25 bp, Mus musculus
acagagcagtaagcgcagcagccgg

SEQ ID NO: 4179 - DNA, 25 bp, Mus musculus
acagagctactgatgccaatgtgga

SEQ ID NO: 4180 - DNA, 25 bp, Mus musculus
acagagctatgcagagggaaggact

SEQ ID NO: 4181 - DNA, 25 bp, Mus musculus
acagagctcagtgcctttcggccct

SEQ ID NO: 4182 - DNA, 25 bp, Mus musculus
acagaggaaccgaagccaagtacca

SEQ ID NO: 4183 - DNA, 25 bp, Mus musculus
acagaggaatttgtacaaggatgtg

SEQ ID NO: 4184 - DNA, 25 bp, Mus musculus
acagaggacaccagctccctgggtg

SEQ ID NO: 4185 - DNA, 25 bp, Mus musculus
acagaggacctctaaaacgtgagcc

SEQ ID NO: 4186 - DNA, 25 bp, Mus musculus
acagaggcagaatacagagaaagct

SEQ ID NO: 4187 - DNA, 25 bp, Mus musculus
acagagggttccaatcgctgccact

SEQ ID NO: 4188 - DNA, 25 bp, Mus musculus
acagagggttcctatcgctgccact

SEQ ID NO: 4189 - DNA, 25 bp, Mus musculus
acagaggtcctacaggaacaccagg

SEQ ID NO: 4190 - DNA, 25 bp, Mus musculus
acagaggtgttagctgcgggctctc

SEQ ID NO: 4191 - DNA, 25 bp, Mus musculus
acagagtccctggtgcactgtgact

SEQ ID NO: 4192 - DNA, 25 bp, Mus musculus
acagagtgcaaggtgttctccaaga

SEQ ID NO: 4193 - DNA, 25 bp, Mus musculus
acagagtgcatgatgttcgggagca

SEQ ID NO: 4194 - DNA, 25 bp, Mus musculus
acagagtgccctgggctctgcaaca

SEQ ID NO: 4195 - DNA, 25 bp, Mus musculus
acagagttccgccactgcctgcatc

SEQ ID NO: 4196 - DNA, 25 bp, Mus musculus
acagagttgaaaagagggtgtgtca

SEQ ID NO: 4197 - DNA, 25 bp, Mus musculus
acagataggaccacgtggcccagga

SEQ ID NO: 4198 - DNA, 25 bp, Mus musculus
acagatcccgccagtgagaagctca

SEQ ID NO: 4199 - DNA, 25 bp, Mus musculus
acagatccctctcacaggcttcgtg

SEQ ID NO: 4200 - DNA, 25 bp, Mus musculus
acagatcggcttgccaaagggtcag

SEQ ID NO: 4201 - DNA, 25 bp, Mus musculus
acagatcttatagcagtcggtttaa

SEQ ID NO: 4202 - DNA, 25 bp, Mus musculus
acagatggcagagttccggaagcag

SEQ ID NO: 4203 - DNA, 25 bp, Mus musculus
acagatggccctcccaactcatttt

SEQ ID NO: 4204 - DNA, 25 bp, Mus musculus
acagatgtgcccagggaagctccca

SEQ ID NO: 4205 - DNA, 25 bp, Mus musculus
acagattgtgatgccacgaggcagc

SEQ ID NO: 4206 - DNA, 25 bp, Mus musculus
acagcaaaaatcaaatgactctgcc

SEQ ID NO: 4207 - DNA, 25 bp, Mus musculus
acagcaagaattcttcactgactca

SEQ ID NO: 4208 - DNA, 25 bp, Mus musculus
acagcaagtgaaggcaagaaatggc

SEQ ID NO: 4209 - DNA, 25 bp, Mus musculus
acagcaagtgtactattccatcggg

SEQ ID NO: 4210 - DNA, 25 bp, Mus musculus
acagcaatgagccgcagttgtgccc

SEQ ID NO: 4211 - DNA, 25 bp, Mus musculus
acagcaatgatgatgtgaagacaga

SEQ ID NO: 4212 - DNA, 25 bp, Mus musculus
acagcacatgtgaaaccagacctca

SEQ ID NO: 4213 - DNA, 25 bp, Mus musculus
acagcacgtgggagcccgaagaaaa

SEQ ID NO: 4214 - DNA, 25 bp, Mus musculus
acagcacttacacgtatgtcagcag

SEQ ID NO: 4215 - DNA, 25 bp, Mus musculus
acagcacttctgaataccatcccaa

SEQ ID NO: 4216 - DNA, 25 bp, Mus musculus
acagcagcaaataaggactcccctt

SEQ ID NO: 4217 - DNA, 25 bp, Mus musculus
acagcagcatacagcatttctccca

SEQ ID NO: 4218 - DNA, 25 bp, Mus musculus
acagcagccagccacggaggacgat

SEQ ID NO: 4219 - DNA, 25 bp, Mus musculus
acagcagcgctctcggatgctggct

SEQ ID NO: 4220 - DNA, 25 bp, Mus musculus
acagcaggacacagctccggttcct

SEQ ID NO: 4221 - DNA, 25 bp, Mus musculus
acagcaggcattaccaatttttgta

SEQ ID NO: 4222 - DNA, 25 bp, Mus musculus
acagcaggcggatatttgtgggcca

SEQ ID NO: 4223 - DNA, 25 bp, Mus musculus
acagcagtcgtcagccgcagaggtt

SEQ ID NO: 4224 - DNA, 25 bp, Mus musculus
acagcagtgcgtgccagcagtggct

SEQ ID NO: 4225 - DNA, 25 bp, Mus musculus
acagcataaccagcgcgagtagcga

SEQ ID NO: 4226 - DNA, 25 bp, Mus musculus
acagcatacggccacaaaaggaagg

SEQ ID NO: 4227 - DNA, 25 bp, Mus musculus
acagcatcaactgggctttctttag

SEQ ID NO: 4228 - DNA, 25 bp, Mus musculus
acagcatcttgatgagcttccacca

SEQ ID NO: 4229 - DNA, 25 bp, Mus musculus
acagcattgcaatccaggccccaca

SEQ ID NO: 4230 - DNA, 25 bp, Mus musculus
acagcattggttcctctagatctca

SEQ ID NO: 4231 - DNA, 25 bp, Mus musculus
acagccaagctgatcgagaagctgg

SEQ ID NO: 4232 - DNA, 25 bp, Mus musculus
acagccaaggttacggaggttatgg

SEQ ID NO: 4233 - DNA, 25 bp, Mus musculus
acagccacatactggaatccgagtc

SEQ ID NO: 4234 - DNA, 25 bp, Mus musculus
acagccagcagtgtgacatttggag

SEQ ID NO: 4235 - DNA, 25 bp, Mus musculus
acagccagtcctacgaggagatggt

SEQ ID NO: 4236 - DNA, 25 bp, Mus musculus
acagccatcctctctggaagtctct

SEQ ID NO: 4237 - DNA, 25 bp, Mus musculus
acagccatctgggaggccttcaagg

SEQ ID NO: 4238 - DNA, 25 bp, Mus musculus
acagcccacatcagctatcgttcgt

SEQ ID NO: 4239 - DNA, 25 bp, Mus musculus
acagcccagaaaggaatcactggta

SEQ ID NO: 4240 - DNA, 25 bp, Mus musculus
acagcccaggacagaggacgctgct

SEQ ID NO: 4241 - DNA, 25 bp, Mus musculus
acagccccactgagatcactgcagg

SEQ ID NO: 4242 - DNA, 25 bp, Mus musculus
acagcccgaatctaccggaagcact

SEQ ID NO: 4243 - DNA, 25 bp, Mus musculus
acagccctggcgctgaacttggacc

SEQ ID NO: 4244 - DNA, 25 bp, Mus musculus
acagccctgtctcggtcctgagatc

SEQ ID NO: 4245 - DNA, 25 bp, Mus musculus
acagccgaatgagcttgttgggaaa

SEQ ID NO: 4246 - DNA, 25 bp, Mus musculus
acagcctagggctgtcaagaagcca

SEQ ID NO: 4247 - DNA, 25 bp, Mus musculus
acagcctccccaaaggaatatacag

SEQ ID NO: 4248 - DNA, 25 bp, Mus musculus
acagcctcctgggaacacatcaagg

SEQ ID NO: 4249 - DNA, 25 bp, Mus musculus
acagcctcctttcaataaccatgag

SEQ ID NO: 4250 - DNA, 25 bp, Mus musculus
acagcctggacgagccatcagtgaa

SEQ ID NO: 4251 - DNA, 25 bp, Mus musculus
acagccttcaatcagtggactcggg

SEQ ID NO: 4252 - DNA, 25 bp, Mus musculus
acagccttcgatgctttctcttgag

SEQ ID NO: 4253 - DNA, 25 bp, Mus musculus
acagccttgcctgagtgatgcagag

SEQ ID NO: 4254 - DNA, 25 bp, Mus musculus
acagcgacagcccaacagagcagaa

SEQ ID NO: 4255 - DNA, 25 bp, Mus musculus
acagcgatgggatcccgtggtcaga

SEQ ID NO: 4256 - DNA, 25 bp, Mus musculus
acagcggacccgaaagacatgtatt

SEQ ID NO: 4257 - DNA, 25 bp, Mus musculus
acagcggaggctacggtgctcctga

SEQ ID NO: 4258 - DNA, 25 bp, Mus musculus
acagcggcaacctgggtgaggactc

SEQ ID NO: 4259 - DNA, 25 bp, Mus musculus
acagcggcctgcagagtcccggtgc

SEQ ID NO: 4260 - DNA, 25 bp, Mus musculus
acagcggtcagagcggcaagacagt

SEQ ID NO: 4261 - DNA, 25 bp, Mus musculus
acagcgtctggagtcatcccgcaga

SEQ ID NO: 4262 - DNA, 25 bp, Mus musculus
acagcgtggacctgcatgtgtacga

SEQ ID NO: 4263 - DNA, 25 bp, Mus musculus
acagcgttgtgtgtgagtgcagtaa

SEQ ID NO: 4264 - DNA, 25 bp, Mus musculus
acagcgtttatgtgttcaaaggaga

SEQ ID NO: 4265 - DNA, 25 bp, Mus musculus
acagctacagcggaggctacggtgc

SEQ ID NO: 4266 - DNA, 25 bp, Mus musculus
acagctacgagcaagcacggcgcct

SEQ ID NO: 4267 - DNA, 25 bp, Mus musculus
acagctagcagtcgccactatgttg

SEQ ID NO: 4268 - DNA, 25 bp, Mus musculus
acagctcagcagatccaggcactaa

SEQ ID NO: 4269 - DNA, 25 bp, Mus musculus
acagctcagtccactgtgttgatgg

SEQ ID NO: 4270 - DNA, 25 bp, Mus musculus
acagctctgcccaggacagtgaggg

SEQ ID NO: 4271 - DNA, 25 bp, Mus musculus
acagctcttcttcaatgggacagaa

SEQ ID NO: 4272 - DNA, 25 bp, Mus musculus
acagctgatgtcgtcgtcatgatgc

SEQ ID NO: 4273 - DNA, 25 bp, Mus musculus
acagctgattttacttctggagtta

SEQ ID NO: 4274 - DNA, 25 bp, Mus musculus
acagctgcaggctcgaaggctggaa

SEQ ID NO: 4275 - DNA, 25 bp, Mus musculus
acagctgccgagacgtatgccaata

SEQ ID NO: 4276 - DNA, 25 bp, Mus musculus
acagctgcctttgtcctagctatgc

SEQ ID NO: 4277 - DNA, 25 bp, Mus musculus
acagctggacaagccggtgctggac

SEQ ID NO: 4278 - DNA, 25 bp, Mus musculus
acagctggagcggacagaagccacc

SEQ ID NO: 4279 - DNA, 25 bp, Mus musculus
acagctgtcatcagctatgactacc

SEQ ID NO: 4280 - DNA, 25 bp, Mus musculus
acagctgtttgacaccatctccctg

SEQ ID NO: 4281 - DNA, 25 bp, Mus musculus
acagcttcagagacagtttaagtac

SEQ ID NO: 4282 - DNA, 25 bp, Mus musculus
acagcttccttagcggcaggagaag

SEQ ID NO: 4283 - DNA, 25 bp, Mus musculus
acagcttgctttcctgcagggtaac

SEQ ID NO: 4284 - DNA, 25 bp, Mus musculus
acagcttgggattttctgcccgaca

SEQ ID NO: 4285 - DNA, 25 bp, Mus musculus
acaggaaatagctgaaaaggctcta

SEQ ID NO: 4286 - DNA, 25 bp, Mus musculus
acaggaactgatgccagtgtctcag

SEQ ID NO: 4287 - DNA, 25 bp, Mus musculus
acaggaagatctgtggacacactga

SEQ ID NO: 4288 - DNA, 25 bp, Mus musculus
acaggaagcagcctggacggtacca

SEQ ID NO: 4289 - DNA, 25 bp, Mus musculus
acaggaagtgacatcgctgtggaga

SEQ ID NO: 4290 - DNA, 25 bp, Mus musculus
acaggaatcaggcatttggaatgaa

SEQ ID NO: 4291 - DNA, 25 bp, Mus musculus
acaggagacacagccttctggcgag

SEQ ID NO: 4292 - DNA, 25 bp, Mus musculus
acaggagacattcacctttgcctta

SEQ ID NO: 4293 - DNA, 25 bp, Mus musculus
acaggagagaccttgcagaaattct

SEQ ID NO: 4294 - DNA, 25 bp, Mus musculus
acaggagcccggcacccatgagttg

SEQ ID NO: 4295 - DNA, 25 bp, Mus musculus
acaggagggaggtccatctacggaa

SEQ ID NO: 4296 - DNA, 25 bp, Mus musculus
acaggaggtatactacctaattcgt

SEQ ID NO: 4297 - DNA, 25 bp, Mus musculus
acaggaggtatagtacctaattcgt

SEQ ID NO: 4298 - DNA, 25 bp, Mus musculus
acaggagtcttggtcatgtcgagca

SEQ ID NO: 4299 - DNA, 25 bp, Mus musculus
acaggagtgtggctgctaggcgccc

SEQ ID NO: 4300 - DNA, 25 bp, Mus musculus
acaggagtgtgggtgctaggcgccc

SEQ ID NO: 4301 - DNA, 25 bp, Mus musculus
acaggatggctcaccagcactgtga

SEQ ID NO: 4302 - DNA, 25 bp, Mus musculus
acaggattgagaggccctgtgctcc

SEQ ID NO: 4303 - DNA, 25 bp, Mus musculus
acaggcaaatactttgacaaagcca

SEQ ID NO: 4304 - DNA, 25 bp, Mus musculus
acaggcaccggaagctgagaactcc

SEQ ID NO: 4305 - DNA, 25 bp, Mus musculus
acaggcaggtcccataggagcagac

SEQ ID NO: 4306 - DNA, 25 bp, Mus musculus
acaggccaagcagaagcaccctgag

SEQ ID NO: 4307 - DNA, 25 bp, Mus musculus
acaggccagatttctcacagacaag

SEQ ID NO: 4308 - DNA, 25 bp, Mus musculus
acaggccagctttcagccattacag

SEQ ID NO: 4309 - DNA, 25 bp, Mus musculus
acaggccagttcatgcgtattcaga

SEQ ID NO: 4310 - DNA, 25 bp, Mus musculus
acaggcccctggtgggtcccttgca

SEQ ID NO: 4311 - DNA, 25 bp, Mus musculus
acaggcccgctcaatgcggacaggg

SEQ ID NO: 4312 - DNA, 25 bp, Mus musculus
acaggccctacgacgagggtctgcg

SEQ ID NO: 4313 - DNA, 25 bp, Mus musculus
acaggccttgacctttgccaagaaa

SEQ ID NO: 4314 - DNA, 25 bp, Mus musculus
acaggcggctactcaggtggaaaga

SEQ ID NO: 4315 - DNA, 25 bp, Mus musculus
acaggctacacactggacactcaaa

SEQ ID NO: 4316 - DNA, 25 bp, Mus musculus
acaggctatccctgtgcggcagcag

SEQ ID NO: 4317 - DNA, 25 bp, Mus musculus
acaggctatttgaccctgatcccca

SEQ ID NO: 4318 - DNA, 25 bp, Mus musculus
acaggctgacggtcacctctccggt

SEQ ID NO: 4319 - DNA, 25 bp, Mus musculus
acaggcttcaggacatgtgtgggct

SEQ ID NO: 4320 - DNA, 25 bp, Mus musculus
acagggaccttgcagcgcgcaacat

SEQ ID NO: 4321 - DNA, 25 bp, Mus musculus
acagggagaggatggcttccttcga

SEQ ID NO: 4322 - DNA, 25 bp, Mus musculus
acagggatcgattgcctctgattct

SEQ ID NO: 4323 - DNA, 25 bp, Mus musculus
acagggatgtaccattgtgtgtgct

SEQ ID NO: 4324 - DNA, 25 bp, Mus musculus
acagggccaccaggtatctcggtct

SEQ ID NO: 4325 - DNA, 25 bp, Mus musculus
acagggctgcatggagcaagccagt

SEQ ID NO: 4326 - DNA, 25 bp, Mus musculus
acagggtgatcccagccttcatgtg

SEQ ID NO: 4327 - DNA, 25 bp, Mus musculus
acaggtacagcacaggcagcgacag

SEQ ID NO: 4328 - DNA, 25 bp, Mus musculus
acaggtccctgtcacctccgtggga

SEQ ID NO: 4329 - DNA, 25 bp, Mus musculus
acaggtctgcccaccttggagcctg

SEQ ID NO: 4330 - DNA, 25 bp, Mus musculus
acaggtgaattctggtaattacgtg

SEQ ID NO: 4331 - DNA, 25 bp, Mus musculus
acaggtgcctgcagaagcatatggc

SEQ ID NO: 4332 - DNA, 25 bp, Mus musculus
acaggtgcgccttgaagagatgtcc

SEQ ID NO: 4333 - DNA, 25 bp, Mus musculus
acaggtgctgtagatctctccgatc

SEQ ID NO: 4334 - DNA, 25 bp, Mus musculus
acaggtgcttctccgaaaccttacg

SEQ ID NO: 4335 - DNA, 25 bp, Mus musculus
acaggtggcggtgcagagacccaca

SEQ ID NO: 4336 - DNA, 25 bp, Mus musculus
acaggtgttcttcactctgatttgg

SEQ ID NO: 4337 - DNA, 25 bp, Mus musculus
acaggttgcccatgccctacctgaa

SEQ ID NO: 4338 - DNA, 25 bp, Mus musculus
acagtacctggtaacctccgggctg

SEQ ID NO: 4339 - DNA, 25 bp, Mus musculus
acagtagaaattggcgctttcgagc

SEQ ID NO: 4340 - DNA, 25 bp, Mus musculus
acagtagagccaccgacagctgcat

SEQ ID NO: 4341 - DNA, 25 bp, Mus musculus
acagtagagcggattgttcgctgca

SEQ ID NO: 4342 - DNA, 25 bp, Mus musculus
acagtagtcaccaatgatcgctggg

SEQ ID NO: 4343 - DNA, 25 bp, Mus musculus
acagtataaactacattgatgtgac

SEQ ID NO: 4344 - DNA, 25 bp, Mus musculus
acagtataaacttcattgatgtgac

SEQ ID NO: 4345 - DNA, 25 bp, Mus musculus
acagtatatgcctcccacaagcagg

SEQ ID NO: 4346 - DNA, 25 bp, Mus musculus
acagtatcgaggaacggcgcatcca

SEQ ID NO: 4347 - DNA, 25 bp, Mus musculus
acagtatggcttggatgtccagaga

SEQ ID NO: 4348 - DNA, 25 bp, Mus musculus
acagtcaagattggccgccgcttca

SEQ ID NO: 4349 - DNA, 25 bp, Mus musculus
acagtcaatgccctggagatcgagc

SEQ ID NO: 4350 - DNA, 25 bp, Mus musculus
acagtcatgaccgtgaggcctttgc

SEQ ID NO: 4351 - DNA, 25 bp, Mus musculus
acagtcatggcaacagcgtgcacct

SEQ ID NO: 4352 - DNA, 25 bp, Mus musculus
acagtcccagtctggtactgggaaa

SEQ ID NO: 4353 - DNA, 25 bp, Mus musculus
acagtctctagcttcgccatgtaca

SEQ ID NO: 4354 - DNA, 25 bp, Mus musculus
acagtctgagcaatgccacgccgtg

SEQ ID NO: 4355 - DNA, 25 bp, Mus musculus
acagtcttcaagagagccttgatga

SEQ ID NO: 4356 - DNA, 25 bp, Mus musculus
acagtcttccagcagttcggcagta

SEQ ID NO: 4357 - DNA, 25 bp, Mus musculus
acagtgaaatgtgccggtgtgctga

SEQ ID NO: 4358 - DNA, 25 bp, Mus musculus
acagtgaagtaagaggactggctgt

SEQ ID NO: 4359 - DNA, 25 bp, Mus musculus
acagtgacagcgaccaggaagagaa

SEQ ID NO: 4360 - DNA, 25 bp, Mus musculus
acagtgagacaaaagatatcaacac

SEQ ID NO: 4361 - DNA, 25 bp, Mus musculus
acagtgagctgcgtccttgaggatg

SEQ ID NO: 4362 - DNA, 25 bp, Mus musculus
acagtgatgatgaccttgcctggaa

SEQ ID NO: 4363 - DNA, 25 bp, Mus musculus
acagtgcccgctggtggtgccaagt

SEQ ID NO: 4364 - DNA, 25 bp, Mus musculus
acagtgccgagctctccagtgaggg

SEQ ID NO: 4365 - DNA, 25 bp, Mus musculus
acagtgctaatcgagatatttccgt

SEQ ID NO: 4366 - DNA, 25 bp, Mus musculus
acagtgctacagtttgaaggccaaa

SEQ ID NO: 4367 - DNA, 25 bp, Mus musculus
acagtgctcggaaagcatctattgt

SEQ ID NO: 4368 - DNA, 25 bp, Mus musculus
acagtgctgcccaggatggacaaca

SEQ ID NO: 4369 - DNA, 25 bp, Mus musculus
acagtgctgccctggatggacaaca

SEQ ID NO: 4370 - DNA, 25 bp, Mus musculus
acagtgctgtgtggcctgacccaga

SEQ ID NO: 4371 - DNA, 25 bp, Mus musculus
acagtggatacagtttgctgtggct

SEQ ID NO: 4372 - DNA, 25 bp, Mus musculus
acagtggccactttgtggccctcaa

SEQ ID NO: 4373 - DNA, 25 bp, Mus musculus
acagtgtcactctggatcctctttg

SEQ ID NO: 4374 - DNA, 25 bp, Mus musculus
acagtgtcttcacaaagaaaatggg

SEQ ID NO: 4375 - DNA, 25 bp, Mus musculus
acagtgtgtgccctgcaggccgcac

SEQ ID NO: 4376 - DNA, 25 bp, Mus musculus
acagtgttcgtgtttgctgtcgtca

SEQ ID NO: 4377 - DNA, 25 bp, Mus musculus
acagtgttcttgagacctcccctga

SEQ ID NO: 4378 - DNA, 25 bp, Mus musculus
acagttactactgcgcctggaaatc

SEQ ID NO: 4379 - DNA, 25 bp, Mus musculus
acagttcaagcccagccacagattg

SEQ ID NO: 4380 - DNA, 25 bp, Mus musculus
acagttcagacaaggcccctgtggt

SEQ ID NO: 4381 - DNA, 25 bp, Mus musculus
acagttctatgtcaccagagagaaa

SEQ ID NO: 4382 - DNA, 25 bp, Mus musculus
acagttctgggccttgtagaaccca

SEQ ID NO: 4383 - DNA, 25 bp, Mus musculus
acagttcttctccagtgcctcaagg

SEQ ID NO: 4384 - DNA, 25 bp, Mus musculus
acagttgcgcgatcctgtcacctca

SEQ ID NO: 4385 - DNA, 25 bp, Mus musculus
acagttggagattgagttcaaggag

SEQ ID NO: 4386 - DNA, 25 bp, Mus musculus
acagttggccatattgaagatcacc

SEQ ID NO: 4387 - DNA, 25 bp, Mus musculus
acagttgttggtgctgtgtattgca

SEQ ID NO: 4388 - DNA, 25 bp, Mus musculus
acagtttgctcctgggaggcgccag

SEQ ID NO: 4389 - DNA, 25 bp, Mus musculus
acagttttgcccagcgccgccttgg

SEQ ID NO: 4390 - DNA, 25 bp, Mus musculus
acataaaccatccttgctacagcct

SEQ ID NO: 4391 - DNA, 25 bp, Mus musculus
acatactggcccctctggtatatcg

SEQ ID NO: 4392 - DNA, 25 bp, Mus musculus
acatagagaaccacgcctgcctggg

SEQ ID NO: 4393 - DNA, 25 bp, Mus musculus
acatagcaagctgcacaagggaact

SEQ ID NO: 4394 - DNA, 25 bp, Mus musculus
acataggcggacagccccggttccg

SEQ ID NO: 4395 - DNA, 25 bp, Mus musculus
acatagggagtgagccccgcagtta

SEQ ID NO: 4396 - DNA, 25 bp, Mus musculus
acatagtcacattaccatgcctagg

SEQ ID NO: 4397 - DNA, 25 bp, Mus musculus
acatagtcgtcagtcctcccttgga

SEQ ID NO: 4398 - DNA, 25 bp, Mus musculus
acatatgtgaacctgctggccccgc

SEQ ID NO: 4399 - DNA, 25 bp, Mus musculus
acatatgtgggtgtaggggccaacc

SEQ ID NO: 4400 - DNA, 25 bp, Mus musculus
acatcaacatggctggagagcccaa

SEQ ID NO: 4401 - DNA, 25 bp, Mus musculus
acatcaagggcatcaccaaactggg

SEQ ID NO: 4402 - DNA, 25 bp, Mus musculus
acatcaagggcggtggagaagacaa

SEQ ID NO: 4403 - DNA, 25 bp, Mus musculus
acatcaatgcaagcctgaagaaaaa

SEQ ID NO: 4404 - DNA, 25 bp, Mus musculus
acatcactgaactggctgacgagca

SEQ ID NO: 4405 - DNA, 25 bp, Mus musculus
acatcagaattctctgcccctgtgt

SEQ ID NO: 4406 - DNA, 25 bp, Mus musculus
acatcagccgcatttacatcttcca

SEQ ID NO: 4407 - DNA, 25 bp, Mus musculus
acatcagcgatctctcctgcacagg

SEQ ID NO: 4408 - DNA, 25 bp, Mus musculus
acatcaggctgtaaacttcctggct

SEQ ID NO: 4409 - DNA, 25 bp, Mus musculus
acatcagtcagcagaacagtaaaat

SEQ ID NO: 4410 - DNA, 25 bp, Mus musculus
acatcatcagcatcgtggccaagga

SEQ ID NO: 4411 - DNA, 25 bp, Mus musculus
acatcatcccattgagaaccccagg

SEQ ID NO: 4412 - DNA, 25 bp, Mus musculus
acatcatgctgatgtttcagaatgc

SEQ ID NO: 4413 - DNA, 25 bp, Mus musculus
acatcatgctgcagcgctgccgaga

SEQ ID NO: 4414 - DNA, 25 bp, Mus musculus
acatcatggacctgaagcaggagct

SEQ ID NO: 4415 - DNA, 25 bp, Mus musculus
acatccatggctggactgcactctt

SEQ ID NO: 4416 - DNA, 25 bp, Mus musculus
acatccctaagcagaaactactgcg

SEQ ID NO: 4417 - DNA, 25 bp, Mus musculus
acatccgtgactctgctgcagccgt

SEQ ID NO: 4418 - DNA, 25 bp, Mus musculus
acatcctccaaacagactgatgcac

SEQ ID NO: 4419 - DNA, 25 bp, Mus musculus
acatcctggaaaaagaccaagccac

SEQ ID NO: 4420 - DNA, 25 bp, Mus musculus
acatcctgtatatcgccaaccttgg

SEQ ID NO: 4421 - DNA, 25 bp, Mus musculus
acatccttaggaatgctttggtgtc

SEQ ID NO: 4422 - DNA, 25 bp, Mus musculus
acatcgacactgtaggcactgaagg

SEQ ID NO: 4423 - DNA, 25 bp, Mus musculus
acatcgacattcacaacttcctggg

SEQ ID NO: 4424 - DNA, 25 bp, Mus musculus
acatcgatgactgctggattggtgg

SEQ ID NO: 4425 - DNA, 25 bp, Mus musculus
acatcgcatctttggctgggcaagc

SEQ ID NO: 4426 - DNA, 25 bp, Mus musculus
acatcgcctggtggtattaccagta

SEQ ID NO: 4427 - DNA, 25 bp, Mus musculus
acatcgcgttccagagcccacagaa

SEQ ID NO: 4428 - DNA, 25 bp, Mus musculus
acatcgggggcctggacaagcagat

SEQ ID NO: 4429 - DNA, 25 bp, Mus musculus
acatcgtgggccagctggacatcct

SEQ ID NO: 4430 - DNA, 25 bp, Mus musculus
acatctatgccctccatcggaacag

SEQ ID NO: 4431 - DNA, 25 bp, Mus musculus
acatctcaggcggatcacagtcgct

SEQ ID NO: 4432 - DNA, 25 bp, Mus musculus
acatctccattctcaagtgcctgca

SEQ ID NO: 4433 - DNA, 25 bp, Mus musculus
acatctgatgatatactaccacaag

SEQ ID NO: 4434 - DNA, 25 bp, Mus musculus
acatctgatttgaaggcagactcaa

SEQ ID NO: 4435 - DNA, 25 bp, Mus musculus
acatctgccacaagtgttcccttcg

SEQ ID NO: 4436 - DNA, 25 bp, Mus musculus
acatcttgagttgatggaagacatt

SEQ ID NO: 4437 - DNA, 25 bp, Mus musculus
acatgaagaacaccacatgccagga

SEQ ID NO: 4438 - DNA, 25 bp, Mus musculus
acatgaagttcaagcagaagcagcg

SEQ ID NO: 4439 - DNA, 25 bp, Mus musculus
acatgacaaaccagaacactccaga

SEQ ID NO: 4440 - DNA, 25 bp, Mus musculus
acatgacatttttacgcttcctgaa

SEQ ID NO: 4441 - DNA, 25 bp, Mus musculus
acatgagagaaatgcgacccaggcc

SEQ ID NO: 4442 - DNA, 25 bp, Mus musculus
acatgaggaaccacaaagcccacct

SEQ ID NO: 4443 - DNA, 25 bp, Mus musculus
acatgaggaacctcaaagcccacct

SEQ ID NO: 4444 - DNA, 25 bp, Mus musculus
acatgatgtcccctcagaagatgag

SEQ ID NO: 4445 - DNA, 25 bp, Mus musculus
acatgattgccagaaatggatacac

SEQ ID NO: 4446 - DNA, 25 bp, Mus musculus
acatgattttcctggttagaagacc

SEQ ID NO: 4447 - DNA, 25 bp, Mus musculus
acatgcacatctaccccattgtcat

SEQ ID NO: 4448 - DNA, 25 bp, Mus musculus
acatgcagaagttcccgttgcggat

SEQ ID NO: 4449 - DNA, 25 bp, Mus musculus
acatgcagttcagccacagcagcag

SEQ ID NO: 4450 - DNA, 25 bp, Mus musculus
acatgcatggaacaaaactcaaaag

SEQ ID NO: 4451 - DNA, 25 bp, Mus musculus
acatgcatgggcattgtgaggaagc

SEQ ID NO: 4452 - DNA, 25 bp, Mus musculus
acatgcctttcctctggcacacaat

SEQ ID NO: 4453 - DNA, 25 bp, Mus musculus
acatgcgggttatggctggagccct

SEQ ID NO: 4454 - DNA, 25 bp, Mus musculus
acatgcgtcaggacctccgcctgat

SEQ ID NO: 4455 - DNA, 25 bp, Mus musculus
acatgctccgtgcacaaggcaaggc

SEQ ID NO: 4456 - DNA, 25 bp, Mus musculus
acatgctgctccagcgactgcagga

SEQ ID NO: 4457 - DNA, 25 bp, Mus musculus
acatggatccgctcagagcccagca

SEQ ID NO: 4458 - DNA, 25 bp, Mus musculus
acatggcaggctacatgccagcgcg

SEQ ID NO: 4459 - DNA, 25 bp, Mus musculus
acatggccaacctatcgcttcacga

SEQ ID NO: 4460 - DNA, 25 bp, Mus musculus
acatggccgccgtttcttgcgggcc

SEQ ID NO: 4461 - DNA, 25 bp, Mus musculus
acatgggagctcacatgttccaggg

SEQ ID NO: 4462 - DNA, 25 bp, Mus musculus
acatgggcaagatcgtgtacagctg

SEQ ID NO: 4463 - DNA, 25 bp, Mus musculus
acatggtttctcagtgaagaggagg

SEQ ID NO: 4464 - DNA, 25 bp, Mus musculus
acatgtatatcaggtactgctgtga

SEQ ID NO: 4465 - DNA, 25 bp, Mus musculus
acatgtcaccaaccttctccgggaa

SEQ ID NO: 4466 - DNA, 25 bp, Mus musculus
acatgtcagagtgggagtcctacta

SEQ ID NO: 4467 - DNA, 25 bp, Mus musculus
acatgtcagatcaagaggaggagat

SEQ ID NO: 4468 - DNA, 25 bp, Mus musculus
acatgtcccggcaggccttgcaggg

SEQ ID NO: 4469 - DNA, 25 bp, Mus musculus
acatgtcctcacgtacatggaggat

SEQ ID NO: 4470 - DNA, 25 bp, Mus musculus
acatgtgaacagagtcccctgcctg

SEQ ID NO: 4471 - DNA, 25 bp, Mus musculus
acatgtgaacagtgtcccctgcctg

SEQ ID NO: 4472 - DNA, 25 bp, Mus musculus
acatgtgaggccagcaaccggctgg

SEQ ID NO: 4473 - DNA, 25 bp, Mus musculus
acatgtgccccgtgtgctgctgagg

SEQ ID NO: 4474 - DNA, 25 bp, Mus musculus
acatgtgggactcctatctatatgg

SEQ ID NO: 4475 - DNA, 25 bp, Mus musculus
acatgtggtaaagatagaccctcca

SEQ ID NO: 4476 - DNA, 25 bp, Mus musculus
acattccagggtgctacagcaagca

SEQ ID NO: 4477 - DNA, 25 bp, Mus musculus
acattcccgtccctacatggcatat

SEQ ID NO: 4478 - DNA, 25 bp, Mus musculus
acattccctacccaagtgtccatga

SEQ ID NO: 4479 - DNA, 25 bp, Mus musculus
acattcccttctcccagggtggtgg

SEQ ID NO: 4480 - DNA, 25 bp, Mus musculus
acattccgaaaagcaaatgggagat

SEQ ID NO: 4481 - DNA, 25 bp, Mus musculus
acattcgggatagggctcacatcct

SEQ ID NO: 4482 - DNA, 25 bp, Mus musculus
acattcgttcctggccagaagcaaa

SEQ ID NO: 4483 - DNA, 25 bp, Mus musculus
acattctctgtagttcccagggcag

SEQ ID NO: 4484 - DNA, 25 bp, Mus musculus
acattctttgatgtggacacttacc

SEQ ID NO: 4485 - DNA, 25 bp, Mus musculus
acattgaaaacagagatgtggccaa

SEQ ID NO: 4486 - DNA, 25 bp, Mus musculus
acattgagcagggtggcctggtcaa

SEQ ID NO: 4487 - DNA, 25 bp, Mus musculus
acattgccttggtccacctctctag

SEQ ID NO: 4488 - DNA, 25 bp, Mus musculus
acattggctccatcatgaagggtgg

SEQ ID NO: 4489 - DNA, 25 bp, Mus musculus
acattgggctaataggcctcattgg

SEQ ID NO: 4490 - DNA, 25 bp, Mus musculus
acattgtctcttcggagccttggca

SEQ ID NO: 4491 - DNA, 25 bp, Mus musculus
acattgtgtacgatccttcacacct

SEQ ID NO: 4492 - DNA, 25 bp, Mus musculus
acattgtgtacgttccttcacacct

SEQ ID NO: 4493 - DNA, 25 bp, Mus musculus
acatttcagaaaatggcccaccaga

SEQ ID NO: 4494 - DNA, 25 bp, Mus musculus
acatttcagaaattggcccaccaga

SEQ ID NO: 4495 - DNA, 25 bp, Mus musculus
acatttcatgttggttcggagagga

SEQ ID NO: 4496 - DNA, 25 bp, Mus musculus
acatttgacacacaaaggcaggaag

SEQ ID NO: 4497 - DNA, 25 bp, Mus musculus
acatttggcccctccctgttggaca

SEQ ID NO: 4498 - DNA, 25 bp, Mus musculus
acatttgggctgtcagcttcgggcc

SEQ ID NO: 4499 - DNA, 25 bp, Mus musculus
acatttggtcagttgggtgcatcat

SEQ ID NO: 4500 - DNA, 25 bp, Mus musculus
acattttaaggtcccgtgctgtggg

SEQ ID NO: 4501 - DNA, 25 bp, Mus musculus
acattttgatggcagagcccaagat

SEQ ID NO: 4502 - DNA, 25 bp, Mus musculus
acatttttatacctgaaattcctgg

SEQ ID NO: 4503 - DNA, 25 bp, Mus musculus
acatttttctacacctggacaaagc

SEQ ID NO: 4504 - DNA, 25 bp, Mus musculus
accaaacatggcagcagagacggga

SEQ ID NO: 4505 - DNA, 25 bp, Mus musculus
accaaaccggctggctgtggtcgga

SEQ ID NO: 4506 - DNA, 25 bp, Mus musculus
accaaagaaaccattgacaagagct

SEQ ID NO: 4507 - DNA, 25 bp, Mus musculus
accaaagatgtctgggaaatccctc

SEQ ID NO: 4508 - DNA, 25 bp, Mus musculus
accaaaggctgaagcccagacgcac

SEQ ID NO: 4509 - DNA, 25 bp, Mus musculus
accaaatgccttgggaaaagcaaag

SEQ ID NO: 4510 - DNA, 25 bp, Mus musculus
accaacacaagctcagcagggacca

SEQ ID NO: 4511 - DNA, 25 bp, Mus musculus
accaacacagttatagcaaagaagc

SEQ ID NO: 4512 - DNA, 25 bp, Mus musculus
accaacacagttttagcaaagaagc

SEQ ID NO: 4513 - DNA, 25 bp, Mus musculus
accaacagagactgtgactccctca

SEQ ID NO: 4514 - DNA, 25 bp, Mus musculus
accaaccacaatggcacaggaggga

SEQ ID NO: 4515 - DNA, 25 bp, Mus musculus
accaacctggccaagtatccagcgt

SEQ ID NO: 4516 - DNA, 25 bp, Mus musculus
accaacgagactgggcagccgctga

SEQ ID NO: 4517 - DNA, 25 bp, Mus musculus
accaacgtccgtcagcctgacagag

SEQ ID NO: 4518 - DNA, 25 bp, Mus musculus
accaactacgcgaggctttgaagat

SEQ ID NO: 4519 - DNA, 25 bp, Mus musculus
accaagaaggcagcagtcgcaggtg

SEQ ID NO: 4520 - DNA, 25 bp, Mus musculus
accaagacgagtgtttgatgggcac

SEQ ID NO: 4521 - DNA, 25 bp, Mus musculus
accaagagcagatccttcaccagcg

SEQ ID NO: 4522 - DNA, 25 bp, Mus musculus
accaagatctcggtcacgatccaaa

SEQ ID NO: 4523 - DNA, 25 bp, Mus musculus
accaagcaaaatgaggccttctctc

SEQ ID NO: 4524 - DNA, 25 bp, Mus musculus
accaagcgcgcgatgcagtgtgtgt

SEQ ID NO: 4525 - DNA, 25 bp, Mus musculus
accaagctggtgaagccaaggagga

SEQ ID NO: 4526 - DNA, 25 bp, Mus musculus
accaagcttgagagccaccttgatg

SEQ ID NO: 4527 - DNA, 25 bp, Mus musculus
accaaggagaacagctcaggctgaa

SEQ ID NO: 4528 - DNA, 25 bp, Mus musculus
accaaggcagctcggctttgtcagg

SEQ ID NO: 4529 - DNA, 25 bp, Mus musculus
accaagggctccttctactgccagg

SEQ ID NO: 4530 - DNA, 25 bp, Mus musculus
accaagggtgctctggacatgttga

SEQ ID NO: 4531 - DNA, 25 bp, Mus musculus
accaatcaagtgctgtgaactagag

SEQ ID NO: 4532 - DNA, 25 bp, Mus musculus
accaatcagaaacagtagcccctac

SEQ ID NO: 4533 - DNA, 25 bp, Mus musculus
accaatgagtcccagaaatccctga

SEQ ID NO: 4534 - DNA, 25 bp, Mus musculus
accacaaaatctgcgggcagtctgg

SEQ ID NO: 4535 - DNA, 25 bp, Mus musculus
accacaaaggctccatattacacag

SEQ ID NO: 4536 - DNA, 25 bp, Mus musculus
accacaactgcgcacgagtgctgca

SEQ ID NO: 4537 - DNA, 25 bp, Mus musculus
accacaaggcgatttgtcggccaca

SEQ ID NO: 4538 - DNA, 25 bp, Mus musculus
accacacatctgaggactcagaact

SEQ ID NO: 4539 - DNA, 25 bp, Mus musculus
accacacggctgacaatggcgtggg

SEQ ID NO: 4540 - DNA, 25 bp, Mus musculus
accacagatgggagaagaatattca

SEQ ID NO: 4541 - DNA, 25 bp, Mus musculus
accacagcagtttagatggactaag

SEQ ID NO: 4542 - DNA, 25 bp, Mus musculus
accacagccaaggagcgggtgcctg

SEQ ID NO: 4543 - DNA, 25 bp, Mus musculus
accacatgcttgtccgggcccatgg

SEQ ID NO: 4544 - DNA, 25 bp, Mus musculus
accacatgttcgtgctggagcagga

SEQ ID NO: 4545 - DNA, 25 bp, Mus musculus
accaccaaacatgaccaaacaagga

SEQ ID NO: 4546 - DNA, 25 bp, Mus musculus
accaccaaccttcggagtagatctc

SEQ ID NO: 4547 - DNA, 25 bp, Mus musculus
accaccacatgttcgtgctggagca

SEQ ID NO: 4548 - DNA, 25 bp, Mus musculus
accaccacgacagcaggcggatatt

SEQ ID NO: 4549 - DNA, 25 bp, Mus musculus
accaccacgacttcagcttggagtt

SEQ ID NO: 4550 - DNA, 25 bp, Mus musculus
accaccactgagtccgtggaggagg

SEQ ID NO: 4551 - DNA, 25 bp, Mus musculus
accaccagcctgtgccatgaacaag

SEQ ID NO: 4552 - DNA, 25 bp, Mus musculus
accaccatgggcaggactcgctgaa

SEQ ID NO: 4553 - DNA, 25 bp, Mus musculus
accacccggagaggacgccttgaga

SEQ ID NO: 4554 - DNA, 25 bp, Mus musculus
accacccgggtggagatagatcgag

SEQ ID NO: 4555 - DNA, 25 bp, Mus musculus
accaccctgatttaagaaggatcct

SEQ ID NO: 4556 - DNA, 25 bp, Mus musculus
accacctcctatctggatttaaaga

SEQ ID NO: 4557 - DNA, 25 bp, Mus musculus
accacctctgtgctgctgcagttgg

SEQ ID NO: 4558 - DNA, 25 bp, Mus musculus
accacctctgtggtgctgcagttgg

SEQ ID NO: 4559 - DNA, 25 bp, Mus musculus
accacctcttggcagtctttgtaga

SEQ ID NO: 4560 - DNA, 25 bp, Mus musculus
accacctcttgggagtctttgtaga

SEQ ID NO: 4561 - DNA, 25 bp, Mus musculus
accacctggcagagaagttccggca

SEQ ID NO: 4562 - DNA, 25 bp, Mus musculus
accacgaactgtctaacacggactg

SEQ ID NO: 4563 - DNA, 25 bp, Mus musculus
accacgacagcaggcggatatttgt

SEQ ID NO: 4564 - DNA, 25 bp, Mus musculus
accacgaggatcctaagacgcatcc

SEQ ID NO: 4565 - DNA, 25 bp, Mus musculus
accacgcggttcagctctttcggag

SEQ ID NO: 4566 - DNA, 25 bp, Mus musculus
accacgcggttctgctctttcggag

SEQ ID NO: 4567 - DNA, 25 bp, Mus musculus
accacgctctcaacgatatgacttc

SEQ ID NO: 4568 - DNA, 25 bp, Mus musculus
accacggacagcgtgagttgggaca

SEQ ID NO: 4569 - DNA, 25 bp, Mus musculus
accacggctgtccagaagacgtcca

SEQ ID NO: 4570 - DNA, 25 bp, Mus musculus
accacggtggccaaaattcttagct

SEQ ID NO: 4571 - DNA, 25 bp, Mus musculus
accacgtctccaagatgagccgcat

SEQ ID NO: 4572 - DNA, 25 bp, Mus musculus
accacgtgcgctgtgcatggcggct

SEQ ID NO: 4573 - DNA, 25 bp, Mus musculus
accactaactgtatggaagtgatga

SEQ ID NO: 4574 - DNA, 25 bp, Mus musculus
accactagccatgggcagccgagat

SEQ ID NO: 4575 - DNA, 25 bp, Mus musculus
accactcagggaggaacacccagaa

SEQ ID NO: 4576 - DNA, 25 bp, Mus musculus
accactgaggcccagcctgcagaaa

SEQ ID NO: 4577 - DNA, 25 bp, Mus musculus
accactgcaatgcacagaatcccag

SEQ ID NO: 4578 - DNA, 25 bp, Mus musculus
accactgtcactccagagattgaga

SEQ ID NO: 4579 - DNA, 25 bp, Mus musculus
accacttacgatgggcttgagcagc

SEQ ID NO: 4580 - DNA, 25 bp, Mus musculus
accagaacaattaccagccctacta

SEQ ID NO: 4581 - DNA, 25 bp, Mus musculus
accagaagcgccagaagtgtcgttg

SEQ ID NO: 4582 - DNA, 25 bp, Mus musculus
accagaatatggtggctgactgttc

SEQ ID NO: 4583 - DNA, 25 bp, Mus musculus
accagacaggaggtgtcctggttgt

SEQ ID NO: 4584 - DNA, 25 bp, Mus musculus
accagaccttccagcgcatcgtgga

SEQ ID NO: 4585 - DNA, 25 bp, Mus musculus
accagacgatatgtttgcggttgga

SEQ ID NO: 4586 - DNA, 25 bp, Mus musculus
accagagaagaattcacttagacag

SEQ ID NO: 4587 - DNA, 25 bp, Mus musculus
accagagcaaagaagaggagggcct

SEQ ID NO: 4588 - DNA, 25 bp, Mus musculus
accagagcagcaggacggaaatcaa

SEQ ID NO: 4589 - DNA, 25 bp, Mus musculus
accagagggacaaggaacgagaacg

SEQ ID NO: 4590 - DNA, 25 bp, Mus musculus
accagagtccttccgtgggtcaaag

SEQ ID NO: 4591 - DNA, 25 bp, Mus musculus
accagataaacctgcaagtcccaag

SEQ ID NO: 4592 - DNA, 25 bp, Mus musculus
accagatcttcaatctatggagcag

SEQ ID NO: 4593 - DNA, 25 bp, Mus musculus
accagatggcccaggaggacgctca

SEQ ID NO: 4594 - DNA, 25 bp, Mus musculus
accagcaacgggacggcacggttgc

SEQ ID NO: 4595 - DNA, 25 bp, Mus musculus
accagcacactgacaaccagaaggt

SEQ ID NO: 4596 - DNA, 25 bp, Mus musculus
accagcaggcctgcctgagggagaa

SEQ ID NO: 4597 - DNA, 25 bp, Mus musculus
accagcaggttctcctgcaagggaa

SEQ ID NO: 4598 - DNA, 25 bp, Mus musculus
accagccacgtatgacggtgccagc

SEQ ID NO: 4599 - DNA, 25 bp, Mus musculus
accagccatgggtcaagaggcttgt

SEQ ID NO: 4600 - DNA, 25 bp, Mus musculus
accagccctactaaaggaggacgct

SEQ ID NO: 4601 - DNA, 25 bp, Mus musculus
accagccggtggaactcagcccggg

SEQ ID NO: 4602 - DNA, 25 bp, Mus musculus
accagccggtggtactcagcccggg

SEQ ID NO: 4603 - DNA, 25 bp, Mus musculus
accagcctgggccatacacttgtgg

SEQ ID NO: 4604 - DNA, 25 bp, Mus musculus
accagcgggtccctgctgacatgat

SEQ ID NO: 4605 - DNA, 25 bp, Mus musculus
accagcgttataagatcaagatgac

SEQ ID NO: 4606 - DNA, 25 bp, Mus musculus
accagctgctgattcacgcggccat

SEQ ID NO: 4607 - DNA, 25 bp, Mus musculus
accagctgctggtggcaccactcag

SEQ ID NO: 4608 - DNA, 25 bp, Mus musculus
accaggacatacaggaacatcatgc

SEQ ID NO: 4609 - DNA, 25 bp, Mus musculus
accaggacatgagcgggagccttct

SEQ ID NO: 4610 - DNA, 25 bp, Mus musculus
accaggacctaggaaacgccagtct

SEQ ID NO: 4611 - DNA, 25 bp, Mus musculus
accaggactgccaccgtgtgacctg

SEQ ID NO: 4612 - DNA, 25 bp, Mus musculus
accaggaggctattctctccacggt

SEQ ID NO: 4613 - DNA, 25 bp, Mus musculus
accaggaggtgatgaactccaagct

SEQ ID NO: 4614 - DNA, 25 bp, Mus musculus
accaggataacctgtaatgggcaag

SEQ ID NO: 4615 - DNA, 25 bp, Mus musculus
accaggccatgctgagtgtggacga

SEQ ID NO: 4616 - DNA, 25 bp, Mus musculus
accaggcctgggttgacgccaagag

SEQ ID NO: 4617 - DNA, 25 bp, Mus musculus
accagggcattactagtctctacca

SEQ ID NO: 4618 - DNA, 25 bp, Mus musculus
accagggttacagagcatctgtact

SEQ ID NO: 4619 - DNA, 25 bp, Mus musculus
accagggttctgacctcgggctcag

SEQ ID NO: 4620 - DNA, 25 bp, Mus musculus
accaggtcgctctggatatccaggc

SEQ ID NO: 4621 - DNA, 25 bp, Mus musculus
accaggtgctactacgctactatga

SEQ ID NO: 4622 - DNA, 25 bp, Mus musculus
accagtacctggaggccaccgggag

SEQ ID NO: 4623 - DNA, 25 bp, Mus musculus
accagtatgggcacaaaaagaaggc

SEQ ID NO: 4624 - DNA, 25 bp, Mus musculus
accagtcaggcagctttgctggctc

SEQ ID NO: 4625 - DNA, 25 bp, Mus musculus
accagtctcactgcatggagccaga

SEQ ID NO: 4626 - DNA, 25 bp, Mus musculus
accagtgaatctgggcctatgggac

SEQ ID NO: 4627 - DNA, 25 bp, Mus musculus
accagtgaccagttcctcttcttaa

SEQ ID NO: 4628 - DNA, 25 bp, Mus musculus
accagtgcatgacagccctggacct

SEQ ID NO: 4629 - DNA, 25 bp, Mus musculus
accagtggagtgaggcagctgccct

SEQ ID NO: 4630 - DNA, 25 bp, Mus musculus
accagtggccctcccaagatggcag

SEQ ID NO: 4631 - DNA, 25 bp, Mus musculus
accagtggtcggtatgcgcacggct

SEQ ID NO: 4632 - DNA, 25 bp, Mus musculus
accagtgtattctaaaaagggactg

SEQ ID NO: 4633 - DNA, 25 bp, Mus musculus
accagtgttctatcctgttgaatcc

SEQ ID NO: 4634 - DNA, 25 bp, Mus musculus
accagttactaggagatgcgggagc

SEQ ID NO: 4635 - DNA, 25 bp, Mus musculus
accagttctaccactccttgctatg

SEQ ID NO: 4636 - DNA, 25 bp, Mus musculus
accagttctaccagggcttccctgg

SEQ ID NO: 4637 - DNA, 25 bp, Mus musculus
accataagtgcggagtgccccatga

SEQ ID NO: 4638 - DNA, 25 bp, Mus musculus
accatacaggtaggcctttccctga

SEQ ID NO: 4639 - DNA, 25 bp, Mus musculus
accataccatccagacactgtttag

SEQ ID NO: 4640 - DNA, 25 bp, Mus musculus
accatatttttgagtccccagtcag

SEQ ID NO: 4641 - DNA, 25 bp, Mus musculus
accatcacggagaagcacaaaatga

SEQ ID NO: 4642 - DNA, 25 bp, Mus musculus
accatcaggctacttatgcatggaa

SEQ ID NO: 4643 - DNA, 25 bp, Mus musculus
accatcatggcagtggagtttgacg

SEQ ID NO: 4644 - DNA, 25 bp, Mus musculus
accatccagcaggtcatcaagtcag

SEQ ID NO: 4645 - DNA, 25 bp, Mus musculus
accatcctgggcattgcccgttgca

SEQ ID NO: 4646 - DNA, 25 bp, Mus musculus
accatcctgtgtcgctgtgagaata

SEQ ID NO: 4647 - DNA, 25 bp, Mus musculus
accatccttgctacagcctagaaca

SEQ ID NO: 4648 - DNA, 25 bp, Mus musculus
accatccttggcttcacaggagcaa

SEQ ID NO: 4649 - DNA, 25 bp, Mus musculus
accatcggtttgtagcggacagcaa

SEQ ID NO: 4650 - DNA, 25 bp, Mus musculus
accatctctccagctggcgacagct

SEQ ID NO: 4651 - DNA, 25 bp, Mus musculus
accatctgcgaccaccggagggaag

SEQ ID NO: 4652 - DNA, 25 bp, Mus musculus
accatcttccgccaggtgtgcctgg

SEQ ID NO: 4653 - DNA, 25 bp, Mus musculus
accatcttgtcgctttgcttctcca

SEQ ID NO: 4654 - DNA, 25 bp, Mus musculus
accatctttccaccatagaaaagga

SEQ ID NO: 4655 - DNA, 25 bp, Mus musculus
accatgagccagagccggccagtgg

SEQ ID NO: 4656 - DNA, 25 bp, Mus musculus
accatgatggcccaatggagccagt

SEQ ID NO: 4657 - DNA, 25 bp, Mus musculus
accatgcaccactttggcctgggca

SEQ ID NO: 4658 - DNA, 25 bp, Mus musculus
accatgcagatcattctacagccat

SEQ ID NO: 4659 - DNA, 25 bp, Mus musculus
accatgccagcatcagtgaactgaa

SEQ ID NO: 4660 - DNA, 25 bp, Mus musculus
accatgccttcctttgttcatgaag

SEQ ID NO: 4661 - DNA, 25 bp, Mus musculus
accatgcgatacctgcctgagctct

SEQ ID NO: 4662 - DNA, 25 bp, Mus musculus
accatgcggaccagtgggactgagc

SEQ ID NO: 4663 - DNA, 25 bp, Mus musculus
accatgcggcgtaagggcaccaagc

SEQ ID NO: 4664 - DNA, 25 bp, Mus musculus
accatgcgtctgagaattcctttgt

SEQ ID NO: 4665 - DNA, 25 bp, Mus musculus
accatggagcgtagagagaacagac

SEQ ID NO: 4666 - DNA, 25 bp, Mus musculus
accatggaggagacaagcctgagga

SEQ ID NO: 4667 - DNA, 25 bp, Mus musculus
accatggccaaagttataaccactg

SEQ ID NO: 4668 - DNA, 25 bp, Mus musculus
accatgggcaggactcgctgaagga

SEQ ID NO: 4669 - DNA, 25 bp, Mus musculus
accatgtatcacattgattgtagag

SEQ ID NO: 4670 - DNA, 25 bp, Mus musculus
accatgtatgacaccaagacccggg

SEQ ID NO: 4671 - DNA, 25 bp, Mus musculus
accattaatcgtactgctcgactgt

SEQ ID NO: 4672 - DNA, 25 bp, Mus musculus
accattaatcgttctgctcgactgt

SEQ ID NO: 4673 - DNA, 25 bp, Mus musculus
accattgaaggagagccggagtcca

SEQ ID NO: 4674 - DNA, 25 bp, Mus musculus
accattgccatcacccagaactttg

SEQ ID NO: 4675 - DNA, 25 bp, Mus musculus
accattgtggagcatgattctggaa

SEQ ID NO: 4676 - DNA, 25 bp, Mus musculus
accattgtttattgggtcacatacc

SEQ ID NO: 4677 - DNA, 25 bp, Mus musculus
accatttaaaacctggaggcactgg

SEQ ID NO: 4678 - DNA, 25 bp, Mus musculus
accattttcataaggaatcttttgc

SEQ ID NO: 4679 - DNA, 25 bp, Mus musculus
acccaaaagcaaacttgctgaaggg

SEQ ID NO: 4680 - DNA, 25 bp, Mus musculus
acccaacagtactctgatcatcagc

SEQ ID NO: 4681 - DNA, 25 bp, Mus musculus
acccaagaaagtggctgggaagtgc

SEQ ID NO: 4682 - DNA, 25 bp, Mus musculus
acccaagcctgagcttgcagtgaga

SEQ ID NO: 4683 - DNA, 25 bp, Mus musculus
acccacagacggaaggcttgctggg

SEQ ID NO: 4684 - DNA, 25 bp, Mus musculus
acccaccagcgaagggagagacagc

SEQ ID NO: 4685 - DNA, 25 bp, Mus musculus
acccacccgcatcttaaggagacga

SEQ ID NO: 4686 - DNA, 25 bp, Mus musculus
acccacgctgaacgaaagggacacg

SEQ ID NO: 4687 - DNA, 25 bp, Mus musculus
acccactcgctgtccaactgtagga

SEQ ID NO: 4688 - DNA, 25 bp, Mus musculus
acccagaatggcaacggcggcggct

SEQ ID NO: 4689 - DNA, 25 bp, Mus musculus
acccagaggtgatcgtggtgacaag

SEQ ID NO: 4690 - DNA, 25 bp, Mus musculus
acccagatgcaggtggtcagaggcc

SEQ ID NO: 4691 - DNA, 25 bp, Mus musculus
acccagccagtgacactgcagctgt

SEQ ID NO: 4692 - DNA, 25 bp, Mus musculus
acccagcccgctggagtgagcagga

SEQ ID NO: 4693 - DNA, 25 bp, Mus musculus
acccagccctgcagcctgatgagta

SEQ ID NO: 4694 - DNA, 25 bp, Mus musculus
acccagctcatgctgatgggccttt

SEQ ID NO: 4695 - DNA, 25 bp, Mus musculus
acccagctcatggtgatgggccttt

SEQ ID NO: 4696 - DNA, 25 bp, Mus musculus
acccagctcccgagagatctgagca

SEQ ID NO: 4697 - DNA, 25 bp, Mus musculus
acccagctggagcacgcgcgcattg

SEQ ID NO: 4698 - DNA, 25 bp, Mus musculus
acccagctgggtcttctcgccagag

SEQ ID NO: 4699 - DNA, 25 bp, Mus musculus
acccagctttgaacccaccaagaat

SEQ ID NO: 4700 - DNA, 25 bp, Mus musculus
acccaggaatggagacaccgctgga

SEQ ID NO: 4701 - DNA, 25 bp, Mus musculus
acccaggcaggctcagtgccttgct

SEQ ID NO: 4702 - DNA, 25 bp, Mus musculus
acccaggcggagagcgcccagagca

SEQ ID NO: 4703 - DNA, 25 bp, Mus musculus
acccaggtggccacagcaagtgaca

SEQ ID NO: 4704 - DNA, 25 bp, Mus musculus
acccaggttccggagaacaagatcg

SEQ ID NO: 4705 - DNA, 25 bp, Mus musculus
acccagtactcatgtcggaggctcc

SEQ ID NO: 4706 - DNA, 25 bp, Mus musculus
acccagttaggaggcgcttcattca

SEQ ID NO: 4707 - DNA, 25 bp, Mus musculus
acccatatgtggtttgtaatgcacc

SEQ ID NO: 4708 - DNA, 25 bp, Mus musculus
acccatctaggattccagagagaaa

SEQ ID NO: 4709 - DNA, 25 bp, Mus musculus
acccatgcagatgcaaaagtccagg

SEQ ID NO: 4710 - DNA, 25 bp, Mus musculus
acccatgccacgtctggtgacacag

SEQ ID NO: 4711 - DNA, 25 bp, Mus musculus
acccatggcttagatgaagaagctg

SEQ ID NO: 4712 - DNA, 25 bp, Mus musculus
accccaaaggagctatgctaaccca

SEQ ID NO: 4713 - DNA, 25 bp, Mus musculus
accccaactatgttgcagaatgtga

SEQ ID NO: 4714 - DNA, 25 bp, Mus musculus
accccaactggaagcagcaacagca

SEQ ID NO: 4715 - DNA, 25 bp, Mus musculus
accccaaggtccagatggcggccaa

SEQ ID NO: 4716 - DNA, 25 bp, Mus musculus
accccagaagaagctgtgaacttca

SEQ ID NO: 4717 - DNA, 25 bp, Mus musculus
accccagaaggtgtcgtctttgact

SEQ ID NO: 4718 - DNA, 25 bp, Mus musculus
accccagacaagaagggctgccgag

SEQ ID NO: 4719 - DNA, 25 bp, Mus musculus
accccagacaagtagggctgccgag

SEQ ID NO: 4720 - DNA, 25 bp, Mus musculus
accccagagcccagaaattcacgtg

SEQ ID NO: 4721 - DNA, 25 bp, Mus musculus
accccagagtggttgatctgctggt

SEQ ID NO: 4722 - DNA, 25 bp, Mus musculus
accccagcatgatgggacggcttgg

SEQ ID NO: 4723 - DNA, 25 bp, Mus musculus
accccaggacaagctcactgctaat

SEQ ID NO: 4724 - DNA, 25 bp, Mus musculus
accccaggagccgtagctgctgatt

SEQ ID NO: 4725 - DNA, 25 bp, Mus musculus
accccatcactatcattgagggcag

SEQ ID NO: 4726 - DNA, 25 bp, Mus musculus
accccatctgcattccaactgttag

SEQ ID NO: 4727 - DNA, 25 bp, Mus musculus
accccatttggcttataaagactcg

SEQ ID NO: 4728 - DNA, 25 bp, Mus musculus
accccgaagagacagggccttcaag

SEQ ID NO: 4729 - DNA, 25 bp, Mus musculus
accccgacagcagcagtagatgaag

SEQ ID NO: 4730 - DNA, 25 bp, Mus musculus
accccgatcagcatgtactcacagg

SEQ ID NO: 4731 - DNA, 25 bp, Mus musculus
accccgatttggcttgacttgctgg

SEQ ID NO: 4732 - DNA, 25 bp, Mus musculus
accccgctggtgaggataacaacgc

SEQ ID NO: 4733 - DNA, 25 bp, Mus musculus
accccggcgaatggaggagtcactc

SEQ ID NO: 4734 - DNA, 25 bp, Mus musculus
accccgtggcagagatggagaacct

SEQ ID NO: 4735 - DNA, 25 bp, Mus musculus
acccctgtcataatggaggtgtctg

SEQ ID NO: 4736 - DNA, 25 bp, Mus musculus
acccctgtgcaccttgtggctctgg

SEQ ID NO: 4737 - DNA, 25 bp, Mus musculus
acccctgttcacagtcagtgtggac

SEQ ID NO: 4738 - DNA, 25 bp, Mus musculus
accccttatccctctggacagaatg

SEQ ID NO: 4739 - DNA, 25 bp, Mus musculus
accccttctctctagccgtgtttga

SEQ ID NO: 4740 - DNA, 25 bp, Mus musculus
acccgaaggatgtgtatagtgtgtc

SEQ ID NO: 4741 - DNA, 25 bp, Mus musculus
acccgaggagccagccgttggcatt

SEQ ID NO: 4742 - DNA, 25 bp, Mus musculus
acccgaggagcctgccgttggcatt

SEQ ID NO: 4743 - DNA, 25 bp, Mus musculus
acccgatgatgtcattgctcagaag

SEQ ID NO: 4744 - DNA, 25 bp, Mus musculus
acccgcaggctgcaaggagcaacag

SEQ ID NO: 4745 - DNA, 25 bp, Mus musculus
acccgctcagagtgggaaaccctct

SEQ ID NO: 4746 - DNA, 25 bp, Mus musculus
acccggagcgcttctttctttgcag

SEQ ID NO: 4747 - DNA, 25 bp, Mus musculus
acccggcaactggaggaaccttcat

SEQ ID NO: 4748 - DNA, 25 bp, Mus musculus
acccgtcccaagaactccagataat

SEQ ID NO: 4749 - DNA, 25 bp, Mus musculus
acccgtgtccggcaggacactgtgt

SEQ ID NO: 4750 - DNA, 25 bp, Mus musculus
acccgtgtccgggaggacactgtgt

SEQ ID NO: 4751 - DNA, 25 bp, Mus musculus
acccgtgtgggctggcctggccttg

SEQ ID NO: 4752 - DNA, 25 bp, Mus musculus
acccgtgtgtgtcgccgataagcac

SEQ ID NO: 4753 - DNA, 25 bp, Mus musculus
accctaggacagagcacgggcaact

SEQ ID NO: 4754 - DNA, 25 bp, Mus musculus
accctatcacagacgagctgctgga

SEQ ID NO: 4755 - DNA, 25 bp, Mus musculus
accctcagaggcaggcaatgcactg

SEQ ID NO: 4756 - DNA, 25 bp, Mus musculus
accctcccagatgatgcagctagtg

SEQ ID NO: 4757 - DNA, 25 bp, Mus musculus
accctcccctgtatcgcttaattga

SEQ ID NO: 4758 - DNA, 25 bp, Mus musculus
accctccgaggatgggacacacgga

SEQ ID NO: 4759 - DNA, 25 bp, Mus musculus
accctcgacagctagagtcattaat

SEQ ID NO: 4760 - DNA, 25 bp, Mus musculus
accctctagagtaatcagaaagaag

SEQ ID NO: 4761 - DNA, 25 bp, Mus musculus
accctctggagacccaggcagggaa

SEQ ID NO: 4762 - DNA, 25 bp, Mus musculus
accctctggctcattgggcagcttt

SEQ ID NO: 4763 - DNA, 25 bp, Mus musculus
accctgaagcgtctctctgcctttt

SEQ ID NO: 4764 - DNA, 25 bp, Mus musculus
accctgactacaactactgctggca

SEQ ID NO: 4765 - DNA, 25 bp, Mus musculus
accctgactatgtgaggccaccata

SEQ ID NO: 4766 - DNA, 25 bp, Mus musculus
accctgagcaggaggcttcactgga

SEQ ID NO: 4767 - DNA, 25 bp, Mus musculus
accctgagccgtaatgatcctgcaa

SEQ ID NO: 4768 - DNA, 25 bp, Mus musculus
accctgatgagccaagagacttcat

SEQ ID NO: 4769 - DNA, 25 bp, Mus musculus
accctgatttaagaaggatcctgac

SEQ ID NO: 4770 - DNA, 25 bp, Mus musculus
accctgcgctgagggtcgcggctat

SEQ ID NO: 4771 - DNA, 25 bp, Mus musculus
accctgctatctgctgagaaacatg

SEQ ID NO: 4772 - DNA, 25 bp, Mus musculus
accctgctctggacacgaacggcag

SEQ ID NO: 4773 - DNA, 25 bp, Mus musculus
accctgctcttcagggaggtcagtt

SEQ ID NO: 4774 - DNA, 25 bp, Mus musculus
accctggagcacatcgtgggccagc

SEQ ID NO: 4775 - DNA, 25 bp, Mus musculus
accctggccgagtgctgctgcagaa

SEQ ID NO: 4776 - DNA, 25 bp, Mus musculus
accctggctaaagcagagccggagc

SEQ ID NO: 4777 - DNA, 25 bp, Mus musculus
accctggctgttacccagagaagaa

SEQ ID NO: 4778 - DNA, 25 bp, Mus musculus
accctgtccagccttccttttggag

SEQ ID NO: 4779 - DNA, 25 bp, Mus musculus
accctgtcggggttgcaacaagaag

SEQ ID NO: 4780 - DNA, 25 bp, Mus musculus
accctgtgtttccatggataataag

SEQ ID NO: 4781 - DNA, 25 bp, Mus musculus
acccttaaagaatgcagcagcttag

SEQ ID NO: 4782 - DNA, 25 bp, Mus musculus
acccttcagcagacgccggagagag

SEQ ID NO: 4783 - DNA, 25 bp, Mus musculus
acccttgacccaaattttctggatg

SEQ ID NO: 4784 - DNA, 25 bp, Mus musculus
acccttgggaaaggagagtctagag

SEQ ID NO: 4785 - DNA, 25 bp, Mus musculus
acccttgtgcttgttcagctcgtgc

SEQ ID NO: 4786 - DNA, 25 bp, Mus musculus
accctttgcggaagtctgcaatgac

SEQ ID NO: 4787 - DNA, 25 bp, Mus musculus
accgaaacacagatcccgagtccta

SEQ ID NO: 4788 - DNA, 25 bp, Mus musculus
accgaaccagcaaggtgcgggcgct

SEQ ID NO: 4789 - DNA, 25 bp, Mus musculus
accgaagaacctcgcgaaggagaag

SEQ ID NO: 4790 - DNA, 25 bp, Mus musculus
accgaagaacctggcgaaggagaag

SEQ ID NO: 4791 - DNA, 25 bp, Mus musculus
accgaagacgatgtgactacatgaa

SEQ ID NO: 4792 - DNA, 25 bp, Mus musculus
accgaagggaggagcactttcactt

SEQ ID NO: 4793 - DNA, 25 bp, Mus musculus
accgaattcggtttaagctcaggag

SEQ ID NO: 4794 - DNA, 25 bp, Mus musculus
accgaccagggcatcaaaaacttgc

SEQ ID NO: 4795 - DNA, 25 bp, Mus musculus
accgacctgtcattacaggacccag

SEQ ID NO: 4796 - DNA, 25 bp, Mus musculus
accgacgggagtacaggcgctttga

SEQ ID NO: 4797 - DNA, 25 bp, Mus musculus
accgagactagacaggtcacccgga

SEQ ID NO: 4798 - DNA, 25 bp, Mus musculus
accgaggagtgcatgcacggccgct

SEQ ID NO: 4799 - DNA, 25 bp, Mus musculus
accgagtcctgaagatccatgaaaa

SEQ ID NO: 4800 - DNA, 25 bp, Mus musculus
accgatttcggcctttgcaaggaat

SEQ ID NO: 4801 - DNA, 25 bp, Mus musculus
accgcaccctgagagttggtttcaa

SEQ ID NO: 4802 - DNA, 25 bp, Mus musculus
accgcagcacctgcgcagtggaggt

SEQ ID NO: 4803 - DNA, 25 bp, Mus musculus
accgcatgatcaagcacgaccggga

SEQ ID NO: 4804 - DNA, 25 bp, Mus musculus
accgcatgatcatgcacgaccggga

SEQ ID NO: 4805 - DNA, 25 bp, Mus musculus
accgcccagtacagcttttggctct

SEQ ID NO: 4806 - DNA, 25 bp, Mus musculus
accgccgcaaccacaaaggtggtgt

SEQ ID NO: 4807 - DNA, 25 bp, Mus musculus
accgccgggtagtgctggcctcctt

SEQ ID NO: 4808 - DNA, 25 bp, Mus musculus
accgcctgcactttctgcctgagag

SEQ ID NO: 4809 - DNA, 25 bp, Mus musculus
accgcgattggaggcaacctggcag

SEQ ID NO: 4810 - DNA, 25 bp, Mus musculus
accgctacggggaagtcacagttca

SEQ ID NO: 4811 - DNA, 25 bp, Mus musculus
accgctactaaatgaaaaccctcag

SEQ ID NO: 4812 - DNA, 25 bp, Mus musculus
accgctagaagagattgttgacaac

SEQ ID NO: 4813 - DNA, 25 bp, Mus musculus
accgctccaaagagggtctcacgga

SEQ ID NO: 4814 - DNA, 25 bp, Mus musculus
accgctctcatggttgctgctcaga

SEQ ID NO: 4815 - DNA, 25 bp, Mus musculus
accgctgctactgacactatgtttc

SEQ ID NO: 4816 - DNA, 25 bp, Mus musculus
accggaagctgagaactccacagag

SEQ ID NO: 4817 - DNA, 25 bp, Mus musculus
accggagccgctatgccgcagtgtt

SEQ ID NO: 4818 - DNA, 25 bp, Mus musculus
accggaggtatagctgtgcccactg

SEQ ID NO: 4819 - DNA, 25 bp, Mus musculus
accggcacaggcctgagctgattga

SEQ ID NO: 4820 - DNA, 25 bp, Mus musculus
accggcagaagatggtgaaagctct

SEQ ID NO: 4821 - DNA, 25 bp, Mus musculus
accggcagcggctagccagagaacg

SEQ ID NO: 4822 - DNA, 25 bp, Mus musculus
accggcgtgtgtacaagtccctctg

SEQ ID NO: 4823 - DNA, 25 bp, Mus musculus
accggctctgaaatcaggctcagcg

SEQ ID NO: 4824 - DNA, 25 bp, Mus musculus
accggcttagtactgtccgtgcagc

SEQ ID NO: 4825 - DNA, 25 bp, Mus musculus
accggcttcagcaggatgagtgagc

SEQ ID NO: 4826 - DNA, 25 bp, Mus musculus
accgggacacaggaatgctgccaag

SEQ ID NO: 4827 - DNA, 25 bp, Mus musculus
accgggagatggagcatttgagaca

SEQ ID NO: 4828 - DNA, 25 bp, Mus musculus
accgggagcgagtgctcagcctctc

SEQ ID NO: 4829 - DNA, 25 bp, Mus musculus
accgggatctgcaatctctgagatg

SEQ ID NO: 4830 - DNA, 25 bp, Mus musculus
accgggatgtactgggtgaaacaca

SEQ ID NO: 4831 - DNA, 25 bp, Mus musculus
accgggtgctagaggagctgcacaa

SEQ ID NO: 4832 - DNA, 25 bp, Mus musculus
accggtactgccatagatgtgccag

SEQ ID NO: 4833 - DNA, 25 bp, Mus musculus
accggtataaaatggtggtgcaagt

SEQ ID NO: 4834 - DNA, 25 bp, Mus musculus
accggtcgatgacacgtggctccaa

SEQ ID NO: 4835 - DNA, 25 bp, Mus musculus
accggtgtgtgataagctctctgag

SEQ ID NO: 4836 - DNA, 25 bp, Mus musculus
accgtaccgctgcagggatcaaagg

SEQ ID NO: 4837 - DNA, 25 bp, Mus musculus
accgtcagctacaccacaaatgcat

SEQ ID NO: 4838 - DNA, 25 bp, Mus musculus
accgtcctgccaacatcgagtctat

SEQ ID NO: 4839 - DNA, 25 bp, Mus musculus
accgtcgggttgtagatgggatatt

SEQ ID NO: 4840 - DNA, 25 bp, Mus musculus
accgtctccaagaagatactctcct

SEQ ID NO: 4841 - DNA, 25 bp, Mus musculus
accgtctggatcttctgtagttttg

SEQ ID NO: 4842 - DNA, 25 bp, Mus musculus
accgtctgggcagaatgtcacgatg

SEQ ID NO: 4843 - DNA, 25 bp, Mus musculus
accgtgagttcatcgctgagaggca

SEQ ID NO: 4844 - DNA, 25 bp, Mus musculus
accgtgatgcctttcatatagtttc

SEQ ID NO: 4845 - DNA, 25 bp, Mus musculus
accgtgcaggcagcatcgtcttgaa

SEQ ID NO: 4846 - DNA, 25 bp, Mus musculus
accgtgcccagtgacaacatttgga

SEQ ID NO: 4847 - DNA, 25 bp, Mus musculus
accgtgcttgctacccgggtggaga

SEQ ID NO: 4848 - DNA, 25 bp, Mus musculus
accgtgcttgcttcccgggtggaga

SEQ ID NO: 4849 - DNA, 25 bp, Mus musculus
accgttatccataacccagtggacg

SEQ ID NO: 4850 - DNA, 25 bp, Mus musculus
accgttgtcagcacacagcgttcac

SEQ ID NO: 4851 - DNA, 25 bp, Mus musculus
acctaaccagtgaccagttcctctt

SEQ ID NO: 4852 - DNA, 25 bp, Mus musculus
acctaactaaaaggtggctcatgag

SEQ ID NO: 4853 - DNA, 25 bp, Mus musculus
acctaccgagtgctgctgggcgcac

SEQ ID NO: 4854 - DNA, 25 bp, Mus musculus
acctaccggaacatgactgagaagc

SEQ ID NO: 4855 - DNA, 25 bp, Mus musculus
acctacctaggccagttccctgata

SEQ ID NO: 4856 - DNA, 25 bp, Mus musculus
acctacctcaaatggtgaccaaacg

SEQ ID NO: 4857 - DNA, 25 bp, Mus musculus
acctacgaggacttccacaccatag

SEQ ID NO: 4858 - DNA, 25 bp, Mus musculus
acctagaccgcgactgcagttccaa

SEQ ID NO: 4859 - DNA, 25 bp, Mus musculus
acctagagctcggatttctataagt

SEQ ID NO: 4860 - DNA, 25 bp, Mus musculus
acctagcctgctattccctgggcat

SEQ ID NO: 4861 - DNA, 25 bp, Mus musculus
acctagcttttgaccacacggatat

SEQ ID NO: 4862 - DNA, 25 bp, Mus musculus
acctaggtcgctctggccaacatgc

SEQ ID NO: 4863 - DNA, 25 bp, Mus musculus
acctaggtcgctgtggccaacatgc

SEQ ID NO: 4864 - DNA, 25 bp, Mus musculus
acctataaagtggaacagagatgcc

SEQ ID NO: 4865 - DNA, 25 bp, Mus musculus
acctatctagagttttcatccctca

SEQ ID NO: 4866 - DNA, 25 bp, Mus musculus
acctatctgcatttgagtcctcaaa

SEQ ID NO: 4867 - DNA, 25 bp, Mus musculus
acctatgacatccatcggctggaga

SEQ ID NO: 4868 - DNA, 25 bp, Mus musculus
acctatttcccctttgactggcaga

SEQ ID NO: 4869 - DNA, 25 bp, Mus musculus
acctcaacgagtggctggccagcaa

SEQ ID NO: 4870 - DNA, 25 bp, Mus musculus
acctcaaggcccacaggaccattgt

SEQ ID NO: 4871 - DNA, 25 bp, Mus musculus
acctcaaggccctcaggaccattgt

SEQ ID NO: 4872 - DNA, 25 bp, Mus musculus
acctcaaggtcattgatgtacaggg

SEQ ID NO: 4873 - DNA, 25 bp, Mus musculus
acctcacactgtgggaagtcagtca

SEQ ID NO: 4874 - DNA, 25 bp, Mus musculus
acctcacgggtctccctggtacaga

SEQ ID NO: 4875 - DNA, 25 bp, Mus musculus
acctcagaagatgagcggcccaaga

SEQ ID NO: 4876 - DNA, 25 bp, Mus musculus
acctcaggactttgatgtggctaat

SEQ ID NO: 4877 - DNA, 25 bp, Mus musculus
acctcaggagtaaaggtgttgctga

SEQ ID NO: 4878 - DNA, 25 bp, Mus musculus
acctcaggcttcacctagttcagag

SEQ ID NO: 4879 - DNA, 25 bp, Mus musculus
acctcagggcattccaggtgcagct

SEQ ID NO: 4880 - DNA, 25 bp, Mus musculus
acctcagggtctgagaggcatcact

SEQ ID NO: 4881 - DNA, 25 bp, Mus musculus
acctcagtgggcagcgctgtgtgaa

SEQ ID NO: 4882 - DNA, 25 bp, Mus musculus
acctcagtgggctgcgctgtgtgaa

SEQ ID NO: 4883 - DNA, 25 bp, Mus musculus
acctcagtgggctgtactctgccct

SEQ ID NO: 4884 - DNA, 25 bp, Mus musculus
acctcatattcagagggtctcctga

SEQ ID NO: 4885 - DNA, 25 bp, Mus musculus
acctcatcaaggagataatcctggt

SEQ ID NO: 4886 - DNA, 25 bp, Mus musculus
acctcatcgtctggcacgtgcggag

SEQ ID NO: 4887 - DNA, 25 bp, Mus musculus
acctcatggagtgcgtggaaggcag

SEQ ID NO: 4888 - DNA, 25 bp, Mus musculus
acctccaatctctgtgtactgcaca

SEQ ID NO: 4889 - DNA, 25 bp, Mus musculus
acctccaatgtcagcaccacagata

SEQ ID NO: 4890 - DNA, 25 bp, Mus musculus
acctccatgggtaactgcacaaaca

SEQ ID NO: 4891 - DNA, 25 bp, Mus musculus
acctcccaaggagcagatggccaag

SEQ ID NO: 4892 - DNA, 25 bp, Mus musculus
acctccttatcacagttgtaattgg

SEQ ID NO: 4893 - DNA, 25 bp, Mus musculus
acctcggaggaatgaaagctatttc

SEQ ID NO: 4894 - DNA, 25 bp, Mus musculus
acctcgggatgtgaccgaaggcccg

SEQ ID NO: 4895 - DNA, 25 bp, Mus musculus
acctcgtgaggctggcatgcaggat

SEQ ID NO: 4896 - DNA, 25 bp, Mus musculus
acctcgtggagatagattattttgg

SEQ ID NO: 4897 - DNA, 25 bp, Mus musculus
acctctaagttactgtcttgcaagg

SEQ ID NO: 4898 - DNA, 25 bp, Mus musculus
acctctacgctgagcagctctcggg

SEQ ID NO: 4899 - DNA, 25 bp, Mus musculus
acctctatccttatttaggccccag

SEQ ID NO: 4900 - DNA, 25 bp, Mus musculus
acctctcgctcttcgtggctcagaa

SEQ ID NO: 4901 - DNA, 25 bp, Mus musculus
acctctcttgagaaggctgccgaag

SEQ ID NO: 4902 - DNA, 25 bp, Mus musculus
acctctgacaaaggccgcttctatg

SEQ ID NO: 4903 - DNA, 25 bp, Mus musculus
acctctgcatatagcggccggaaga

SEQ ID NO: 4904 - DNA, 25 bp, Mus musculus
acctctgcttgaggtccaaagaagg

SEQ ID NO: 4905 - DNA, 25 bp, Mus musculus
acctctgggtgaggctaagccattc

SEQ ID NO: 4906 - DNA, 25 bp, Mus musculus
acctctggttttcagtgttgttggc

SEQ ID NO: 4907 - DNA, 25 bp, Mus musculus
acctctggttttgagtgttgttggc

SEQ ID NO: 4908 - DNA, 25 bp, Mus musculus
acctcttatgatgcacagtgtacag

SEQ ID NO: 4909 - DNA, 25 bp, Mus musculus
acctcttccgtaatgcgggatgtgc

SEQ ID NO: 4910 - DNA, 25 bp, Mus musculus
acctcttcctcaccgcaggagtgat

SEQ ID NO: 4911 - DNA, 25 bp, Mus musculus
acctctttcttgagaaggctctgca

SEQ ID NO: 4912 - DNA, 25 bp, Mus musculus
acctcttttatgacagtgctcctag

SEQ ID NO: 4913 - DNA, 25 bp, Mus musculus
acctgaaataccagcactcagcagg

SEQ ID NO: 4914 - DNA, 25 bp, Mus musculus
acctgaaccacgaggccgcagcaga

SEQ ID NO: 4915 - DNA, 25 bp, Mus musculus
acctgaagcccatggcagaccgggc

SEQ ID NO: 4916 - DNA, 25 bp, Mus musculus
acctgaaggataaggtcacctatac

SEQ ID NO: 4917 - DNA, 25 bp, Mus musculus
acctgaagggccagatggaagccat

SEQ ID NO: 4918 - DNA, 25 bp, Mus musculus
acctgaatttccaggatgtttatcg

SEQ ID NO: 4919 - DNA, 25 bp, Mus musculus
acctgacaggcaccttctacatgtg

SEQ ID NO: 4920 - DNA, 25 bp, Mus musculus
acctgaccagcgagagggaagtcct

SEQ ID NO: 4921 - DNA, 25 bp, Mus musculus
acctgaccagcgtgagggaagtcct

SEQ ID NO: 4922 - DNA, 25 bp, Mus musculus
acctgaccgggaagaaattccaatg

SEQ ID NO: 4923 - DNA, 25 bp, Mus musculus
acctgactgtggcatgtgtgcccat

SEQ ID NO: 4924 - DNA, 25 bp, Mus musculus
acctgagagatccccagaagccatc

SEQ ID NO: 4925 - DNA, 25 bp, Mus musculus
acctgagattgtgagtgtgttgcga

SEQ ID NO: 4926 - DNA, 25 bp, Mus musculus
acctgagccgcatcctgaacgagat

SEQ ID NO: 4927 - DNA, 25 bp, Mus musculus
acctgaggacccacggaagtgacag

SEQ ID NO: 4928 - DNA, 25 bp, Mus musculus
acctgaggaccctcggaagtgacag

SEQ ID NO: 4929 - DNA, 25 bp, Mus musculus
acctgaggctgcagatggcaataga

SEQ ID NO: 4930 - DNA, 25 bp, Mus musculus
acctgagggtggacagccagaagca

SEQ ID NO: 4931 - DNA, 25 bp, Mus musculus
acctgagtcaggagctgagtgccga

SEQ ID NO: 4932 - DNA, 25 bp, Mus musculus
acctgatctcacagaatctgaaaag

SEQ ID NO: 4933 - DNA, 25 bp, Mus musculus
acctgatgagccaagaagtgcctga

SEQ ID NO: 4934 - DNA, 25 bp, Mus musculus
acctgcagcatgagcgcattgtgca

SEQ ID NO: 4935 - DNA, 25 bp, Mus musculus
acctgcaggacatgttcatcgtcca

SEQ ID NO: 4936 - DNA, 25 bp, Mus musculus
acctgcaggcgaagctacagctgcg

SEQ ID NO: 4937 - DNA, 25 bp, Mus musculus
acctgcagggagctatggacgacct

SEQ ID NO: 4938 - DNA, 25 bp, Mus musculus
acctgcagtaccagccaaaaaggct

SEQ ID NO: 4939 - DNA, 25 bp, Mus musculus
acctgcatgtggacgtcccaaagga

SEQ ID NO: 4940 - DNA, 25 bp, Mus musculus
acctgcattctctggcggctgacca

SEQ ID NO: 4941 - DNA, 25 bp, Mus musculus
acctgccatattcagtaagaactga

SEQ ID NO: 4942 - DNA, 25 bp, Mus musculus
acctgccatcatgggtgtggtttcc

SEQ ID NO: 4943 - DNA, 25 bp, Mus musculus
acctgccggatcacgattgccatca

SEQ ID NO: 4944 - DNA, 25 bp, Mus musculus
acctgcggcagacagtgacgacagc

SEQ ID NO: 4945 - DNA, 25 bp, Mus musculus
acctgcgtctcacccttatctgaga

SEQ ID NO: 4946 - DNA, 25 bp, Mus musculus
acctgctcatgaaggacttgattaa

SEQ ID NO: 4947 - DNA, 25 bp, Mus musculus
acctgctgagatatcctgctgatcc

SEQ ID NO: 4948 - DNA, 25 bp, Mus musculus
acctgctgcagttctctgccaacat

SEQ ID NO: 4949 - DNA, 25 bp, Mus musculus
acctgctgccacttacactggtgtc

SEQ ID NO: 4950 - DNA, 25 bp, Mus musculus
acctggaatgtcttcattatctgct

SEQ ID NO: 4951 - DNA, 25 bp, Mus musculus
acctggacagctacgagcaagcacg

SEQ ID NO: 4952 - DNA, 25 bp, Mus musculus
acctggaccagaccgaacagtggga

SEQ ID NO: 4953 - DNA, 25 bp, Mus musculus
acctggagaagagtgccgtactcca

SEQ ID NO: 4954 - DNA, 25 bp, Mus musculus
acctggagaagatgcgcctagagcc

SEQ ID NO: 4955 - DNA, 25 bp, Mus musculus
acctggagcgtcagacttaacagga

SEQ ID NO: 4956 - DNA, 25 bp, Mus musculus
acctggattttgagccactgtccac

SEQ ID NO: 4957 - DNA, 25 bp, Mus musculus
acctggcccagaaccaaatgtacac

SEQ ID NO: 4958 - DNA, 25 bp, Mus musculus
acctggccgagggagttctctctag

SEQ ID NO: 4959 - DNA, 25 bp, Mus musculus
acctggcctggcagtatgggccttg

SEQ ID NO: 4960 - DNA, 25 bp, Mus musculus
acctggcgctcgagcccgggtagct

SEQ ID NO: 4961 - DNA, 25 bp, Mus musculus
acctggctatgcctttgatgtggag

SEQ ID NO: 4962 - DNA, 25 bp, Mus musculus
acctggctctgtggaatgtgtggtc

SEQ ID NO: 4963 - DNA, 25 bp, Mus musculus
acctggctggctgtatccatggcct

SEQ ID NO: 4964 - DNA, 25 bp, Mus musculus
acctggctgggctaacccagacaac

SEQ ID NO: 4965 - DNA, 25 bp, Mus musculus
acctgggcacttagacacagtgaag

SEQ ID NO: 4966 - DNA, 25 bp, Mus musculus
acctgggctggcatgccgacaacat

SEQ ID NO: 4967 - DNA, 25 bp, Mus musculus
acctgggtcgcttagagatccccgc

SEQ ID NO: 4968 - DNA, 25 bp, Mus musculus
acctggtgcccgagtgattgtgaca

SEQ ID NO: 4969 - DNA, 25 bp, Mus musculus
acctggtgtgtaaggatgactggaa

SEQ ID NO: 4970 - DNA, 25 bp, Mus musculus
acctgtagtggccattccctgggag

SEQ ID NO: 4971 - DNA, 25 bp, Mus musculus
acctgtcaggtgaccttccctggag

SEQ ID NO: 4972 - DNA, 25 bp, Mus musculus
acctgtccaacaagataaacgtggg

SEQ ID NO: 4973 - DNA, 25 bp, Mus musculus
acctgtctacagtgggtacccacgt

SEQ ID NO: 4974 - DNA, 25 bp, Mus musculus
acctgtgcgcctgggtactgggatt

SEQ ID NO: 4975 - DNA, 25 bp, Mus musculus
acctgtggatgccagattccctgaa

SEQ ID NO: 4976 - DNA, 25 bp, Mus musculus
acctgtgtattccagcggcagacac

SEQ ID NO: 4977 - DNA, 25 bp, Mus musculus
acctgtgtgagctgcaaaaggtgga

SEQ ID NO: 4978 - DNA, 25 bp, Mus musculus
acctgtgtgtgccacagctccggct

SEQ ID NO: 4979 - DNA, 25 bp, Mus musculus
acctgtgttacattgcccctgcttt

SEQ ID NO: 4980 - DNA, 25 bp, Mus musculus
acctgttagcagaagggaagagaca

SEQ ID NO: 4981 - DNA, 25 bp, Mus musculus
acctgttcccgtctaactgagcgtg

SEQ ID NO: 4982 - DNA, 25 bp, Mus musculus
accttaaagcaggagctggaagttg

SEQ ID NO: 4983 - DNA, 25 bp, Mus musculus
accttaaggatgtgatcctactgac

SEQ ID NO: 4984 - DNA, 25 bp, Mus musculus
accttatgagcctcccaggagatca

SEQ ID NO: 4985 - DNA, 25 bp, Mus musculus
accttcaacatggaggctgtgggca

SEQ ID NO: 4986 - DNA, 25 bp, Mus musculus
accttcaaggccaagttcacgcagc

SEQ ID NO: 4987 - DNA, 25 bp, Mus musculus
accttcaggaatttggctgccatag

SEQ ID NO: 4988 - DNA, 25 bp, Mus musculus
accttcaggcaaatcctctcaagga

SEQ ID NO: 4989 - DNA, 25 bp, Mus musculus
accttcatggtattccaagccttgg

SEQ ID NO: 4990 - DNA, 25 bp, Mus musculus
accttccaacacagtgcagacagca

SEQ ID NO: 4991 - DNA, 25 bp, Mus musculus
accttccctcccagtatgtgggtgc

SEQ ID NO: 4992 - DNA, 25 bp, Mus musculus
accttccgagatcttagtaagccag

SEQ ID NO: 4993 - DNA, 25 bp, Mus musculus
accttcgggcccatgcagaagagcc

SEQ ID NO: 4994 - DNA, 25 bp, Mus musculus
accttctcccagtacaccgtggtag

SEQ ID NO: 4995 - DNA, 25 bp, Mus musculus
accttctgatttgctgtgtcctgag

SEQ ID NO: 4996 - DNA, 25 bp, Mus musculus
accttgaagctggtattggctatgc

SEQ ID NO: 4997 - DNA, 25 bp, Mus musculus
accttgagctgcacattagccttgg

SEQ ID NO: 4998 - DNA, 25 bp, Mus musculus
accttgaggctctgcaactgcgagc

SEQ ID NO: 4999 - DNA, 25 bp, Mus musculus
accttgataaggtgctacggccccg

SEQ ID NO: 5000 - DNA, 25 bp, Mus musculus
accttgatccttcagacattttgga

SEQ ID NO: 5001 - DNA, 25 bp, Mus musculus
accttgattgggatgctggcggcca

SEQ ID NO: 5002 - DNA, 25 bp, Mus musculus
accttgctcagaagcttccaaacct

SEQ ID NO: 5003 - DNA, 25 bp, Mus musculus
accttggagcctgcgccagtgcgga

SEQ ID NO: 5004 - DNA, 25 bp, Mus musculus
accttggcaaatgacagggttccca

SEQ ID NO: 5005 - DNA, 25 bp, Mus musculus
accttgggtagccttggcccattgc

SEQ ID NO: 5006 - DNA, 25 bp, Mus musculus
accttgtgaaggtgtctgccaggca

SEQ ID NO: 5007 - DNA, 25 bp, Mus musculus
acctttagctccatgtcgcctcgtg

SEQ ID NO: 5008 - DNA, 25 bp, Mus musculus
acctttcagatgaagcctggcggcc

SEQ ID NO: 5009 - DNA, 25 bp, Mus musculus
acctttccatgggagtagaggacgg

SEQ ID NO: 5010 - DNA, 25 bp, Mus musculus
acctttccctctttggcacacttgg

SEQ ID NO: 5011 - DNA, 25 bp, Mus musculus
acctttcctgcttcagtatatccag

SEQ ID NO: 5012 - DNA, 25 bp, Mus musculus
acctttctgagaatacatgttccgg

SEQ ID NO: 5013 - DNA, 25 bp, Mus musculus
acctttgacctctcgctcttcgtgg

SEQ ID NO: 5014 - DNA, 25 bp, Mus musculus
acctttgacgcggtgatcattgtgg

SEQ ID NO: 5015 - DNA, 25 bp, Mus musculus
acctttggatggatgaatggcctga

SEQ ID NO: 5016 - DNA, 25 bp, Mus musculus
acctttgtcctacttccagaatgcc

SEQ ID NO: 5017 - DNA, 25 bp, Mus musculus
accttttaccatccaagtgcccaga

SEQ ID NO: 5018 - DNA, 25 bp, Mus musculus
acgaaacaatgaatcagaaaagccc

SEQ ID NO: 5019 - DNA, 25 bp, Mus musculus
acgaaaccccgggaggagcagatca

SEQ ID NO: 5020 - DNA, 25 bp, Mus musculus
acgaaacgtatgctttccttccaag

SEQ ID NO: 5021 - DNA, 25 bp, Mus musculus
acgaacacggctcagcgcggtgatt

SEQ ID NO: 5022 - DNA, 25 bp, Mus musculus
acgaactagtggactggttcctgga

SEQ ID NO: 5023 - DNA, 25 bp, Mus musculus
acgaactgtgttttgaatttggtct

SEQ ID NO: 5024 - DNA, 25 bp, Mus musculus
acgaagacctccgtgatggccacaa

SEQ ID NO: 5025 - DNA, 25 bp, Mus musculus
acgaagagctctagaaagaagaata

SEQ ID NO: 5026 - DNA, 25 bp, Mus musculus
acgaagctcctgaaggtgcctctga

SEQ ID NO: 5027 - DNA, 25 bp, Mus musculus
acgaagctggtgctgccgacacctg

SEQ ID NO: 5028 - DNA, 25 bp, Mus musculus
acgaaggagcgccaagtagcctcac

SEQ ID NO: 5029 - DNA, 25 bp, Mus musculus
acgaaggagcgcgaagtagcctcac

SEQ ID NO: 5030 - DNA, 25 bp, Mus musculus
acgaaggccattcttctagcttctc

SEQ ID NO: 5031 - DNA, 25 bp, Mus musculus
acgaataggatgattgtccttactg

SEQ ID NO: 5032 - DNA, 25 bp, Mus musculus
acgaataggatgtttgtccttactg

SEQ ID NO: 5033 - DNA, 25 bp, Mus musculus
acgaatgccgtcaccctggtacctg

SEQ ID NO: 5034 - DNA, 25 bp, Mus musculus
acgaatgccgtctccctggtacctg

SEQ ID NO: 5035 - DNA, 25 bp, Mus musculus
acgaatgtacatctatagtgggaac

SEQ ID NO: 5036 - DNA, 25 bp, Mus musculus
acgaattgctcagtcttgctagcag

SEQ ID NO: 5037 - DNA, 25 bp, Mus musculus
acgacacactgaagcagcggcggca

SEQ ID NO: 5038 - DNA, 25 bp, Mus musculus
acgacactagcacggacctcacgga

SEQ ID NO: 5039 - DNA, 25 bp, Mus musculus
acgacatgatgggacggaaccagac

SEQ ID NO: 5040 - DNA, 25 bp, Mus musculus
acgacattctgccagaccagagcta

SEQ ID NO: 5041 - DNA, 25 bp, Mus musculus
acgaccagctggtcctcactggcag

SEQ ID NO: 5042 - DNA, 25 bp, Mus musculus
acgaccgtgatacccctgattgtgg

SEQ ID NO: 5043 - DNA, 25 bp, Mus musculus
acgacctaaaacttcagcagtgaag

SEQ ID NO: 5044 - DNA, 25 bp, Mus musculus
acgacctgtgtgtgccacagctccg

SEQ ID NO: 5045 - DNA, 25 bp, Mus musculus
acgactacatcctcctgcctgaggg

SEQ ID NO: 5046 - DNA, 25 bp, Mus musculus
acgactctgtggaccgcgtgggact

SEQ ID NO: 5047 - DNA, 25 bp, Mus musculus
acgacttcgtgggacaatgccacca

SEQ ID NO: 5048 - DNA, 25 bp, Mus musculus
acgagaaaccgtctggctagagaga

SEQ ID NO: 5049 - DNA, 25 bp, Mus musculus
acgagaccccgaagagacagggcct

SEQ ID NO: 5050 - DNA, 25 bp, Mus musculus
acgagactccagcagcacagtgtgc

SEQ ID NO: 5051 - DNA, 25 bp, Mus musculus
acgagcaggaattggcgtttactgg

SEQ ID NO: 5052 - DNA, 25 bp, Mus musculus
acgagcccatgcacgacgtctgctg

SEQ ID NO: 5053 - DNA, 25 bp, Mus musculus
acgagcccatgctcgacgtctgctg

SEQ ID NO: 5054 - DNA, 25 bp, Mus musculus
acgagcgcccgacaggcagacctaa

SEQ ID NO: 5055 - DNA, 25 bp, Mus musculus
acgagcgcccgagaggcagacctaa

SEQ ID NO: 5056 - DNA, 25 bp, Mus musculus
acgagcgcctctgggaacctcatgg

SEQ ID NO: 5057 - DNA, 25 bp, Mus musculus
acgagctgcaccactcaggatggaa

SEQ ID NO: 5058 - DNA, 25 bp, Mus musculus
acgagctggaccacgccctcaatga

SEQ ID NO: 5059 - DNA, 25 bp, Mus musculus
acgagctgttgtccttgagtcgatg

SEQ ID NO: 5060 - DNA, 25 bp, Mus musculus
acgaggaagtaaaccatgccacatc

SEQ ID NO: 5061 - DNA, 25 bp, Mus musculus
acgaggagaaagaccaggaggaatc

SEQ ID NO: 5062 - DNA, 25 bp, Mus musculus
acgaggagagctgcgagagttctct

SEQ ID NO: 5063 - DNA, 25 bp, Mus musculus
acgaggaggtgctgcagaacatgct

SEQ ID NO: 5064 - DNA, 25 bp, Mus musculus
acgaggatcctaagacgcatccctg

SEQ ID NO: 5065 - DNA, 25 bp, Mus musculus
acgaggcaccatctcaggagcggaa

SEQ ID NO: 5066 - DNA, 25 bp, Mus musculus
acgaggcgtttctcactcatgacgc

SEQ ID NO: 5067 - DNA, 25 bp, Mus musculus
acgaggctcgcacagtcttccgcgt

SEQ ID NO: 5068 - DNA, 25 bp, Mus musculus
acgaggctggctacttcaatgagga

SEQ ID NO: 5069 - DNA, 25 bp, Mus musculus
acgagggaagcgagaagtcgccttt

SEQ ID NO: 5070 - DNA, 25 bp, Mus musculus
acgagggcggactgcctctggctca

SEQ ID NO: 5071 - DNA, 25 bp, Mus musculus
acgagggctactgtcaggcccaggc

SEQ ID NO: 5072 - DNA, 25 bp, Mus musculus
acgagtgggcctgaaagcccctgga

SEQ ID NO: 5073 - DNA, 25 bp, Mus musculus
acgagtgtcagcaccagctgcgcga

SEQ ID NO: 5074 - DNA, 25 bp, Mus musculus
acgagtgtgccacccgagcctcgtg

SEQ ID NO: 5075 - DNA, 25 bp, Mus musculus
acgagtgtgccagccgagcctcgtg

SEQ ID NO: 5076 - DNA, 25 bp, Mus musculus
acgatcagacctactgctgtcagga

SEQ ID NO: 5077 - DNA, 25 bp, Mus musculus
acgatccacactagttatgggaatc

SEQ ID NO: 5078 - DNA, 25 bp, Mus musculus
acgatgacgtatagcccacctcggg

SEQ ID NO: 5079 - DNA, 25 bp, Mus musculus
acgatgacgtattgcccacctcggg

SEQ ID NO: 5080 - DNA, 25 bp, Mus musculus
acgatgcggtccctagttctacctc

SEQ ID NO: 5081 - DNA, 25 bp, Mus musculus
acgatgcttcaataaatacagaccc

SEQ ID NO: 5082 - DNA, 25 bp, Mus musculus
acgatggcagcatgcccaccatgca

SEQ ID NO: 5083 - DNA, 25 bp, Mus musculus
acgatggcagccctggcacagcaga

SEQ ID NO: 5084 - DNA, 25 bp, Mus musculus
acgcaaagaattacaactaggccag

SEQ ID NO: 5085 - DNA, 25 bp, Mus musculus
acgcaacgggaagaggtcaacaagt

SEQ ID NO: 5086 - DNA, 25 bp, Mus musculus
acgcaatacaagtttggccacacca

SEQ ID NO: 5087 - DNA, 25 bp, Mus musculus
acgcactgcaatcatcccggcatga

SEQ ID NO: 5088 - DNA, 25 bp, Mus musculus
acgcagaaagctagccgaccagtac

SEQ ID NO: 5089 - DNA, 25 bp, Mus musculus
acgcagagccgctggccagtatagc

SEQ ID NO: 5090 - DNA, 25 bp, Mus musculus
acgcagcagctgtcatcttttgaaa

SEQ ID NO: 5091 - DNA, 25 bp, Mus musculus
acgcagccttaagcctcagcaaaga

SEQ ID NO: 5092 - DNA, 25 bp, Mus musculus
acgcagtctgccaggaggcgcaatc

SEQ ID NO: 5093 - DNA, 25 bp, Mus musculus
acgccaagactgtccggaatgacaa

SEQ ID NO: 5094 - DNA, 25 bp, Mus musculus
acgccaatgagtgtgaagggaagcc

SEQ ID NO: 5095 - DNA, 25 bp, Mus musculus
acgccaatgtcaccgtacagattga

SEQ ID NO: 5096 - DNA, 25 bp, Mus musculus
acgccacagggcttgatgccatatg

SEQ ID NO: 5097 - DNA, 25 bp, Mus musculus
acgcccagggcacgctttccaaaat

SEQ ID NO: 5098 - DNA, 25 bp, Mus musculus
acgccccaggagaatacaggtgcca

SEQ ID NO: 5099 - DNA, 25 bp, Mus musculus
acgccccaggagtatacaggtgcca

SEQ ID NO: 5100 - DNA, 25 bp, Mus musculus
acgccctcaatgacatgacctctat

SEQ ID NO: 5101 - DNA, 25 bp, Mus musculus
acgccgactgggacttctgcttcca

SEQ ID NO: 5102 - DNA, 25 bp, Mus musculus
acgccgggccgatcatggaagcttg

SEQ ID NO: 5103 - DNA, 25 bp, Mus musculus
acgcctacggcaaggccgggaagat

SEQ ID NO: 5104 - DNA, 25 bp, Mus musculus
acgcctagttggttgaactgtttgg

SEQ ID NO: 5105 - DNA, 25 bp, Mus musculus
acgcctcgatgctgctacagggatc

SEQ ID NO: 5106 - DNA, 25 bp, Mus musculus
acgcctctaaagagtcatggcagca

SEQ ID NO: 5107 - DNA, 25 bp, Mus musculus
acgcctgcagaagaacagcctaaaa

SEQ ID NO: 5108 - DNA, 25 bp, Mus musculus
acgcctgggacattggtgacgatga

SEQ ID NO: 5109 - DNA, 25 bp, Mus musculus
acgcctgtgcatgtggctgccgcgt

SEQ ID NO: 5110 - DNA, 25 bp, Mus musculus
acgccttcataccaaaggatctaca

SEQ ID NO: 5111 - DNA, 25 bp, Mus musculus
acgcctttagaacagtggtgcctag

SEQ ID NO: 5112 - DNA, 25 bp, Mus musculus
acgcgcctcgagcagatttcctctg

SEQ ID NO: 5113 - DNA, 25 bp, Mus musculus
acgcgcggcccatcgggagatccag

SEQ ID NO: 5114 - DNA, 25 bp, Mus musculus
acgcggaacaccgagggatgctcaa

SEQ ID NO: 5115 - DNA, 25 bp, Mus musculus
acgcggacagcaagcccgtggcact

SEQ ID NO: 5116 - DNA, 25 bp, Mus musculus
acgcgggcgatccaggatgcttaac

SEQ ID NO: 5117 - DNA, 25 bp, Mus musculus
acgcggtgaaggaccatgggctcca

SEQ ID NO: 5118 - DNA, 25 bp, Mus musculus
acgcggtgatcattgtgggtgccct

SEQ ID NO: 5119 - DNA, 25 bp, Mus musculus
acgcgtcaaattgctcacgaaaggg

SEQ ID NO: 5120 - DNA, 25 bp, Mus musculus
acgctatcaagcagaactggagtca

SEQ ID NO: 5121 - DNA, 25 bp, Mus musculus
acgctattacaaggagacctctggc

SEQ ID NO: 5122 - DNA, 25 bp, Mus musculus
acgctcaggagaatccaggaccggg

SEQ ID NO: 5123 - DNA, 25 bp, Mus musculus
acgctcatcagtatgtggccagagc

SEQ ID NO: 5124 - DNA, 25 bp, Mus musculus
acgctcatgtgctcctggctgcctt

SEQ ID NO: 5125 - DNA, 25 bp, Mus musculus
acgctcggacccatggcaactctgt

SEQ ID NO: 5126 - DNA, 25 bp, Mus musculus
acgctctcaacgatatgacttccat

SEQ ID NO: 5127 - DNA, 25 bp, Mus musculus
acgctctggttgctgtgatgactcg

SEQ ID NO: 5128 - DNA, 25 bp, Mus musculus
acgctgaacgaaagggacacggagc

SEQ ID NO: 5129 - DNA, 25 bp, Mus musculus
acgctgaggccaaccagcagcagac

SEQ ID NO: 5130 - DNA, 25 bp, Mus musculus
acgctgcattgggatacagatccat

SEQ ID NO: 5131 - DNA, 25 bp, Mus musculus
acgctgctgaaagatggctgaagaa

SEQ ID NO: 5132 - DNA, 25 bp, Mus musculus
acgctgctggccagaagatgtcgga

SEQ ID NO: 5133 - DNA, 25 bp, Mus musculus
acgctggctccgagcgccatggtca

SEQ ID NO: 5134 - DNA, 25 bp, Mus musculus
acgctggctccgtgcgccatggtca

SEQ ID NO: 5135 - DNA, 25 bp, Mus musculus
acgctggtagagacggtggtggaga

SEQ ID NO: 5136 - DNA, 25 bp, Mus musculus
acgcttacacaacctcagaagtcac

SEQ ID NO: 5137 - DNA, 25 bp, Mus musculus
acggaaactagaagcattgccacca

SEQ ID NO: 5138 - DNA, 25 bp, Mus musculus
acggaaccagactgctgtgagagaa

SEQ ID NO: 5139 - DNA, 25 bp, Mus musculus
acggaatatcaatcccagcacagca

SEQ ID NO: 5140 - DNA, 25 bp, Mus musculus
acggacactagaggagctcctgaag

SEQ ID NO: 5141 - DNA, 25 bp, Mus musculus
acggacatcttcctgcccaagccaa

SEQ ID NO: 5142 - DNA, 25 bp, Mus musculus
acggaccgtgccagagattgagaag

SEQ ID NO: 5143 - DNA, 25 bp, Mus musculus
acggagaaggaagccctgctaaggc

SEQ ID NO: 5144 - DNA, 25 bp, Mus musculus
acggagagtaactgtgaggtgcctc

SEQ ID NO: 5145 - DNA, 25 bp, Mus musculus
acggaggctctctgctggttggctc

SEQ ID NO: 5146 - DNA, 25 bp, Mus musculus
acggagggctccatcacctgctcag

SEQ ID NO: 5147 - DNA, 25 bp, Mus musculus
acggagggctccttcacctgctcag

SEQ ID NO: 5148 - DNA, 25 bp, Mus musculus
acggagggctcgaaccactgcgagt

SEQ ID NO: 5149 - DNA, 25 bp, Mus musculus
acggagggctcgtaccactgcgagt

SEQ ID NO: 5150 - DNA, 25 bp, Mus musculus
acggaggttctctcgtggtgagttc

SEQ ID NO: 5151 - DNA, 25 bp, Mus musculus
acggatagtggcatccaggctgcat

SEQ ID NO: 5152 - DNA, 25 bp, Mus musculus
acggatcgtaccatcgtttcttggg

SEQ ID NO: 5153 - DNA, 25 bp, Mus musculus
acggatctgggtagatgcagaagaa

SEQ ID NO: 5154 - DNA, 25 bp, Mus musculus
acggatctgggttgatgcagaagaa

SEQ ID NO: 5155 - DNA, 25 bp, Mus musculus
acggatgcctcggaagatgcatcac

SEQ ID NO: 5156 - DNA, 25 bp, Mus musculus
acggcacgccacagggcaagcagaa

SEQ ID NO: 5157 - DNA, 25 bp, Mus musculus
acggcagggtgctgaccattgttcc

SEQ ID NO: 5158 - DNA, 25 bp, Mus musculus
acggccaaaggccagtctgaccgag

SEQ ID NO: 5159 - DNA, 25 bp, Mus musculus
acggccagttcagggtgatgcacac

SEQ ID NO: 5160 - DNA, 25 bp, Mus musculus
acggccccgatgcagactgctttga

SEQ ID NO: 5161 - DNA, 25 bp, Mus musculus
acggccctggtgcagatgttccgca

SEQ ID NO: 5162 - DNA, 25 bp, Mus musculus
acggccctttggttctgtgtcttca

SEQ ID NO: 5163 - DNA, 25 bp, Mus musculus
acggccgccttgtctggagacacag

SEQ ID NO: 5164 - DNA, 25 bp, Mus musculus
acggcctactatcgcggagctatgg

SEQ ID NO: 5165 - DNA, 25 bp, Mus musculus
acggcgaagacaccggccgtcatct

SEQ ID NO: 5166 - DNA, 25 bp, Mus musculus
acggcgaccgcgactgcaaggacaa

SEQ ID NO: 5167 - DNA, 25 bp, Mus musculus
acggcgagtgccacaacagcctggg

SEQ ID NO: 5168 - DNA, 25 bp, Mus musculus
acggcgagtgcctcaacagcctggg

SEQ ID NO: 5169 - DNA, 25 bp, Mus musculus
acggcgccatgttgccctgcagctg

SEQ ID NO: 5170 - DNA, 25 bp, Mus musculus
acggcgctcatcctcgaggacagac

SEQ ID NO: 5171 - DNA, 25 bp, Mus musculus
acggctaccagcagggctacgggcc

SEQ ID NO: 5172 - DNA, 25 bp, Mus musculus
acggctcgctaccactgcaggaacg

SEQ ID NO: 5173 - DNA, 25 bp, Mus musculus
acggctcgggtcaggccaccggaca

SEQ ID NO: 5174 - DNA, 25 bp, Mus musculus
acggctgaaacaccggaagctccgg

SEQ ID NO: 5175 - DNA, 25 bp, Mus musculus
acggctgtgacttcttccccgaacg

SEQ ID NO: 5176 - DNA, 25 bp, Mus musculus
acggcttcgggcctgctgacctacg

SEQ ID NO: 5177 - DNA, 25 bp, Mus musculus
acggcttctgcttctgccgcagtct

SEQ ID NO: 5178 - DNA, 25 bp, Mus musculus
acggcttttccatggagatgaacgc

SEQ ID NO: 5179 - DNA, 25 bp, Mus musculus
acgggaagaggtcaacaagtttcat

SEQ ID NO: 5180 - DNA, 25 bp, Mus musculus
acgggacagtgagccgaggaaccct

SEQ ID NO: 5181 - DNA, 25 bp, Mus musculus
acgggactgcggaacctgggcaaca

SEQ ID NO: 5182 - DNA, 25 bp, Mus musculus
acgggagatctatgaccgctatggc

SEQ ID NO: 5183 - DNA, 25 bp, Mus musculus
acgggagcacccagacggatggccc

SEQ ID NO: 5184 - DNA, 25 bp, Mus musculus
acgggatggcttctctggccctgca

SEQ ID NO: 5185 - DNA, 25 bp, Mus musculus
acgggcacttatgcgcagacagaga

SEQ ID NO: 5186 - DNA, 25 bp, Mus musculus
acgggcatgtttaaggaactctgga

SEQ ID NO: 5187 - DNA, 25 bp, Mus musculus
acgggctctggacgaccatcaccat

SEQ ID NO: 5188 - DNA, 25 bp, Mus musculus
acgggctggccttcaatgcactcat

SEQ ID NO: 5189 - DNA, 25 bp, Mus musculus
acgggtcacactgctggaagccatc

SEQ ID NO: 5190 - DNA, 25 bp, Mus musculus
acgggtcctagtagcagtgtcagtg

SEQ ID NO: 5191 - DNA, 25 bp, Mus musculus
acgggtccttcctaactgatagcag

SEQ ID NO: 5192 - DNA, 25 bp, Mus musculus
acgggtttggccgaagtgcctcaga

SEQ ID NO: 5193 - DNA, 25 bp, Mus musculus
acgggtttttcctgcagctggagcc

SEQ ID NO: 5194 - DNA, 25 bp, Mus musculus
acggtgaaggaaaagtcctgagcgt

SEQ ID NO: 5195 - DNA, 25 bp, Mus musculus
acggtgcagattgcgagccggccta

SEQ ID NO: 5196 - DNA, 25 bp, Mus musculus
acggtgcccacagcgacgaagagat

SEQ ID NO: 5197 - DNA, 25 bp, Mus musculus
acggtgctacgccagccactgtgtc

SEQ ID NO: 5198 - DNA, 25 bp, Mus musculus
acggttagaacacctgcaggagaaa

SEQ ID NO: 5199 - DNA, 25 bp, Mus musculus
acggttcctggtatgcggtcttggc

SEQ ID NO: 5200 - DNA, 25 bp, Mus musculus
acggtttgagctctcgtgcccgcag

SEQ ID NO: 5201 - DNA, 25 bp, Mus musculus
acgtaagatcatccgcatgtgggca

SEQ ID NO: 5202 - DNA, 25 bp, Mus musculus
acgtaagttggcgttccgctcagga

SEQ ID NO: 5203 - DNA, 25 bp, Mus musculus
acgtacaaggaccaggcacctgctt

SEQ ID NO: 5204 - DNA, 25 bp, Mus musculus
acgtacacaccctcagaggcaggca

SEQ ID NO: 5205 - DNA, 25 bp, Mus musculus
acgtacagggcatgtctgaaggcag

SEQ ID NO: 5206 - DNA, 25 bp, Mus musculus
acgtacctgatcagctccaaccaga

SEQ ID NO: 5207 - DNA, 25 bp, Mus musculus
acgtatcacgacatcggcatgaacc

SEQ ID NO: 5208 - DNA, 25 bp, Mus musculus
acgtatgtccttcgatccggagtga

SEQ ID NO: 5209 - DNA, 25 bp, Mus musculus
acgtcaacgggctgcgcagagttct

SEQ ID NO: 5210 - DNA, 25 bp, Mus musculus
acgtcaactgtgacccctgtaagcc

SEQ ID NO: 5211 - DNA, 25 bp, Mus musculus
acgtcaactgtgtcccctgtaagcc

SEQ ID NO: 5212 - DNA, 25 bp, Mus musculus
acgtcaatatggagaggcacccagc

SEQ ID NO: 5213 - DNA, 25 bp, Mus musculus
acgtcactgccttactttgtgctca

SEQ ID NO: 5214 - DNA, 25 bp, Mus musculus
acgtcagaaacaacagcctgttcca

SEQ ID NO: 5215 - DNA, 25 bp, Mus musculus
acgtcagccggctccggcgatgcag

SEQ ID NO: 5216 - DNA, 25 bp, Mus musculus
acgtcagtgtgcaccctgaagccgg

SEQ ID NO: 5217 - DNA, 25 bp, Mus musculus
acgtcatcaatgcagcgggcttccc

SEQ ID NO: 5218 - DNA, 25 bp, Mus musculus
acgtccctcgttagtgtggctgtca

SEQ ID NO: 5219 - DNA, 25 bp, Mus musculus
acgtctcagagaggctgtgcaactg

SEQ ID NO: 5220 - DNA, 25 bp, Mus musculus
acgtctgtccgtagcctgctgaggc

SEQ ID NO: 5221 - DNA, 25 bp, Mus musculus
acgtcttccgccagcgcatgatgca

SEQ ID NO: 5222 - DNA, 25 bp, Mus musculus
acgtgcatacgctgaagtggctggc

SEQ ID NO: 5223 - DNA, 25 bp, Mus musculus
acgtgccagaccagcgggagatcgt

SEQ ID NO: 5224 - DNA, 25 bp, Mus musculus
acgtgcgaccctggcattctgggct

SEQ ID NO: 5225 - DNA, 25 bp, Mus musculus
acgtgctgatcctgctttaccacca

SEQ ID NO: 5226 - DNA, 25 bp, Mus musculus
acgtgctgtctctagggctcctcac

SEQ ID NO: 5227 - DNA, 25 bp, Mus musculus
acgtgcttgactcgcgacagctacc

SEQ ID NO: 5228 - DNA, 25 bp, Mus musculus
acgtggacagtagagaagccccagc

SEQ ID NO: 5229 - DNA, 25 bp, Mus musculus
acgtggacctgttggatatccttca

SEQ ID NO: 5230 - DNA, 25 bp, Mus musculus
acgtggcatgactcccgcagccaga

SEQ ID NO: 5231 - DNA, 25 bp, Mus musculus
acgtggccctgaatccctgctgtga

SEQ ID NO: 5232 - DNA, 25 bp, Mus musculus
acgtggctgggtctccagctgtccc

SEQ ID NO: 5233 - DNA, 25 bp, Mus musculus
acgtggtcaagtacgagagtggccc

SEQ ID NO: 5234 - DNA, 25 bp, Mus musculus
acgtgtacgagcagcacgagaacag

SEQ ID NO: 5235 - DNA, 25 bp, Mus musculus
acgtgtacggtgattctgatggctg

SEQ ID NO: 5236 - DNA, 25 bp, Mus musculus
acgtgtctcttcatgcagttctcca

SEQ ID NO: 5237 - DNA, 25 bp, Mus musculus
acgttaggggataagcaatagggct

SEQ ID NO: 5238 - DNA, 25 bp, Mus musculus
acgttatcatgtggctggaccaccg

SEQ ID NO: 5239 - DNA, 25 bp, Mus musculus
acgttggaggttacatgaaggcgct

SEQ ID NO: 5240 - DNA, 25 bp, Mus musculus
acgttggcaccatctgtgaccccga

SEQ ID NO: 5241 - DNA, 25 bp, Mus musculus
acgttggctttccaagttcatgatg

SEQ ID NO: 5242 - DNA, 25 bp, Mus musculus
acgttgggcagttttgtggagacca

SEQ ID NO: 5243 - DNA, 25 bp, Mus musculus
acgttgggcctcagccctcacaggg

SEQ ID NO: 5244 - DNA, 25 bp, Mus musculus
acgttgtgaagaggacaggcgccat

SEQ ID NO: 5245 - DNA, 25 bp, Mus musculus
actaaaacccgattctgatcaacag

SEQ ID NO: 5246 - DNA, 25 bp, Mus musculus
actaaagcagcacgtggagcccttg

SEQ ID NO: 5247 - DNA, 25 bp, Mus musculus
actaaatggacttgctgtcaaactt

SEQ ID NO: 5248 - DNA, 25 bp, Mus musculus
actaacacgggcacagtcaccggct

SEQ ID NO: 5249 - DNA, 25 bp, Mus musculus
actaaccagaagctacggctctctc

SEQ ID NO: 5250 - DNA, 25 bp, Mus musculus
actaacggttatgacggagactatt

SEQ ID NO: 5251 - DNA, 25 bp, Mus musculus
actaactgtatggaagtgatgacgg

SEQ ID NO: 5252 - DNA, 25 bp, Mus musculus
actaagagatatgcccggaaacaga

SEQ ID NO: 5253 - DNA, 25 bp, Mus musculus
actaagagccctgggtgatgaagac

SEQ ID NO: 5254 - DNA, 25 bp, Mus musculus
actaagcagggcaggcaagtgccca

SEQ ID NO: 5255 - DNA, 25 bp, Mus musculus
actaagcatcgtctttcagctactt

SEQ ID NO: 5256 - DNA, 25 bp, Mus musculus
actaaggattaagtaggatgtcaac

SEQ ID NO: 5257 - DNA, 25 bp, Mus musculus
actaagtgcttagttcaaaccattc

SEQ ID NO: 5258 - DNA, 25 bp, Mus musculus
actaataccgctcctggttggcgga

SEQ ID NO: 5259 - DNA, 25 bp, Mus musculus
actaattggctttgctggtgctccg

SEQ ID NO: 5260 - DNA, 25 bp, Mus musculus
actacaaagcaattggcaagatagg

SEQ ID NO: 5261 - DNA, 25 bp, Mus musculus
actacaaagttctgctcagccggca

SEQ ID NO: 5262 - DNA, 25 bp, Mus musculus
actacaagcctccagactgctcggt

SEQ ID NO: 5263 - DNA, 25 bp, Mus musculus
actacactgttgaagacctggcaca

SEQ ID NO: 5264 - DNA, 25 bp, Mus musculus
actacagcaatgaattggtggccta

SEQ ID NO: 5265 - DNA, 25 bp, Mus musculus
actacagttcctcttttggcccgct

SEQ ID NO: 5266 - DNA, 25 bp, Mus musculus
actacatatgactgccctccacggt

SEQ ID NO: 5267 - DNA, 25 bp, Mus musculus
actacatccaggcttccacgtacgt

SEQ ID NO: 5268 - DNA, 25 bp, Mus musculus
actacatccagggttccacgtacgt

SEQ ID NO: 5269 - DNA, 25 bp, Mus musculus
actacattgcatatgcccatagtac

SEQ ID NO: 5270 - DNA, 25 bp, Mus musculus
actaccaacacacttatagcaaaga

SEQ ID NO: 5271 - DNA, 25 bp, Mus musculus
actaccaacacagttatagcaaaga

SEQ ID NO: 5272 - DNA, 25 bp, Mus musculus
actaccagaagtctgagaagaagtg

SEQ ID NO: 5273 - DNA, 25 bp, Mus musculus
actaccagcaggctctgaccagtgc

SEQ ID NO: 5274 - DNA, 25 bp, Mus musculus
actacgatgacacagatgacgatga

SEQ ID NO: 5275 - DNA, 25 bp, Mus musculus
actacggaaagccaaggagaccatt

SEQ ID NO: 5276 - DNA, 25 bp, Mus musculus
actacggctcaggaagcctctctgg

SEQ ID NO: 5277 - DNA, 25 bp, Mus musculus
actacgtggtgctcatggctgcggc

SEQ ID NO: 5278 - DNA, 25 bp, Mus musculus
actactgctgtctggtgccgggctc

SEQ ID NO: 5279 - DNA, 25 bp, Mus musculus
actacttcatggcatttggaggcgg

SEQ ID NO: 5280 - DNA, 25 bp, Mus musculus
actagaacgagaggcccggatatgc

SEQ ID NO: 5281 - DNA, 25 bp, Mus musculus
actagaaggacgtggtagtgcttcc

SEQ ID NO: 5282 - DNA, 25 bp, Mus musculus
actagaagtgctgtagatgaggacc

SEQ ID NO: 5283 - DNA, 25 bp, Mus musculus
actagacaggtcacccggagtgctt

SEQ ID NO: 5284 - DNA, 25 bp, Mus musculus
actagactggcccttggataccatc

SEQ ID NO: 5285 - DNA, 25 bp, Mus musculus
actagagctgtgaggcccctcaacc

SEQ ID NO: 5286 - DNA, 25 bp, Mus musculus
actagaggctgggtaccagatagca

SEQ ID NO: 5287 - DNA, 25 bp, Mus musculus
actagaggtgtttctggcccagctg

SEQ ID NO: 5288 - DNA, 25 bp, Mus musculus
actagatgtccagaagtattttcac

SEQ ID NO: 5289 - DNA, 25 bp, Mus musculus
actagcacggacctcacggacgtga

SEQ ID NO: 5290 - DNA, 25 bp, Mus musculus
actagccctggtcaggacccggatg

SEQ ID NO: 5291 - DNA, 25 bp, Mus musculus
actagctggctaaactcattcttgg

SEQ ID NO: 5292 - DNA, 25 bp, Mus musculus
actagggcagttcccatccttcaga

SEQ ID NO: 5293 - DNA, 25 bp, Mus musculus
actagtcagtgcttcgcaagatgga

SEQ ID NO: 5294 - DNA, 25 bp, Mus musculus
actagtgctcctatatctccagctg

SEQ ID NO: 5295 - DNA, 25 bp, Mus musculus
actagtggcccctgtcaagagaaag

SEQ ID NO: 5296 - DNA, 25 bp, Mus musculus
actatacccagcatctggactggca

SEQ ID NO: 5297 - DNA, 25 bp, Mus musculus
actataggtgttcatgatcgtgttt

SEQ ID NO: 5298 - DNA, 25 bp, Mus musculus
actatagtggctatggcggctatga

SEQ ID NO: 5299 - DNA, 25 bp, Mus musculus
actatatacaagatcctgtgacggg

SEQ ID NO: 5300 - DNA, 25 bp, Mus musculus
actatcagacctaccgagtgctgct

SEQ ID NO: 5301 - DNA, 25 bp, Mus musculus
actatccgctggctgctgaatgggc

SEQ ID NO: 5302 - DNA, 25 bp, Mus musculus
actatcctgaggacgtactggtgcc

SEQ ID NO: 5303 - DNA, 25 bp, Mus musculus
actatcctgggtgcatggttgaatt

SEQ ID NO: 5304 - DNA, 25 bp, Mus musculus
actatcgctgggatcctcttcatct

SEQ ID NO: 5305 - DNA, 25 bp, Mus musculus
actatcgtctgacaaaggctttgct

SEQ ID NO: 5306 - DNA, 25 bp, Mus musculus
actatgaacagacaggtttgtccct

SEQ ID NO: 5307 - DNA, 25 bp, Mus musculus
actatgaatgggagggctgattttc

SEQ ID NO: 5308 - DNA, 25 bp, Mus musculus
actatgacggaagtaaaggcttaca

SEQ ID NO: 5309 - DNA, 25 bp, Mus musculus
actatgatggacaatctgtctttca

SEQ ID NO: 5310 - DNA, 25 bp, Mus musculus
actatgcagtggtcggtaggacaca

SEQ ID NO: 5311 - DNA, 25 bp, Mus musculus
actatgcataaggacagcagtggac

SEQ ID NO: 5312 - DNA, 25 bp, Mus musculus
actatgcattgatgggtacccgtca

SEQ ID NO: 5313 - DNA, 25 bp, Mus musculus
actatgtattgtggaagacagggcc

SEQ ID NO: 5314 - DNA, 25 bp, Mus musculus
actatgtggcggcaaatgtgaacct

SEQ ID NO: 5315 - DNA, 25 bp, Mus musculus
actatgtggcgggaaatgtgaacct

SEQ ID NO: 5316 - DNA, 25 bp, Mus musculus
actattaagataatggaagtccctg

SEQ ID NO: 5317 - DNA, 25 bp, Mus musculus
actattacacctacccaggctcgct

SEQ ID NO: 5318 - DNA, 25 bp, Mus musculus
actattaccagcagcaggcacaacc

SEQ ID NO: 5319 - DNA, 25 bp, Mus musculus
actattaccatactgtgctgtggat

SEQ ID NO: 5320 - DNA, 25 bp, Mus musculus
actattaccttgctcccatgccaat

SEQ ID NO: 5321 - DNA, 25 bp, Mus musculus
actattcacggatcattgagcgtct

SEQ ID NO: 5322 - DNA, 25 bp, Mus musculus
actattgcggcctggagcagtgcca

SEQ ID NO: 5323 - DNA, 25 bp, Mus musculus
actattgtagatgagctgggcaagg

SEQ ID NO: 5324 - DNA, 25 bp, Mus musculus
actcaaacctaggtggcctcatgga

SEQ ID NO: 5325 - DNA, 25 bp, Mus musculus
actcaaagcccagaatggcaagaga

SEQ ID NO: 5326 - DNA, 25 bp, Mus musculus
actcaaccactttagccgcaagctt

SEQ ID NO: 5327 - DNA, 25 bp, Mus musculus
actcaagaccaactcagctgtccgg

SEQ ID NO: 5328 - DNA, 25 bp, Mus musculus
actcaagtgggcttcaggcatcttc

SEQ ID NO: 5329 - DNA, 25 bp, Mus musculus
actcaatctggccatggtttacaga

SEQ ID NO: 5330 - DNA, 25 bp, Mus musculus
actcacacggtctggaagcaacccg

SEQ ID NO: 5331 - DNA, 25 bp, Mus musculus
actcacaggcttcctggacaaaaga

SEQ ID NO: 5332 - DNA, 25 bp, Mus musculus
actcacatcactcctgtgccgatta

SEQ ID NO: 5333 - DNA, 25 bp, Mus musculus
actcaccataagtgcggagtgcccc

SEQ ID NO: 5334 - DNA, 25 bp, Mus musculus
actcactcttaccacctgtggtgga

SEQ ID NO: 5335 - DNA, 25 bp, Mus musculus
actcactctttggagatgtgaagaa

SEQ ID NO: 5336 - DNA, 25 bp, Mus musculus
actcacttcgtaggccagactggac

SEQ ID NO: 5337 - DNA, 25 bp, Mus musculus
actcagaaccacagaaaacggaggg

SEQ ID NO: 5338 - DNA, 25 bp, Mus musculus
actcagaagcgcatccgagtgacca

SEQ ID NO: 5339 - DNA, 25 bp, Mus musculus
actcagacccagcaagttttcctta

SEQ ID NO: 5340 - DNA, 25 bp, Mus musculus
actcagactatgtgcacctctgcag

SEQ ID NO: 5341 - DNA, 25 bp, Mus musculus
actcagaggcttagcccggccaggt

SEQ ID NO: 5342 - DNA, 25 bp, Mus musculus
actcagcatttagaccgggttgtct

SEQ ID NO: 5343 - DNA, 25 bp, Mus musculus
actcagccaccttcaagtcatttga

SEQ ID NO: 5344 - DNA, 25 bp, Mus musculus
actcagccggagttgtaccacccaa

SEQ ID NO: 5345 - DNA, 25 bp, Mus musculus
actcagcctcaagggtcttctgtgg

SEQ ID NO: 5346 - DNA, 25 bp, Mus musculus
actcagcgagatcaccctgcctgtg

SEQ ID NO: 5347 - DNA, 25 bp, Mus musculus
actcagctccgaattacgtatagaa

SEQ ID NO: 5348 - DNA, 25 bp, Mus musculus
actcagctgacctgctcaagggcct

SEQ ID NO: 5349 - DNA, 25 bp, Mus musculus
actcagctgtggtgtgctgcaagac

SEQ ID NO: 5350 - DNA, 25 bp, Mus musculus
actcaggaatctgctcaactgctgg

SEQ ID NO: 5351 - DNA, 25 bp, Mus musculus
actcaggagagcgtgggcctcgtac

SEQ ID NO: 5352 - DNA, 25 bp, Mus musculus
actcaggcagctggataagcacggc

SEQ ID NO: 5353 - DNA, 25 bp, Mus musculus
actcaggctatcgtaagtgtactac

SEQ ID NO: 5354 - DNA, 25 bp, Mus musculus
actcagggagtgtctgagtcttctg

SEQ ID NO: 5355 - DNA, 25 bp, Mus musculus
actcagtccctcattatgatccagc

SEQ ID NO: 5356 - DNA, 25 bp, Mus musculus
actcagtcggctgtcaaatcactga

SEQ ID NO: 5357 - DNA, 25 bp, Mus musculus
actcagtctgcaccaatatcctggg

SEQ ID NO: 5358 - DNA, 25 bp, Mus musculus
actcatacagaacaagaactttgac

SEQ ID NO: 5359 - DNA, 25 bp, Mus musculus
actcatagttcccatagccccgaga

SEQ ID NO: 5360 - DNA, 25 bp, Mus musculus
actcatctgaaaaactgccacagga

SEQ ID NO: 5361 - DNA, 25 bp, Mus musculus
actcatgggcatcttgtctacatcc

SEQ ID NO: 5362 - DNA, 25 bp, Mus musculus
actcatgggcatgttgtctacatcc

SEQ ID NO: 5363 - DNA, 25 bp, Mus musculus
actcattagtagagagcagtgaaag

SEQ ID NO: 5364 - DNA, 25 bp, Mus musculus
actcattatgtagctccagctagct

SEQ ID NO: 5365 - DNA, 25 bp, Mus musculus
actcattgaaagaagaatcagggac

SEQ ID NO: 5366 - DNA, 25 bp, Mus musculus
actcatttctatggtggcaggaagc

SEQ ID NO: 5367 - DNA, 25 bp, Mus musculus
actccaacacagattggcttaagtt

SEQ ID NO: 5368 - DNA, 25 bp, Mus musculus
actccaacacagtttggcttaagtt

SEQ ID NO: 5369 - DNA, 25 bp, Mus musculus
actccaaccggaagaagcaccgcgg

SEQ ID NO: 5370 - DNA, 25 bp, Mus musculus
actccagatgtagcccatccaaaag

SEQ ID NO: 5371 - DNA, 25 bp, Mus musculus
actccagattgctgtctggacagag

SEQ ID NO: 5372 - DNA, 25 bp, Mus musculus
actccagcttgggagggcagggcca

SEQ ID NO: 5373 - DNA, 25 bp, Mus musculus
actccaggcctgagcgtgcggccag

SEQ ID NO: 5374 - DNA, 25 bp, Mus musculus
actccagtcttgacattcttcaggg

SEQ ID NO: 5375 - DNA, 25 bp, Mus musculus
actccagtgatccagagaattggga

SEQ ID NO: 5376 - DNA, 25 bp, Mus musculus
actccagtgcctattctacagccaa

SEQ ID NO: 5377 - DNA, 25 bp, Mus musculus
actccatatacagaaatcgaagcag

SEQ ID NO: 5378 - DNA, 25 bp, Mus musculus
actccatgtgtaaatatccctgcct

SEQ ID NO: 5379 - DNA, 25 bp, Mus musculus
actccattagaggacacactggtta

SEQ ID NO: 5380 - DNA, 25 bp, Mus musculus
actcccaaccagacagtaacagcgg

SEQ ID NO: 5381 - DNA, 25 bp, Mus musculus
actcccaacccttggctctgtgagg

SEQ ID NO: 5382 - DNA, 25 bp, Mus musculus
actcccaatggcagggatgagtctg

SEQ ID NO: 5383 - DNA, 25 bp, Mus musculus
actcccctagcctatagtttggcca

SEQ ID NO: 5384 - DNA, 25 bp, Mus musculus
actccctgcatgcaagcaagcactt

SEQ ID NO: 5385 - DNA, 25 bp, Mus musculus
actccctgtctgttgggtcctcagg

SEQ ID NO: 5386 - DNA, 25 bp, Mus musculus
actccgcagaaaccaaggaaagcca

SEQ ID NO: 5387 - DNA, 25 bp, Mus musculus
actccgcgctgcagttggtgccgct

SEQ ID NO: 5388 - DNA, 25 bp, Mus musculus
actccgcgctgctgttggtgccgct

SEQ ID NO: 5389 - DNA, 25 bp, Mus musculus
actccggaaaggtgcgagatccaca

SEQ ID NO: 5390 - DNA, 25 bp, Mus musculus
actccgggcgcaattgatcccgctg

SEQ ID NO: 5391 - DNA, 25 bp, Mus musculus
actccgggcgcatttgatcccgctg

SEQ ID NO: 5392 - DNA, 25 bp, Mus musculus
actcctacccattggtctaagcttg

SEQ ID NO: 5393 - DNA, 25 bp, Mus musculus
actcctagcctcagctctgttcaaa

SEQ ID NO: 5394 - DNA, 25 bp, Mus musculus
actcctcagtgatccccatcgatag

SEQ ID NO: 5395 - DNA, 25 bp, Mus musculus
actcctcagttacctttaatgggat

SEQ ID NO: 5396 - DNA, 25 bp, Mus musculus
actcctccacagctcagggaaggat

SEQ ID NO: 5397 - DNA, 25 bp, Mus musculus
actcctctgataaaatgcctaatga

SEQ ID NO: 5398 - DNA, 25 bp, Mus musculus
actcctcttcgtcggcagtgacagc

SEQ ID NO: 5399 - DNA, 25 bp, Mus musculus
actcctctttgtccgaggtgcacag

SEQ ID NO: 5400 - DNA, 25 bp, Mus musculus
actcctgacaagtgtggaggacccc

SEQ ID NO: 5401 - DNA, 25 bp, Mus musculus
actcctggaagtagatgtaagtgaa

SEQ ID NO: 5402 - DNA, 25 bp, Mus musculus
actcctgggaccgtcttgtggacga

SEQ ID NO: 5403 - DNA, 25 bp, Mus musculus
actccttccggtgttgactgtggca

SEQ ID NO: 5404 - DNA, 25 bp, Mus musculus
actccttgcaggtccttaccttgtt

SEQ ID NO: 5405 - DNA, 25 bp, Mus musculus
actccttgctatgtgtcgtgcttca

SEQ ID NO: 5406 - DNA, 25 bp, Mus musculus
actcctttgatggaagcagctgcct

SEQ ID NO: 5407 - DNA, 25 bp, Mus musculus
actcctttgggccacaagagggcac

SEQ ID NO: 5408 - DNA, 25 bp, Mus musculus
actcgagattctgcacccctgccag

SEQ ID NO: 5409 - DNA, 25 bp, Mus musculus
actcgataagtatgcctgtcatgag

SEQ ID NO: 5410 - DNA, 25 bp, Mus musculus
actcgcacagcgtacggaccaaatg

SEQ ID NO: 5411 - DNA, 25 bp, Mus musculus
actcggaaaaatctaagaaagccag

SEQ ID NO: 5412 - DNA, 25 bp, Mus musculus
actcggaaggagctacagtcagact

SEQ ID NO: 5413 - DNA, 25 bp, Mus musculus
actcggagctggatgtgcgcactgc

SEQ ID NO: 5414 - DNA, 25 bp, Mus musculus
actcgggatgcaggcttcactgtgg

SEQ ID NO: 5415 - DNA, 25 bp, Mus musculus
actcggttaggcatggatttgctgc

SEQ ID NO: 5416 - DNA, 25 bp, Mus musculus
actcgtctgctctcaggcagattcc

SEQ ID NO: 5417 - DNA, 25 bp, Mus musculus
actcgtttgctgtcacgtgcctgtg

SEQ ID NO: 5418 - DNA, 25 bp, Mus musculus
actctaaaaaacgatgaaggcactg

SEQ ID NO: 5419 - DNA, 25 bp, Mus musculus
actctaacaagctcgggaagaaggt

SEQ ID NO: 5420 - DNA, 25 bp, Mus musculus
actctaaggagggatgataacgtta

SEQ ID NO: 5421 - DNA, 25 bp, Mus musculus
actctaagtcggaggtgcccgagcc

SEQ ID NO: 5422 - DNA, 25 bp, Mus musculus
actctatggtgaggactgatggaca

SEQ ID NO: 5423 - DNA, 25 bp, Mus musculus
actctatttaatacagtgtcctcaa

SEQ ID NO: 5424 - DNA, 25 bp, Mus musculus
actctcaccatcaggctacttatgc

SEQ ID NO: 5425 - DNA, 25 bp, Mus musculus
actctcacggaccaggcagacattg

SEQ ID NO: 5426 - DNA, 25 bp, Mus musculus
actctcagacacagcggcagctttg

SEQ ID NO: 5427 - DNA, 25 bp, Mus musculus
actctcagaggcagtgagccgggca

SEQ ID NO: 5428 - DNA, 25 bp, Mus musculus
actctcgagcgcactctcgtggagg

SEQ ID NO: 5429 - DNA, 25 bp, Mus musculus
actctcgcagcctgctggaggcctt

SEQ ID NO: 5430 - DNA, 25 bp, Mus musculus
actctcgggctgatcaggtgagtga

SEQ ID NO: 5431 - DNA, 25 bp, Mus musculus
actctcgggctgttcaggtgagtga

SEQ ID NO: 5432 - DNA, 25 bp, Mus musculus
actctcgtgctgctgtggccgatcc

SEQ ID NO: 5433 - DNA, 25 bp, Mus musculus
actctctgtggcgaggcctggcaga

SEQ ID NO: 5434 - DNA, 25 bp, Mus musculus
actctgaccaagtagcgcagagtga

SEQ ID NO: 5435 - DNA, 25 bp, Mus musculus
actctgaggagctcttggccactga

SEQ ID NO: 5436 - DNA, 25 bp, Mus musculus
actctgaggtccataaagttcagtg

SEQ ID NO: 5437 - DNA, 25 bp, Mus musculus
actctgatcactatggtttgtacca

SEQ ID NO: 5438 - DNA, 25 bp, Mus musculus
actctgatgtccttagttcttgaca

SEQ ID NO: 5439 - DNA, 25 bp, Mus musculus
actctgcagaagctagtgcagcttg

SEQ ID NO: 5440 - DNA, 25 bp, Mus musculus
actctgcagaggacgttcgtaagtt

SEQ ID NO: 5441 - DNA, 25 bp, Mus musculus
actctgcccttctaagtaaacggcg

SEQ ID NO: 5442 - DNA, 25 bp, Mus musculus
actctgcgaagagcctgcaggccag

SEQ ID NO: 5443 - DNA, 25 bp, Mus musculus
actctgctagtctgggtcggtgtca

SEQ ID NO: 5444 - DNA, 25 bp, Mus musculus
actctgctgtttgctgcatgctgca

SEQ ID NO: 5445 - DNA, 25 bp, Mus musculus
actctgcttttgactctgatgtcct

SEQ ID NO: 5446 - DNA, 25 bp, Mus musculus
actctgggccccacggctatcatgt

SEQ ID NO: 5447 - DNA, 25 bp, Mus musculus
actctgggtgtctgcaagtacacgg

SEQ ID NO: 5448 - DNA, 25 bp, Mus musculus
actctgggtttaacaaacagagaca

SEQ ID NO: 5449 - DNA, 25 bp, Mus musculus
actctgggtttctggactgtgcaag

SEQ ID NO: 5450 - DNA, 25 bp, Mus musculus
actctgtaatctgaagcctgcaaag

SEQ ID NO: 5451 - DNA, 25 bp, Mus musculus
actctgtgcacacggtcactgtgag

SEQ ID NO: 5452 - DNA, 25 bp, Mus musculus
actctgtgcacagggtcactgtgag

SEQ ID NO: 5453 - DNA, 25 bp, Mus musculus
actctgttgtccttgggtgccgaca

SEQ ID NO: 5454 - DNA, 25 bp, Mus musculus
actctgttttctactgcagtggaca

SEQ ID NO: 5455 - DNA, 25 bp, Mus musculus
actcttacaactccccaggtggtgg

SEQ ID NO: 5456 - DNA, 25 bp, Mus musculus
actcttaccacctgtggtggacacc

SEQ ID NO: 5457 - DNA, 25 bp, Mus musculus
actcttcaatcagctcatcaagtga

SEQ ID NO: 5458 - DNA, 25 bp, Mus musculus
actcttcaggcacatatggaagatc

SEQ ID NO: 5459 - DNA, 25 bp, Mus musculus
actcttgtgggcaaacctttggatg

SEQ ID NO: 5460 - DNA, 25 bp, Mus musculus
actctttatatatcagaagctggcc

SEQ ID NO: 5461 - DNA, 25 bp, Mus musculus
actctttcccagtgtaatgacacct

SEQ ID NO: 5462 - DNA, 25 bp, Mus musculus
actctttcctccatgcagcagttca

SEQ ID NO: 5463 - DNA, 25 bp, Mus musculus
actgaaaacacagcctatctgtttg

SEQ ID NO: 5464 - DNA, 25 bp, Mus musculus
actgaaacaagcaaagaagttctgg

SEQ ID NO: 5465 - DNA, 25 bp, Mus musculus
actgaaacaagctaagaagttctgg

SEQ ID NO: 5466 - DNA, 25 bp, Mus musculus
actgaaatggcaagaaggcctccag

SEQ ID NO: 5467 - DNA, 25 bp, Mus musculus
actgaacagcaaccacacaggctac

SEQ ID NO: 5468 - DNA, 25 bp, Mus musculus
actgaaccgtgatgcctttcatata

SEQ ID NO: 5469 - DNA, 25 bp, Mus musculus
actgaagaagtaccccgagaagctc

SEQ ID NO: 5470 - DNA, 25 bp, Mus musculus
actgaagaatgagaccatctggtac

SEQ ID NO: 5471 - DNA, 25 bp, Mus musculus
actgaagagtctaaggctctcctgg

SEQ ID NO: 5472 - DNA, 25 bp, Mus musculus
actgaagcaggctaccgagccgccg

SEQ ID NO: 5473 - DNA, 25 bp, Mus musculus
actgaaggaggagctaagttcgaaa

SEQ ID NO: 5474 - DNA, 25 bp, Mus musculus
actgaagttctaggcgcctgtgaac

SEQ ID NO: 5475 - DNA, 25 bp, Mus musculus
actgaattcttctgcccaatggcca

SEQ ID NO: 5476 - DNA, 25 bp, Mus musculus
actgacaaactcatgatggatggcc

SEQ ID NO: 5477 - DNA, 25 bp, Mus musculus
actgacaagcacctttctcctgatg

SEQ ID NO: 5478 - DNA, 25 bp, Mus musculus
actgacagccattgttcaggtgctc

SEQ ID NO: 5479 - DNA, 25 bp, Mus musculus
actgacagtctgtgcaccctaacaa

SEQ ID NO: 5480 - DNA, 25 bp, Mus musculus
actgacatcacatggtccgagagcc

SEQ ID NO: 5481 - DNA, 25 bp, Mus musculus
actgacatctatccctccaagtgga

SEQ ID NO: 5482 - DNA, 25 bp, Mus musculus
actgaccctcaatgtcaagagtgaa

SEQ ID NO: 5483 - DNA, 25 bp, Mus musculus
actgaccttgaaccactccaaagct

SEQ ID NO: 5484 - DNA, 25 bp, Mus musculus
actgacgtttgtggctggtcaagtt

SEQ ID NO: 5485 - DNA, 25 bp, Mus musculus
actgactgattacagagggatcccc

SEQ ID NO: 5486 - DNA, 25 bp, Mus musculus
actgactggactgtggctgttggca

SEQ ID NO: 5487 - DNA, 25 bp, Mus musculus
actgactgtcaaagccaaggccaca

SEQ ID NO: 5488 - DNA, 25 bp, Mus musculus
actgagagggagtttggcaactacc

SEQ ID NO: 5489 - DNA, 25 bp, Mus musculus
actgagagtttaccactggagttca

SEQ ID NO: 5490 - DNA, 25 bp, Mus musculus
actgagcagcctggcctccaatgta

SEQ ID NO: 5491 - DNA, 25 bp, Mus musculus
actgagcctgcgacgatggcctctg

SEQ ID NO: 5492 - DNA, 25 bp, Mus musculus
actgagccttgagcgcatcagttta

SEQ ID NO: 5493 - DNA, 25 bp, Mus musculus
actgaggacagccttgtgtcaaaag

SEQ ID NO: 5494 - DNA, 25 bp, Mus musculus
actgaggaggccagatgcctctgtg

SEQ ID NO: 5495 - DNA, 25 bp, Mus musculus
actgaggccccgagagtacagtgac

SEQ ID NO: 5496 - DNA, 25 bp, Mus musculus
actgaggctttattgtctccagcac

SEQ ID NO: 5497 - DNA, 25 bp, Mus musculus
actgagggcccagagactgaccttg

SEQ ID NO: 5498 - DNA, 25 bp, Mus musculus
actgagtatcccactagcacgaaag

SEQ ID NO: 5499 - DNA, 25 bp, Mus musculus
actgagtctgtctgcatgatgcagc

SEQ ID NO: 5500 - DNA, 25 bp, Mus musculus
actgagttgcccgaggcctggtacc

SEQ ID NO: 5501 - DNA, 25 bp, Mus musculus
actgagtttggaagcctctgggcag

SEQ ID NO: 5502 - DNA, 25 bp, Mus musculus
actgatagggctccagtgaccctgc

SEQ ID NO: 5503 - DNA, 25 bp, Mus musculus
actgatgagccctcagacggcagga

SEQ ID NO: 5504 - DNA, 25 bp, Mus musculus
actgatgatgtggaaagggctttgc

SEQ ID NO: 5505 - DNA, 25 bp, Mus musculus
actgatggacatacattatctgaga

SEQ ID NO: 5506 - DNA, 25 bp, Mus musculus
actgatggtgttgatgaaaagctcc

SEQ ID NO: 5507 - DNA, 25 bp, Mus musculus
actgattggaaacatggaccgtgag

SEQ ID NO: 5508 - DNA, 25 bp, Mus musculus
actgatttccagacactacaagaaa

SEQ ID NO: 5509 - DNA, 25 bp, Mus musculus
actgcaagaggcttactctgtcacc

SEQ ID NO: 5510 - DNA, 25 bp, Mus musculus
actgcaagccacagcgggctcagca

SEQ ID NO: 5511 - DNA, 25 bp, Mus musculus
actgcaaggtgtactaagggtataa

SEQ ID NO: 5512 - DNA, 25 bp, Mus musculus
actgcaaggtgttctaagggtataa

SEQ ID NO: 5513 - DNA, 25 bp, Mus musculus
actgcaccaggctgctcagcagggc

SEQ ID NO: 5514 - DNA, 25 bp, Mus musculus
actgcacctgcactttcttctataa

SEQ ID NO: 5515 - DNA, 25 bp, Mus musculus
actgcacggacgaggacaggatcgt

SEQ ID NO: 5516 - DNA, 25 bp, Mus musculus
actgcacggacgtggacaggatcgt

SEQ ID NO: 5517 - DNA, 25 bp, Mus musculus
actgcactcttccactgtaccagtg

SEQ ID NO: 5518 - DNA, 25 bp, Mus musculus
actgcagaagggacagatgacaggt

SEQ ID NO: 5519 - DNA, 25 bp, Mus musculus
actgcagaagggtcagatgacaggt

SEQ ID NO: 5520 - DNA, 25 bp, Mus musculus
actgcagaccagtgtattctaaaaa

SEQ ID NO: 5521 - DNA, 25 bp, Mus musculus
actgcagcagaagttggaataattg

SEQ ID NO: 5522 - DNA, 25 bp, Mus musculus
actgcagcagcccacaaggacagca

SEQ ID NO: 5523 - DNA, 25 bp, Mus musculus
actgcagcctcctgggcggctcagt

SEQ ID NO: 5524 - DNA, 25 bp, Mus musculus
actgcagcgttagaaacagattctg

SEQ ID NO: 5525 - DNA, 25 bp, Mus musculus
actgcagctcatggcggagttcctg

SEQ ID NO: 5526 - DNA, 25 bp, Mus musculus
actgcagctccaacagctgctgcaa

SEQ ID NO: 5527 - DNA, 25 bp, Mus musculus
actgcagctttccacagtggtggca

SEQ ID NO: 5528 - DNA, 25 bp, Mus musculus
actgcaggaagagcgccagcgagct

SEQ ID NO: 5529 - DNA, 25 bp, Mus musculus
actgcaggactactttgcagccaag

SEQ ID NO: 5530 - DNA, 25 bp, Mus musculus
actgcagggttgtgtccctagcaaa

SEQ ID NO: 5531 - DNA, 25 bp, Mus musculus
actgcagtaatggatgctccgcgcc

SEQ ID NO: 5532 - DNA, 25 bp, Mus musculus
actgcagtaggtggtggtttccttc

SEQ ID NO: 5533 - DNA, 25 bp, Mus musculus
actgcatcgaggagaagggaccaca

SEQ ID NO: 5534 - DNA, 25 bp, Mus musculus
actgccaagtgggataacttcctgg

SEQ ID NO: 5535 - DNA, 25 bp, Mus musculus
actgccacaggaattgcttctctgc

SEQ ID NO: 5536 - DNA, 25 bp, Mus musculus
actgccacccaaagatcatagatgc

SEQ ID NO: 5537 - DNA, 25 bp, Mus musculus
actgccaccgagatagccatcaacg

SEQ ID NO: 5538 - DNA, 25 bp, Mus musculus
actgccactggtcggctccagagct

SEQ ID NO: 5539 - DNA, 25 bp, Mus musculus
actgcccagctgtgattggacccgc

SEQ ID NO: 5540 - DNA, 25 bp, Mus musculus
actgcccagtggtttatcgtggttt

SEQ ID NO: 5541 - DNA, 25 bp, Mus musculus
actgcccgtggttgatttgttctgc

SEQ ID NO: 5542 - DNA, 25 bp, Mus musculus
actgccctctgacttctcattgagt

SEQ ID NO: 5543 - DNA, 25 bp, Mus musculus
actgccctgatggaggcaaattcca

SEQ ID NO: 5544 - DNA, 25 bp, Mus musculus
actgccgaggagtcaatgcaattgt

SEQ ID NO: 5545 - DNA, 25 bp, Mus musculus
actgcctcgtcatgtatgtcatcct

SEQ ID NO: 5546 - DNA, 25 bp, Mus musculus
actgccttactttgtgctcatcatc

SEQ ID NO: 5547 - DNA, 25 bp, Mus musculus
actgccttctcctgtcaggccggga

SEQ ID NO: 5548 - DNA, 25 bp, Mus musculus
actgccttgtggttcttaatcagcc

SEQ ID NO: 5549 - DNA, 25 bp, Mus musculus
actgcggagtgtcatgaatacttcc

SEQ ID NO: 5550 - DNA, 25 bp, Mus musculus
actgcgggcgccaacggcacatcgg

SEQ ID NO: 5551 - DNA, 25 bp, Mus musculus
actgctcaggcaagaagcggtgctg

SEQ ID NO: 5552 - DNA, 25 bp, Mus musculus
actgctcataaacgactttgggaga

SEQ ID NO: 5553 - DNA, 25 bp, Mus musculus
actgctcctggtatgatacatccag

SEQ ID NO: 5554 - DNA, 25 bp, Mus musculus
actgctcggctttggtcatgggact

SEQ ID NO: 5555 - DNA, 25 bp, Mus musculus
actgctgagcgtggagatgaccgca

SEQ ID NO: 5556 - DNA, 25 bp, Mus musculus
actgctgccgcgctcaatggaggcc

SEQ ID NO: 5557 - DNA, 25 bp, Mus musculus
actgctgctcttcgaggacgagttt

SEQ ID NO: 5558 - DNA, 25 bp, Mus musculus
actgctgctgatctgggacaatggc

SEQ ID NO: 5559 - DNA, 25 bp, Mus musculus
actgctggagttaataccaccgaca

SEQ ID NO: 5560 - DNA, 25 bp, Mus musculus
actgctgggagatgtccctgtggta

SEQ ID NO: 5561 - DNA, 25 bp, Mus musculus
actgctgtacgcctttgcctatggg

SEQ ID NO: 5562 - DNA, 25 bp, Mus musculus
actgctgtgcccctggtccttcagt

SEQ ID NO: 5563 - DNA, 25 bp, Mus musculus
actgcttcacctgcgtgatgtgcca

SEQ ID NO: 5564 - DNA, 25 bp, Mus musculus
actgcttctcaacttggaggagtac

SEQ ID NO: 5565 - DNA, 25 bp, Mus musculus
actgcttctctgctaaatgtttcca

SEQ ID NO: 5566 - DNA, 25 bp, Mus musculus
actgcttgccgatagcagccatcgt

SEQ ID NO: 5567 - DNA, 25 bp, Mus musculus
actgcttgctaaagtgtgaagggac

SEQ ID NO: 5568 - DNA, 25 bp, Mus musculus
actgctttgaaagcaccgaggagag

SEQ ID NO: 5569 - DNA, 25 bp, Mus musculus
actgctttgggctgggccgctcagc

SEQ ID NO: 5570 - DNA, 25 bp, Mus musculus
actggaaaaggttcaataaattgct

SEQ ID NO: 5571 - DNA, 25 bp, Mus musculus
actggaaagagggtgatgacgcaat

SEQ ID NO: 5572 - DNA, 25 bp, Mus musculus
actggaaagccaagacaggactgga

SEQ ID NO: 5573 - DNA, 25 bp, Mus musculus
actggaaagtccaaaggctatggtt

SEQ ID NO: 5574 - DNA, 25 bp, Mus musculus
actggaagaatgagataagtcctct

SEQ ID NO: 5575 - DNA, 25 bp, Mus musculus
actggaagcattgaatcctctggaa

SEQ ID NO: 5576 - DNA, 25 bp, Mus musculus
actggacaaggatggatggcttcac

SEQ ID NO: 5577 - DNA, 25 bp, Mus musculus
actggacacgcactactggacttgg

SEQ ID NO: 5578 - DNA, 25 bp, Mus musculus
actggacataccctggctctctgac

SEQ ID NO: 5579 - DNA, 25 bp, Mus musculus
actggacgctggtgcccatgcccgt

SEQ ID NO: 5580 - DNA, 25 bp, Mus musculus
actggactgcaatgccaagcagtgg

SEQ ID NO: 5581 - DNA, 25 bp, Mus musculus
actggacttagtcctctgctcttca

SEQ ID NO: 5582 - DNA, 25 bp, Mus musculus
actggagaaatgcagcccaagtgtt

SEQ ID NO: 5583 - DNA, 25 bp, Mus musculus
actggagatgcccatattattggca

SEQ ID NO: 5584 - DNA, 25 bp, Mus musculus
actggagctggcatggatagagcca

SEQ ID NO: 5585 - DNA, 25 bp, Mus musculus
actggaggagtgtcagcggaaccac

SEQ ID NO: 5586 - DNA, 25 bp, Mus musculus
actggagtggcacacactacctgca

SEQ ID NO: 5587 - DNA, 25 bp, Mus musculus
actggagttaccctgatcttcttgc

SEQ ID NO: 5588 - DNA, 25 bp, Mus musculus
actggatccctacaacagaccttgg

SEQ ID NO: 5589 - DNA, 25 bp, Mus musculus
actggatcctcacaggaactcctct

SEQ ID NO: 5590 - DNA, 25 bp, Mus musculus
actggatctctgcatatccaggccc

SEQ ID NO: 5591 - DNA, 25 bp, Mus musculus
actggatgataaaggacggttgtga

SEQ ID NO: 5592 - DNA, 25 bp, Mus musculus
actggatgtgttcacacctgatgag

SEQ ID NO: 5593 - DNA, 25 bp, Mus musculus
actggattgaggagcccgtgcgcca

SEQ ID NO: 5594 - DNA, 25 bp, Mus musculus
actggcaaacatatgtttctggaac

SEQ ID NO: 5595 - DNA, 25 bp, Mus musculus
actggcaagatcctgcacccagagg

SEQ ID NO: 5596 - DNA, 25 bp, Mus musculus
actggcacagcagcaagtaacttga

SEQ ID NO: 5597 - DNA, 25 bp, Mus musculus
actggcactgcttgagggagactta

SEQ ID NO: 5598 - DNA, 25 bp, Mus musculus
actggcagaagccacctctcaacag

SEQ ID NO: 5599 - DNA, 25 bp, Mus musculus
actggcagacttggagacatagtcc

SEQ ID NO: 5600 - DNA, 25 bp, Mus musculus
actggcagagccttggccaccagct

SEQ ID NO: 5601 - DNA, 25 bp, Mus musculus
actggcatagaaaagaggagaaaga

SEQ ID NO: 5602 - DNA, 25 bp, Mus musculus
actggcatagttggagacaaaggag

SEQ ID NO: 5603 - DNA, 25 bp, Mus musculus
actggccacgctcatgtgctcctgg

SEQ ID NO: 5604 - DNA, 25 bp, Mus musculus
actggccactgactcaggttatctt

SEQ ID NO: 5605 - DNA, 25 bp, Mus musculus
actggccttagctgagcgggcctgt

SEQ ID NO: 5606 - DNA, 25 bp, Mus musculus
actggcctttgtatggagaagatcc

SEQ ID NO: 5607 - DNA, 25 bp, Mus musculus
actggcgcattgactcttgtgggca

SEQ ID NO: 5608 - DNA, 25 bp, Mus musculus
actggctaatcaagagtgaaaaacc

SEQ ID NO: 5609 - DNA, 25 bp, Mus musculus
actggctacccacagacggaaggct

SEQ ID NO: 5610 - DNA, 25 bp, Mus musculus
actggctcctctaacctgtgggtcc

SEQ ID NO: 5611 - DNA, 25 bp, Mus musculus
actggctctatgacctctaaatagg

SEQ ID NO: 5612 - DNA, 25 bp, Mus musculus
actggctgatccttcaaggtccagc

SEQ ID NO: 5613 - DNA, 25 bp, Mus musculus
actggctgtggcactggctctgacg

SEQ ID NO: 5614 - DNA, 25 bp, Mus musculus
actggcttggcatggcctgttagtg

SEQ ID NO: 5615 - DNA, 25 bp, Mus musculus
actggctttccgtcacttattacga

SEQ ID NO: 5616 - DNA, 25 bp, Mus musculus
actggctttctcttgtggcttctgt

SEQ ID NO: 5617 - DNA, 25 bp, Mus musculus
actggctttgctgtcatcaccgcgg

SEQ ID NO: 5618 - DNA, 25 bp, Mus musculus
actgggaaagacctcgatcccaaca

SEQ ID NO: 5619 - DNA, 25 bp, Mus musculus
actgggaagtacatgtgccggatca

SEQ ID NO: 5620 - DNA, 25 bp, Mus musculus
actgggatgcgtgctcacctcttgc

SEQ ID NO: 5621 - DNA, 25 bp, Mus musculus
actgggatgtccaccatggccaggg

SEQ ID NO: 5622 - DNA, 25 bp, Mus musculus
actgggattctggtggccccaggct

SEQ ID NO: 5623 - DNA, 25 bp, Mus musculus
actgggcactacagcagcgacacca

SEQ ID NO: 5624 - DNA, 25 bp, Mus musculus
actgggccaatttcgcaagaaatgg

SEQ ID NO: 5625 - DNA, 25 bp, Mus musculus
actgggccgtgtggcgctacttccg

SEQ ID NO: 5626 - DNA, 25 bp, Mus musculus
actgggctgaatggtaacctatccc

SEQ ID NO: 5627 - DNA, 25 bp, Mus musculus
actgggtgacctgcaccgtgctgtg

SEQ ID NO: 5628 - DNA, 25 bp, Mus musculus
actgggttcggtgcccggacaacag

SEQ ID NO: 5629 - DNA, 25 bp, Mus musculus
actgggtttgtcatgtgtcgacgga

SEQ ID NO: 5630 - DNA, 25 bp, Mus musculus
actggtacgtttgcggctgctggac

SEQ ID NO: 5631 - DNA, 25 bp, Mus musculus
actggtcaaaaagctggataaggaa

SEQ ID NO: 5632 - DNA, 25 bp, Mus musculus
actggtcctgtaaacaagattcaaa

SEQ ID NO: 5633 - DNA, 25 bp, Mus musculus
actggtctctttggctgctggttga

SEQ ID NO: 5634 - DNA, 25 bp, Mus musculus
actggtgcttgaaaatgagggcgcc

SEQ ID NO: 5635 - DNA, 25 bp, Mus musculus
actggtggctaaagtgaaggctgca

SEQ ID NO: 5636 - DNA, 25 bp, Mus musculus
actggtggttcatcaaggtccggga

SEQ ID NO: 5637 - DNA, 25 bp, Mus musculus
actggtgtgactgtggacttccaga

SEQ ID NO: 5638 - DNA, 25 bp, Mus musculus
actggttctctagaccatgctagcg

SEQ ID NO: 5639 - DNA, 25 bp, Mus musculus
actggttggacagcatacggccaca

SEQ ID NO: 5640 - DNA, 25 bp, Mus musculus
actgtaaagctcttcattgatggaa

SEQ ID NO: 5641 - DNA, 25 bp, Mus musculus
actgtaaccgctataatgaggatga

SEQ ID NO: 5642 - DNA, 25 bp, Mus musculus
actgtaaggcggataagacccagca

SEQ ID NO: 5643 - DNA, 25 bp, Mus musculus
actgtaaggtggtcttttcccagca

SEQ ID NO: 5644 - DNA, 25 bp, Mus musculus
actgtacacttctctttctcaatga

SEQ ID NO: 5645 - DNA, 25 bp, Mus musculus
actgtaggaagtgccgctggagaaa

SEQ ID NO: 5646 - DNA, 25 bp, Mus musculus
actgtatcccttgcgtgtgtgtgat

SEQ ID NO: 5647 - DNA, 25 bp, Mus musculus
actgtcaaggccttcatgatgttgg

SEQ ID NO: 5648 - DNA, 25 bp, Mus musculus
actgtcagcggctggaccccagcgg

SEQ ID NO: 5649 - DNA, 25 bp, Mus musculus
actgtcatcctgaatttctgccacc

SEQ ID NO: 5650 - DNA, 25 bp, Mus musculus
actgtcatggcacctgcctctactt

SEQ ID NO: 5651 - DNA, 25 bp, Mus musculus
actgtcatggcagctgcctctactt

SEQ ID NO: 5652 - DNA, 25 bp, Mus musculus
actgtcccctacatagtgggcttca

SEQ ID NO: 5653 - DNA, 25 bp, Mus musculus
actgtcgaagcttgagaagtctccc

SEQ ID NO: 5654 - DNA, 25 bp, Mus musculus
actgtcgctaaccatggcgtctgga

SEQ ID NO: 5655 - DNA, 25 bp, Mus musculus
actgtcgttctctgtgacaatttgg

SEQ ID NO: 5656 - DNA, 25 bp, Mus musculus
actgtctcgtaatctacttaaggac

SEQ ID NO: 5657 - DNA, 25 bp, Mus musculus
actgtcttcgccctgctctatgctt

SEQ ID NO: 5658 - DNA, 25 bp, Mus musculus
actgtcttgctttgagtggacatga

SEQ ID NO: 5659 - DNA, 25 bp, Mus musculus
actgtctttgatcgcctgatctttc

SEQ ID NO: 5660 - DNA, 25 bp, Mus musculus
actgtctttgatggcctgatctttc

SEQ ID NO: 5661 - DNA, 25 bp, Mus musculus
actgtgaagtaacccatagacagct

SEQ ID NO: 5662 - DNA, 25 bp, Mus musculus
actgtgaatgacatagacatctttg

SEQ ID NO: 5663 - DNA, 25 bp, Mus musculus
actgtgaatgagtggcctgatcaag

SEQ ID NO: 5664 - DNA, 25 bp, Mus musculus
actgtgaatgcttcggccactccaa

SEQ ID NO: 5665 - DNA, 25 bp, Mus musculus
actgtgacgtttctggctggcaacc

SEQ ID NO: 5666 - DNA, 25 bp, Mus musculus
actgtgactatggagttgtgatctt

SEQ ID NO: 5667 - DNA, 25 bp, Mus musculus
actgtgactgactccgtgggtcaga

SEQ ID NO: 5668 - DNA, 25 bp, Mus musculus
actgtgagcggtattcggcctgcga

SEQ ID NO: 5669 - DNA, 25 bp, Mus musculus
actgtgagtttcttctcctgagaga

SEQ ID NO: 5670 - DNA, 25 bp, Mus musculus
actgtgattgcctcccgggctggaa

SEQ ID NO: 5671 - DNA, 25 bp, Mus musculus
actgtgcaagtgacgggactttatc

SEQ ID NO: 5672 - DNA, 25 bp, Mus musculus
actgtgcagaccttcgtcattcttg

SEQ ID NO: 5673 - DNA, 25 bp, Mus musculus
actgtgcagcccaggcgcagcaggc

SEQ ID NO: 5674 - DNA, 25 bp, Mus musculus
actgtgccaactcgtttgctgtcac

SEQ ID NO: 5675 - DNA, 25 bp, Mus musculus
actgtgccaggaggatcttggctaa

SEQ ID NO: 5676 - DNA, 25 bp, Mus musculus
actgtggaagaattctgtggttctg

SEQ ID NO: 5677 - DNA, 25 bp, Mus musculus
actgtggaagatatctgcatgttga

SEQ ID NO: 5678 - DNA, 25 bp, Mus musculus
actgtggagccaacgtggacctgtt

SEQ ID NO: 5679 - DNA, 25 bp, Mus musculus
actgtggagtccacccaggagcaga

SEQ ID NO: 5680 - DNA, 25 bp, Mus musculus
actgtggagtcctcccaggagcaga

SEQ ID NO: 5681 - DNA, 25 bp, Mus musculus
actgtggatcgggtcctttggagcc

SEQ ID NO: 5682 - DNA, 25 bp, Mus musculus
actgtggcaagattgcattctacag

SEQ ID NO: 5683 - DNA, 25 bp, Mus musculus
actgtggccatccatacactggacc

SEQ ID NO: 5684 - DNA, 25 bp, Mus musculus
actgtgggtgatacctccctgagga

SEQ ID NO: 5685 - DNA, 25 bp, Mus musculus
actgtggtgtggctcatagcccgta

SEQ ID NO: 5686 - DNA, 25 bp, Mus musculus
actgtgtaggcctgttgcccatggg

SEQ ID NO: 5687 - DNA, 25 bp, Mus musculus
actgtgtgcccctgaagtgacccag

SEQ ID NO: 5688 - DNA, 25 bp, Mus musculus
actgtgtgttagaaagtggtaaatc

SEQ ID NO: 5689 - DNA, 25 bp, Mus musculus
actgtgtgttagtaagtggtaaatc

SEQ ID NO: 5690 - DNA, 25 bp, Mus musculus
actgtgttcccttctctaggcactt

SEQ ID NO: 5691 - DNA, 25 bp, Mus musculus
actgttaccaagtccctggtgctgg

SEQ ID NO: 5692 - DNA, 25 bp, Mus musculus
actgttctgtggataaacgtcattg

SEQ ID NO: 5693 - DNA, 25 bp, Mus musculus
actgttgaggtgtgaacgtggacac

SEQ ID NO: 5694 - DNA, 25 bp, Mus musculus
actgtttgacatgacggcaaaaaat

SEQ ID NO: 5695 - DNA, 25 bp, Mus musculus
actgtttgcttgaggtttgttctcc

SEQ ID NO: 5696 - DNA, 25 bp, Mus musculus
actgtttggatggtgcaacggattt

SEQ ID NO: 5697 - DNA, 25 bp, Mus musculus
actgttttaactgcttgccgatagc

SEQ ID NO: 5698 - DNA, 25 bp, Mus musculus
acttaaagccatcgctacacctgag

SEQ ID NO: 5699 - DNA, 25 bp, Mus musculus
acttaaagccatggctacacctgag

SEQ ID NO: 5700 - DNA, 25 bp, Mus musculus
acttaaagtctggatcctgttctca

SEQ ID NO: 5701 - DNA, 25 bp, Mus musculus
acttaagaagaaattgcacccaaca

SEQ ID NO: 5702 - DNA, 25 bp, Mus musculus
acttaatgagctgcctcctcagcag

SEQ ID NO: 5703 - DNA, 25 bp, Mus musculus
acttacaggcatgggacctgctggc

SEQ ID NO: 5704 - DNA, 25 bp, Mus musculus
acttagacatcttggacactgctgg

SEQ ID NO: 5705 - DNA, 25 bp, Mus musculus
acttagcatttatacgagggcagct

SEQ ID NO: 5706 - DNA, 25 bp, Mus musculus
acttaggattccagggattcccaca

SEQ ID NO: 5707 - DNA, 25 bp, Mus musculus
acttaggccacaccagtgagaagtc

SEQ ID NO: 5708 - DNA, 25 bp, Mus musculus
acttaggccacagcagtgagaagtc

SEQ ID NO: 5709 - DNA, 25 bp, Mus musculus
acttagtccaccactgtccaacatg

SEQ ID NO: 5710 - DNA, 25 bp, Mus musculus
acttagtgacattgggttggaatac

SEQ ID NO: 5711 - DNA, 25 bp, Mus musculus
acttatccaaacctgtggctggtac

SEQ ID NO: 5712 - DNA, 25 bp, Mus musculus
acttatccaaacgtgtggctggtac

SEQ ID NO: 5713 - DNA, 25 bp, Mus musculus
acttatctactgctcacggaccgtg

SEQ ID NO: 5714 - DNA, 25 bp, Mus musculus
acttatctgaaagagatgtcatttc

SEQ ID NO: 5715 - DNA, 25 bp, Mus musculus
acttatgagacaaacattttcacca

SEQ ID NO: 5716 - DNA, 25 bp, Mus musculus
acttattgaagaagttatgatcggg

SEQ ID NO: 5717 - DNA, 25 bp, Mus musculus
acttattggcccctgctgagattcc

SEQ ID NO: 5718 - DNA, 25 bp, Mus musculus
acttcaaacaggcagcagagctctt

SEQ ID NO: 5719 - DNA, 25 bp, Mus musculus
acttcaacgctgagccaccttggga

SEQ ID NO: 5720 - DNA, 25 bp, Mus musculus
acttcaagacagctgccacctttgc

SEQ ID NO: 5721 - DNA, 25 bp, Mus musculus
acttcaagacgacagttctggaggg

SEQ ID NO: 5722 - DNA, 25 bp, Mus musculus
acttcaagcacagcaacatggcgag

SEQ ID NO: 5723 - DNA, 25 bp, Mus musculus
acttcaatctgccaatgtgcaaagc

SEQ ID NO: 5724 - DNA, 25 bp, Mus musculus
acttcaatgcagaagctgtcaagaa

SEQ ID NO: 5725 - DNA, 25 bp, Mus musculus
acttcaccattgctagaaactcggg

SEQ ID NO: 5726 - DNA, 25 bp, Mus musculus
acttcaccgcgattggaggcaacct

SEQ ID NO: 5727 - DNA, 25 bp, Mus musculus
acttcactccacacgggtgcagatg

SEQ ID NO: 5728 - DNA, 25 bp, Mus musculus
acttcagaagcagccaagcctattc

SEQ ID NO: 5729 - DNA, 25 bp, Mus musculus
acttcagacgcagagcgagcccttg

SEQ ID NO: 5730 - DNA, 25 bp, Mus musculus
acttcagatacgaaatatcccgccc

SEQ ID NO: 5731 - DNA, 25 bp, Mus musculus
acttcaggaggtgcagatcaccgag

SEQ ID NO: 5732 - DNA, 25 bp, Mus musculus
acttcagggacagcctcaagatgaa

SEQ ID NO: 5733 - DNA, 25 bp, Mus musculus
acttcaggttgtgttcatggtccgg

SEQ ID NO: 5734 - DNA, 25 bp, Mus musculus
acttcagtatatcccgaagctacgc

SEQ ID NO: 5735 - DNA, 25 bp, Mus musculus
acttcatcaagtctgtcatcggcca

SEQ ID NO: 5736 - DNA, 25 bp, Mus musculus
acttcatggagtgcctggtggatgc

SEQ ID NO: 5737 - DNA, 25 bp, Mus musculus
acttcatggcatttggaggcgggaa

SEQ ID NO: 5738 - DNA, 25 bp, Mus musculus
acttcatgtccccaaaatgactcct

SEQ ID NO: 5739 - DNA, 25 bp, Mus musculus
acttcattgcacatctcttgggtcg

SEQ ID NO: 5740 - DNA, 25 bp, Mus musculus
acttccaactgaatatgagaggaac

SEQ ID NO: 5741 - DNA, 25 bp, Mus musculus
acttccaccagttgaaccctgaggt

SEQ ID NO: 5742 - DNA, 25 bp, Mus musculus
acttccactaccaacacagttatag

SEQ ID NO: 5743 - DNA, 25 bp, Mus musculus
acttccactacctacacagttatag

SEQ ID NO: 5744 - DNA, 25 bp, Mus musculus
acttccagacagtcccctgctaatg

SEQ ID NO: 5745 - DNA, 25 bp, Mus musculus
acttccagctgcctggcactttcgg

SEQ ID NO: 5746 - DNA, 25 bp, Mus musculus
acttccagtcaagtggatggctcct

SEQ ID NO: 5747 - DNA, 25 bp, Mus musculus
acttccatgtctcaactgaagaatg

SEQ ID NO: 5748 - DNA, 25 bp, Mus musculus
acttccattggaaactgaacctgtg

SEQ ID NO: 5749 - DNA, 25 bp, Mus musculus
acttccctgccggaggcgttgggat

SEQ ID NO: 5750 - DNA, 25 bp, Mus musculus
acttccgggaccatgctgagcagca

SEQ ID NO: 5751 - DNA, 25 bp, Mus musculus
acttccgggcgtgaagatcgtacac

SEQ ID NO: 5752 - DNA, 25 bp, Mus musculus
acttcctccagggatggtctgtagg

SEQ ID NO: 5753 - DNA, 25 bp, Mus musculus
acttcctcgacattctcctgggtgc

SEQ ID NO: 5754 - DNA, 25 bp, Mus musculus
acttcctggaactagctgagactca

SEQ ID NO: 5755 - DNA, 25 bp, Mus musculus
acttcctggcatttgaaaggctcct

SEQ ID NO: 5756 - DNA, 25 bp, Mus musculus
acttccttctaggagtggaatgtga

SEQ ID NO: 5757 - DNA, 25 bp, Mus musculus
acttcctttataggatggagtgtgg

SEQ ID NO: 5758 - DNA, 25 bp, Mus musculus
acttcgaagctctgcagcacgtgcc

SEQ ID NO: 5759 - DNA, 25 bp, Mus musculus
acttcgagctgtgcctggcagtgca

SEQ ID NO: 5760 - DNA, 25 bp, Mus musculus
acttcgaggcttcatgattgtctac

SEQ ID NO: 5761 - DNA, 25 bp, Mus musculus
acttcgcaggctgcgcagtgtgcag

SEQ ID NO: 5762 - DNA, 25 bp, Mus musculus
acttcgcagtcctggtggatcttca

SEQ ID NO: 5763 - DNA, 25 bp, Mus musculus
acttcgtaggccagactggacttga

SEQ ID NO: 5764 - DNA, 25 bp, Mus musculus
acttcgtgcagtatgcctgctttgg

SEQ ID NO: 5765 - DNA, 25 bp, Mus musculus
acttcgtggagatctgcaaacggga

SEQ ID NO: 5766 - DNA, 25 bp, Mus musculus
acttctaaggactacaacagtctca

SEQ ID NO: 5767 - DNA, 25 bp, Mus musculus
acttctaatcctcatcatgacaacg

SEQ ID NO: 5768 - DNA, 25 bp, Mus musculus
acttctactggagggaatggccgcc

SEQ ID NO: 5769 - DNA, 25 bp, Mus musculus
acttctcacactacaaagtcctgtg

SEQ ID NO: 5770 - DNA, 25 bp, Mus musculus
acttctcacagagctgtacccttta

SEQ ID NO: 5771 - DNA, 25 bp, Mus musculus
acttctctacctgctcttctggaaa

SEQ ID NO: 5772 - DNA, 25 bp, Mus musculus
acttctctccggatgagtgggaatg

SEQ ID NO: 5773 - DNA, 25 bp, Mus musculus
acttctctgaaaatgccgccaggca

SEQ ID NO: 5774 - DNA, 25 bp, Mus musculus
acttctgaatgccaccttcttgaac

SEQ ID NO: 5775 - DNA, 25 bp, Mus musculus
acttctgacactgagagctctatca

SEQ ID NO: 5776 - DNA, 25 bp, Mus musculus
acttctgcagcagcataatgacctg

SEQ ID NO: 5777 - DNA, 25 bp, Mus musculus
acttctggtaccatccaaagagcag

SEQ ID NO: 5778 - DNA, 25 bp, Mus musculus
acttctgtctgaggtacacaaagga

SEQ ID NO: 5779 - DNA, 25 bp, Mus musculus
acttcttaacccagctccaggagct

SEQ ID NO: 5780 - DNA, 25 bp, Mus musculus
acttcttcgtgatgagtgattacag

SEQ ID NO: 5781 - DNA, 25 bp, Mus musculus
acttcttggctgatgtcctgtggca

SEQ ID NO: 5782 - DNA, 25 bp, Mus musculus
acttcttggctgttgtcctgtggca

SEQ ID NO: 5783 - DNA, 25 bp, Mus musculus
acttcttgtctcctgataaccctct

SEQ ID NO: 5784 - DNA, 25 bp, Mus musculus
acttcttgtctcgtgataaccctct

SEQ ID NO: 5785 - DNA, 25 bp, Mus musculus
acttgaaattctcaacaggactgag

SEQ ID NO: 5786 - DNA, 25 bp, Mus musculus
acttgaagagattatgagaagaacc

SEQ ID NO: 5787 - DNA, 25 bp, Mus musculus
acttgaatatttgccaagtatgtga

SEQ ID NO: 5788 - DNA, 25 bp, Mus musculus
acttgaatctagtggaggagggcca

SEQ ID NO: 5789 - DNA, 25 bp, Mus musculus
acttgaatgtgacagagtacatgtg

SEQ ID NO: 5790 - DNA, 25 bp, Mus musculus
acttgatcaacttctgccttagcta

SEQ ID NO: 5791 - DNA, 25 bp, Mus musculus
acttgattgtgaccccgtttgctca

SEQ ID NO: 5792 - DNA, 25 bp, Mus musculus
acttgcaagtgtgagagacagcatt

SEQ ID NO: 5793 - DNA, 25 bp, Mus musculus
acttgcaatctgttccctgcatcca

SEQ ID NO: 5794 - DNA, 25 bp, Mus musculus
acttgcagcttttctctatggaggg

SEQ ID NO: 5795 - DNA, 25 bp, Mus musculus
acttgcaggtggaccacatgaacct

SEQ ID NO: 5796 - DNA, 25 bp, Mus musculus
acttgcatcaagatcaggcctgaag

SEQ ID NO: 5797 - DNA, 25 bp, Mus musculus
acttgccactccctactgaataaag

SEQ ID NO: 5798 - DNA, 25 bp, Mus musculus
acttgccatggttgtgcctccccag

SEQ ID NO: 5799 - DNA, 25 bp, Mus musculus
acttgccgagaggatccgtgccggt

SEQ ID NO: 5800 - DNA, 25 bp, Mus musculus
acttgcctccacaagggttgtccac

SEQ ID NO: 5801 - DNA, 25 bp, Mus musculus
acttgcctgcactgtatactatttt

SEQ ID NO: 5802 - DNA, 25 bp, Mus musculus
acttgcgatgtagctaagggatggc

SEQ ID NO: 5803 - DNA, 25 bp, Mus musculus
acttgctacactgactacctctgga

SEQ ID NO: 5804 - DNA, 25 bp, Mus musculus
acttgctactgcctgagcggcctct

SEQ ID NO: 5805 - DNA, 25 bp, Mus musculus
acttgctagccaaagccatcaccga

SEQ ID NO: 5806 - DNA, 25 bp, Mus musculus
acttgctctggttcaaaccaagaca

SEQ ID NO: 5807 - DNA, 25 bp, Mus musculus
acttgctcttaagcacggtggtttg

SEQ ID NO: 5808 - DNA, 25 bp, Mus musculus
acttgctcttgagctttctgcacta

SEQ ID NO: 5809 - DNA, 25 bp, Mus musculus
acttgctgaattggctagactagcc

SEQ ID NO: 5810 - DNA, 25 bp, Mus musculus
acttgctgccaagggctatagaagt

SEQ ID NO: 5811 - DNA, 25 bp, Mus musculus
acttgcttggactatacgacactgc

SEQ ID NO: 5812 - DNA, 25 bp, Mus musculus
acttgcttttccagagcagaaaaga

SEQ ID NO: 5813 - DNA, 25 bp, Mus musculus
acttggaaggtgttgtggatgtccc

SEQ ID NO: 5814 - DNA, 25 bp, Mus musculus
acttggacacgggtcctggaagtga

SEQ ID NO: 5815 - DNA, 25 bp, Mus musculus
acttggacagaagagtgcttgctgt

SEQ ID NO: 5816 - DNA, 25 bp, Mus musculus
acttggacagtagaggagcgcctcc

SEQ ID NO: 5817 - DNA, 25 bp, Mus musculus
acttggacctcgagggattaggccg

SEQ ID NO: 5818 - DNA, 25 bp, Mus musculus
acttggacttctggcgccagctctg

SEQ ID NO: 5819 - DNA, 25 bp, Mus musculus
acttggacttcttggatggcagcgc

SEQ ID NO: 5820 - DNA, 25 bp, Mus musculus
acttggaggagtactactttgagca

SEQ ID NO: 5821 - DNA, 25 bp, Mus musculus
acttggcaagcaaggaaagaaacct

SEQ ID NO: 5822 - DNA, 25 bp, Mus musculus
acttggctggagtgaggattacccg

SEQ ID NO: 5823 - DNA, 25 bp, Mus musculus
acttggctttcttgcatatccgaag

SEQ ID NO: 5824 - DNA, 25 bp, Mus musculus
acttgggaacctcacatttactacg

SEQ ID NO: 5825 - DNA, 25 bp, Mus musculus
acttgggcccctacctcaggtggat

SEQ ID NO: 5826 - DNA, 25 bp, Mus musculus
acttgggcgacaaccggacagagct

SEQ ID NO: 5827 - DNA, 25 bp, Mus musculus
acttggtacatttgacttgcatgtc

SEQ ID NO: 5828 - DNA, 25 bp, Mus musculus
acttggtctatacactggctttctc

SEQ ID NO: 5829 - DNA, 25 bp, Mus musculus
acttggtggaggagattaaaaagcg

SEQ ID NO: 5830 - DNA, 25 bp, Mus musculus
acttggtggttctccgttcttcctg

SEQ ID NO: 5831 - DNA, 25 bp, Mus musculus
acttgtaagttctactgaaacatga

SEQ ID NO: 5832 - DNA, 25 bp, Mus musculus
acttgtaccacgagctgatgaagca

SEQ ID NO: 5833 - DNA, 25 bp, Mus musculus
acttgtgctgaccagtgatcagtcc

SEQ ID NO: 5834 - DNA, 25 bp, Mus musculus
acttgtggcaatatgtgacatttca

SEQ ID NO: 5835 - DNA, 25 bp, Mus musculus
acttgtggtggcagggaatccctcc

SEQ ID NO: 5836 - DNA, 25 bp, Mus musculus
acttgtgtctcccagttgtggccag

SEQ ID NO: 5837 - DNA, 25 bp, Mus musculus
acttgtgtgcctttgatcagcgctg

SEQ ID NO: 5838 - DNA, 25 bp, Mus musculus
acttgttgaagtgctgaatagtttc

SEQ ID NO: 5839 - DNA, 25 bp, Mus musculus
actttaagaagcttcatgaggctcg

SEQ ID NO: 5840 - DNA, 25 bp, Mus musculus
actttacacccttctcgctattcag

SEQ ID NO: 5841 - DNA, 25 bp, Mus musculus
actttacagacactatctcactcag

SEQ ID NO: 5842 - DNA, 25 bp, Mus musculus
actttacccgccaacctgtctatgt

SEQ ID NO: 5843 - DNA, 25 bp, Mus musculus
actttactttgcctctctgaaggac

SEQ ID NO: 5844 - DNA, 25 bp, Mus musculus
actttactttgcgtctctgaaggac

SEQ ID NO: 5845 - DNA, 25 bp, Mus musculus
actttatcgtgagtaacatccagct

SEQ ID NO: 5846 - DNA, 25 bp, Mus musculus
actttctacacaatgagcagcaatg

SEQ ID NO: 5847 - DNA, 25 bp, Mus musculus
actttctagcgcatgagaagatctg

SEQ ID NO: 5848 - DNA, 25 bp, Mus musculus
actttctcggagtctggaatgctga

SEQ ID NO: 5849 - DNA, 25 bp, Mus musculus
actttctctctactgtaggaggagc

SEQ ID NO: 5850 - DNA, 25 bp, Mus musculus
actttgaaaagctgcggctgacatt

SEQ ID NO: 5851 - DNA, 25 bp, Mus musculus
actttgaacaaaggctaaatcaggc

SEQ ID NO: 5852 - DNA, 25 bp, Mus musculus
actttgaagtttctacattagtggg

SEQ ID NO: 5853 - DNA, 25 bp, Mus musculus
actttgaagtttgtacattagtggg

SEQ ID NO: 5854 - DNA, 25 bp, Mus musculus
actttgagaaacctgtggtcatgaa

SEQ ID NO: 5855 - DNA, 25 bp, Mus musculus
actttgaggaagaatgcctggagtt

SEQ ID NO: 5856 - DNA, 25 bp, Mus musculus
actttgagtggcttcgaagtgaact

SEQ ID NO: 5857 - DNA, 25 bp, Mus musculus
actttgatttcttggatctccggct

SEQ ID NO: 5858 - DNA, 25 bp, Mus musculus
actttgccagattaagattgtctgg

SEQ ID NO: 5859 - DNA, 25 bp, Mus musculus
actttgccagcattgcagccatagg

SEQ ID NO: 5860 - DNA, 25 bp, Mus musculus
actttgccatgctgggacttggaga

SEQ ID NO: 5861 - DNA, 25 bp, Mus musculus
actttgcgcgaaggcaccagcaggt

SEQ ID NO: 5862 - DNA, 25 bp, Mus musculus
actttgctaaactctccagatagag

SEQ ID NO: 5863 - DNA, 25 bp, Mus musculus
actttgctgaagttgaacagatggc

SEQ ID NO: 5864 - DNA, 25 bp, Mus musculus
actttggagacatgctttaccctta

SEQ ID NO: 5865 - DNA, 25 bp, Mus musculus
actttggaggacactgatgggaccc

SEQ ID NO: 5866 - DNA, 25 bp, Mus musculus
actttgggttgctcagtctcctggg

SEQ ID NO: 5867 - DNA, 25 bp, Mus musculus
actttgggttgctgagtggattgcc

SEQ ID NO: 5868 - DNA, 25 bp, Mus musculus
actttgtagtgtgccagctctttgc

SEQ ID NO: 5869 - DNA, 25 bp, Mus musculus
actttgtatcatctctccctacctg

SEQ ID NO: 5870 - DNA, 25 bp, Mus musculus
actttgtgaccagggtttcagttgg

SEQ ID NO: 5871 - DNA, 25 bp, Mus musculus
actttgtgacttaaagtctggatcc

SEQ ID NO: 5872 - DNA, 25 bp, Mus musculus
actttgtggaattgctggacagtgg

SEQ ID NO: 5873 - DNA, 25 bp, Mus musculus
actttgtggctgagtatgagccctt

SEQ ID NO: 5874 - DNA, 25 bp, Mus musculus
acttttcacagattgaattgcgcat

SEQ ID NO: 5875 - DNA, 25 bp, Mus musculus
acttttcctttaaggctggccagtg

SEQ ID NO: 5876 - DNA, 25 bp, Mus musculus
acttttgttggaggcatttggacca

SEQ ID NO: 5877 - DNA, 25 bp, Mus musculus
actttttaattcgagcctctgcagc

SEQ ID NO: 5878 - DNA, 25 bp, Mus musculus
actttttcattcaggtgctagaggc

SEQ ID NO: 5879 - DNA, 25 bp, Mus musculus
actttttggaggatgaaccctctgc

SEQ ID NO: 5880 - DNA, 25 bp, Mus musculus
agaaaaaagccttggcctgccggag

SEQ ID NO: 5881 - DNA, 25 bp, Mus musculus
agaaaaacattacgagggtatatca

SEQ ID NO: 5882 - DNA, 25 bp, Mus musculus
agaaaaacattaggagggtatatca

SEQ ID NO: 5883 - DNA, 25 bp, Mus musculus
agaaaaagtcatatttcccacgttg

SEQ ID NO: 5884 - DNA, 25 bp, Mus musculus
agaaaaatcttatctgcctgtgaga

SEQ ID NO: 5885 - DNA, 25 bp, Mus musculus
agaaaaattcaacgccaagattcag

SEQ ID NO: 5886 - DNA, 25 bp, Mus musculus
agaaaacatcgttctgcagcaagga

SEQ ID NO: 5887 - DNA, 25 bp, Mus musculus
agaaaaccagacatgctgggaccag

SEQ ID NO: 5888 - DNA, 25 bp, Mus musculus
agaaaaccagacttgctgggaccag

SEQ ID NO: 5889 - DNA, 25 bp, Mus musculus
agaaaacccacgagcggatgcagac

SEQ ID NO: 5890 - DNA, 25 bp, Mus musculus
agaaaaccttgctcagaagcttcca

SEQ ID NO: 5891 - DNA, 25 bp, Mus musculus
agaaaacggctcaaagatgagggtg

SEQ ID NO: 5892 - DNA, 25 bp, Mus musculus
agaaaagcaagcacaggaagatcct

SEQ ID NO: 5893 - DNA, 25 bp, Mus musculus
agaaaagcagctctactccccaggt

SEQ ID NO: 5894 - DNA, 25 bp, Mus musculus
agaaaagcagctgcacctggctgag

SEQ ID NO: 5895 - DNA, 25 bp, Mus musculus
agaaaagcctcatgttcatcgagcc

SEQ ID NO: 5896 - DNA, 25 bp, Mus musculus
agaaaagctgcacgcatgaagtaga

SEQ ID NO: 5897 - DNA, 25 bp, Mus musculus
agaaaagctgcaggcatgaagtaga

SEQ ID NO: 5898 - DNA, 25 bp, Mus musculus
agaaaatattcctaccccggcgctg

SEQ ID NO: 5899 - DNA, 25 bp, Mus musculus
agaaaatattctggatgctcgcctc

SEQ ID NO: 5900 - DNA, 25 bp, Mus musculus
agaaaatgaagccagagtttgagag

SEQ ID NO: 5901 - DNA, 25 bp, Mus musculus
agaaaatggtaaatttcagagctgg

SEQ ID NO: 5902 - DNA, 25 bp, Mus musculus
agaaaatgtgtccaactgcatccag

SEQ ID NO: 5903 - DNA, 25 bp, Mus musculus
agaaaattgctcactatccctccac

SEQ ID NO: 5904 - DNA, 25 bp, Mus musculus
agaaacaatggacctcaagttcaac

SEQ ID NO: 5905 - DNA, 25 bp, Mus musculus
agaaacagcaagtgaaggcaagaaa

SEQ ID NO: 5906 - DNA, 25 bp, Mus musculus
agaaacagctagagaccatcgacca

SEQ ID NO: 5907 - DNA, 25 bp, Mus musculus
agaaacatctgcagatctcccagga

SEQ ID NO: 5908 - DNA, 25 bp, Mus musculus
agaaacatgtggtggcgtggaaaat

SEQ ID NO: 5909 - DNA, 25 bp, Mus musculus
agaaaccagcatgtctcaggccagc

SEQ ID NO: 5910 - DNA, 25 bp, Mus musculus
agaaacctgggtcttccgcaggatt

SEQ ID NO: 5911 - DNA, 25 bp, Mus musculus
agaaacgatggcagccctggcacag

SEQ ID NO: 5912 - DNA, 25 bp, Mus musculus
agaaacgccctgaagctgcagaaag

SEQ ID NO: 5913 - DNA, 25 bp, Mus musculus
agaaactagaacgagaggcccggat

SEQ ID NO: 5914 - DNA, 25 bp, Mus musculus
agaaactcagctggaggaggcctcc

SEQ ID NO: 5915 - DNA, 25 bp, Mus musculus
agaaactcgggctgaagaccatcca

SEQ ID NO: 5916 - DNA, 25 bp, Mus musculus
agaaactctttcacaggctggacag

SEQ ID NO: 5917 - DNA, 25 bp, Mus musculus
agaaactgatctcagaactggatga

SEQ ID NO: 5918 - DNA, 25 bp, Mus musculus
agaaactgcagtacatcaccagatg

SEQ ID NO: 5919 - DNA, 25 bp, Mus musculus
agaaacttcaaagtgccagggcggt

SEQ ID NO: 5920 - DNA, 25 bp, Mus musculus
agaaacttcaatctgccaatgtgca

SEQ ID NO: 5921 - DNA, 25 bp, Mus musculus
agaaagaagggcactaccagccgtt

SEQ ID NO: 5922 - DNA, 25 bp, Mus musculus
agaaagacagcatccgatccccacg

SEQ ID NO: 5923 - DNA, 25 bp, Mus musculus
agaaagaccttactgggacatgtca

SEQ ID NO: 5924 - DNA, 25 bp, Mus musculus
agaaagagaacaaatcctccttcag

SEQ ID NO: 5925 - DNA, 25 bp, Mus musculus
agaaagagaagaattcccctgctgg

SEQ ID NO: 5926 - DNA, 25 bp, Mus musculus
agaaagaggacaccacctttgatga

SEQ ID NO: 5927 - DNA, 25 bp, Mus musculus
agaaagcacgggatctgcacccaac

SEQ ID NO: 5928 - DNA, 25 bp, Mus musculus
agaaagcaggatggaccatagttac

SEQ ID NO: 5929 - DNA, 25 bp, Mus musculus
agaaagcccgggagtccaaagacat

SEQ ID NO: 5930 - DNA, 25 bp, Mus musculus
agaaagcctgacaccaacagcaagt

SEQ ID NO: 5931 - DNA, 25 bp, Mus musculus
agaaagctgcagtgaggcaagaatg

SEQ ID NO: 5932 - DNA, 25 bp, Mus musculus
agaaaggatggcgtccttcgggcac

SEQ ID NO: 5933 - DNA, 25 bp, Mus musculus
agaaaggcccattctgtttataact

SEQ ID NO: 5934 - DNA, 25 bp, Mus musculus
agaaagggcatctctcctccaagcc

SEQ ID NO: 5935 - DNA, 25 bp, Mus musculus
agaaagggctgaaaaaagtcaggag

SEQ ID NO: 5936 - DNA, 25 bp, Mus musculus
agaaaggtgctcctgtcaaacaaaa

SEQ ID NO: 5937 - DNA, 25 bp, Mus musculus
agaaagtccggcctgtgaagccacg

SEQ ID NO: 5938 - DNA, 25 bp, Mus musculus
agaaataagctgaaacaaactgtgg

SEQ ID NO: 5939 - DNA, 25 bp, Mus musculus
agaaataccagaggcgaattgttcc

SEQ ID NO: 5940 - DNA, 25 bp, Mus musculus
agaaatcggcgagccaggaagacaa

SEQ ID NO: 5941 - DNA, 25 bp, Mus musculus
agaaatcttttttgcactcctgcgc

SEQ ID NO: 5942 - DNA, 25 bp, Mus musculus
agaaatgaaagatgcctactatcag

SEQ ID NO: 5943 - DNA, 25 bp, Mus musculus
agaaatgcattctctctctgtatcc

SEQ ID NO: 5944 - DNA, 25 bp, Mus musculus
agaaatgcttattcgtactcctatt

SEQ ID NO: 5945 - DNA, 25 bp, Mus musculus
agaaatggaagatcttcctggagag

SEQ ID NO: 5946 - DNA, 25 bp, Mus musculus
agaaatggccagagtttttgacaga

SEQ ID NO: 5947 - DNA, 25 bp, Mus musculus
agaaatggccgccaagctacacccg

SEQ ID NO: 5948 - DNA, 25 bp, Mus musculus
agaaatggtgcatgggaaattgttc

SEQ ID NO: 5949 - DNA, 25 bp, Mus musculus
agaaattatattagcttcagagcag

SEQ ID NO: 5950 - DNA, 25 bp, Mus musculus
agaaattatatttgcttcagagcag

SEQ ID NO: 5951 - DNA, 25 bp, Mus musculus
agaaattcggtcatgccaggcatgg

SEQ ID NO: 5952 - DNA, 25 bp, Mus musculus
agaaattcttggagagtggtggcca

SEQ ID NO: 5953 - DNA, 25 bp, Mus musculus
agaaattgcacggtaccgtggtaga

SEQ ID NO: 5954 - DNA, 25 bp, Mus musculus
agaaattgggagaacagaacactga

SEQ ID NO: 5955 - DNA, 25 bp, Mus musculus
agaaatttcggatggagtctgggat

SEQ ID NO: 5956 - DNA, 25 bp, Mus musculus
agaaattttgaagaatctaagccag

SEQ ID NO: 5957 - DNA, 25 bp, Mus musculus
agaacaaactaacagttcactcaag

SEQ ID NO: 5958 - DNA, 25 bp, Mus musculus
agaacaatgtctcccctgtctcgag

SEQ ID NO: 5959 - DNA, 25 bp, Mus musculus
agaacacagctttgtaactgtgaag

SEQ ID NO: 5960 - DNA, 25 bp, Mus musculus
agaacaccattctgaaggcctatga

SEQ ID NO: 5961 - DNA, 25 bp, Mus musculus
agaacacccagcagactctcagctg

SEQ ID NO: 5962 - DNA, 25 bp, Mus musculus
agaacacgctcctctcggtggccat

SEQ ID NO: 5963 - DNA, 25 bp, Mus musculus
agaacacgctgtgggccggcaccgt

SEQ ID NO: 5964 - DNA, 25 bp, Mus musculus
agaacactgtggaactgttaacaga

SEQ ID NO: 5965 - DNA, 25 bp, Mus musculus
agaacagaagcacggcgaaaaaatc

SEQ ID NO: 5966 - DNA, 25 bp, Mus musculus
agaacagatcacaagtgctcctggt

SEQ ID NO: 5967 - DNA, 25 bp, Mus musculus
agaacagatcagtggaggacaggaa

SEQ ID NO: 5968 - DNA, 25 bp, Mus musculus
agaacagcgacaaacacctagccgg

SEQ ID NO: 5969 - DNA, 25 bp, Mus musculus
agaacagctcgagccgggaaaactg

SEQ ID NO: 5970 - DNA, 25 bp, Mus musculus
agaacatcattcagtgacaaactct

SEQ ID NO: 5971 - DNA, 25 bp, Mus musculus
agaacatcctctcagcaatcctggg

SEQ ID NO: 5972 - DNA, 25 bp, Mus musculus
agaacatcgtgcacggcagtggaag

SEQ ID NO: 5973 - DNA, 25 bp, Mus musculus
agaacatggagactgccgcccgatg

SEQ ID NO: 5974 - DNA, 25 bp, Mus musculus
agaacatgttttgctgtacctctgt

SEQ ID NO: 5975 - DNA, 25 bp, Mus musculus
agaaccagaagttctccgagcactt

SEQ ID NO: 5976 - DNA, 25 bp, Mus musculus
agaaccagatggacatagccacgtc

SEQ ID NO: 5977 - DNA, 25 bp, Mus musculus
agaaccaggcgctgccctcgggaca

SEQ ID NO: 5978 - DNA, 25 bp, Mus musculus
agaaccccagacatagcccaaagag

SEQ ID NO: 5979 - DNA, 25 bp, Mus musculus
agaacccggatgatggagatatttt

SEQ ID NO: 5980 - DNA, 25 bp, Mus musculus
agaacccttccaccgtgtgctgcag

SEQ ID NO: 5981 - DNA, 25 bp, Mus musculus
agaaccggcgaatgcaggagctacg

SEQ ID NO: 5982 - DNA, 25 bp, Mus musculus
agaacctgccatctcagcccaagag

SEQ ID NO: 5983 - DNA, 25 bp, Mus musculus
agaacctggcggttgaggccctgac

SEQ ID NO: 5984 - DNA, 25 bp, Mus musculus
agaacctgggtgctgcagccccaga

SEQ ID NO: 5985 - DNA, 25 bp, Mus musculus
agaaccttgcgtgggcgtcctatga

SEQ ID NO: 5986 - DNA, 25 bp, Mus musculus
agaacctttggtgtacatgaggaaa

SEQ ID NO: 5987 - DNA, 25 bp, Mus musculus
agaacgatgcttagaaaagtaccag

SEQ ID NO: 5988 - DNA, 25 bp, Mus musculus
agaactacgcctaaacatgcagaag

SEQ ID NO: 5989 - DNA, 25 bp, Mus musculus
agaactatgtggatctcgtatccag

SEQ ID NO: 5990 - DNA, 25 bp, Mus musculus
agaactcaacggcaagctggtgaag

SEQ ID NO: 5991 - DNA, 25 bp, Mus musculus
agaactcacagctagtttgtttgag

SEQ ID NO: 5992 - DNA, 25 bp, Mus musculus
agaactctgtctgggcatcatgggc

SEQ ID NO: 5993 - DNA, 25 bp, Mus musculus
agaactcttggcttctccagaaccg

SEQ ID NO: 5994 - DNA, 25 bp, Mus musculus
agaactgagagttctgcaaagggag

SEQ ID NO: 5995 - DNA, 25 bp, Mus musculus
agaactgagtatcccactagcacga

SEQ ID NO: 5996 - DNA, 25 bp, Mus musculus
agaacttacatctcctctggccaac

SEQ ID NO: 5997 - DNA, 25 bp, Mus musculus
agaacttaccaagcagtatgaaaag

SEQ ID NO: 5998 - DNA, 25 bp, Mus musculus
agaacttgcatcaagatcaggcctg

SEQ ID NO: 5999 - DNA, 25 bp, Mus musculus
agaacttggtcaaaaccaactgtga

SEQ ID NO: 6000 - DNA, 25 bp, Mus musculus
agaactttgccagcagcaccaactt

SEQ ID NO: 6001 - DNA, 25 bp, Mus musculus
agaagaaacccacaatcaaagacag

SEQ ID NO: 6002 - DNA, 25 bp, Mus musculus
agaagaaaggttacatcatggcgtc

SEQ ID NO: 6003 - DNA, 25 bp, Mus musculus
agaagaaatagagaccggtatgtgg

SEQ ID NO: 6004 - DNA, 25 bp, Mus musculus
agaagaacaaaccatcccacggctc

SEQ ID NO: 6005 - DNA, 25 bp, Mus musculus
agaagaactgttggatttgcctggg

SEQ ID NO: 6006 - DNA, 25 bp, Mus musculus
agaagaagacttgaatctctttgcc

SEQ ID NO: 6007 - DNA, 25 bp, Mus musculus
agaagaatttagaaggcatagttgc

SEQ ID NO: 6008 - DNA, 25 bp, Mus musculus
agaagacaagaaggagacagaggac

SEQ ID NO: 6009 - DNA, 25 bp, Mus musculus
agaagacaatcggtcagaagcctgg

SEQ ID NO: 6010 - DNA, 25 bp, Mus musculus
agaagacagcacttacacgtatgtc

SEQ ID NO: 6011 - DNA, 25 bp, Mus musculus
agaagacccaggtcctacaacccag

SEQ ID NO: 6012 - DNA, 25 bp, Mus musculus
agaagacctatctgcatttgagtcc

SEQ ID NO: 6013 - DNA, 25 bp, Mus musculus
agaagacggcaccacgactaagtac

SEQ ID NO: 6014 - DNA, 25 bp, Mus musculus
agaagactgctcttggttgttcaag

SEQ ID NO: 6015 - DNA, 25 bp, Mus musculus
agaagacttccaaaacctgatgtga

SEQ ID NO: 6016 - DNA, 25 bp, Mus musculus
agaagagaaacccacagactcacct

SEQ ID NO: 6017 - DNA, 25 bp, Mus musculus
agaagagaccatcactagccccaag

SEQ ID NO: 6018 - DNA, 25 bp, Mus musculus
agaagagaccgctgatgttggcagc

SEQ ID NO: 6019 - DNA, 25 bp, Mus musculus
agaagagagactcggtcatcccgcc

SEQ ID NO: 6020 - DNA, 25 bp, Mus musculus
agaagagagactgggtcatcccgcc

SEQ ID NO: 6021 - DNA, 25 bp, Mus musculus
agaagagagtacctttatcagctcc

SEQ ID NO: 6022 - DNA, 25 bp, Mus musculus
agaagagagtgactaacacacaaga

SEQ ID NO: 6023 - DNA, 25 bp, Mus musculus
agaagagcagaaccacccatcaggt

SEQ ID NO: 6024 - DNA, 25 bp, Mus musculus
agaagagcaggaagacatacctgta

SEQ ID NO: 6025 - DNA, 25 bp, Mus musculus
agaagagcccctcctggccagtgtg

SEQ ID NO: 6026 - DNA, 25 bp, Mus musculus
agaagaggaacccaaaaagcagcta

SEQ ID NO: 6027 - DNA, 25 bp, Mus musculus
agaagaggaccctcaatcctgagtt

SEQ ID NO: 6028 - DNA, 25 bp, Mus musculus
agaagaggagcgaggcccctcctca

SEQ ID NO: 6029 - DNA, 25 bp, Mus musculus
agaagaggatctgggaaagcctttg

SEQ ID NO: 6030 - DNA, 25 bp, Mus musculus
agaagaggctcgacaagcatgtgat

SEQ ID NO: 6031 - DNA, 25 bp, Mus musculus
agaagagggcactcagaaggagact

SEQ ID NO: 6032 - DNA, 25 bp, Mus musculus
agaagaggtgactgcccctgcacca

SEQ ID NO: 6033 - DNA, 25 bp, Mus musculus
agaagagtgcgtctcccgatgccgc

SEQ ID NO: 6034 - DNA, 25 bp, Mus musculus
agaagagtttggttgtatgaagaca

SEQ ID NO: 6035 - DNA, 25 bp, Mus musculus
agaagatatccgagcaactgaaaaa

SEQ ID NO: 6036 - DNA, 25 bp, Mus musculus
agaagatgcctctgattggtctggg

SEQ ID NO: 6037 - DNA, 25 bp, Mus musculus
agaagatggcggagaagaaccgcaa

SEQ ID NO: 6038 - DNA, 25 bp, Mus musculus
agaagatgtggccacgtgtcctagc

SEQ ID NO: 6039 - DNA, 25 bp, Mus musculus
agaagattcgagagccgtgtctcaa

SEQ ID NO: 6040 - DNA, 25 bp, Mus musculus
agaagattgtgagatcaagcacctt

SEQ ID NO: 6041 - DNA, 25 bp, Mus musculus
agaagatttgcggagttttatcagc

SEQ ID NO: 6042 - DNA, 25 bp, Mus musculus
agaagcaaaagcacggccgccttgt

SEQ ID NO: 6043 - DNA, 25 bp, Mus musculus
agaagcaaaatctcttattgcccaa

SEQ ID NO: 6044 - DNA, 25 bp, Mus musculus
agaagcaccttgagatacacacagc

SEQ ID NO: 6045 - DNA, 25 bp, Mus musculus
agaagcagagctatggaatcccaac

SEQ ID NO: 6046 - DNA, 25 bp, Mus musculus
agaagcatatctccctcctccatga

SEQ ID NO: 6047 - DNA, 25 bp, Mus musculus
agaagcatcgggaatcaggagatgc

SEQ ID NO: 6048 - DNA, 25 bp, Mus musculus
agaagcatttccagaaagaagagca

SEQ ID NO: 6049 - DNA, 25 bp, Mus musculus
agaagccaagaaggccttccttgac

SEQ ID NO: 6050 - DNA, 25 bp, Mus musculus
agaagccaccctggaggctgagcag

SEQ ID NO: 6051 - DNA, 25 bp, Mus musculus
agaagcccacccagtgtccaggttt

SEQ ID NO: 6052 - DNA, 25 bp, Mus musculus
agaagcccagttcccagtggataaa

SEQ ID NO: 6053 - DNA, 25 bp, Mus musculus
agaagcccagttgccagtggataaa

SEQ ID NO: 6054 - DNA, 25 bp, Mus musculus
agaagccggcaaggctcccagcaaa

SEQ ID NO: 6055 - DNA, 25 bp, Mus musculus
agaagcctgtacagcggcctgcaga

SEQ ID NO: 6056 - DNA, 25 bp, Mus musculus
agaagcctgtgcctcatcccaggag

SEQ ID NO: 6057 - DNA, 25 bp, Mus musculus
agaagcgctaccaagcagccgctgg

SEQ ID NO: 6058 - DNA, 25 bp, Mus musculus
agaagcggtgaaccactgatattca

SEQ ID NO: 6059 - DNA, 25 bp, Mus musculus
agaagcgtccctgcggaagcgtttc

SEQ ID NO: 6060 - DNA, 25 bp, Mus musculus
agaagcgtccggctgcttcctcagc

SEQ ID NO: 6061 - DNA, 25 bp, Mus musculus
agaagctacggctctctcctaactg

SEQ ID NO: 6062 - DNA, 25 bp, Mus musculus
agaagctgcgttccctaacccaggc

SEQ ID NO: 6063 - DNA, 25 bp, Mus musculus
agaagctggatcttagcaacgtcca

SEQ ID NO: 6064 - DNA, 25 bp, Mus musculus
agaagctggcagtgctccgggaact

SEQ ID NO: 6065 - DNA, 25 bp, Mus musculus
agaagctggccagatttgtggctca

SEQ ID NO: 6066 - DNA, 25 bp, Mus musculus
agaagctggtggaccaggctctgct

SEQ ID NO: 6067 - DNA, 25 bp, Mus musculus
agaagcttgatgactctaaacctag

SEQ ID NO: 6068 - DNA, 25 bp, Mus musculus
agaaggaagccctgctaaggcggct

SEQ ID NO: 6069 - DNA, 25 bp, Mus musculus
agaaggaagcggcactccgcgcact

SEQ ID NO: 6070 - DNA, 25 bp, Mus musculus
agaaggaagtgcatcttcatacacc

SEQ ID NO: 6071 - DNA, 25 bp, Mus musculus
agaaggaatcagagctctggaagct

SEQ ID NO: 6072 - DNA, 25 bp, Mus musculus
agaaggacagacagtgtcgcggcct

SEQ ID NO: 6073 - DNA, 25 bp, Mus musculus
agaaggacagcctcagacattccag

SEQ ID NO: 6074 - DNA, 25 bp, Mus musculus
agaaggagatcgagacctactgccg

SEQ ID NO: 6075 - DNA, 25 bp, Mus musculus
agaaggagtagctctggcgtcttat

SEQ ID NO: 6076 - DNA, 25 bp, Mus musculus
agaaggatgacaggattgaagagct

SEQ ID NO: 6077 - DNA, 25 bp, Mus musculus
agaaggatggtcacaaagatccact

SEQ ID NO: 6078 - DNA, 25 bp, Mus musculus
agaaggatttgaacagcctgtggcc

SEQ ID NO: 6079 - DNA, 25 bp, Mus musculus
agaaggcacgggtcctgagtgtaaa

SEQ ID NO: 6080 - DNA, 25 bp, Mus musculus
agaaggcagcgctagtgtcttctcg

SEQ ID NO: 6081 - DNA, 25 bp, Mus musculus
agaaggcattatacctggagcaaaa

SEQ ID NO: 6082 - DNA, 25 bp, Mus musculus
agaaggcattattcctggagcaaaa

SEQ ID NO: 6083 - DNA, 25 bp, Mus musculus
agaaggccaagcagctggtggcttt

SEQ ID NO: 6084 - DNA, 25 bp, Mus musculus
agaaggccagcacgttcaatatttg

SEQ ID NO: 6085 - DNA, 25 bp, Mus musculus
agaaggccctggatcttgaccccag

SEQ ID NO: 6086 - DNA, 25 bp, Mus musculus
agaaggcctcctaagattagacctg

SEQ ID NO: 6087 - DNA, 25 bp, Mus musculus
agaaggcgaaggtctccttctccag

SEQ ID NO: 6088 - DNA, 25 bp, Mus musculus
agaaggcgtcgtggtcttccagaca

SEQ ID NO: 6089 - DNA, 25 bp, Mus musculus
agaaggctacatccctgaacactgg

SEQ ID NO: 6090 - DNA, 25 bp, Mus musculus
agaaggctaggattgaagaagacaa

SEQ ID NO: 6091 - DNA, 25 bp, Mus musculus
agaaggctctgcagctcgccaggcg

SEQ ID NO: 6092 - DNA, 25 bp, Mus musculus
agaaggctctgcagtggcacccaga

SEQ ID NO: 6093 - DNA, 25 bp, Mus musculus
agaaggctctttcttgtggatatat

SEQ ID NO: 6094 - DNA, 25 bp, Mus musculus
agaaggctgctattgaaagagagta

SEQ ID NO: 6095 - DNA, 25 bp, Mus musculus
agaaggctgtcgaacccttgtatac

SEQ ID NO: 6096 - DNA, 25 bp, Mus musculus
agaagggatacacagttgggtttca

SEQ ID NO: 6097 - DNA, 25 bp, Mus musculus
agaagggcagctgaacggtctccag

SEQ ID NO: 6098 - DNA, 25 bp, Mus musculus
agaagggctaaagagatgactcagc

SEQ ID NO: 6099 - DNA, 25 bp, Mus musculus
agaagggctccaaacctccgaatgc

SEQ ID NO: 6100 - DNA, 25 bp, Mus musculus
agaagggctgcagcttcctgccaga

SEQ ID NO: 6101 - DNA, 25 bp, Mus musculus
agaagggtagcttactagccccagc

SEQ ID NO: 6102 - DNA, 25 bp, Mus musculus
agaagggtgagatcctctccgaaga

SEQ ID NO: 6103 - DNA, 25 bp, Mus musculus
agaagggttacttcgcagtgactga

SEQ ID NO: 6104 - DNA, 25 bp, Mus musculus
agaaggtatccaaggccacgtccca

SEQ ID NO: 6105 - DNA, 25 bp, Mus musculus
agaaggtgacagagaggcgccctct

SEQ ID NO: 6106 - DNA, 25 bp, Mus musculus
agaaggtgatcctccgagagcaggt

SEQ ID NO: 6107 - DNA, 25 bp, Mus musculus
agaagtaaaatcttgtcctaggaag

SEQ ID NO: 6108 - DNA, 25 bp, Mus musculus
agaagtacccgttccctatcctcat

SEQ ID NO: 6109 - DNA, 25 bp, Mus musculus
agaagtactcatccgcctggtactc

SEQ ID NO: 6110 - DNA, 25 bp, Mus musculus
agaagtactcatgcgcctggtactc

SEQ ID NO: 6111 - DNA, 25 bp, Mus musculus
agaagtatggagaaacggctaatga

SEQ ID NO: 6112 - DNA, 25 bp, Mus musculus
agaagtcaatgctcaggagcagaag

SEQ ID NO: 6113 - DNA, 25 bp, Mus musculus
agaagtcctcagctaccccgagagg

SEQ ID NO: 6114 - DNA, 25 bp, Mus musculus
agaagtcgaggaaaggccaacaatc

SEQ ID NO: 6115 - DNA, 25 bp, Mus musculus
agaagtcgtcctggcgggattgctc

SEQ ID NO: 6116 - DNA, 25 bp, Mus musculus
agaagtctgggcctccagatgccag

SEQ ID NO: 6117 - DNA, 25 bp, Mus musculus
agaagtgaaattccaaaagacagaa

SEQ ID NO: 6118 - DNA, 25 bp, Mus musculus
agaagtgaccgcctgtgtgctgctc

SEQ ID NO: 6119 - DNA, 25 bp, Mus musculus
agaagtgaggatgcaagcaactcct

SEQ ID NO: 6120 - DNA, 25 bp, Mus musculus
agaagtggaaccgtcttctgctgtg

SEQ ID NO: 6121 - DNA, 25 bp, Mus musculus
agaagtggcctcgacttcggactag

SEQ ID NO: 6122 - DNA, 25 bp, Mus musculus
agaagtggtgcggtatctggtccaa

SEQ ID NO: 6123 - DNA, 25 bp, Mus musculus
agaagttaaatagctatcccaaagg

SEQ ID NO: 6124 - DNA, 25 bp, Mus musculus
agaagttatcagctggtgttttcag

SEQ ID NO: 6125 - DNA, 25 bp, Mus musculus
agaagttggcgatcaaggacctcca

SEQ ID NO: 6126 - DNA, 25 bp, Mus musculus
agaagtttcagtggcctgcaagtta

SEQ ID NO: 6127 - DNA, 25 bp, Mus musculus
agaagtttctgaggcccttctcttg

SEQ ID NO: 6128 - DNA, 25 bp, Mus musculus
agaataaagactcggtgatcaccgc

SEQ ID NO: 6129 - DNA, 25 bp, Mus musculus
agaataatggtggatctttcagggc

SEQ ID NO: 6130 - DNA, 25 bp, Mus musculus
agaatacatgttcaccacagccgtc

SEQ ID NO: 6131 - DNA, 25 bp, Mus musculus
agaataccagagtccttccgtgggt

SEQ ID NO: 6132 - DNA, 25 bp, Mus musculus
agaataccccgggttcagcaaggct

SEQ ID NO: 6133 - DNA, 25 bp, Mus musculus
agaataccgttctgtatggctacta

SEQ ID NO: 6134 - DNA, 25 bp, Mus musculus
agaatacggactttccaaccagctg

SEQ ID NO: 6135 - DNA, 25 bp, Mus musculus
agaatatcctcaaccctctgcgaag

SEQ ID NO: 6136 - DNA, 25 bp, Mus musculus
agaatatgacaggacggcatccctt

SEQ ID NO: 6137 - DNA, 25 bp, Mus musculus
agaatattcaggctgctggagccca

SEQ ID NO: 6138 - DNA, 25 bp, Mus musculus
agaatcaatctcatcccactgagga

SEQ ID NO: 6139 - DNA, 25 bp, Mus musculus
agaatcagacccatgctaagcgcgc

SEQ ID NO: 6140 - DNA, 25 bp, Mus musculus
agaatcagcgcctccagcagaaagt

SEQ ID NO: 6141 - DNA, 25 bp, Mus musculus
agaatcagctggcttcctctagccc

SEQ ID NO: 6142 - DNA, 25 bp, Mus musculus
agaatcatcacagggtcctttgacc

SEQ ID NO: 6143 - DNA, 25 bp, Mus musculus
agaatcatgaggacagagggcctgt

SEQ ID NO: 6144 - DNA, 25 bp, Mus musculus
agaatccgggctgaatctggcacca

SEQ ID NO: 6145 - DNA, 25 bp, Mus musculus
agaatccgtacgatttcgttctgtg

SEQ ID NO: 6146 - DNA, 25 bp, Mus musculus
agaatcgcacgtccacaccggtgcg

SEQ ID NO: 6147 - DNA, 25 bp, Mus musculus
agaatctcaccatggcctcctctgg

SEQ ID NO: 6148 - DNA, 25 bp, Mus musculus
agaatctcccttcccaaaggacatg

SEQ ID NO: 6149 - DNA, 25 bp, Mus musculus
agaatctgagtccactcagaaggcc

SEQ ID NO: 6150 - DNA, 25 bp, Mus musculus
agaatctgcttcagctaaggccaag

SEQ ID NO: 6151 - DNA, 25 bp, Mus musculus
agaatgacaagcttcagctggaaga

SEQ ID NO: 6152 - DNA, 25 bp, Mus musculus
agaatgacagctgcctacatctgaa

SEQ ID NO: 6153 - DNA, 25 bp, Mus musculus
agaatgaccacatcaacctgaaagt

SEQ ID NO: 6154 - DNA, 25 bp, Mus musculus
agaatgacggacaagtgtttccgga

SEQ ID NO: 6155 - DNA, 25 bp, Mus musculus
agaatgagctatggtttagaacggg

SEQ ID NO: 6156 - DNA, 25 bp, Mus musculus
agaatgccagcaacatggagtacag

SEQ ID NO: 6157 - DNA, 25 bp, Mus musculus
agaatgctacctcccaggagctgga

SEQ ID NO: 6158 - DNA, 25 bp, Mus musculus
agaatgctagagaattcatgggaga

SEQ ID NO: 6159 - DNA, 25 bp, Mus musculus
agaatggacagaattgccctggcta

SEQ ID NO: 6160 - DNA, 25 bp, Mus musculus
agaatggccgctccgtgcgtgtgcg

SEQ ID NO: 6161 - DNA, 25 bp, Mus musculus
agaatggccgctgcgtgcgtgtgcg

SEQ ID NO: 6162 - DNA, 25 bp, Mus musculus
agaatgggcagaagcgagccaagct

SEQ ID NO: 6163 - DNA, 25 bp, Mus musculus
agaatggttaaagggaatgacctca

SEQ ID NO: 6164 - DNA, 25 bp, Mus musculus
agaatgtcaccaacaacctcaagtc

SEQ ID NO: 6165 - DNA, 25 bp, Mus musculus
agaatgtcaccgagtacgtcgtccg

SEQ ID NO: 6166 - DNA, 25 bp, Mus musculus
agaatgttctcaagcctgcacagga

SEQ ID NO: 6167 - DNA, 25 bp, Mus musculus
agaattcagtgacccgtcgttggag

SEQ ID NO: 6168 - DNA, 25 bp, Mus musculus
agaattccgcggttgctgtgagcgc

SEQ ID NO: 6169 - DNA, 25 bp, Mus musculus
agaattccttggagacggtgggcac

SEQ ID NO: 6170 - DNA, 25 bp, Mus musculus
agaattctcgggtccggcagagccc

SEQ ID NO: 6171 - DNA, 25 bp, Mus musculus
agaattggtggaagcccaggagcta

SEQ ID NO: 6172 - DNA, 25 bp, Mus musculus
agaatttagcgcagcaccctttccc

SEQ ID NO: 6173 - DNA, 25 bp, Mus musculus
agaatttagcgctgcaccctttccc

SEQ ID NO: 6174 - DNA, 25 bp, Mus musculus
agaatttgttcagttccaccccaca

SEQ ID NO: 6175 - DNA, 25 bp, Mus musculus
agacaacagagaggtccgtgtgccc

SEQ ID NO: 6176 - DNA, 25 bp, Mus musculus
agacaactctgaatctttgaaaatg

SEQ ID NO: 6177 - DNA, 25 bp, Mus musculus
agacaagaggacaggagctcgttag

SEQ ID NO: 6178 - DNA, 25 bp, Mus musculus
agacaagcctgaggagacggagaga

SEQ ID NO: 6179 - DNA, 25 bp, Mus musculus
agacaagcggagaccagagttctgg

SEQ ID NO: 6180 - DNA, 25 bp, Mus musculus
agacaaggaaatggccaactcgggc

SEQ ID NO: 6181 - DNA, 25 bp, Mus musculus
agacaaggaggaggctaagccagat

SEQ ID NO: 6182 - DNA, 25 bp, Mus musculus
agacaaggcccctgtggtgaaggct

SEQ ID NO: 6183 - DNA, 25 bp, Mus musculus
agacaagggctgacaaccatcgaag

SEQ ID NO: 6184 - DNA, 25 bp, Mus musculus
agacaataccgacggcagaaccagc

SEQ ID NO: 6185 - DNA, 25 bp, Mus musculus
agacaatccaatcggagaacaacgg

SEQ ID NO: 6186 - DNA, 25 bp, Mus musculus
agacaatccaatgggagaacaacgg

SEQ ID NO: 6187 - DNA, 25 bp, Mus musculus
agacacagccatcctctctggaagt

SEQ ID NO: 6188 - DNA, 25 bp, Mus musculus
agacacagccttctggcgagggcct

SEQ ID NO: 6189 - DNA, 25 bp, Mus musculus
agacacatacaacctgccaaagtta

SEQ ID NO: 6190 - DNA, 25 bp, Mus musculus
agacacatacaagctgccaaagtta

SEQ ID NO: 6191 - DNA, 25 bp, Mus musculus
agacacatccctaagcagaaactac

SEQ ID NO: 6192 - DNA, 25 bp, Mus musculus
agacacatgtggtaaagatagaccc

SEQ ID NO: 6193 - DNA, 25 bp, Mus musculus
agacacccttggatcaatcctactg

SEQ ID NO: 6194 - DNA, 25 bp, Mus musculus
agacacctgggcactctgcaggtga

SEQ ID NO: 6195 - DNA, 25 bp, Mus musculus
agacacctttgacgtcttccgccag

SEQ ID NO: 6196 - DNA, 25 bp, Mus musculus
agacacggcggcagaagctcacagc

SEQ ID NO: 6197 - DNA, 25 bp, Mus musculus
agacacggcttctgaggcaggcaca

SEQ ID NO: 6198 - DNA, 25 bp, Mus musculus
agacactctgctcggagctgatgag

SEQ ID NO: 6199 - DNA, 25 bp, Mus musculus
agacagacatcatctttgaggtggg

SEQ ID NO: 6200 - DNA, 25 bp, Mus musculus
agacagactggaagcttcggctccc

SEQ ID NO: 6201 - DNA, 25 bp, Mus musculus
agacagagaatgaccacatcaacct

SEQ ID NO: 6202 - DNA, 25 bp, Mus musculus
agacagaggctgatgcggatgcata

SEQ ID NO: 6203 - DNA, 25 bp, Mus musculus
agacagaggtggcaattgaatcccg

SEQ ID NO: 6204 - DNA, 25 bp, Mus musculus
agacagcacttacacgtatgtcagc

SEQ ID NO: 6205 - DNA, 25 bp, Mus musculus
agacagcatcccacggacacaagta

SEQ ID NO: 6206 - DNA, 25 bp, Mus musculus
agacagcctgccaggagtatactgt

SEQ ID NO: 6207 - DNA, 25 bp, Mus musculus
agacagcgagcgctactctcgtaga

SEQ ID NO: 6208 - DNA, 25 bp, Mus musculus
agacaggcctgtctggtcttgagat

SEQ ID NO: 6209 - DNA, 25 bp, Mus musculus
agacaggtttgtccctcccaatcca

SEQ ID NO: 6210 - DNA, 25 bp, Mus musculus
agacagtcatctctatcagaaaaaa

SEQ ID NO: 6211 - DNA, 25 bp, Mus musculus
agacagtgaaggtctctgtgtctgc

SEQ ID NO: 6212 - DNA, 25 bp, Mus musculus
agacagtgagcgacgaggctcgtca

SEQ ID NO: 6213 - DNA, 25 bp, Mus musculus
agacagtgagggagccgggcaagct

SEQ ID NO: 6214 - DNA, 25 bp, Mus musculus
agacagtggtgcacctcacgctgtg

SEQ ID NO: 6215 - DNA, 25 bp, Mus musculus
agacagtggtgctcctcacgctgtg

SEQ ID NO: 6216 - DNA, 25 bp, Mus musculus
agacagttcagcagtcaaaaatctg

SEQ ID NO: 6217 - DNA, 25 bp, Mus musculus
agacatacaaaagcctcttctgaag

SEQ ID NO: 6218 - DNA, 25 bp, Mus musculus
agacatgaaccgactcatcatgaac

SEQ ID NO: 6219 - DNA, 25 bp, Mus musculus
agacatgctgcaggccctgaaagtt

SEQ ID NO: 6220 - DNA, 25 bp, Mus musculus
agacatgtcgatccctctggaaagt

SEQ ID NO: 6221 - DNA, 25 bp, Mus musculus
agacattaaacaagttgaacacaag

SEQ ID NO: 6222 - DNA, 25 bp, Mus musculus
agacattatctgacgaatctgatga

SEQ ID NO: 6223 - DNA, 25 bp, Mus musculus
agacattatgttacatcaccagaag

SEQ ID NO: 6224 - DNA, 25 bp, Mus musculus
agacattcacacttataccagcctc

SEQ ID NO: 6225 - DNA, 25 bp, Mus musculus
agacattccccaatgctgactttgc

SEQ ID NO: 6226 - DNA, 25 bp, Mus musculus
agacatttgggctgtcagcttcggg

SEQ ID NO: 6227 - DNA, 25 bp, Mus musculus
agacatttgtaatctgggactccag

SEQ ID NO: 6228 - DNA, 25 bp, Mus musculus
agacattttattccagactgcaaaa

SEQ ID NO: 6229 - DNA, 25 bp, Mus musculus
agaccaacacgatgggctgcggaca

SEQ ID NO: 6230 - DNA, 25 bp, Mus musculus
agaccaactactacaacctggatgg

SEQ ID NO: 6231 - DNA, 25 bp, Mus musculus
agaccaactcagctgtccggacctg

SEQ ID NO: 6232 - DNA, 25 bp, Mus musculus
agaccaagacccacatccaggagtg

SEQ ID NO: 6233 - DNA, 25 bp, Mus musculus
agaccaagccacaggaatttgccac

SEQ ID NO: 6234 - DNA, 25 bp, Mus musculus
agaccaagcgtgtggcggcacaagt

SEQ ID NO: 6235 - DNA, 25 bp, Mus musculus
agaccaaggagacgctccgaggcat

SEQ ID NO: 6236 - DNA, 25 bp, Mus musculus
agaccaaggagaggctccgaggcat

SEQ ID NO: 6237 - DNA, 25 bp, Mus musculus
agaccaagtttcacatccatcaccg

SEQ ID NO: 6238 - DNA, 25 bp, Mus musculus
agaccagcaagtccgggtcctgctc

SEQ ID NO: 6239 - DNA, 25 bp, Mus musculus
agaccagcagaagcgcatctgtgag

SEQ ID NO: 6240 - DNA, 25 bp, Mus musculus
agaccagcgtgatctgctccgacaa

SEQ ID NO: 6241 - DNA, 25 bp, Mus musculus
agaccagctcacctatggagcagaa

SEQ ID NO: 6242 - DNA, 25 bp, Mus musculus
agaccaggcagctgcgctcctgaca

SEQ ID NO: 6243 - DNA, 25 bp, Mus musculus
agaccatcctaagctacattccaag

SEQ ID NO: 6244 - DNA, 25 bp, Mus musculus
agaccatgccttcctttgttcatga

SEQ ID NO: 6245 - DNA, 25 bp, Mus musculus
agacccaagcctgagcttgcagtga

SEQ ID NO: 6246 - DNA, 25 bp, Mus musculus
agacccagagcttcgagagaaccca

SEQ ID NO: 6247 - DNA, 25 bp, Mus musculus
agacccatgggaatcaaagccagca

SEQ ID NO: 6248 - DNA, 25 bp, Mus musculus
agacccattcctgtgaaagcagtgg

SEQ ID NO: 6249 - DNA, 25 bp, Mus musculus
agaccccgaagagacagggccttca

SEQ ID NO: 6250 - DNA, 25 bp, Mus musculus
agaccccgacagcagcagtagatga

SEQ ID NO: 6251 - DNA, 25 bp, Mus musculus
agaccccggtgtgttcgtgctcctg

SEQ ID NO: 6252 - DNA, 25 bp, Mus musculus
agacccctctccctcgggaaatgat

SEQ ID NO: 6253 - DNA, 25 bp, Mus musculus
agacccctctgcacgtagctgctga

SEQ ID NO: 6254 - DNA, 25 bp, Mus musculus
agaccctaaaatccctaagagcaag

SEQ ID NO: 6255 - DNA, 25 bp, Mus musculus
agaccctagaccagcagaagcgcat

SEQ ID NO: 6256 - DNA, 25 bp, Mus musculus
agaccctgctctggaaagataaagc

SEQ ID NO: 6257 - DNA, 25 bp, Mus musculus
agaccctggaggagcactcccactg

SEQ ID NO: 6258 - DNA, 25 bp, Mus musculus
agaccgggccacctgtcattcaagg

SEQ ID NO: 6259 - DNA, 25 bp, Mus musculus
agaccgggccatgccgcgcaatgat

SEQ ID NO: 6260 - DNA, 25 bp, Mus musculus
agaccgtcctgtcccggatcactag

SEQ ID NO: 6261 - DNA, 25 bp, Mus musculus
agacctaccgagtgctgctgggcgc

SEQ ID NO: 6262 - DNA, 25 bp, Mus musculus
agacctatctgcatttgagtcctca

SEQ ID NO: 6263 - DNA, 25 bp, Mus musculus
agacctcaagaggaactccctgggc

SEQ ID NO: 6264 - DNA, 25 bp, Mus musculus
agacctcagaccgaggctggtggct

SEQ ID NO: 6265 - DNA, 25 bp, Mus musculus
agacctctgctaaggaaggactcct

SEQ ID NO: 6266 - DNA, 25 bp, Mus musculus
agacctctgtggatgccggatgcct

SEQ ID NO: 6267 - DNA, 25 bp, Mus musculus
agacctcttccgtaatgcgggatgt

SEQ ID NO: 6268 - DNA, 25 bp, Mus musculus
agacctgcaggcgaagctacagctg

SEQ ID NO: 6269 - DNA, 25 bp, Mus musculus
agacctggatgcagtcctcttgctt

SEQ ID NO: 6270 - DNA, 25 bp, Mus musculus
agacctgggcaatgtgactgctgga

SEQ ID NO: 6271 - DNA, 25 bp, Mus musculus
agacctgtacagcttgcacagctgg

SEQ ID NO: 6272 - DNA, 25 bp, Mus musculus
agaccttagacaagaaagatgggag

SEQ ID NO: 6273 - DNA, 25 bp, Mus musculus
agaccttagcgaccaagtgccagac

SEQ ID NO: 6274 - DNA, 25 bp, Mus musculus
agaccttcaggcaaatcctctcaag

SEQ ID NO: 6275 - DNA, 25 bp, Mus musculus
agaccttctggacccttgaccatgc

SEQ ID NO: 6276 - DNA, 25 bp, Mus musculus
agaccttgccaatcccggtccagat

SEQ ID NO: 6277 - DNA, 25 bp, Mus musculus
agacgacctggatgatgatgtcatc

SEQ ID NO: 6278 - DNA, 25 bp, Mus musculus
agacgacctgtgtgtgccacagctc

SEQ ID NO: 6279 - DNA, 25 bp, Mus musculus
agacgatctggaagccggccccatg

SEQ ID NO: 6280 - DNA, 25 bp, Mus musculus
agacgatgctggagccaccacctca

SEQ ID NO: 6281 - DNA, 25 bp, Mus musculus
agacgatggatcacaaccgaaaccg

SEQ ID NO: 6282 - DNA, 25 bp, Mus musculus
agacgattcgctggtgggatccacc

SEQ ID NO: 6283 - DNA, 25 bp, Mus musculus
agacgcagagcgagcccttgctgtg

SEQ ID NO: 6284 - DNA, 25 bp, Mus musculus
agacgcagatggtattttttaacct

SEQ ID NO: 6285 - DNA, 25 bp, Mus musculus
agacgcagtacgtgctggatgtgca

SEQ ID NO: 6286 - DNA, 25 bp, Mus musculus
agacgcctgcagaagaacagcctaa

SEQ ID NO: 6287 - DNA, 25 bp, Mus musculus
agacgctgcacaacctagtccacaa

SEQ ID NO: 6288 - DNA, 25 bp, Mus musculus
agacgcttagcttaggcctgaggga

SEQ ID NO: 6289 - DNA, 25 bp, Mus musculus
agacggaaaaccctctgcccggatg

SEQ ID NO: 6290 - DNA, 25 bp, Mus musculus
agacggaagcctgggctttgccgca

SEQ ID NO: 6291 - DNA, 25 bp, Mus musculus
agacggatgccatacagaggacgga

SEQ ID NO: 6292 - DNA, 25 bp, Mus musculus
agacggatggccctgcagacaacac

SEQ ID NO: 6293 - DNA, 25 bp, Mus musculus
agacggcaccacgactaagtacttt

SEQ ID NO: 6294 - DNA, 25 bp, Mus musculus
agacggcagcgacaaatgatcccaa

SEQ ID NO: 6295 - DNA, 25 bp, Mus musculus
agacggcagctcacagtccagtgga

SEQ ID NO: 6296 - DNA, 25 bp, Mus musculus
agacggcagtccagctggccctgcg

SEQ ID NO: 6297 - DNA, 25 bp, Mus musculus
agacggcattgcatatggcggctcg

SEQ ID NO: 6298 - DNA, 25 bp, Mus musculus
agacggccccagcagtgctgctgaa

SEQ ID NO: 6299 - DNA, 25 bp, Mus musculus
agacgggtcacactgctggaagcca

SEQ ID NO: 6300 - DNA, 25 bp, Mus musculus
agacgggtccactgccacgtgtgtc

SEQ ID NO: 6301 - DNA, 25 bp, Mus musculus
agacggtcaccatgatgccacccga

SEQ ID NO: 6302 - DNA, 25 bp, Mus musculus
agacggtgcagaggctcatcccagc

SEQ ID NO: 6303 - DNA, 25 bp, Mus musculus
agacgtacgaggtggatctgaataa

SEQ ID NO: 6304 - DNA, 25 bp, Mus musculus
agacgtcatcatgtggcactaacac

SEQ ID NO: 6305 - DNA, 25 bp, Mus musculus
agactaaaacacaagattgcacccc

SEQ ID NO: 6306 - DNA, 25 bp, Mus musculus
agactagaaggcacgggtcctgagt

SEQ ID NO: 6307 - DNA, 25 bp, Mus musculus
agactatatggcatcaaccataggg

SEQ ID NO: 6308 - DNA, 25 bp, Mus musculus
agactcaagagatctacatgcctct

SEQ ID NO: 6309 - DNA, 25 bp, Mus musculus
agactcagttgagttgacaacctta

SEQ ID NO: 6310 - DNA, 25 bp, Mus musculus
agactccattgacggtggcccagaa

SEQ ID NO: 6311 - DNA, 25 bp, Mus musculus
agactcctcggcagaagacaaagac

SEQ ID NO: 6312 - DNA, 25 bp, Mus musculus
agactcctgtgctttcggctctgag

SEQ ID NO: 6313 - DNA, 25 bp, Mus musculus
agactcgcttacagcttgatgcaag

SEQ ID NO: 6314 - DNA, 25 bp, Mus musculus
agactcgtgttcagcgtggctagca

SEQ ID NO: 6315 - DNA, 25 bp, Mus musculus
agactcgtgttctgcgtggctagca

SEQ ID NO: 6316 - DNA, 25 bp, Mus musculus
agactctcgcggatcgacatcgcca

SEQ ID NO: 6317 - DNA, 25 bp, Mus musculus
agactctcgctctcgcacaggatca

SEQ ID NO: 6318 - DNA, 25 bp, Mus musculus
agactctcttcgtgcaccgattctc

SEQ ID NO: 6319 - DNA, 25 bp, Mus musculus
agactctgaatgtagtggaggagaa

SEQ ID NO: 6320 - DNA, 25 bp, Mus musculus
agactctggactctcaggctgtcag

SEQ ID NO: 6321 - DNA, 25 bp, Mus musculus
agactctggctgtgcgctcctaccg

SEQ ID NO: 6322 - DNA, 25 bp, Mus musculus
agactcttcaatcagctcatcaagt

SEQ ID NO: 6323 - DNA, 25 bp, Mus musculus
agactgaaccaacggcatctcggga

SEQ ID NO: 6324 - DNA, 25 bp, Mus musculus
agactgacacgccagggaacgacga

SEQ ID NO: 6325 - DNA, 25 bp, Mus musculus
agactgccctgatggaggcaaattc

SEQ ID NO: 6326 - DNA, 25 bp, Mus musculus
agactgcgcctcactctgctgtcag

SEQ ID NO: 6327 - DNA, 25 bp, Mus musculus
agactgctcctggtatgatacatcc

SEQ ID NO: 6328 - DNA, 25 bp, Mus musculus
agactggaagcttcggctcccggtg

SEQ ID NO: 6329 - DNA, 25 bp, Mus musculus
agactggaggctacgccagcttgga

SEQ ID NO: 6330 - DNA, 25 bp, Mus musculus
agactggagtggcacacactacctg

SEQ ID NO: 6331 - DNA, 25 bp, Mus musculus
agactggcgcattgactcttgtggg

SEQ ID NO: 6332 - DNA, 25 bp, Mus musculus
agactgggtcatcccgccaatcaac

SEQ ID NO: 6333 - DNA, 25 bp, Mus musculus
agactgggtcatgccgccaatcaac

SEQ ID NO: 6334 - DNA, 25 bp, Mus musculus
agactgtactgttgacccgaaggac

SEQ ID NO: 6335 - DNA, 25 bp, Mus musculus
agactgtcacagagctctgtaaatc

SEQ ID NO: 6336 - DNA, 25 bp, Mus musculus
agactgtgcgccatggctccaaggc

SEQ ID NO: 6337 - DNA, 25 bp, Mus musculus
agacttattgatctgcacacaaatg

SEQ ID NO: 6338 - DNA, 25 bp, Mus musculus
agacttcttcgtgatgagtgattac

SEQ ID NO: 6339 - DNA, 25 bp, Mus musculus
agacttgagaggaccaggaccacaa

SEQ ID NO: 6340 - DNA, 25 bp, Mus musculus
agacttggaccggactgtccagcag

SEQ ID NO: 6341 - DNA, 25 bp, Mus musculus
agacttggtctatacactggctttc

SEQ ID NO: 6342 - DNA, 25 bp, Mus musculus
agactttaaccaagggcggtgagca

SEQ ID NO: 6343 - DNA, 25 bp, Mus musculus
agactttccaagatgtccatctctt

SEQ ID NO: 6344 - DNA, 25 bp, Mus musculus
agactttcccaagcctctggttgcg

SEQ ID NO: 6345 - DNA, 25 bp, Mus musculus
agactttctggatggcttcttcaga

SEQ ID NO: 6346 - DNA, 25 bp, Mus musculus
agactttgtcatcggcctttgctga

SEQ ID NO: 6347 - DNA, 25 bp, Mus musculus
agacttttcctttaaggctggccag

SEQ ID NO: 6348 - DNA, 25 bp, Mus musculus
agactttttacttctgtgatcgcag

SEQ ID NO: 6349 - DNA, 25 bp, Mus musculus
agagaaaaaacagcgcggatttctg

SEQ ID NO: 6350 - DNA, 25 bp, Mus musculus
agagaaaatgttcaagggcaaacgg

SEQ ID NO: 6351 - DNA, 25 bp, Mus musculus
agagaaacgccctgtgcaacttgct

SEQ ID NO: 6352 - DNA, 25 bp, Mus musculus
agagaaaggagttaaagggcaagct

SEQ ID NO: 6353 - DNA, 25 bp, Mus musculus
agagaacattataagcttgattggc

SEQ ID NO: 6354 - DNA, 25 bp, Mus musculus
agagaacccggatgatggagatatt

SEQ ID NO: 6355 - DNA, 25 bp, Mus musculus
agagaaccttcagttgaatcaggag

SEQ ID NO: 6356 - DNA, 25 bp, Mus musculus
agagaaccttgcgtgggcgtcctat

SEQ ID NO: 6357 - DNA, 25 bp, Mus musculus
agagaactccagaaagtgaagaaga

SEQ ID NO: 6358 - DNA, 25 bp, Mus musculus
agagaacttaatccctgccggtgct

SEQ ID NO: 6359 - DNA, 25 bp, Mus musculus
agagaacttgctctggttcaaacca

SEQ ID NO: 6360 - DNA, 25 bp, Mus musculus
agagaagacaataccgacggcagaa

SEQ ID NO: 6361 - DNA, 25 bp, Mus musculus
agagaagagcagaaagagctgcagc

SEQ ID NO: 6362 - DNA, 25 bp, Mus musculus
agagaagcactctggtgaccatggc

SEQ ID NO: 6363 - DNA, 25 bp, Mus musculus
agagaagcagcttctacttcaggaa

SEQ ID NO: 6364 - DNA, 25 bp, Mus musculus
agagaagcctcccttccagcacaag

SEQ ID NO: 6365 - DNA, 25 bp, Mus musculus
agagaagctgcttccgtctgccctg

SEQ ID NO: 6366 - DNA, 25 bp, Mus musculus
agagaatattctagctaagtcttca

SEQ ID NO: 6367 - DNA, 25 bp, Mus musculus
agagaatattcttgctaagtcttca

SEQ ID NO: 6368 - DNA, 25 bp, Mus musculus
agagaatgaccacatcaacctgaaa

SEQ ID NO: 6369 - DNA, 25 bp, Mus musculus
agagacaagcactccagagaacaag

SEQ ID NO: 6370 - DNA, 25 bp, Mus musculus
agagacagcggccagtactggccca

SEQ ID NO: 6371 - DNA, 25 bp, Mus musculus
agagaccaggcctgggttgacgcca

SEQ ID NO: 6372 - DNA, 25 bp, Mus musculus
agagaccatcactagccccaagaag

SEQ ID NO: 6373 - DNA, 25 bp, Mus musculus
agagacccagaaagaaatggctggt

SEQ ID NO: 6374 - DNA, 25 bp, Mus musculus
agagacccatgcctggtgcagagac

SEQ ID NO: 6375 - DNA, 25 bp, Mus musculus
agagaccgccctgtaccgaaagatg

SEQ ID NO: 6376 - DNA, 25 bp, Mus musculus
agagacgagccctgcaggcttcaag

SEQ ID NO: 6377 - DNA, 25 bp, Mus musculus
agagacgcctgcagaagaacagcct

SEQ ID NO: 6378 - DNA, 25 bp, Mus musculus
agagacggaggcatccctgcagacc

SEQ ID NO: 6379 - DNA, 25 bp, Mus musculus
agagacggcattgcatatggcggct

SEQ ID NO: 6380 - DNA, 25 bp, Mus musculus
agagacgttagcacaaatgatagaa

SEQ ID NO: 6381 - DNA, 25 bp, Mus musculus
agagactcagacctggaccccaggg

SEQ ID NO: 6382 - DNA, 25 bp, Mus musculus
agagactcagcccagagagaacagg

SEQ ID NO: 6383 - DNA, 25 bp, Mus musculus
agagactccaaagctcaagaagaag

SEQ ID NO: 6384 - DNA, 25 bp, Mus musculus
agagactggagatgactacaggacc

SEQ ID NO: 6385 - DNA, 25 bp, Mus musculus
agagacttttcatggtttcctattg

SEQ ID NO: 6386 - DNA, 25 bp, Mus musculus
agagagaactgccagtgtcctccgc

SEQ ID NO: 6387 - DNA, 25 bp, Mus musculus
agagagaagaacgagcccggcagca

SEQ ID NO: 6388 - DNA, 25 bp, Mus musculus
agagagacctgcagtacgtggagaa

SEQ ID NO: 6389 - DNA, 25 bp, Mus musculus
agagagactagatggtgaaaacatt

SEQ ID NO: 6390 - DNA, 25 bp, Mus musculus
agagagagcgagcagcacagcaaca

SEQ ID NO: 6391 - DNA, 25 bp, Mus musculus
agagagcaaccaacgtcacctatca

SEQ ID NO: 6392 - DNA, 25 bp, Mus musculus
agagagcatggaaccgatgtgtttg

SEQ ID NO: 6393 - DNA, 25 bp, Mus musculus
agagagcattggactccccaggact

SEQ ID NO: 6394 - DNA, 25 bp, Mus musculus
agagagcccagctatagcccagggc

SEQ ID NO: 6395 - DNA, 25 bp, Mus musculus
agagagccgaaaccccaccctggag

SEQ ID NO: 6396 - DNA, 25 bp, Mus musculus
agagagccgcaggtctctgctgccg

SEQ ID NO: 6397 - DNA, 25 bp, Mus musculus
agagagcctgagacccaacttccca

SEQ ID NO: 6398 - DNA, 25 bp, Mus musculus
agagagcggctggtcttcagtctga

SEQ ID NO: 6399 - DNA, 25 bp, Mus musculus
agagagctgagtgagtggccacatt

SEQ ID NO: 6400 - DNA, 25 bp, Mus musculus
agagaggacggaagcccaggtacaa

SEQ ID NO: 6401 - DNA, 25 bp, Mus musculus
agagaggccagcgcttaggagaaca

SEQ ID NO: 6402 - DNA, 25 bp, Mus musculus
agagaggcgccctctgcacactgtg

SEQ ID NO: 6403 - DNA, 25 bp, Mus musculus
agagaggtcacatggcttgctcgag

SEQ ID NO: 6404 - DNA, 25 bp, Mus musculus
agagaggtcctatcaaaaccaaaca

SEQ ID NO: 6405 - DNA, 25 bp, Mus musculus
agagagtacctgatcgagaagctgc

SEQ ID NO: 6406 - DNA, 25 bp, Mus musculus
agagagtacctttatcagctccagg

SEQ ID NO: 6407 - DNA, 25 bp, Mus musculus
agagagtcaagctggcatcctgcct

SEQ ID NO: 6408 - DNA, 25 bp, Mus musculus
agagagttgggcagatgccccacaa

SEQ ID NO: 6409 - DNA, 25 bp, Mus musculus
agagatagacctttcccagggtgca

SEQ ID NO: 6410 - DNA, 25 bp, Mus musculus
agagatcaagactaggtttccaacc

SEQ ID NO: 6411 - DNA, 25 bp, Mus musculus
agagatcattctgcccagcacaggc

SEQ ID NO: 6412 - DNA, 25 bp, Mus musculus
agagatccaagcactgaggcgcctg

SEQ ID NO: 6413 - DNA, 25 bp, Mus musculus
agagatctgacctatctaaggatca

SEQ ID NO: 6414 - DNA, 25 bp, Mus musculus
agagatctgccaacctgtgcgcctg

SEQ ID NO: 6415 - DNA, 25 bp, Mus musculus
agagatgaacaataaactggctgag

SEQ ID NO: 6416 - DNA, 25 bp, Mus musculus
agagatgacctccatcttgcgaagt

SEQ ID NO: 6417 - DNA, 25 bp, Mus musculus
agagatgatggtgtttgctgccctg

SEQ ID NO: 6418 - DNA, 25 bp, Mus musculus
agagatggcacatactggcccagca

SEQ ID NO: 6419 - DNA, 25 bp, Mus musculus
agagatggctgaggaccctgattca

SEQ ID NO: 6420 - DNA, 25 bp, Mus musculus
agagatgtcatcatgagggaattcc

SEQ ID NO: 6421 - DNA, 25 bp, Mus musculus
agagattatgagaagaaccaggagg

SEQ ID NO: 6422 - DNA, 25 bp, Mus musculus
agagcaacaggaagacgacctggat

SEQ ID NO: 6423 - DNA, 25 bp, Mus musculus
agagcaaccacaccacaggccgttt

SEQ ID NO: 6424 - DNA, 25 bp, Mus musculus
agagcaagattccttgctgcctggg

SEQ ID NO: 6425 - DNA, 25 bp, Mus musculus
agagcaagccagtagctgacttgct

SEQ ID NO: 6426 - DNA, 25 bp, Mus musculus
agagcaatcacatcaagctgtcggg

SEQ ID NO: 6427 - DNA, 25 bp, Mus musculus
agagcacaacttcccttttcagttc

SEQ ID NO: 6428 - DNA, 25 bp, Mus musculus
agagcacgggcaactgctgcatcca

SEQ ID NO: 6429 - DNA, 25 bp, Mus musculus
agagcactgaatctcctggcactgg

SEQ ID NO: 6430 - DNA, 25 bp, Mus musculus
agagcagaaaagcagcgccccttat

SEQ ID NO: 6431 - DNA, 25 bp, Mus musculus
agagcagacacactaacaaccctct

SEQ ID NO: 6432 - DNA, 25 bp, Mus musculus
agagcagagagacacagtgcccatc

SEQ ID NO: 6433 - DNA, 25 bp, Mus musculus
agagcagagcagtagattggcaaaa

SEQ ID NO: 6434 - DNA, 25 bp, Mus musculus
agagcagaggagttatgttatacct

SEQ ID NO: 6435 - DNA, 25 bp, Mus musculus
agagcagcccctggccttatggagg

SEQ ID NO: 6436 - DNA, 25 bp, Mus musculus
agagcagccttaaccctgcagcctt

SEQ ID NO: 6437 - DNA, 25 bp, Mus musculus
agagcaggcattgtgtatgggaact

SEQ ID NO: 6438 - DNA, 25 bp, Mus musculus
agagcagtgcctcacgcctcatgag

SEQ ID NO: 6439 - DNA, 25 bp, Mus musculus
agagcagtgtgaaccagtggcccca

SEQ ID NO: 6440 - DNA, 25 bp, Mus musculus
agagcatctcccttatgtctgtggg

SEQ ID NO: 6441 - DNA, 25 bp, Mus musculus
agagcatgttctactcttccagagg

SEQ ID NO: 6442 - DNA, 25 bp, Mus musculus
agagcattgccgtggccaaatcctt

SEQ ID NO: 6443 - DNA, 25 bp, Mus musculus
agagcattggactccccaggactgg

SEQ ID NO: 6444 - DNA, 25 bp, Mus musculus
agagccaagaggttccgagggcacc

SEQ ID NO: 6445 - DNA, 25 bp, Mus musculus
agagccaagtgcagctgtcttagag

SEQ ID NO: 6446 - DNA, 25 bp, Mus musculus
agagccaccatgacccgctggacgt

SEQ ID NO: 6447 - DNA, 25 bp, Mus musculus
agagccaccggtactgccatagatg

SEQ ID NO: 6448 - DNA, 25 bp, Mus musculus
agagccaggaggcaccaaagcaaga

SEQ ID NO: 6449 - DNA, 25 bp, Mus musculus
agagcccagaagaccagaaagccct

SEQ ID NO: 6450 - DNA, 25 bp, Mus musculus
agagcccagaagtccagaaagccct

SEQ ID NO: 6451 - DNA, 25 bp, Mus musculus
agagcccatgaagcccaggatgcgg

SEQ ID NO: 6452 - DNA, 25 bp, Mus musculus
agagccccaggctctgctgtctggc

SEQ ID NO: 6453 - DNA, 25 bp, Mus musculus
agagcccctatggacgacgccaggg

SEQ ID NO: 6454 - DNA, 25 bp, Mus musculus
agagcccgatttctgaagatcccga

SEQ ID NO: 6455 - DNA, 25 bp, Mus musculus
agagcccggaagcatgctcctctta

SEQ ID NO: 6456 - DNA, 25 bp, Mus musculus
agagccctatgcactggtgagaagg

SEQ ID NO: 6457 - DNA, 25 bp, Mus musculus
agagccctctctccctttagtggct

SEQ ID NO: 6458 - DNA, 25 bp, Mus musculus
agagccgctggccagtatagcacga

SEQ ID NO: 6459 - DNA, 25 bp, Mus musculus
agagccggcgtcaccccttgggtcg

SEQ ID NO: 6460 - DNA, 25 bp, Mus musculus
agagccggtccctgcagcagcagct

SEQ ID NO: 6461 - DNA, 25 bp, Mus musculus
agagcctcaggccaccatttctgaa

SEQ ID NO: 6462 - DNA, 25 bp, Mus musculus
agagcctggaactcccctagtcctt

SEQ ID NO: 6463 - DNA, 25 bp, Mus musculus
agagccttcccctgtaacaaggaga

SEQ ID NO: 6464 - DNA, 25 bp, Mus musculus
agagccttctaagaagcatgggagg

SEQ ID NO: 6465 - DNA, 25 bp, Mus musculus
agagccttggacttactgagtctca

SEQ ID NO: 6466 - DNA, 25 bp, Mus musculus
agagccttgtcctgcaggcccctgg

SEQ ID NO: 6467 - DNA, 25 bp, Mus musculus
agagcgaccagctgggcagcataca

SEQ ID NO: 6468 - DNA, 25 bp, Mus musculus
agagcgactggtacctgggcaacct

SEQ ID NO: 6469 - DNA, 25 bp, Mus musculus
agagcgagaaagagaacacgttccc

SEQ ID NO: 6470 - DNA, 25 bp, Mus musculus
agagcgatatgggagaagaacatga

SEQ ID NO: 6471 - DNA, 25 bp, Mus musculus
agagcgcagagagatgctgaccagt

SEQ ID NO: 6472 - DNA, 25 bp, Mus musculus
agagcgcatgaggatacagaaagct

SEQ ID NO: 6473 - DNA, 25 bp, Mus musculus
agagcgcggagcagggatccacttc

SEQ ID NO: 6474 - DNA, 25 bp, Mus musculus
agagcgcggagctgggatccacttc

SEQ ID NO: 6475 - DNA, 25 bp, Mus musculus
agagcgctgccaagatgatccgcca

SEQ ID NO: 6476 - DNA, 25 bp, Mus musculus
agagcgctgtgacgccctcgctgca

SEQ ID NO: 6477 - DNA, 25 bp, Mus musculus
agagcggagcgatgaccaaggacct

SEQ ID NO: 6478 - DNA, 25 bp, Mus musculus
agagcggagcggaagctaagaaact

SEQ ID NO: 6479 - DNA, 25 bp, Mus musculus
agagcggcgaacatgttcaagatgg

SEQ ID NO: 6480 - DNA, 25 bp, Mus musculus
agagcgggactacggcccgcccatt

SEQ ID NO: 6481 - DNA, 25 bp, Mus musculus
agagcgtgggcctcgtacagcagca

SEQ ID NO: 6482 - DNA, 25 bp, Mus musculus
agagcgtggtgctttttctggtctc

SEQ ID NO: 6483 - DNA, 25 bp, Mus musculus
agagcgtgtaagtatgagaacccag

SEQ ID NO: 6484 - DNA, 25 bp, Mus musculus
agagctacagattggagctgatgat

SEQ ID NO: 6485 - DNA, 25 bp, Mus musculus
agagctacggaaccactagtgtgca

SEQ ID NO: 6486 - DNA, 25 bp, Mus musculus
agagctatgcccagcgccccatgtt

SEQ ID NO: 6487 - DNA, 25 bp, Mus musculus
agagctatgcgtttgatggttctca

SEQ ID NO: 6488 - DNA, 25 bp, Mus musculus
agagctcagggcaagcacaggcctt

SEQ ID NO: 6489 - DNA, 25 bp, Mus musculus
agagctcagtgctggaaagcctagt

SEQ ID NO: 6490 - DNA, 25 bp, Mus musculus
agagctcccgacaagcaggccgctg

SEQ ID NO: 6491 - DNA, 25 bp, Mus musculus
agagctccctctcagtctttacctg

SEQ ID NO: 6492 - DNA, 25 bp, Mus musculus
agagctcctggctcgggtgtgtcac

SEQ ID NO: 6493 - DNA, 25 bp, Mus musculus
agagctcggatttctataagtgtga

SEQ ID NO: 6494 - DNA, 25 bp, Mus musculus
agagctctgcggataaagagagact

SEQ ID NO: 6495 - DNA, 25 bp, Mus musculus
agagctcttagaaatcactgtgggc

SEQ ID NO: 6496 - DNA, 25 bp, Mus musculus
agagctgagcatttctctctggcag

SEQ ID NO: 6497 - DNA, 25 bp, Mus musculus
agagctgagcgaagtattggagaca

SEQ ID NO: 6498 - DNA, 25 bp, Mus musculus
agagctgcgagtggtgccagactct

SEQ ID NO: 6499 - DNA, 25 bp, Mus musculus
agagctgctcagtgatcaaggatga

SEQ ID NO: 6500 - DNA, 25 bp, Mus musculus
agagctgcttttcaatatgattccg

SEQ ID NO: 6501 - DNA, 25 bp, Mus musculus
agagctggatatcaagaagaatgag

SEQ ID NO: 6502 - DNA, 25 bp, Mus musculus
agagctggcaccacagaatctgggc

SEQ ID NO: 6503 - DNA, 25 bp, Mus musculus
agagcttcaagaaacagtcgtttgt

SEQ ID NO: 6504 - DNA, 25 bp, Mus musculus
agagcttcgggctgagcttgctaag

SEQ ID NO: 6505 - DNA, 25 bp, Mus musculus
agagcttgcagtgacctccccaaag

SEQ ID NO: 6506 - DNA, 25 bp, Mus musculus
agaggaaccgaagccaagtaccaca

SEQ ID NO: 6507 - DNA, 25 bp, Mus musculus
agaggaagacacatgtactattggg

SEQ ID NO: 6508 - DNA, 25 bp, Mus musculus
agaggaagccattacccactgctgc

SEQ ID NO: 6509 - DNA, 25 bp, Mus musculus
agaggaaggagtggcagtaccaaat

SEQ ID NO: 6510 - DNA, 25 bp, Mus musculus
agaggaatggcttcagtgataagat

SEQ ID NO: 6511 - DNA, 25 bp, Mus musculus
agaggaccgtgtggcacttgcagta

SEQ ID NO: 6512 - DNA, 25 bp, Mus musculus
agaggactagaaggagcggttccca

SEQ ID NO: 6513 - DNA, 25 bp, Mus musculus
agaggactggcagcaaccggtttgc

SEQ ID NO: 6514 - DNA, 25 bp, Mus musculus
agaggagcagcttctagcagtgcaa

SEQ ID NO: 6515 - DNA, 25 bp, Mus musculus
agaggagcagtcaggttcacaagaa

SEQ ID NO: 6516 - DNA, 25 bp, Mus musculus
agaggagcagttgtgcagccaagcc

SEQ ID NO: 6517 - DNA, 25 bp, Mus musculus
agaggagccatcctcacctgttagg

SEQ ID NO: 6518 - DNA, 25 bp, Mus musculus
agaggagctcatcaaagcccagaag

SEQ ID NO: 6519 - DNA, 25 bp, Mus musculus
agaggagctgctacagctgaaggtc

SEQ ID NO: 6520 - DNA, 25 bp, Mus musculus
agaggaggaaaaaggcttcagcttg

SEQ ID NO: 6521 - DNA, 25 bp, Mus musculus
agaggaggcctgactacccttgcct

SEQ ID NO: 6522 - DNA, 25 bp, Mus musculus
agaggaggcttttcagaccaagctt

SEQ ID NO: 6523 - DNA, 25 bp, Mus musculus
agaggatggtggtatatcagacagc

SEQ ID NO: 6524 - DNA, 25 bp, Mus musculus
agaggatgttcttggaaagggacaa

SEQ ID NO: 6525 - DNA, 25 bp, Mus musculus
agaggatttctaccgctccacggcg

SEQ ID NO: 6526 - DNA, 25 bp, Mus musculus
agaggcacaccccactgagcaagct

SEQ ID NO: 6527 - DNA, 25 bp, Mus musculus
agaggcaccatcacgcccattttgg

SEQ ID NO: 6528 - DNA, 25 bp, Mus musculus
agaggcacggactagatacttctcg

SEQ ID NO: 6529 - DNA, 25 bp, Mus musculus
agaggcagcctctcccgagacatgg

SEQ ID NO: 6530 - DNA, 25 bp, Mus musculus
agaggcaggtgtcccgttgccaccc

SEQ ID NO: 6531 - DNA, 25 bp, Mus musculus
agaggcatgccagcacacttctcgg

SEQ ID NO: 6532 - DNA, 25 bp, Mus musculus
agaggcattagaagccctgaaatgg

SEQ ID NO: 6533 - DNA, 25 bp, Mus musculus
agaggcattagatgccctgaaatgg

SEQ ID NO: 6534 - DNA, 25 bp, Mus musculus
agaggcattgaatcccatgtgagcc

SEQ ID NO: 6535 - DNA, 25 bp, Mus musculus
agaggcccacggactacctgcctga

SEQ ID NO: 6536 - DNA, 25 bp, Mus musculus
agaggcccatgaagccaggccagaa

SEQ ID NO: 6537 - DNA, 25 bp, Mus musculus
agaggccctggcacaagcagaagtc

SEQ ID NO: 6538 - DNA, 25 bp, Mus musculus
agaggccgaggttcagctactactg

SEQ ID NO: 6539 - DNA, 25 bp, Mus musculus
agaggccgattcctgactgccacct

SEQ ID NO: 6540 - DNA, 25 bp, Mus musculus
agaggcctccagaagagtatgacca

SEQ ID NO: 6541 - DNA, 25 bp, Mus musculus
agaggcctgtccctcagcagattta

SEQ ID NO: 6542 - DNA, 25 bp, Mus musculus
agaggcgaaggattgtggtccctcc

SEQ ID NO: 6543 - DNA, 25 bp, Mus musculus
agaggcggacccagagctggatcct

SEQ ID NO: 6544 - DNA, 25 bp, Mus musculus
agaggctctgtcagacgcgcctcga

SEQ ID NO: 6545 - DNA, 25 bp, Mus musculus
agaggctgacacgacccagactgtc

SEQ ID NO: 6546 - DNA, 25 bp, Mus musculus
agaggctgacctgccaatcccagag

SEQ ID NO: 6547 - DNA, 25 bp, Mus musculus
agaggctgggccgtgacttggacag

SEQ ID NO: 6548 - DNA, 25 bp, Mus musculus
agaggcttctggactacagcctgca

SEQ ID NO: 6549 - DNA, 25 bp, Mus musculus
agagggaagccaatgttgatgccgc

SEQ ID NO: 6550 - DNA, 25 bp, Mus musculus
agagggactcctgggaccgtcttgt

SEQ ID NO: 6551 - DNA, 25 bp, Mus musculus
agagggagaccaaagttatcaagga

SEQ ID NO: 6552 - DNA, 25 bp, Mus musculus
agagggagccacaaactcaggccaa

SEQ ID NO: 6553 - DNA, 25 bp, Mus musculus
agagggatttcataactgcactgcc

SEQ ID NO: 6554 - DNA, 25 bp, Mus musculus
agagggcagacaagcagtctgtgca

SEQ ID NO: 6555 - DNA, 25 bp, Mus musculus
agagggccatgggactagatctgca

SEQ ID NO: 6556 - DNA, 25 bp, Mus musculus
agagggcccatcatctctgacatcc

SEQ ID NO: 6557 - DNA, 25 bp, Mus musculus
agagggccctgcttccgttctgggc

SEQ ID NO: 6558 - DNA, 25 bp, Mus musculus
agagggcgtccgatccccaggattg

SEQ ID NO: 6559 - DNA, 25 bp, Mus musculus
agagggctccttcagctgtctgtgt

SEQ ID NO: 6560 - DNA, 25 bp, Mus musculus
agagggctccttgagctgtctgtgt

SEQ ID NO: 6561 - DNA, 25 bp, Mus musculus
agagggctggccactccagtgccta

SEQ ID NO: 6562 - DNA, 25 bp, Mus musculus
agagggctgtgtaccgagatatcac

SEQ ID NO: 6563 - DNA, 25 bp, Mus musculus
agagggcttcggtgatgccgcactc

SEQ ID NO: 6564 - DNA, 25 bp, Mus musculus
agagggctttggtttgagagcaaca

SEQ ID NO: 6565 - DNA, 25 bp, Mus musculus
agaggtactactagatcttccagta

SEQ ID NO: 6566 - DNA, 25 bp, Mus musculus
agaggtactacttgatcttccagta

SEQ ID NO: 6567 - DNA, 25 bp, Mus musculus
agaggtagccatggtgacaagcaga

SEQ ID NO: 6568 - DNA, 25 bp, Mus musculus
agaggtatttgagcagcgagctgaa

SEQ ID NO: 6569 - DNA, 25 bp, Mus musculus
agaggtccagagagactgactgtgt

SEQ ID NO: 6570 - DNA, 25 bp, Mus musculus
agaggtcctacaggaacaccaggga

SEQ ID NO: 6571 - DNA, 25 bp, Mus musculus
agaggtgacagctgccttgcgtgtc

SEQ ID NO: 6572 - DNA, 25 bp, Mus musculus
agaggtgatgctgatggctgacaaa

SEQ ID NO: 6573 - DNA, 25 bp, Mus musculus
agaggtggacgctgctcccaccgtg

SEQ ID NO: 6574 - DNA, 25 bp, Mus musculus
agaggtgttagctgcgggctctcca

SEQ ID NO: 6575 - DNA, 25 bp, Mus musculus
agaggtgtttctggcccagctggaa

SEQ ID NO: 6576 - DNA, 25 bp, Mus musculus
agagtaatgcggagcagcacgcaga

SEQ ID NO: 6577 - DNA, 25 bp, Mus musculus
agagtacacggccaagatcgcactg

SEQ ID NO: 6578 - DNA, 25 bp, Mus musculus
agagtacctttatcagctccaggag

SEQ ID NO: 6579 - DNA, 25 bp, Mus musculus
agagtatgattttggaagccaggag

SEQ ID NO: 6580 - DNA, 25 bp, Mus musculus
agagtatgctctggagccggccaca

SEQ ID NO: 6581 - DNA, 25 bp, Mus musculus
agagtatggcctcagaacctaccct

SEQ ID NO: 6582 - DNA, 25 bp, Mus musculus
agagtcagccccaccaatatgcagg

SEQ ID NO: 6583 - DNA, 25 bp, Mus musculus
agagtcagtgtcacaaaaccattta

SEQ ID NO: 6584 - DNA, 25 bp, Mus musculus
agagtcagtgtctcaaaaccattta

SEQ ID NO: 6585 - DNA, 25 bp, Mus musculus
agagtcgtgggctacttcgtgtccg

SEQ ID NO: 6586 - DNA, 25 bp, Mus musculus
agagtctctcaaggctgtcctccta

SEQ ID NO: 6587 - DNA, 25 bp, Mus musculus
agagtctggcaaaagcaccattgtg

SEQ ID NO: 6588 - DNA, 25 bp, Mus musculus
agagtgaacaggaaacgagtgatgc

SEQ ID NO: 6589 - DNA, 25 bp, Mus musculus
agagtgaacttcatcgggacaggag

SEQ ID NO: 6590 - DNA, 25 bp, Mus musculus
agagtgaacttcttcgggacaggag

SEQ ID NO: 6591 - DNA, 25 bp, Mus musculus
agagtgaagttcacgcgagtgctgc

SEQ ID NO: 6592 - DNA, 25 bp, Mus musculus
agagtgactctggagaagctgcccc

SEQ ID NO: 6593 - DNA, 25 bp, Mus musculus
agagtgagctcttggagatttcagg

SEQ ID NO: 6594 - DNA, 25 bp, Mus musculus
agagtgagttcagtttttacctaag

SEQ ID NO: 6595 - DNA, 25 bp, Mus musculus
agagtgcaaggtgttctccaagacc

SEQ ID NO: 6596 - DNA, 25 bp, Mus musculus
agagtgcccataacacagaacccct

SEQ ID NO: 6597 - DNA, 25 bp, Mus musculus
agagtgctgctgaagtcctccacgg

SEQ ID NO: 6598 - DNA, 25 bp, Mus musculus
agagtggaggatgctttttatacat

SEQ ID NO: 6599 - DNA, 25 bp, Mus musculus
agagtggcaatgagactgagcctgc

SEQ ID NO: 6600 - DNA, 25 bp, Mus musculus
agagtggcgatgacagcttcgatga

SEQ ID NO: 6601 - DNA, 25 bp, Mus musculus
agagtgggcccatgggcaatatcat

SEQ ID NO: 6602 - DNA, 25 bp, Mus musculus
agagtgggtgatgccaccaatattc

SEQ ID NO: 6603 - DNA, 25 bp, Mus musculus
agagtgtcagaattatgccaaggag

SEQ ID NO: 6604 - DNA, 25 bp, Mus musculus
agagtgtcttttggcgctttcttag

SEQ ID NO: 6605 - DNA, 25 bp, Mus musculus
agagtgtgtatgtgaccagcactag

SEQ ID NO: 6606 - DNA, 25 bp, Mus musculus
agagtgtgtttgaggtaccaagagc

SEQ ID NO: 6607 - DNA, 25 bp, Mus musculus
agagttatgtgagctcccagcccag

SEQ ID NO: 6608 - DNA, 25 bp, Mus musculus
agagttcaatcagaacaacggaaat

SEQ ID NO: 6609 - DNA, 25 bp, Mus musculus
agagttcgacgaggtgacagcagat

SEQ ID NO: 6610 - DNA, 25 bp, Mus musculus
agagtttccggacatctccttggga

SEQ ID NO: 6611 - DNA, 25 bp, Mus musculus
agagtttgaagaggtgattgaggac

SEQ ID NO: 6612 - DNA, 25 bp, Mus musculus
agagttttcggccaggtgacatagt

SEQ ID NO: 6613 - DNA, 25 bp, Mus musculus
agataaaaggaacagaacctcagac

SEQ ID NO: 6614 - DNA, 25 bp, Mus musculus
agataaacctgcaagtcccaagttt

SEQ ID NO: 6615 - DNA, 25 bp, Mus musculus
agataacaggcaccgcacccgtctt

SEQ ID NO: 6616 - DNA, 25 bp, Mus musculus
agataacttcaccttcaaatgccat

SEQ ID NO: 6617 - DNA, 25 bp, Mus musculus
agataagcctcgaagcagccttgcc

SEQ ID NO: 6618 - DNA, 25 bp, Mus musculus
agataaggttttcaacactgcctgg

SEQ ID NO: 6619 - DNA, 25 bp, Mus musculus
agataatcggacattcacactgaga

SEQ ID NO: 6620 - DNA, 25 bp, Mus musculus
agataatcggactttcacactgaga

SEQ ID NO: 6621 - DNA, 25 bp, Mus musculus
agataatgagcaccccttggttgca

SEQ ID NO: 6622 - DNA, 25 bp, Mus musculus
agataatgttctcgccaatgaggac

SEQ ID NO: 6623 - DNA, 25 bp, Mus musculus
agataatgttctggccaatgaggac

SEQ ID NO: 6624 - DNA, 25 bp, Mus musculus
agataattataagagggtcacaggc

SEQ ID NO: 6625 - DNA, 25 bp, Mus musculus
agatacacacaacgtagcctccttc

SEQ ID NO: 6626 - DNA, 25 bp, Mus musculus
agatacagccaagaccacggagagc

SEQ ID NO: 6627 - DNA, 25 bp, Mus musculus
agataccaccatgcctatacgtcga

SEQ ID NO: 6628 - DNA, 25 bp, Mus musculus
agataccagtgccaggcctgtgccc

SEQ ID NO: 6629 - DNA, 25 bp, Mus musculus
agataccagtgcgaggcctgtgccc

SEQ ID NO: 6630 - DNA, 25 bp, Mus musculus
agataccggcgccatgtccagcgct

SEQ ID NO: 6631 - DNA, 25 bp, Mus musculus
agatacgaaatatcccgccccactt

SEQ ID NO: 6632 - DNA, 25 bp, Mus musculus
agatacgtgcgaccctgtcacctga

SEQ ID NO: 6633 - DNA, 25 bp, Mus musculus
agatagacctttcccagggtgcagc

SEQ ID NO: 6634 - DNA, 25 bp, Mus musculus
agatagagaccatcaccatgattta

SEQ ID NO: 6635 - DNA, 25 bp, Mus musculus
agataggagccattggttgggataa

SEQ ID NO: 6636 - DNA, 25 bp, Mus musculus
agatagggcaccaaggacagagcaa

SEQ ID NO: 6637 - DNA, 25 bp, Mus musculus
agatagtcgtgtgggcgctccctgt

SEQ ID NO: 6638 - DNA, 25 bp, Mus musculus
agatatcacggagtatcagagcatt

SEQ ID NO: 6639 - DNA, 25 bp, Mus musculus
agatatccgagcaactgaaaaagac

SEQ ID NO: 6640 - DNA, 25 bp, Mus musculus
agatatgcaaagtaaacagggtgcc

SEQ ID NO: 6641 - DNA, 25 bp, Mus musculus
agatattcaagctgaaatctaccag

SEQ ID NO: 6642 - DNA, 25 bp, Mus musculus
agatatttgcagtgtagttggccaa

SEQ ID NO: 6643 - DNA, 25 bp, Mus musculus
agatcaaaaagagccggcgtcaccc

SEQ ID NO: 6644 - DNA, 25 bp, Mus musculus
agatcaaaacctattcctgggacaa

SEQ ID NO: 6645 - DNA, 25 bp, Mus musculus
agatcaagaagtccccactcaccat

SEQ ID NO: 6646 - DNA, 25 bp, Mus musculus
agatcaagaggaggagatgtgcttt

SEQ ID NO: 6647 - DNA, 25 bp, Mus musculus
agatcaatgaaggagaggtactctc

SEQ ID NO: 6648 - DNA, 25 bp, Mus musculus
agatcacaggcccaggatgctgccc

SEQ ID NO: 6649 - DNA, 25 bp, Mus musculus
agatcaccgaggagaagccgctgtt

SEQ ID NO: 6650 - DNA, 25 bp, Mus musculus
agatcacggattagtcaaccttagg

SEQ ID NO: 6651 - DNA, 25 bp, Mus musculus
agatcactagtttggcttacgaaat

SEQ ID NO: 6652 - DNA, 25 bp, Mus musculus
agatcatccctggtgctaagcatgg

SEQ ID NO: 6653 - DNA, 25 bp, Mus musculus
agatcatgagtcctttggccaaatg

SEQ ID NO: 6654 - DNA, 25 bp, Mus musculus
agatcattagcagtgattctaaggg

SEQ ID NO: 6655 - DNA, 25 bp, Mus musculus
agatccagctgaaagaggccaagca

SEQ ID NO: 6656 - DNA, 25 bp, Mus musculus
agatccccagatatgtgttattgag

SEQ ID NO: 6657 - DNA, 25 bp, Mus musculus
agatccctctcacaggcttcgtggc

SEQ ID NO: 6658 - DNA, 25 bp, Mus musculus
agatccctgacgacatgggatcaaa

SEQ ID NO: 6659 - DNA, 25 bp, Mus musculus
agatcctcacccgagatgccaaggg

SEQ ID NO: 6660 - DNA, 25 bp, Mus musculus
agatcctctctcacctttgcaatcg

SEQ ID NO: 6661 - DNA, 25 bp, Mus musculus
agatcctgatgccattcctagtcca

SEQ ID NO: 6662 - DNA, 25 bp, Mus musculus
agatcctgcctttcgagctgaaggg

SEQ ID NO: 6663 - DNA, 25 bp, Mus musculus
agatcctggaggctgtgctacactg

SEQ ID NO: 6664 - DNA, 25 bp, Mus musculus
agatccttttaaaatctgggcccag

SEQ ID NO: 6665 - DNA, 25 bp, Mus musculus
agatcgatgctgcagccgaactcat

SEQ ID NO: 6666 - DNA, 25 bp, Mus musculus
agatcgcccaggtacacagcaaggc

SEQ ID NO: 6667 - DNA, 25 bp, Mus musculus
agatctaaagctggaaaacataatg

SEQ ID NO: 6668 - DNA, 25 bp, Mus musculus
agatctagcctcaggtccattccag

SEQ ID NO: 6669 - DNA, 25 bp, Mus musculus
agatctcattaaatgcagaatgcag

SEQ ID NO: 6670 - DNA, 25 bp, Mus musculus
agatctccgttgctctctgctgcgc

SEQ ID NO: 6671 - DNA, 25 bp, Mus musculus
agatctctatggctcacagatgtgc

SEQ ID NO: 6672 - DNA, 25 bp, Mus musculus
agatctctcaagaatgacagcctgg

SEQ ID NO: 6673 - DNA, 25 bp, Mus musculus
agatctctcctttcagaaggacggg

SEQ ID NO: 6674 - DNA, 25 bp, Mus musculus
agatctgccaacctgtgcgcctggg

SEQ ID NO: 6675 - DNA, 25 bp, Mus musculus
agatctgcgacaagtacctcccagg

SEQ ID NO: 6676 - DNA, 25 bp, Mus musculus
agatctggctctcccatccacatag

SEQ ID NO: 6677 - DNA, 25 bp, Mus musculus
agatctgggactcttcgcttttgga

SEQ ID NO: 6678 - DNA, 25 bp, Mus musculus
agatctggtgctttggccctgatgg

SEQ ID NO: 6679 - DNA, 25 bp, Mus musculus
agatctgtggatctgtactgcccag

SEQ ID NO: 6680 - DNA, 25 bp, Mus musculus
agatctgtttgctcagcttcacgtc

SEQ ID NO: 6681 - DNA, 25 bp, Mus musculus
agatcttatagcagtcggtttaaag

SEQ ID NO: 6682 - DNA, 25 bp, Mus musculus
agatcttcttgtctcagagagcagt

SEQ ID NO: 6683 - DNA, 25 bp, Mus musculus
agatgaacagattttgccagggaga

SEQ ID NO: 6684 - DNA, 25 bp, Mus musculus
agatgaactggcagacttggagaca

SEQ ID NO: 6685 - DNA, 25 bp, Mus musculus
agatgaaggcccaggctcgggagga

SEQ ID NO: 6686 - DNA, 25 bp, Mus musculus
agatgaataagaagcgcgaggccga

SEQ ID NO: 6687 - DNA, 25 bp, Mus musculus
agatgacacctttctaacagctcaa

SEQ ID NO: 6688 - DNA, 25 bp, Mus musculus
agatgacatccttgtggcctcggca

SEQ ID NO: 6689 - DNA, 25 bp, Mus musculus
agatgacatgttgtgtgcaggagat

SEQ ID NO: 6690 - DNA, 25 bp, Mus musculus
agatgacccctagttcttcctatgg

SEQ ID NO: 6691 - DNA, 25 bp, Mus musculus
agatgaccgcactgaaggaggaaag

SEQ ID NO: 6692 - DNA, 25 bp, Mus musculus
agatgacgcggcaggtagaccactt

SEQ ID NO: 6693 - DNA, 25 bp, Mus musculus
agatgacggaggtgctgccaaacca

SEQ ID NO: 6694 - DNA, 25 bp, Mus musculus
agatgactccatccggtacccatac

SEQ ID NO: 6695 - DNA, 25 bp, Mus musculus
agatgagcgaggaggccgacatcct

SEQ ID NO: 6696 - DNA, 25 bp, Mus musculus
agatgagcgtgtgaacctgctgtcc

SEQ ID NO: 6697 - DNA, 25 bp, Mus musculus
agatgagcttcccagccgtggactg

SEQ ID NO: 6698 - DNA, 25 bp, Mus musculus
agatgagtccccaaagaaaagtgct

SEQ ID NO: 6699 - DNA, 25 bp, Mus musculus
agatgagttccttcagtcctgacag

SEQ ID NO: 6700 - DNA, 25 bp, Mus musculus
agatgagttgagtggagatgcttct

SEQ ID NO: 6701 - DNA, 25 bp, Mus musculus
agatgatggctgacatgtacaacag

SEQ ID NO: 6702 - DNA, 25 bp, Mus musculus
agatgattctctgttgccagcgcca

SEQ ID NO: 6703 - DNA, 25 bp, Mus musculus
agatgatttggtagaagcgcttccc

SEQ ID NO: 6704 - DNA, 25 bp, Mus musculus
agatgcaatatctcagcccattctt

SEQ ID NO: 6705 - DNA, 25 bp, Mus musculus
agatgcacaggtgcgccttgaagag

SEQ ID NO: 6706 - DNA, 25 bp, Mus musculus
agatgcagcgcatgctcagccagct

SEQ ID NO: 6707 - DNA, 25 bp, Mus musculus
agatgccacccaagtttatatagca

SEQ ID NO: 6708 - DNA, 25 bp, Mus musculus
agatgccagcgactgcatatgaaag

SEQ ID NO: 6709 - DNA, 25 bp, Mus musculus
agatgccgctcatgccattgtccca

SEQ ID NO: 6710 - DNA, 25 bp, Mus musculus
agatgcctactatcagactcttcat

SEQ ID NO: 6711 - DNA, 25 bp, Mus musculus
agatgcgcatcctgatggtgggcct

SEQ ID NO: 6712 - DNA, 25 bp, Mus musculus
agatgcgggatcagtacgagaagat

SEQ ID NO: 6713 - DNA, 25 bp, Mus musculus
agatgctctcagctttttatgaggg

SEQ ID NO: 6714 - DNA, 25 bp, Mus musculus
agatgctgaccggaagtatgaagag

SEQ ID NO: 6715 - DNA, 25 bp, Mus musculus
agatgctgaggatgcgatctatgga

SEQ ID NO: 6716 - DNA, 25 bp, Mus musculus
agatggaactgcttcatccactggg

SEQ ID NO: 6717 - DNA, 25 bp, Mus musculus
agatggacagagacgtacgtgcgct

SEQ ID NO: 6718 - DNA, 25 bp, Mus musculus
agatggacattcaggctgcagctgt

SEQ ID NO: 6719 - DNA, 25 bp, Mus musculus
agatggaccccagctgtaccgtggg

SEQ ID NO: 6720 - DNA, 25 bp, Mus musculus
agatggagaacctggtacccctgga

SEQ ID NO: 6721 - DNA, 25 bp, Mus musculus
agatggatggcctttgaggacgtgg

SEQ ID NO: 6722 - DNA, 25 bp, Mus musculus
agatggcagaacactcccactgcag

SEQ ID NO: 6723 - DNA, 25 bp, Mus musculus
agatggccagtcaggtggcaagtcc

SEQ ID NO: 6724 - DNA, 25 bp, Mus musculus
agatggcgcaagtctcattcctcca

SEQ ID NO: 6725 - DNA, 25 bp, Mus musculus
agatggctgaggaccctgattcaat

SEQ ID NO: 6726 - DNA, 25 bp, Mus musculus
agatggctgggctgaatgctatcca

SEQ ID NO: 6727 - DNA, 25 bp, Mus musculus
agatggctgtggtggatatctatca

SEQ ID NO: 6728 - DNA, 25 bp, Mus musculus
agatgggccgcatcctacagcgcac

SEQ ID NO: 6729 - DNA, 25 bp, Mus musculus
agatgggctctgaggcgcacgtcaa

SEQ ID NO: 6730 - DNA, 25 bp, Mus musculus
agatggtaccttggatgatggtgaa

SEQ ID NO: 6731 - DNA, 25 bp, Mus musculus
agatggtagctgtaaaacatctggg

SEQ ID NO: 6732 - DNA, 25 bp, Mus musculus
agatggtcagaaggacaactggagc

SEQ ID NO: 6733 - DNA, 25 bp, Mus musculus
agatgtagctaaaaagagttcagga

SEQ ID NO: 6734 - DNA, 25 bp, Mus musculus
agatgtcatcatgagggaattccga

SEQ ID NO: 6735 - DNA, 25 bp, Mus musculus
agatgtcccactttgtgtccaatgg

SEQ ID NO: 6736 - DNA, 25 bp, Mus musculus
agatgtctaagggacacatgttggc

SEQ ID NO: 6737 - DNA, 25 bp, Mus musculus
agatgtgagagctctgtgtcatctg

SEQ ID NO: 6738 - DNA, 25 bp, Mus musculus
agatgtggttgctgtctccaggaat

SEQ ID NO: 6739 - DNA, 25 bp, Mus musculus
agatgttctgcatgactaagagaag

SEQ ID NO: 6740 - DNA, 25 bp, Mus musculus
agatgttgcttgacagatccgcccc

SEQ ID NO: 6741 - DNA, 25 bp, Mus musculus
agatgttgtggagacattgctacag

SEQ ID NO: 6742 - DNA, 25 bp, Mus musculus
agattacagggccaagggagaccca

SEQ ID NO: 6743 - DNA, 25 bp, Mus musculus
agattagagctcagatgggcattgg

SEQ ID NO: 6744 - DNA, 25 bp, Mus musculus
agattataccattctctcggcccgg

SEQ ID NO: 6745 - DNA, 25 bp, Mus musculus
agattatatttctagagctgagtct

SEQ ID NO: 6746 - DNA, 25 bp, Mus musculus
agattatccaggctaaccccgctct

SEQ ID NO: 6747 - DNA, 25 bp, Mus musculus
agattatctcggagccttgcttcaa

SEQ ID NO: 6748 - DNA, 25 bp, Mus musculus
agattccaaggaggccacgccatga

SEQ ID NO: 6749 - DNA, 25 bp, Mus musculus
agattcctcagagccatattcagca

SEQ ID NO: 6750 - DNA, 25 bp, Mus musculus
agattccttgaacagacaaagcaag

SEQ ID NO: 6751 - DNA, 25 bp, Mus musculus
agattcggtcctatgtgtacgctga

SEQ ID NO: 6752 - DNA, 25 bp, Mus musculus
agattctggtcactggatcctctgg

SEQ ID NO: 6753 - DNA, 25 bp, Mus musculus
agattgaactggcttgtgactccca

SEQ ID NO: 6754 - DNA, 25 bp, Mus musculus
agattgacggccgtggtgaccacca

SEQ ID NO: 6755 - DNA, 25 bp, Mus musculus
agattgagatgctcttgaaggacga

SEQ ID NO: 6756 - DNA, 25 bp, Mus musculus
agattgaggttctctatattcggaa

SEQ ID NO: 6757 - DNA, 25 bp, Mus musculus
agattgcagatgtgtttgcccaaat

SEQ ID NO: 6758 - DNA, 25 bp, Mus musculus
agattgccagcgtttctgaaccaag

SEQ ID NO: 6759 - DNA, 25 bp, Mus musculus
agattgccatcgtgacggagagccg

SEQ ID NO: 6760 - DNA, 25 bp, Mus musculus
agattgcccagaagagcccctcctg

SEQ ID NO: 6761 - DNA, 25 bp, Mus musculus
agattgctgcgtactctccgctgcc

SEQ ID NO: 6762 - DNA, 25 bp, Mus musculus
agattgctggcctccatttgaccaa

SEQ ID NO: 6763 - DNA, 25 bp, Mus musculus
agattggcatctcggtggaattgtt

SEQ ID NO: 6764 - DNA, 25 bp, Mus musculus
agattggcccgcagattggaggatc

SEQ ID NO: 6765 - DNA, 25 bp, Mus musculus
agattggctgcttgttgcgcctgga

SEQ ID NO: 6766 - DNA, 25 bp, Mus musculus
agattgtgagatcaagcaccttgga

SEQ ID NO: 6767 - DNA, 25 bp, Mus musculus
agattgtggctcttgtgggccagtc

SEQ ID NO: 6768 - DNA, 25 bp, Mus musculus
agattgtgttgcctcctagtggaca

SEQ ID NO: 6769 - DNA, 25 bp, Mus musculus
agatttacaccgagctctgacttcc

SEQ ID NO: 6770 - DNA, 25 bp, Mus musculus
agatttctgcacacacctccctaac

SEQ ID NO: 6771 - DNA, 25 bp, Mus musculus
agatttgtgggcattggctggaaca

SEQ ID NO: 6772 - DNA, 25 bp, Mus musculus
agatttgtgggctttggctggaaca

SEQ ID NO: 6773 - DNA, 25 bp, Mus musculus
agattttcaccgactccctaatgag

SEQ ID NO: 6774 - DNA, 25 bp, Mus musculus
agattttcaccgtctccctaatgag

SEQ ID NO: 6775 - DNA, 25 bp, Mus musculus
agatttttcaagaaagaagtgcctg

SEQ ID NO: 6776 - DNA, 25 bp, Mus musculus
agcaaaacagtgtgcctccctcaca

SEQ ID NO: 6777 - DNA, 25 bp, Mus musculus
agcaaaacgctccactgcaagtgca

SEQ ID NO: 6778 - DNA, 25 bp, Mus musculus
agcaaaagcgactcagtagtctttc

SEQ ID NO: 6779 - DNA, 25 bp, Mus musculus
agcaaacagaccatcgcggcgatct

SEQ ID NO: 6780 - DNA, 25 bp, Mus musculus
agcaaaggcacagatcaattcctca

SEQ ID NO: 6781 - DNA, 25 bp, Mus musculus
agcaaagttgaccagtccctccata

SEQ ID NO: 6782 - DNA, 25 bp, Mus musculus
agcaaatgccattacttagtggatt

SEQ ID NO: 6783 - DNA, 25 bp, Mus musculus
agcaaatgtgctggccgatgcctct

SEQ ID NO: 6784 - DNA, 25 bp, Mus musculus
agcaacaaaaggtcacaagcagtag

SEQ ID NO: 6785 - DNA, 25 bp, Mus musculus
agcaacaactcctgcaacaagtgtc

SEQ ID NO: 6786 - DNA, 25 bp, Mus musculus
agcaacagaggcagagactgggaca

SEQ ID NO: 6787 - DNA, 25 bp, Mus musculus
agcaacagctggacaagccggtgct

SEQ ID NO: 6788 - DNA, 25 bp, Mus musculus
agcaacccatagaacccgggaggag

SEQ ID NO: 6789 - DNA, 25 bp, Mus musculus
agcaaccgtcgtatcctgaacaagg

SEQ ID NO: 6790 - DNA, 25 bp, Mus musculus
agcaacctccccagatgggtcgtca

SEQ ID NO: 6791 - DNA, 25 bp, Mus musculus
agcaacggatgcacaggctgctggc

SEQ ID NO: 6792 - DNA, 25 bp, Mus musculus
agcaacgtggactccctgccgggct

SEQ ID NO: 6793 - DNA, 25 bp, Mus musculus
agcaactagaggtatttcaaagaga

SEQ ID NO: 6794 - DNA, 25 bp, Mus musculus
agcaactatgatagcaagccctgga

SEQ ID NO: 6795 - DNA, 25 bp, Mus musculus
agcaactggtggatggtttcctagc

SEQ ID NO: 6796 - DNA, 25 bp, Mus musculus
agcaacttcatcagtcccaacatga

SEQ ID NO: 6797 - DNA, 25 bp, Mus musculus
agcaagaaattcagttatcaaccac

SEQ ID NO: 6798 - DNA, 25 bp, Mus musculus
agcaagaatgtgtgcccttaatgaa

SEQ ID NO: 6799 - DNA, 25 bp, Mus musculus
agcaagaggaggacctatgctggcc

SEQ ID NO: 6800 - DNA, 25 bp, Mus musculus
agcaagcaagggtccgtccctttgc

SEQ ID NO: 6801 - DNA, 25 bp, Mus musculus
agcaagccagcgaatcgggaggctt

SEQ ID NO: 6802 - DNA, 25 bp, Mus musculus
agcaagccagcgtatcgggaggctt

SEQ ID NO: 6803 - DNA, 25 bp, Mus musculus
agcaagcctcgcctgtcctacaatg

SEQ ID NO: 6804 - DNA, 25 bp, Mus musculus
agcaagcgtcttggcatagcagtga

SEQ ID NO: 6805 - DNA, 25 bp, Mus musculus
agcaagctcaattataagccacccc

SEQ ID NO: 6806 - DNA, 25 bp, Mus musculus
agcaagctcttttgtcatctctttg

SEQ ID NO: 6807 - DNA, 25 bp, Mus musculus
agcaagctgaattggaagactcccc

SEQ ID NO: 6808 - DNA, 25 bp, Mus musculus
agcaagctgtctgtgatccacagag

SEQ ID NO: 6809 - DNA, 25 bp, Mus musculus
agcaaggatgccctgcgaaggcacc

SEQ ID NO: 6810 - DNA, 25 bp, Mus musculus
agcaaggatggctcgggcttcctca

SEQ ID NO: 6811 - DNA, 25 bp, Mus musculus
agcaagtccgggtcctgctcttcag

SEQ ID NO: 6812 - DNA, 25 bp, Mus musculus
agcaagtctgcgtcccggccagacg

SEQ ID NO: 6813 - DNA, 25 bp, Mus musculus
agcaagtgaaggcaagaaatggctc

SEQ ID NO: 6814 - DNA, 25 bp, Mus musculus
agcaagtgccagaggctcttccgct

SEQ ID NO: 6815 - DNA, 25 bp, Mus musculus
agcaagtgctaagacaggcaggtcc

SEQ ID NO: 6816 - DNA, 25 bp, Mus musculus
agcaagttttccttaacacctgcag

SEQ ID NO: 6817 - DNA, 25 bp, Mus musculus
agcaatcaatctttggaatccagag

SEQ ID NO: 6818 - DNA, 25 bp, Mus musculus
agcaatcagaagtgaccacagagag

SEQ ID NO: 6819 - DNA, 25 bp, Mus musculus
agcaatccaatgagcaccttcgccg

SEQ ID NO: 6820 - DNA, 25 bp, Mus musculus
agcaatgaattggtggcctagcaac

SEQ ID NO: 6821 - DNA, 25 bp, Mus musculus
agcaatgacctgatgttactacgcc

SEQ ID NO: 6822 - DNA, 25 bp, Mus musculus
agcacaagaagctgacccaggccat

SEQ ID NO: 6823 - DNA, 25 bp, Mus musculus
agcacaagccactcacgcgctggaa

SEQ ID NO: 6824 - DNA, 25 bp, Mus musculus
agcacaccttcacccaacatgttta

SEQ ID NO: 6825 - DNA, 25 bp, Mus musculus
agcacaccttcagccaacatgttta

SEQ ID NO: 6826 - DNA, 25 bp, Mus musculus
agcacactcgaaggaaggactcccg

SEQ ID NO: 6827 - DNA, 25 bp, Mus musculus
agcacagcactcatagttcccatag

SEQ ID NO: 6828 - DNA, 25 bp, Mus musculus
agcacagccctcagcatcaacgagg

SEQ ID NO: 6829 - DNA, 25 bp, Mus musculus
agcacagccgcctcagagctttggc

SEQ ID NO: 6830 - DNA, 25 bp, Mus musculus
agcacaggctacacactggacactc

SEQ ID NO: 6831 - DNA, 25 bp, Mus musculus
agcacaggctggtgctgctcgagaa

SEQ ID NO: 6832 - DNA, 25 bp, Mus musculus
agcacatgcagtcgacatcaatggc

SEQ ID NO: 6833 - DNA, 25 bp, Mus musculus
agcacatgcagtggacatcaatggc

SEQ ID NO: 6834 - DNA, 25 bp, Mus musculus
agcacatgcctagcctcaggctggg

SEQ ID NO: 6835 - DNA, 25 bp, Mus musculus
agcaccacatgatcagctttgtgga

SEQ ID NO: 6836 - DNA, 25 bp, Mus musculus
agcaccatggcccacgttgccttga

SEQ ID NO: 6837 - DNA, 25 bp, Mus musculus
agcacccagtccagacacagctaag

SEQ ID NO: 6838 - DNA, 25 bp, Mus musculus
agcacccagtcctgacacagctaag

SEQ ID NO: 6839 - DNA, 25 bp, Mus musculus
agcacccagttctggtctgcacagc

SEQ ID NO: 6840 - DNA, 25 bp, Mus musculus
agcacccctatttccaggtgcagag

SEQ ID NO: 6841 - DNA, 25 bp, Mus musculus
agcacccggaggatggacgatgact

SEQ ID NO: 6842 - DNA, 25 bp, Mus musculus
agcaccctggtctcaatggcgcagt

SEQ ID NO: 6843 - DNA, 25 bp, Mus musculus
agcaccctgtgcctgtccttggaca

SEQ ID NO: 6844 - DNA, 25 bp, Mus musculus
agcaccctgtgcgtgtccttggaca

SEQ ID NO: 6845 - DNA, 25 bp, Mus musculus
agcacccttgggaaaggagagtcta

SEQ ID NO: 6846 - DNA, 25 bp, Mus musculus
agcaccctttgccatgatgagccac

SEQ ID NO: 6847 - DNA, 25 bp, Mus musculus
agcaccgaaaaggagatcctgcctc

SEQ ID NO: 6848 - DNA, 25 bp, Mus musculus
agcaccgccactctgcctgagaatg

SEQ ID NO: 6849 - DNA, 25 bp, Mus musculus
agcaccgcgaggctgagtactacgt

SEQ ID NO: 6850 - DNA, 25 bp, Mus musculus
agcaccgcgggaaaaagagcaccgg

SEQ ID NO: 6851 - DNA, 25 bp, Mus musculus
agcaccggcgccaagtcagggagca

SEQ ID NO: 6852 - DNA, 25 bp, Mus musculus
agcacctcttctcagccagccacac

SEQ ID NO: 6853 - DNA, 25 bp, Mus musculus
agcacctggagaagagtgccgtact

SEQ ID NO: 6854 - DNA, 25 bp, Mus musculus
agcaccttcagagcttgcaccagaa

SEQ ID NO: 6855 - DNA, 25 bp, Mus musculus
agcaccttcaggacgctcgctgtcg

SEQ ID NO: 6856 - DNA, 25 bp, Mus musculus
agcaccttcaggtcgctcgctgtcg

SEQ ID NO: 6857 - DNA, 25 bp, Mus musculus
agcaccttgagatacacacagccac

SEQ ID NO: 6858 - DNA, 25 bp, Mus musculus
agcaccttggccgtcgggaaatgac

SEQ ID NO: 6859 - DNA, 25 bp, Mus musculus
agcacgagtgcttccaggaggagct

SEQ ID NO: 6860 - DNA, 25 bp, Mus musculus
agcacgggcaactgctgcatccagc

SEQ ID NO: 6861 - DNA, 25 bp, Mus musculus
agcacgttgccttgtggaggaactt

SEQ ID NO: 6862 - DNA, 25 bp, Mus musculus
agcactaccgggacctacagaggaa

SEQ ID NO: 6863 - DNA, 25 bp, Mus musculus
agcactatttctttcattacctgga

SEQ ID NO: 6864 - DNA, 25 bp, Mus musculus
agcactcagactatgtgcacctctg

SEQ ID NO: 6865 - DNA, 25 bp, Mus musculus
agcactctcctgatctaatgagttt

SEQ ID NO: 6866 - DNA, 25 bp, Mus musculus
agcactgaacaaaaccactccattg

SEQ ID NO: 6867 - DNA, 25 bp, Mus musculus
agcactgaagcaacacaaaaccctc

SEQ ID NO: 6868 - DNA, 25 bp, Mus musculus
agcactgactcctgtaggtgtcctc

SEQ ID NO: 6869 - DNA, 25 bp, Mus musculus
agcactgcacctgatgaaccgcgtt

SEQ ID NO: 6870 - DNA, 25 bp, Mus musculus
agcactggcactacatcagctttgg

SEQ ID NO: 6871 - DNA, 25 bp, Mus musculus
agcactgttattccttgccgccatc

SEQ ID NO: 6872 - DNA, 25 bp, Mus musculus
agcacttctgcacctcgggagcctg

SEQ ID NO: 6873 - DNA, 25 bp, Mus musculus
agcactttgcgtcaccttaccctag

SEQ ID NO: 6874 - DNA, 25 bp, Mus musculus
agcagaaagagctgcagcgagctgc

SEQ ID NO: 6875 - DNA, 25 bp, Mus musculus
agcagaaagcctcctacagctcggg

SEQ ID NO: 6876 - DNA, 25 bp, Mus musculus
agcagaaaggctatggccatgggca

SEQ ID NO: 6877 - DNA, 25 bp, Mus musculus
agcagaaatcctgggaatcaaatta

SEQ ID NO: 6878 - DNA, 25 bp, Mus musculus
agcagaaatggtgtcaacctgtcag

SEQ ID NO: 6879 - DNA, 25 bp, Mus musculus
agcagaacatcactggctccagctc

SEQ ID NO: 6880 - DNA, 25 bp, Mus musculus
agcagaagcaccacttacctctaga

SEQ ID NO: 6881 - DNA, 25 bp, Mus musculus
agcagaagtgaggatgcaagcaact

SEQ ID NO: 6882 - DNA, 25 bp, Mus musculus
agcagaatacggactttccaaccag

SEQ ID NO: 6883 - DNA, 25 bp, Mus musculus
agcagacactgcagcacgggcagcg

SEQ ID NO: 6884 - DNA, 25 bp, Mus musculus
agcagacatgaaccgactcatcatg

SEQ ID NO: 6885 - DNA, 25 bp, Mus musculus
agcagaccagagcagcctcatggaa

SEQ ID NO: 6886 - DNA, 25 bp, Mus musculus
agcagacttctgacgcccacacatt

SEQ ID NO: 6887 - DNA, 25 bp, Mus musculus
agcagagacagaggcctattttggg

SEQ ID NO: 6888 - DNA, 25 bp, Mus musculus
agcagagcagtagattggcaaaata

SEQ ID NO: 6889 - DNA, 25 bp, Mus musculus
agcagagcagtgtgaaccagtggcc

SEQ ID NO: 6890 - DNA, 25 bp, Mus musculus
agcagagccctctctccctttagtg

SEQ ID NO: 6891 - DNA, 25 bp, Mus musculus
agcagagctcctccttgtccggcag

SEQ ID NO: 6892 - DNA, 25 bp, Mus musculus
agcagaggaagggaacagcacatct

SEQ ID NO: 6893 - DNA, 25 bp, Mus musculus
agcagaggagcacgcagctgaacaa

SEQ ID NO: 6894 - DNA, 25 bp, Mus musculus
agcagaggagcctccggccacagct

SEQ ID NO: 6895 - DNA, 25 bp, Mus musculus
agcagaggagttatgttatacctcc

SEQ ID NO: 6896 - DNA, 25 bp, Mus musculus
agcagaggcagagtctcgaaccggc

SEQ ID NO: 6897 - DNA, 25 bp, Mus musculus
agcagaggtactggctttgcaggca

SEQ ID NO: 6898 - DNA, 25 bp, Mus musculus
agcagaggttccaggcacgcacagc

SEQ ID NO: 6899 - DNA, 25 bp, Mus musculus
agcagataagattccctcctcgatc

SEQ ID NO: 6900 - DNA, 25 bp, Mus musculus
agcagatgtggacactgacagcaga

SEQ ID NO: 6901 - DNA, 25 bp, Mus musculus
agcagatgtggagactgacagcaga

SEQ ID NO: 6902 - DNA, 25 bp, Mus musculus
agcagatgtgtgagatcttctattc

SEQ ID NO: 6903 - DNA, 25 bp, Mus musculus
agcagattgctgtcatgagaggcca

SEQ ID NO: 6904 - DNA, 25 bp, Mus musculus
agcagcaaaagcgactcagtagtct

SEQ ID NO: 6905 - DNA, 25 bp, Mus musculus
agcagcaaatcctattgagtctcag

SEQ ID NO: 6906 - DNA, 25 bp, Mus musculus
agcagcaacagcagatactgcagct

SEQ ID NO: 6907 - DNA, 25 bp, Mus musculus
agcagcaacagccaggatgacctgg

SEQ ID NO: 6908 - DNA, 25 bp, Mus musculus
agcagcaacagcctgccaggactca

SEQ ID NO: 6909 - DNA, 25 bp, Mus musculus
agcagcaagacgctggctgttccac

SEQ ID NO: 6910 - DNA, 25 bp, Mus musculus
agcagcaagcaagggtccgtccctt

SEQ ID NO: 6911 - DNA, 25 bp, Mus musculus
agcagcaagctgttcccgcggcagc

SEQ ID NO: 6912 - DNA, 25 bp, Mus musculus
agcagcaatccaatgagcaccttcg

SEQ ID NO: 6913 - DNA, 25 bp, Mus musculus
agcagcaccagctcatccaggaggc

SEQ ID NO: 6914 - DNA, 25 bp, Mus musculus
agcagcacttgcttggactatacga

SEQ ID NO: 6915 - DNA, 25 bp, Mus musculus
agcagcagaggagcaccaggatcgt

SEQ ID NO: 6916 - DNA, 25 bp, Mus musculus
agcagcagagggtggtatttccaga

SEQ ID NO: 6917 - DNA, 25 bp, Mus musculus
agcagcagcctagaagacgctagca

SEQ ID NO: 6918 - DNA, 25 bp, Mus musculus
agcagcaggacgtacagggcatgtc

SEQ ID NO: 6919 - DNA, 25 bp, Mus musculus
agcagcaggcacagcggctggagca

SEQ ID NO: 6920 - DNA, 25 bp, Mus musculus
agcagcatacgttctactgccaaga

SEQ ID NO: 6921 - DNA, 25 bp, Mus musculus
agcagcatcacagactccactatgt

SEQ ID NO: 6922 - DNA, 25 bp, Mus musculus
agcagcatgagggtcagcactacag

SEQ ID NO: 6923 - DNA, 25 bp, Mus musculus
agcagcatgccgagtgacctgtcca

SEQ ID NO: 6924 - DNA, 25 bp, Mus musculus
agcagcatgtcaagggtcaccagca

SEQ ID NO: 6925 - DNA, 25 bp, Mus musculus
agcagcattgggactattctcaagt

SEQ ID NO: 6926 - DNA, 25 bp, Mus musculus
agcagcatttgggattggaacaaga

SEQ ID NO: 6927 - DNA, 25 bp, Mus musculus
agcagccagtgttttccattgtacc

SEQ ID NO: 6928 - DNA, 25 bp, Mus musculus
agcagccatcaactgtgtgcggtcc

SEQ ID NO: 6929 - DNA, 25 bp, Mus musculus
agcagcccagagaggcccaagggat

SEQ ID NO: 6930 - DNA, 25 bp, Mus musculus
agcagccccggcatgacctcaggga

SEQ ID NO: 6931 - DNA, 25 bp, Mus musculus
agcagcccggatgcgggatacgcca

SEQ ID NO: 6932 - DNA, 25 bp, Mus musculus
agcagccctgtgagcccccaggaat

SEQ ID NO: 6933 - DNA, 25 bp, Mus musculus
agcagcctctgggttccattcaagc

SEQ ID NO: 6934 - DNA, 25 bp, Mus musculus
agcagcgacttcctggtggtgaaca

SEQ ID NO: 6935 - DNA, 25 bp, Mus musculus
agcagcgccgtttccgactggaacg

SEQ ID NO: 6936 - DNA, 25 bp, Mus musculus
agcagcggccgttcacaaggatgct

SEQ ID NO: 6937 - DNA, 25 bp, Mus musculus
agcagcgtcaaggaaaggctccggc

SEQ ID NO: 6938 - DNA, 25 bp, Mus musculus
agcagctaccagaacccagtcagga

SEQ ID NO: 6939 - DNA, 25 bp, Mus musculus
agcagctatactcggacagcattta

SEQ ID NO: 6940 - DNA, 25 bp, Mus musculus
agcagctatactgggacagcattta

SEQ ID NO: 6941 - DNA, 25 bp, Mus musculus
agcagctcaagatcaaccggctggc

SEQ ID NO: 6942 - DNA, 25 bp, Mus musculus
agcagctgcaccaagtgaggacgga

SEQ ID NO: 6943 - DNA, 25 bp, Mus musculus
agcagctgctgaatgtcaaggccca

SEQ ID NO: 6944 - DNA, 25 bp, Mus musculus
agcagctggcaatcatccagattca

SEQ ID NO: 6945 - DNA, 25 bp, Mus musculus
agcagctgggcatgatcgagaagct

SEQ ID NO: 6946 - DNA, 25 bp, Mus musculus
agcagcttcgagtggatgctctgga

SEQ ID NO: 6947 - DNA, 25 bp, Mus musculus
agcaggaagacatacctgtacttct

SEQ ID NO: 6948 - DNA, 25 bp, Mus musculus
agcaggagcctctaaaggctgggcc

SEQ ID NO: 6949 - DNA, 25 bp, Mus musculus
agcaggatacaaagcagccatagtt

SEQ ID NO: 6950 - DNA, 25 bp, Mus musculus
agcaggatattgagaccctacatgg

SEQ ID NO: 6951 - DNA, 25 bp, Mus musculus
agcaggatgtgtctttgcccaagcc

SEQ ID NO: 6952 - DNA, 25 bp, Mus musculus
agcaggattgctgaatggtctggcc

SEQ ID NO: 6953 - DNA, 25 bp, Mus musculus
agcaggcaaggagaaatgccgaccg

SEQ ID NO: 6954 - DNA, 25 bp, Mus musculus
agcaggccagggaccgccagagcaa

SEQ ID NO: 6955 - DNA, 25 bp, Mus musculus
agcaggccctggctcttcagctgca

SEQ ID NO: 6956 - DNA, 25 bp, Mus musculus
agcaggctctgaccagtgcgcagct

SEQ ID NO: 6957 - DNA, 25 bp, Mus musculus
agcaggctggttctgagaccacccg

SEQ ID NO: 6958 - DNA, 25 bp, Mus musculus
agcaggctgtaactgagacagacag

SEQ ID NO: 6959 - DNA, 25 bp, Mus musculus
agcaggctgtgctgtatgccaaggc

SEQ ID NO: 6960 - DNA, 25 bp, Mus musculus
agcaggcttgggtgcaactgaaaga

SEQ ID NO: 6961 - DNA, 25 bp, Mus musculus
agcagggactcgtgaaacagcagga

SEQ ID NO: 6962 - DNA, 25 bp, Mus musculus
agcagggactgagccctgcaggctc

SEQ ID NO: 6963 - DNA, 25 bp, Mus musculus
agcagggaggttatgaggcttaata

SEQ ID NO: 6964 - DNA, 25 bp, Mus musculus
agcagggcaagctgcaggaagcact

SEQ ID NO: 6965 - DNA, 25 bp, Mus musculus
agcagggccacacgcatatcatcaa

SEQ ID NO: 6966 - DNA, 25 bp, Mus musculus
agcagggcctcaagccggtctccag

SEQ ID NO: 6967 - DNA, 25 bp, Mus musculus
agcaggtagagcaagcccgcagctc

SEQ ID NO: 6968 - DNA, 25 bp, Mus musculus
agcaggtgaagaatgtgatgaagaa

SEQ ID NO: 6969 - DNA, 25 bp, Mus musculus
agcaggttaagctggcactggccgt

SEQ ID NO: 6970 - DNA, 25 bp, Mus musculus
agcaggttcctgacccatctggacc

SEQ ID NO: 6971 - DNA, 25 bp, Mus musculus
agcaggttggagaccttcatcagac

SEQ ID NO: 6972 - DNA, 25 bp, Mus musculus
agcagtagcagctctgattgtgaca

SEQ ID NO: 6973 - DNA, 25 bp, Mus musculus
agcagtatggtgtccgtggctaccc

SEQ ID NO: 6974 - DNA, 25 bp, Mus musculus
agcagtcaggttcacaagaaaagca

SEQ ID NO: 6975 - DNA, 25 bp, Mus musculus
agcagtcagtgacaggtgtgacctc

SEQ ID NO: 6976 - DNA, 25 bp, Mus musculus
agcagtcctgatggcacggcttgga

SEQ ID NO: 6977 - DNA, 25 bp, Mus musculus
agcagtgaacttggctgcagagata

SEQ ID NO: 6978 - DNA, 25 bp, Mus musculus
agcagtgaagcaacccatagaaccc

SEQ ID NO: 6979 - DNA, 25 bp, Mus musculus
agcagtgccagacgccaacgtttgc

SEQ ID NO: 6980 - DNA, 25 bp, Mus musculus
agcagtgccggaccctccaggaaga

SEQ ID NO: 6981 - DNA, 25 bp, Mus musculus
agcagtgcctcacgcctcatgagaa

SEQ ID NO: 6982 - DNA, 25 bp, Mus musculus
agcagtgcgcactgctgctgagtga

SEQ ID NO: 6983 - DNA, 25 bp, Mus musculus
agcagtggaagacaatggaattgcc

SEQ ID NO: 6984 - DNA, 25 bp, Mus musculus
agcagttaacatgggctctgtgcag

SEQ ID NO: 6985 - DNA, 25 bp, Mus musculus
agcagttaaggcgacgtcttcatga

SEQ ID NO: 6986 - DNA, 25 bp, Mus musculus
agcagttgacgcgtagtcactggga

SEQ ID NO: 6987 - DNA, 25 bp, Mus musculus
agcagttgtgcagccaagccaaggg

SEQ ID NO: 6988 - DNA, 25 bp, Mus musculus
agcataaagccgcacgaagcccctt

SEQ ID NO: 6989 - DNA, 25 bp, Mus musculus
agcatattccgcgtagtgttccacg

SEQ ID NO: 6990 - DNA, 25 bp, Mus musculus
agcatcaactcacggtttgccaaag

SEQ ID NO: 6991 - DNA, 25 bp, Mus musculus
agcatcaccgacctgtcattacagg

SEQ ID NO: 6992 - DNA, 25 bp, Mus musculus
agcatcactgtggatattgctgtga

SEQ ID NO: 6993 - DNA, 25 bp, Mus musculus
agcatcagctacagccagcctggct

SEQ ID NO: 6994 - DNA, 25 bp, Mus musculus
agcatcaggcgcaggcagaagctct

SEQ ID NO: 6995 - DNA, 25 bp, Mus musculus
agcatcagtactggaagctgtttac

SEQ ID NO: 6996 - DNA, 25 bp, Mus musculus
agcatccaatatcagtgagccccac

SEQ ID NO: 6997 - DNA, 25 bp, Mus musculus
agcatccagcagctaccctacggga

SEQ ID NO: 6998 - DNA, 25 bp, Mus musculus
agcatccagcaggtaccctacggga

SEQ ID NO: 6999 - DNA, 25 bp, Mus musculus
agcatcccacgtcggatgatgagca

SEQ ID NO: 7000 - DNA, 25 bp, Mus musculus
agcatcccacgtgggatgatgagca

SEQ ID NO: 7001 - DNA, 25 bp, Mus musculus
agcatcccactatggtggacctacc

SEQ ID NO: 7002 - DNA, 25 bp, Mus musculus
agcatcggctgaaacgctaccacag

SEQ ID NO: 7003 - DNA, 25 bp, Mus musculus
agcatctaccaggagctgttgggac

SEQ ID NO: 7004 - DNA, 25 bp, Mus musculus
agcatctattgttaaaaacctgaag

SEQ ID NO: 7005 - DNA, 25 bp, Mus musculus
agcatctcagaacagaccccgacag

SEQ ID NO: 7006 - DNA, 25 bp, Mus musculus
agcatctccagaggaggacagattg

SEQ ID NO: 7007 - DNA, 25 bp, Mus musculus
agcatctccagctgccagtcttggc

SEQ ID NO: 7008 - DNA, 25 bp, Mus musculus
agcatctccctcaggacagaagcct

SEQ ID NO: 7009 - DNA, 25 bp, Mus musculus
agcatctgtccagcttcatcaagca

SEQ ID NO: 7010 - DNA, 25 bp, Mus musculus
agcatcttccgtgagattctccatg

SEQ ID NO: 7011 - DNA, 25 bp, Mus musculus
agcatcttctctatttccagctggc

SEQ ID NO: 7012 - DNA, 25 bp, Mus musculus
agcatcttgatgagcttccaccacc

SEQ ID NO: 7013 - DNA, 25 bp, Mus musculus
agcatgaacttcactccgacacgga

SEQ ID NO: 7014 - DNA, 25 bp, Mus musculus
agcatgacgttcctcttgatgttgc

SEQ ID NO: 7015 - DNA, 25 bp, Mus musculus
agcatgagggtcagcactacagcat

SEQ ID NO: 7016 - DNA, 25 bp, Mus musculus
agcatgcagcagagcgcagagagat

SEQ ID NO: 7017 - DNA, 25 bp, Mus musculus
agcatgccctcatccagcagtactg

SEQ ID NO: 7018 - DNA, 25 bp, Mus musculus
agcatgctaattggactttaacacc

SEQ ID NO: 7019 - DNA, 25 bp, Mus musculus
agcatgctagtgattcaagttcatc

SEQ ID NO: 7020 - DNA, 25 bp, Mus musculus
agcatgctcaacgtgttcctcaagt

SEQ ID NO: 7021 - DNA, 25 bp, Mus musculus
agcatgctcagcagtgctaatctag

SEQ ID NO: 7022 - DNA, 25 bp, Mus musculus
agcatgctccaaggttacagctccg

SEQ ID NO: 7023 - DNA, 25 bp, Mus musculus
agcatgcttggaaacacagcggcca

SEQ ID NO: 7024 - DNA, 25 bp, Mus musculus
agcatggaaccgatgtgtttgtgtg

SEQ ID NO: 7025 - DNA, 25 bp, Mus musculus
agcatggaagactgccctgatggag

SEQ ID NO: 7026 - DNA, 25 bp, Mus musculus
agcatggacagtcccctggaccttt

SEQ ID NO: 7027 - DNA, 25 bp, Mus musculus
agcatggaggactataccttgaact

SEQ ID NO: 7028 - DNA, 25 bp, Mus musculus
agcatggcaggtggaagctgtcccc

SEQ ID NO: 7029 - DNA, 25 bp, Mus musculus
agcatgggtgtgtggagctccatcc

SEQ ID NO: 7030 - DNA, 25 bp, Mus musculus
agcatgtaccagagctatggctccc

SEQ ID NO: 7031 - DNA, 25 bp, Mus musculus
agcatgttcagatcagagtcgcccg

SEQ ID NO: 7032 - DNA, 25 bp, Mus musculus
agcattaatggctgcagaggataag

SEQ ID NO: 7033 - DNA, 25 bp, Mus musculus
agcattctctcagggaagccccgag

SEQ ID NO: 7034 - DNA, 25 bp, Mus musculus
agcattgagaacacgctgtgggccg

SEQ ID NO: 7035 - DNA, 25 bp, Mus musculus
agcatttgctagctgtccttgccac

SEQ ID NO: 7036 - DNA, 25 bp, Mus musculus
agcatttgggattggaacaagacat

SEQ ID NO: 7037 - DNA, 25 bp, Mus musculus
agcattttgacggttttgtggtgga

SEQ ID NO: 7038 - DNA, 25 bp, Mus musculus
agccaaagccatcaccgaaactgcg

SEQ ID NO: 7039 - DNA, 25 bp, Mus musculus
agccaaagcccagattaagacatag

SEQ ID NO: 7040 - DNA, 25 bp, Mus musculus
agccaacagagcagtaagcgcagca

SEQ ID NO: 7041 - DNA, 25 bp, Mus musculus
agccaactacctaggctgggcactc

SEQ ID NO: 7042 - DNA, 25 bp, Mus musculus
agccaagaacccatgtacacaatgg

SEQ ID NO: 7043 - DNA, 25 bp, Mus musculus
agccaagagtgaagcccagaaacaa

SEQ ID NO: 7044 - DNA, 25 bp, Mus musculus
agccaagatcaagcccaaacagcag

SEQ ID NO: 7045 - DNA, 25 bp, Mus musculus
agccaagcgccgtggtagcccaagc

SEQ ID NO: 7046 - DNA, 25 bp, Mus musculus
agccaagctgctcaacgtgggcttc

SEQ ID NO: 7047 - DNA, 25 bp, Mus musculus
agccaagctgctgaacgtgggcttc

SEQ ID NO: 7048 - DNA, 25 bp, Mus musculus
agccaaggactctacgcttttcgag

SEQ ID NO: 7049 - DNA, 25 bp, Mus musculus
agccaagtcattggacaggaggtcc

SEQ ID NO: 7050 - DNA, 25 bp, Mus musculus
agccaagtgatcattaataaagctt

SEQ ID NO: 7051 - DNA, 25 bp, Mus musculus
agccaatcagatgctcttagttcag

SEQ ID NO: 7052 - DNA, 25 bp, Mus musculus
agccaatgaggtggaagctgtcaaa

SEQ ID NO: 7053 - DNA, 25 bp, Mus musculus
agccaatgtggtcatccgccagagc

SEQ ID NO: 7054 - DNA, 25 bp, Mus musculus
agccaatgttgatgccgccacaaag

SEQ ID NO: 7055 - DNA, 25 bp, Mus musculus
agccacagacatcgaaggcaatccc

SEQ ID NO: 7056 - DNA, 25 bp, Mus musculus
agccacagacatggaaggcaatccc

SEQ ID NO: 7057 - DNA, 25 bp, Mus musculus
agccacagacccctgtccgggagga

SEQ ID NO: 7058 - DNA, 25 bp, Mus musculus
agccacagacccgtgtccgggagga

SEQ ID NO: 7059 - DNA, 25 bp, Mus musculus
agccacagtgtgagcgctggaaatc

SEQ ID NO: 7060 - DNA, 25 bp, Mus musculus
agccaccaggacatgagcgggagcc

SEQ ID NO: 7061 - DNA, 25 bp, Mus musculus
agccacccgggaggctgagacaaga

SEQ ID NO: 7062 - DNA, 25 bp, Mus musculus
agccaccgacatgggcacaatgcag

SEQ ID NO: 7063 - DNA, 25 bp, Mus musculus
agccaccgtcggcatagacttcagg

SEQ ID NO: 7064 - DNA, 25 bp, Mus musculus
agccacctgccagatcctgaaggag

SEQ ID NO: 7065 - DNA, 25 bp, Mus musculus
agccacctgtccagactcggagaag

SEQ ID NO: 7066 - DNA, 25 bp, Mus musculus
agccacctgtcctgactcggagaag

SEQ ID NO: 7067 - DNA, 25 bp, Mus musculus
agccacgtatgacggtgccagcctc

SEQ ID NO: 7068 - DNA, 25 bp, Mus musculus
agccactcagcacgcatgcatgttg

SEQ ID NO: 7069 - DNA, 25 bp, Mus musculus
agccactcttggagcgggttgctga

SEQ ID NO: 7070 - DNA, 25 bp, Mus musculus
agccactgcccactgagcaatacgg

SEQ ID NO: 7071 - DNA, 25 bp, Mus musculus
agccagaactgatacagccccgctg

SEQ ID NO: 7072 - DNA, 25 bp, Mus musculus
agccagaagcccacaaagaaagtca

SEQ ID NO: 7073 - DNA, 25 bp, Mus musculus
agccagaatgtcaccgagtacgtcg

SEQ ID NO: 7074 - DNA, 25 bp, Mus musculus
agccagagaaacctccccggagtgc

SEQ ID NO: 7075 - DNA, 25 bp, Mus musculus
agccagagacaggaggacgggctgc

SEQ ID NO: 7076 - DNA, 25 bp, Mus musculus
agccagagggcatccagcagcaggc

SEQ ID NO: 7077 - DNA, 25 bp, Mus musculus
agccagatgttcatcatgatgacac

SEQ ID NO: 7078 - DNA, 25 bp, Mus musculus
agccagatgttcttcatgatgacac

SEQ ID NO: 7079 - DNA, 25 bp, Mus musculus
agccagcactgagctagacgccaag

SEQ ID NO: 7080 - DNA, 25 bp, Mus musculus
agccagcagctaaaaagccgccagc

SEQ ID NO: 7081 - DNA, 25 bp, Mus musculus
agccagcggaaggtgaaacctcagc

SEQ ID NO: 7082 - DNA, 25 bp, Mus musculus
agccagctacccatactaatttatg

SEQ ID NO: 7083 - DNA, 25 bp, Mus musculus
agccagctacccttactaatttatg

SEQ ID NO: 7084 - DNA, 25 bp, Mus musculus
agccagctataaccagcgctcttct

SEQ ID NO: 7085 - DNA, 25 bp, Mus musculus
agccagctccgaaagcaaaagaggg

SEQ ID NO: 7086 - DNA, 25 bp, Mus musculus
agccagctgctcctgttgacccggg

SEQ ID NO: 7087 - DNA, 25 bp, Mus musculus
agccaggaagcgctactggcccttc

SEQ ID NO: 7088 - DNA, 25 bp, Mus musculus
agccaggaccaatgctgagaaacag

SEQ ID NO: 7089 - DNA, 25 bp, Mus musculus
agccaggactcctgcaattacaaag

SEQ ID NO: 7090 - DNA, 25 bp, Mus musculus
agccaggaggcagccagggctctat

SEQ ID NO: 7091 - DNA, 25 bp, Mus musculus
agccaggccagctgtggtagctccg

SEQ ID NO: 7092 - DNA, 25 bp, Mus musculus
agccagggcctgctttgtcagcctg

SEQ ID NO: 7093 - DNA, 25 bp, Mus musculus
agccagggcctggtttgtcagcctg

SEQ ID NO: 7094 - DNA, 25 bp, Mus musculus
agccagtatacagcggatgaatacc

SEQ ID NO: 7095 - DNA, 25 bp, Mus musculus
agccagtgccccattattgaccctg

SEQ ID NO: 7096 - DNA, 25 bp, Mus musculus
agccagtgtaactccttcaagactg

SEQ ID NO: 7097 - DNA, 25 bp, Mus musculus
agccagtgtgtctccctgctgcggg

SEQ ID NO: 7098 - DNA, 25 bp, Mus musculus
agccagttctgctcacctgtgaatg

SEQ ID NO: 7099 - DNA, 25 bp, Mus musculus
agccagttgctgagccagaaacatg

SEQ ID NO: 7100 - DNA, 25 bp, Mus musculus
agccagtttctctgctgacgcaaga

SEQ ID NO: 7101 - DNA, 25 bp, Mus musculus
agccatcactcctcagaaggcaacg

SEQ ID NO: 7102 - DNA, 25 bp, Mus musculus
agccatcagggctctctgcagaatc

SEQ ID NO: 7103 - DNA, 25 bp, Mus musculus
agccatcgatgctgccttggctgcc

SEQ ID NO: 7104 - DNA, 25 bp, Mus musculus
agccatcttctatgctgtggaccag

SEQ ID NO: 7105 - DNA, 25 bp, Mus musculus
agccatgaagctggcgtgcacagtg

SEQ ID NO: 7106 - DNA, 25 bp, Mus musculus
agccatgagatctgaggccacagct

SEQ ID NO: 7107 - DNA, 25 bp, Mus musculus
agccatgctggtttgctgcagacag

SEQ ID NO: 7108 - DNA, 25 bp, Mus musculus
agccatggtgggtccgccgagctca

SEQ ID NO: 7109 - DNA, 25 bp, Mus musculus
agccatgtccacagggagcccctga

SEQ ID NO: 7110 - DNA, 25 bp, Mus musculus
agccatttattgaaactcgccagga

SEQ ID NO: 7111 - DNA, 25 bp, Mus musculus
agcccaacaggaagcaaagcaaagg

SEQ ID NO: 7112 - DNA, 25 bp, Mus musculus
agcccaacaggatgcaaagcaaagg

SEQ ID NO: 7113 - DNA, 25 bp, Mus musculus
agcccaactataccgagctgcagga

SEQ ID NO: 7114 - DNA, 25 bp, Mus musculus
agcccaactatagcgagctgcagga

SEQ ID NO: 7115 - DNA, 25 bp, Mus musculus
agcccaagaccatgaagctcagtga

SEQ ID NO: 7116 - DNA, 25 bp, Mus musculus
agcccaagcagattaccatagaaaa

SEQ ID NO: 7117 - DNA, 25 bp, Mus musculus
agcccaagcctaatagacccaaggg

SEQ ID NO: 7118 - DNA, 25 bp, Mus musculus
agcccacagacgcttttgtgagctg

SEQ ID NO: 7119 - DNA, 25 bp, Mus musculus
agcccacagagatggcggcccaaga

SEQ ID NO: 7120 - DNA, 25 bp, Mus musculus
agcccacagtggatgtcagccagcc

SEQ ID NO: 7121 - DNA, 25 bp, Mus musculus
agcccactgatgagccctcagacgg

SEQ ID NO: 7122 - DNA, 25 bp, Mus musculus
agcccagagcaggattgctgaatgg

SEQ ID NO: 7123 - DNA, 25 bp, Mus musculus
agcccagattgccatcgtgacggag

SEQ ID NO: 7124 - DNA, 25 bp, Mus musculus
agcccagcatacagactgctgacag

SEQ ID NO: 7125 - DNA, 25 bp, Mus musculus
agcccagccacatgcctcatggagg

SEQ ID NO: 7126 - DNA, 25 bp, Mus musculus
agcccagctgaacaacccacaggtt

SEQ ID NO: 7127 - DNA, 25 bp, Mus musculus
agcccagctgaagaacccacaggtt

SEQ ID NO: 7128 - DNA, 25 bp, Mus musculus
agcccaggcaactcagtgagacctt

SEQ ID NO: 7129 - DNA, 25 bp, Mus musculus
agcccagggcctccatctggactgg

SEQ ID NO: 7130 - DNA, 25 bp, Mus musculus
agcccagtcgtctcggtggctacga

SEQ ID NO: 7131 - DNA, 25 bp, Mus musculus
agcccagtggaggtgctgttccaac

SEQ ID NO: 7132 - DNA, 25 bp, Mus musculus
agcccatagtgaaccacaccacgtg

SEQ ID NO: 7133 - DNA, 25 bp, Mus musculus
agcccatcatcttcgtttctgacag

SEQ ID NO: 7134 - DNA, 25 bp, Mus musculus
agcccatcatggagcggatcctccg

SEQ ID NO: 7135 - DNA, 25 bp, Mus musculus
agcccatgactgtgagctcagacca

SEQ ID NO: 7136 - DNA, 25 bp, Mus musculus
agcccatgccagggaagattacaaa

SEQ ID NO: 7137 - DNA, 25 bp, Mus musculus
agccccaaggcatcttcagctggca

SEQ ID NO: 7138 - DNA, 25 bp, Mus musculus
agccccaaggttcgcagcggacctg

SEQ ID NO: 7139 - DNA, 25 bp, Mus musculus
agccccagaaatccgctgctgtgtg

SEQ ID NO: 7140 - DNA, 25 bp, Mus musculus
agccccaggtcttccagtcacactg

SEQ ID NO: 7141 - DNA, 25 bp, Mus musculus
agccccagtgggaagccctctggat

SEQ ID NO: 7142 - DNA, 25 bp, Mus musculus
agccccatctccagtatttcctttg

SEQ ID NO: 7143 - DNA, 25 bp, Mus musculus
agccccgagacaacgaagctcttgc

SEQ ID NO: 7144 - DNA, 25 bp, Mus musculus
agccccgaggatcgtcctgtgtcca

SEQ ID NO: 7145 - DNA, 25 bp, Mus musculus
agccccgagggctgtctctcagaga

SEQ ID NO: 7146 - DNA, 25 bp, Mus musculus
agccccggatacaggtgactggttg

SEQ ID NO: 7147 - DNA, 25 bp, Mus musculus
agcccctccattctgcacgagaatt

SEQ ID NO: 7148 - DNA, 25 bp, Mus musculus
agcccctcggctccggaaaggctct

SEQ ID NO: 7149 - DNA, 25 bp, Mus musculus
agcccctgcctaatgaaaattgtgc

SEQ ID NO: 7150 - DNA, 25 bp, Mus musculus
agcccctggagctaccagcgggcaa

SEQ ID NO: 7151 - DNA, 25 bp, Mus musculus
agcccctggaggagtgcctctgcag

SEQ ID NO: 7152 - DNA, 25 bp, Mus musculus
agccccttctcaatggtagtacctt

SEQ ID NO: 7153 - DNA, 25 bp, Mus musculus
agccccttctcattggtagtacctt

SEQ ID NO: 7154 - DNA, 25 bp, Mus musculus
agcccgatctttcggccctgcggtg

SEQ ID NO: 7155 - DNA, 25 bp, Mus musculus
agcccgatttctgaagatcccgaga

SEQ ID NO: 7156 - DNA, 25 bp, Mus musculus
agcccgcaagatctggtgctttggc

SEQ ID NO: 7157 - DNA, 25 bp, Mus musculus
agcccgggctcaagaatctgaatct

SEQ ID NO: 7158 - DNA, 25 bp, Mus musculus
agcccgtgagtgacaaggtgtatga

SEQ ID NO: 7159 - DNA, 25 bp, Mus musculus
agcccgtgagtgtcaaggtgtatga

SEQ ID NO: 7160 - DNA, 25 bp, Mus musculus
agcccgtgatgctggcctgctacgt

SEQ ID NO: 7161 - DNA, 25 bp, Mus musculus
agcccgtgcctctgtggtgctgcag

SEQ ID NO: 7162 - DNA, 25 bp, Mus musculus
agcccgtggcactgacgcctgcgta

SEQ ID NO: 7163 - DNA, 25 bp, Mus musculus
agccctacacgaaccagcggcagaa

SEQ ID NO: 7164 - DNA, 25 bp, Mus musculus
agccctacgaagaggccaccgagag

SEQ ID NO: 7165 - DNA, 25 bp, Mus musculus
agccctagcctctcccagcttgagt

SEQ ID NO: 7166 - DNA, 25 bp, Mus musculus
agccctaggcgatgctggagctccc

SEQ ID NO: 7167 - DNA, 25 bp, Mus musculus
agccctagtgcaggagccacactga

SEQ ID NO: 7168 - DNA, 25 bp, Mus musculus
agccctccagggatcaagtccagag

SEQ ID NO: 7169 - DNA, 25 bp, Mus musculus
agccctctgctttctagtgatgccg

SEQ ID NO: 7170 - DNA, 25 bp, Mus musculus
agccctcttgtgcaggaccatggag

SEQ ID NO: 7171 - DNA, 25 bp, Mus musculus
agccctgcagttgtgtgcactgcca

SEQ ID NO: 7172 - DNA, 25 bp, Mus musculus
agccctgccttgtctcaaagagaag

SEQ ID NO: 7173 - DNA, 25 bp, Mus musculus
agccctggacacactgcgcagctgg

SEQ ID NO: 7174 - DNA, 25 bp, Mus musculus
agccctggtcccagaactgaggagc

SEQ ID NO: 7175 - DNA, 25 bp, Mus musculus
agccctggtgatggcttcagcccgg

SEQ ID NO: 7176 - DNA, 25 bp, Mus musculus
agccctgtggtacttcggctcggcc

SEQ ID NO: 7177 - DNA, 25 bp, Mus musculus
agcccttagctgatgggcaggtgtc

SEQ ID NO: 7178 - DNA, 25 bp, Mus musculus
agccgaaagcgtgtttgcaaatgtc

SEQ ID NO: 7179 - DNA, 25 bp, Mus musculus
agccgaactggatgcagaccaccca

SEQ ID NO: 7180 - DNA, 25 bp, Mus musculus
agccgaagttcgaggacacagagct

SEQ ID NO: 7181 - DNA, 25 bp, Mus musculus
agccgaatgtcccatgcacctggag

SEQ ID NO: 7182 - DNA, 25 bp, Mus musculus
agccgactcgcttatgctggctgag

SEQ ID NO: 7183 - DNA, 25 bp, Mus musculus
agccgagaccggaagtactgcgaag

SEQ ID NO: 7184 - DNA, 25 bp, Mus musculus
agccgagcccaaaaagatgaagaaa

SEQ ID NO: 7185 - DNA, 25 bp, Mus musculus
agccgagccgaaaggccgccatgcg

SEQ ID NO: 7186 - DNA, 25 bp, Mus musculus
agccgagccgaatggccgccatgcg

SEQ ID NO: 7187 - DNA, 25 bp, Mus musculus
agccgagcttgcagaaatcccagaa

SEQ ID NO: 7188 - DNA, 25 bp, Mus musculus
agccgagtgcttctccccgagcagg

SEQ ID NO: 7189 - DNA, 25 bp, Mus musculus
agccgatggattcctctcataaatg

SEQ ID NO: 7190 - DNA, 25 bp, Mus musculus
agccgcaaagaaccatagccctggg

SEQ ID NO: 7191 - DNA, 25 bp, Mus musculus
agccgcagccaacacacggtttgca

SEQ ID NO: 7192 - DNA, 25 bp, Mus musculus
agccgcagccaagacacggtttgca

SEQ ID NO: 7193 - DNA, 25 bp, Mus musculus
agccgcattgaccaagcccagaagc

SEQ ID NO: 7194 - DNA, 25 bp, Mus musculus
agccgccctcggaactcctgggagt

SEQ ID NO: 7195 - DNA, 25 bp, Mus musculus
agccgccctcggtactcctgggagt

SEQ ID NO: 7196 - DNA, 25 bp, Mus musculus
agccgctggaaagccacccggattt

SEQ ID NO: 7197 - DNA, 25 bp, Mus musculus
agccgctgggctcattgaacaccct

SEQ ID NO: 7198 - DNA, 25 bp, Mus musculus
agccggaaagagtcggccagcagca

SEQ ID NO: 7199 - DNA, 25 bp, Mus musculus
agccggagcacaccaaatccaggat

SEQ ID NO: 7200 - DNA, 25 bp, Mus musculus
agccggagttgtaccacccaatgaa

SEQ ID NO: 7201 - DNA, 25 bp, Mus musculus
agccgggacactaccagaacacttc

SEQ ID NO: 7202 - DNA, 25 bp, Mus musculus
agccgggacacttccagaacacttc

SEQ ID NO: 7203 - DNA, 25 bp, Mus musculus
agccgggcacccttggcagtttctg

SEQ ID NO: 7204 - DNA, 25 bp, Mus musculus
agccgggctggtggctatgacttca

SEQ ID NO: 7205 - DNA, 25 bp, Mus musculus
agccggtcctggagtagaagtcacc

SEQ ID NO: 7206 - DNA, 25 bp, Mus musculus
agccgtactattcacaacactgctg

SEQ ID NO: 7207 - DNA, 25 bp, Mus musculus
agccgtcatgcccatggtggcagct

SEQ ID NO: 7208 - DNA, 25 bp, Mus musculus
agccgttgcgcagtcctgcggtaca

SEQ ID NO: 7209 - DNA, 25 bp, Mus musculus
agccgttggcatagcacatccatcc

SEQ ID NO: 7210 - DNA, 25 bp, Mus musculus
agccgttggcattgcacatccatcc

SEQ ID NO: 7211 - DNA, 25 bp, Mus musculus
agcctaaaggaaccattgaatatac

SEQ ID NO: 7212 - DNA, 25 bp, Mus musculus
agcctaacctggagacctgcagcag

SEQ ID NO: 7213 - DNA, 25 bp, Mus musculus
agcctactaccatcatcgagaagaa

SEQ ID NO: 7214 - DNA, 25 bp, Mus musculus
agcctagaaaagtggagctgtctga

SEQ ID NO: 7215 - DNA, 25 bp, Mus musculus
agcctagaggaagccaaacagttat

SEQ ID NO: 7216 - DNA, 25 bp, Mus musculus
agcctatgatcaacaaatatgggaa

SEQ ID NO: 7217 - DNA, 25 bp, Mus musculus
agcctatggaaagaagggactacat

SEQ ID NO: 7218 - DNA, 25 bp, Mus musculus
agcctattcagtacccagcaaccag

SEQ ID NO: 7219 - DNA, 25 bp, Mus musculus
agcctcaaaccaccgttatccataa

SEQ ID NO: 7220 - DNA, 25 bp, Mus musculus
agcctcacggttgtccagtcttcga

SEQ ID NO: 7221 - DNA, 25 bp, Mus musculus
agcctcatcaagtgcctggtaacca

SEQ ID NO: 7222 - DNA, 25 bp, Mus musculus
agcctccaagacacaaaggaaaaca

SEQ ID NO: 7223 - DNA, 25 bp, Mus musculus
agcctccagcaaacaagtaccctat

SEQ ID NO: 7224 - DNA, 25 bp, Mus musculus
agcctccaggatccagtccggctgt

SEQ ID NO: 7225 - DNA, 25 bp, Mus musculus
agcctcccatgtgcttactgctaag

SEQ ID NO: 7226 - DNA, 25 bp, Mus musculus
agcctcccctgtcatctcaaatatg

SEQ ID NO: 7227 - DNA, 25 bp, Mus musculus
agcctccggcttgtgtgcagttgga

SEQ ID NO: 7228 - DNA, 25 bp, Mus musculus
agcctcctaaggcagctggagctgc

SEQ ID NO: 7229 - DNA, 25 bp, Mus musculus
agcctcctcaacaatgggaaactgc

SEQ ID NO: 7230 - DNA, 25 bp, Mus musculus
agcctcctgttcgtaaagctggcca

SEQ ID NO: 7231 - DNA, 25 bp, Mus musculus
agcctcgaaggctgtgctgccaaga

SEQ ID NO: 7232 - DNA, 25 bp, Mus musculus
agcctctcatccacggatagtctgc

SEQ ID NO: 7233 - DNA, 25 bp, Mus musculus
agcctctgcctcatgatgaaacata

SEQ ID NO: 7234 - DNA, 25 bp, Mus musculus
agcctctggtcattcaactatttct

SEQ ID NO: 7235 - DNA, 25 bp, Mus musculus
agcctctttggacaccctgatccaa

SEQ ID NO: 7236 - DNA, 25 bp, Mus musculus
agcctgaactggtttggagtcagtg

SEQ ID NO: 7237 - DNA, 25 bp, Mus musculus
agcctgaagaggaggtgcatgacct

SEQ ID NO: 7238 - DNA, 25 bp, Mus musculus
agcctgacaccaacagcaagtctgc

SEQ ID NO: 7239 - DNA, 25 bp, Mus musculus
agcctgagagctttggttggagaca

SEQ ID NO: 7240 - DNA, 25 bp, Mus musculus
agcctgagcctgctcaccttcagag

SEQ ID NO: 7241 - DNA, 25 bp, Mus musculus
agcctgagcgcgatgccatctatga

SEQ ID NO: 7242 - DNA, 25 bp, Mus musculus
agcctgagttgcctgcggcctgcac

SEQ ID NO: 7243 - DNA, 25 bp, Mus musculus
agcctgatgagacccgagaacccac

SEQ ID NO: 7244 - DNA, 25 bp, Mus musculus
agcctgatggatatggtggagttcc

SEQ ID NO: 7245 - DNA, 25 bp, Mus musculus
agcctgatggatttggtggagttcc

SEQ ID NO: 7246 - DNA, 25 bp, Mus musculus
agcctgatgtggctgcagagcccac

SEQ ID NO: 7247 - DNA, 25 bp, Mus musculus
agcctgcacacagaagtccctgaaa

SEQ ID NO: 7248 - DNA, 25 bp, Mus musculus
agcctgcaggccagcgtgctaatga

SEQ ID NO: 7249 - DNA, 25 bp, Mus musculus
agcctgcattcccaacatagtagtt

SEQ ID NO: 7250 - DNA, 25 bp, Mus musculus
agcctgcctatgctgtgctgcttgc

SEQ ID NO: 7251 - DNA, 25 bp, Mus musculus
agcctgcctcatcagcttgggttat

SEQ ID NO: 7252 - DNA, 25 bp, Mus musculus
agcctgcgtgagatcacactgctct

SEQ ID NO: 7253 - DNA, 25 bp, Mus musculus
agcctgctcgcattgaggaggaaga

SEQ ID NO: 7254 - DNA, 25 bp, Mus musculus
agcctggaccatttttcagatttag

SEQ ID NO: 7255 - DNA, 25 bp, Mus musculus
agcctggaggtgagagaacagtcct

SEQ ID NO: 7256 - DNA, 25 bp, Mus musculus
agcctggaggtgtgagaacagtcct

SEQ ID NO: 7257 - DNA, 25 bp, Mus musculus
agcctggcacagaagccgaggtcac

SEQ ID NO: 7258 - DNA, 25 bp, Mus musculus
agcctggcacagtagccgaggtcac

SEQ ID NO: 7259 - DNA, 25 bp, Mus musculus
agcctggcaccgtggtcagaatgca

SEQ ID NO: 7260 - DNA, 25 bp, Mus musculus
agcctggcacgcagaggccctggca

SEQ ID NO: 7261 - DNA, 25 bp, Mus musculus
agcctggccgactccatgcagcaga

SEQ ID NO: 7262 - DNA, 25 bp, Mus musculus
agcctggcctacctgcgcactgagt

SEQ ID NO: 7263 - DNA, 25 bp, Mus musculus
agcctggctcacagaccattcctgg

SEQ ID NO: 7264 - DNA, 25 bp, Mus musculus
agcctggctgatcctggaagagctg

SEQ ID NO: 7265 - DNA, 25 bp, Mus musculus
agcctgtccatgtggcacgggcttg

SEQ ID NO: 7266 - DNA, 25 bp, Mus musculus
agcctgtctgcagttttcacaaatt

SEQ ID NO: 7267 - DNA, 25 bp, Mus musculus
agcctgtgccatgaacaaggagtcc

SEQ ID NO: 7268 - DNA, 25 bp, Mus musculus
agcctgtggactgtctggacggcct

SEQ ID NO: 7269 - DNA, 25 bp, Mus musculus
agcctgtggcacacaaagactccac

SEQ ID NO: 7270 - DNA, 25 bp, Mus musculus
agcctgtggccgtcttcctgggagt

SEQ ID NO: 7271 - DNA, 25 bp, Mus musculus
agcctgtgggttgagaatcaagaag

SEQ ID NO: 7272 - DNA, 25 bp, Mus musculus
agccttaagctgtgtgttttactgt

SEQ ID NO: 7273 - DNA, 25 bp, Mus musculus
agccttcaaggaacagctgacccac

SEQ ID NO: 7274 - DNA, 25 bp, Mus musculus
agccttcaccgatgtggccactggc

SEQ ID NO: 7275 - DNA, 25 bp, Mus musculus
agccttcggcagaagcatgcccagc

SEQ ID NO: 7276 - DNA, 25 bp, Mus musculus
agccttctatgacccaagaagtcta

SEQ ID NO: 7277 - DNA, 25 bp, Mus musculus
agccttctcttcatacccctgggtg

SEQ ID NO: 7278 - DNA, 25 bp, Mus musculus
agccttctggcgagggcctttcgga

SEQ ID NO: 7279 - DNA, 25 bp, Mus musculus
agccttcttacctgttagacattgg

SEQ ID NO: 7280 - DNA, 25 bp, Mus musculus
agccttgcacgcaacagctctgctg

SEQ ID NO: 7281 - DNA, 25 bp, Mus musculus
agccttggctgcagcgcgcaggagg

SEQ ID NO: 7282 - DNA, 25 bp, Mus musculus
agccttggtgaacggccggccactt

SEQ ID NO: 7283 - DNA, 25 bp, Mus musculus
agcctttggccgcttctctcctgga

SEQ ID NO: 7284 - DNA, 25 bp, Mus musculus
agcgaatgccgccttccttgtcggg

SEQ ID NO: 7285 - DNA, 25 bp, Mus musculus
agcgaatgtcaacgcacaatctcag

SEQ ID NO: 7286 - DNA, 25 bp, Mus musculus
agcgacaccacaactgcgcacgagt

SEQ ID NO: 7287 - DNA, 25 bp, Mus musculus
agcgacacgccgactatacgaaaag

SEQ ID NO: 7288 - DNA, 25 bp, Mus musculus
agcgacataagccagagcatcgttc

SEQ ID NO: 7289 - DNA, 25 bp, Mus musculus
agcgacataagcgagagcatcgttc

SEQ ID NO: 7290 - DNA, 25 bp, Mus musculus
agcgacccctcgaggcaacctttga

SEQ ID NO: 7291 - DNA, 25 bp, Mus musculus
agcgaccgtgccaaggctgagcagc

SEQ ID NO: 7292 - DNA, 25 bp, Mus musculus
agcgactcccaaagccatcaggaag

SEQ ID NO: 7293 - DNA, 25 bp, Mus musculus
agcgactctcgcagcctgctggagg

SEQ ID NO: 7294 - DNA, 25 bp, Mus musculus
agcgagactatcaaatctattacag

SEQ ID NO: 7295 - DNA, 25 bp, Mus musculus
agcgagctgtgctgttggaacagca

SEQ ID NO: 7296 - DNA, 25 bp, Mus musculus
agcgagtcgggctcaaagtccagcc

SEQ ID NO: 7297 - DNA, 25 bp, Mus musculus
agcgagtgccctacaccttctgcag

SEQ ID NO: 7298 - DNA, 25 bp, Mus musculus
agcgatgagcaagatgctttcaagc

SEQ ID NO: 7299 - DNA, 25 bp, Mus musculus
agcgatgcaactaagttaaggccaa

SEQ ID NO: 7300 - DNA, 25 bp, Mus musculus
agcgatggcagtcaccagtgactaa

SEQ ID NO: 7301 - DNA, 25 bp, Mus musculus
agcgatggctggagccactcttgga

SEQ ID NO: 7302 - DNA, 25 bp, Mus musculus
agcgattggccagcctctggctcta

SEQ ID NO: 7303 - DNA, 25 bp, Mus musculus
agcgcaagatgctggccgccatcca

SEQ ID NO: 7304 - DNA, 25 bp, Mus musculus
agcgcaagcgaaggcggaagcatca

SEQ ID NO: 7305 - DNA, 25 bp, Mus musculus
agcgcactctttctttctcctggat

SEQ ID NO: 7306 - DNA, 25 bp, Mus musculus
agcgcaggcccctcctggtacagag

SEQ ID NO: 7307 - DNA, 25 bp, Mus musculus
agcgcaggccctgctgggagttaca

SEQ ID NO: 7308 - DNA, 25 bp, Mus musculus
agcgcatccgccagcagattgacgg

SEQ ID NO: 7309 - DNA, 25 bp, Mus musculus
agcgcatgaggatacagaaagctgg

SEQ ID NO: 7310 - DNA, 25 bp, Mus musculus
agcgccactcgtccacagcgaagaa

SEQ ID NO: 7311 - DNA, 25 bp, Mus musculus
agcgccactcgtgcacagcgaagaa

SEQ ID NO: 7312 - DNA, 25 bp, Mus musculus
agcgccagcagtcagcacagtgaag

SEQ ID NO: 7313 - DNA, 25 bp, Mus musculus
agcgccaggtctacatccagcctga

SEQ ID NO: 7314 - DNA, 25 bp, Mus musculus
agcgccatgtagtgcccagcaggtg

SEQ ID NO: 7315 - DNA, 25 bp, Mus musculus
agcgcccacgatccacgtgtacgag

SEQ ID NO: 7316 - DNA, 25 bp, Mus musculus
agcgcccgagagagaagttatcagt

SEQ ID NO: 7317 - DNA, 25 bp, Mus musculus
agcgccgacctgtgtccagtgtgca

SEQ ID NO: 7318 - DNA, 25 bp, Mus musculus
agcgccgtttccgactggaacgtgg

SEQ ID NO: 7319 - DNA, 25 bp, Mus musculus
agcgcgcagcccctcttggaataag

SEQ ID NO: 7320 - DNA, 25 bp, Mus musculus
agcgcgcagcccgtcttggaataag

SEQ ID NO: 7321 - DNA, 25 bp, Mus musculus
agcgcggcagcacgcatggttctgg

SEQ ID NO: 7322 - DNA, 25 bp, Mus musculus
agcgcgtggtggacaagaaaagact

SEQ ID NO: 7323 - DNA, 25 bp, Mus musculus
agcgctaccaagcagccgctgggct

SEQ ID NO: 7324 - DNA, 25 bp, Mus musculus
agcgctatcggcattgtgatgcccc

SEQ ID NO: 7325 - DNA, 25 bp, Mus musculus
agcgctggaactgctcggcactgga

SEQ ID NO: 7326 - DNA, 25 bp, Mus musculus
agcgctgtgcactgccctcgcggag

SEQ ID NO: 7327 - DNA, 25 bp, Mus musculus
agcgctgtgtgaacagcaccagcag

SEQ ID NO: 7328 - DNA, 25 bp, Mus musculus
agcgctgtgtgatcagcaccagcag

SEQ ID NO: 7329 - DNA, 25 bp, Mus musculus
agcgctttgcagcaaatgcccatgc

SEQ ID NO: 7330 - DNA, 25 bp, Mus musculus
agcggaaacggagctgcccgaagac

SEQ ID NO: 7331 - DNA, 25 bp, Mus musculus
agcggaacacactgtgggaactgcc

SEQ ID NO: 7332 - DNA, 25 bp, Mus musculus
agcggaagaacctggctgccattca

SEQ ID NO: 7333 - DNA, 25 bp, Mus musculus
agcggaaggtgaaacctcagccgcc

SEQ ID NO: 7334 - DNA, 25 bp, Mus musculus
agcggagaagcctgctgtgcccaac

SEQ ID NO: 7335 - DNA, 25 bp, Mus musculus
agcggagacacctggacttcctcga

SEQ ID NO: 7336 - DNA, 25 bp, Mus musculus
agcggagccgtctggaacaggaaaa

SEQ ID NO: 7337 - DNA, 25 bp, Mus musculus
agcggaggccgaaaagagagaaaca

SEQ ID NO: 7338 - DNA, 25 bp, Mus musculus
agcggagtctttgttcccttcacag

SEQ ID NO: 7339 - DNA, 25 bp, Mus musculus
agcggagttgacaaccgaccttgcg

SEQ ID NO: 7340 - DNA, 25 bp, Mus musculus
agcggagttgactaccgaccttgcg

SEQ ID NO: 7341 - DNA, 25 bp, Mus musculus
agcggcaaggagaaggcagggccca

SEQ ID NO: 7342 - DNA, 25 bp, Mus musculus
agcggcacgaagtaaagagcgaccc

SEQ ID NO: 7343 - DNA, 25 bp, Mus musculus
agcggcagacacaccatctcaaaac

SEQ ID NO: 7344 - DNA, 25 bp, Mus musculus
agcggcccacggagcaatacagtga

SEQ ID NO: 7345 - DNA, 25 bp, Mus musculus
agcggcctcctcttcatttaccagg

SEQ ID NO: 7346 - DNA, 25 bp, Mus musculus
agcggcctctactgctgtctagtga

SEQ ID NO: 7347 - DNA, 25 bp, Mus musculus
agcggcgacacctgggtccaggatt

SEQ ID NO: 7348 - DNA, 25 bp, Mus musculus
agcggcgggtcacacctctgccttt

SEQ ID NO: 7349 - DNA, 25 bp, Mus musculus
agcggctagccagagaacgccgaga

SEQ ID NO: 7350 - DNA, 25 bp, Mus musculus
agcggctggacgtcgcgagcccact

SEQ ID NO: 7351 - DNA, 25 bp, Mus musculus
agcgggagaaggtgccagccaaccc

SEQ ID NO: 7352 - DNA, 25 bp, Mus musculus
agcgggagtgcctcaagtatcggct

SEQ ID NO: 7353 - DNA, 25 bp, Mus musculus
agcgggcagctaaagttgctgagca

SEQ ID NO: 7354 - DNA, 25 bp, Mus musculus
agcgggcccaacagctgctgcagct

SEQ ID NO: 7355 - DNA, 25 bp, Mus musculus
agcgggctcagcagcactcttgcaa

SEQ ID NO: 7356 - DNA, 25 bp, Mus musculus
agcggggaaaattgctgtctcagcc

SEQ ID NO: 7357 - DNA, 25 bp, Mus musculus
agcgggtctgcaaggctgtgctcct

SEQ ID NO: 7358 - DNA, 25 bp, Mus musculus
agcgggtctgcatggctgtgctcct

SEQ ID NO: 7359 - DNA, 25 bp, Mus musculus
agcggtactgccgaggagtcaatgc

SEQ ID NO: 7360 - DNA, 25 bp, Mus musculus
agcggtgacacatcctcatgcctgg

SEQ ID NO: 7361 - DNA, 25 bp, Mus musculus
agcggtgcatccaggacaccggcgt

SEQ ID NO: 7362 - DNA, 25 bp, Mus musculus
agcggtggctctttctgtggtcttg

SEQ ID NO: 7363 - DNA, 25 bp, Mus musculus
agcggttccagagcatgcatgcttc

SEQ ID NO: 7364 - DNA, 25 bp, Mus musculus
agcggttcccacctctcggaggaca

SEQ ID NO: 7365 - DNA, 25 bp, Mus musculus
agcgtaatcacagaagaaatgaatg

SEQ ID NO: 7366 - DNA, 25 bp, Mus musculus
agcgtccacagtacagatccttggg

SEQ ID NO: 7367 - DNA, 25 bp, Mus musculus
agcgtccaccagaacacagttataa

SEQ ID NO: 7368 - DNA, 25 bp, Mus musculus
agcgtccccgctgaagaagtgcctt

SEQ ID NO: 7369 - DNA, 25 bp, Mus musculus
agcgtccctgcggaagcgtttcctg

SEQ ID NO: 7370 - DNA, 25 bp, Mus musculus
agcgtctccgtgaagtcctggtccg

SEQ ID NO: 7371 - DNA, 25 bp, Mus musculus
agcgtctgtaaattctaaggctccc

SEQ ID NO: 7372 - DNA, 25 bp, Mus musculus
agcgtctttgggttttctgtccgct

SEQ ID NO: 7373 - DNA, 25 bp, Mus musculus
agcgtggaggcctcttataagtgtt

SEQ ID NO: 7374 - DNA, 25 bp, Mus musculus
agcgtggcaagcaccgtgcggttcc

SEQ ID NO: 7375 - DNA, 25 bp, Mus musculus
agcgtgtaccttcatcaagtccaac

SEQ ID NO: 7376 - DNA, 25 bp, Mus musculus
agcgtgtgacgagcagtagctgccc

SEQ ID NO: 7377 - DNA, 25 bp, Mus musculus
agcgtgtgcgctatgattcttccaa

SEQ ID NO: 7378 - DNA, 25 bp, Mus musculus
agcgttctcctatcccactggaatg

SEQ ID NO: 7379 - DNA, 25 bp, Mus musculus
agctaaaggctgagaggaactacca

SEQ ID NO: 7380 - DNA, 25 bp, Mus musculus
agctaaagggccctcttgtaccaga

SEQ ID NO: 7381 - DNA, 25 bp, Mus musculus
agctaaccagttcctggctcctggc

SEQ ID NO: 7382 - DNA, 25 bp, Mus musculus
agctaacccagaaggtggcccagga

SEQ ID NO: 7383 - DNA, 25 bp, Mus musculus
agctaaccttgtaagatgaattggg

SEQ ID NO: 7384 - DNA, 25 bp, Mus musculus
agctaagaaatacgtcccgccacgc

SEQ ID NO: 7385 - DNA, 25 bp, Mus musculus
agctaatgagatatgtgtgggagac

SEQ ID NO: 7386 - DNA, 25 bp, Mus musculus
agctaatgcctttgacaacctcctc

SEQ ID NO: 7387 - DNA, 25 bp, Mus musculus
agctacagcggaggctacggtgctc

SEQ ID NO: 7388 - DNA, 25 bp, Mus musculus
agctaccaggccaacacagcagaca

SEQ ID NO: 7389 - DNA, 25 bp, Mus musculus
agctacctcggtactgggagtacag

SEQ ID NO: 7390 - DNA, 25 bp, Mus musculus
agctacctggtgactcaggcccagc

SEQ ID NO: 7391 - DNA, 25 bp, Mus musculus
agctacggacatggaagcctgtcct

SEQ ID NO: 7392 - DNA, 25 bp, Mus musculus
agctacgtcacttcctcccagtggt

SEQ ID NO: 7393 - DNA, 25 bp, Mus musculus
agctacttaatacggaacatcaaaa

SEQ ID NO: 7394 - DNA, 25 bp, Mus musculus
agctagaggaagaacacaatggcta

SEQ ID NO: 7395 - DNA, 25 bp, Mus musculus
agctagctgtggatccggaggccct

SEQ ID NO: 7396 - DNA, 25 bp, Mus musculus
agctagcttatgctgttcgaggcaa

SEQ ID NO: 7397 - DNA, 25 bp, Mus musculus
agctaggcagcactcggatgcccaa

SEQ ID NO: 7398 - DNA, 25 bp, Mus musculus
agctaggtcgcgaccacgagctcgg

SEQ ID NO: 7399 - DNA, 25 bp, Mus musculus
agctaggtgatgactccctgccagc

SEQ ID NO: 7400 - DNA, 25 bp, Mus musculus
agctagtgagcttcgaagaggacgc

SEQ ID NO: 7401 - DNA, 25 bp, Mus musculus
agctagtgtgcatgtgcctaccgcc

SEQ ID NO: 7402 - DNA, 25 bp, Mus musculus
agctatacgtacaatggcaagggag

SEQ ID NO: 7403 - DNA, 25 bp, Mus musculus
agctatagcccagggccgctaccgg

SEQ ID NO: 7404 - DNA, 25 bp, Mus musculus
agctatccagattggtgttaaaaag

SEQ ID NO: 7405 - DNA, 25 bp, Mus musculus
agctatgacagctataacaacggag

SEQ ID NO: 7406 - DNA, 25 bp, Mus musculus
agctatgactacgtggaggagccca

SEQ ID NO: 7407 - DNA, 25 bp, Mus musculus
agctatgagatgctcgtttccctgg

SEQ ID NO: 7408 - DNA, 25 bp, Mus musculus
agctattttaagtactctgtttcag

SEQ ID NO: 7409 - DNA, 25 bp, Mus musculus
agctcaaagcccaagctccaagagg

SEQ ID NO: 7410 - DNA, 25 bp, Mus musculus
agctcaagatcctggcccgggacct

SEQ ID NO: 7411 - DNA, 25 bp, Mus musculus
agctcaagggacctcacacgtctgg

SEQ ID NO: 7412 - DNA, 25 bp, Mus musculus
agctcacctatggagcagaacaaag

SEQ ID NO: 7413 - DNA, 25 bp, Mus musculus
agctcactactatacaacacaggtg

SEQ ID NO: 7414 - DNA, 25 bp, Mus musculus
agctcactcatgtggttctggattc

SEQ ID NO: 7415 - DNA, 25 bp, Mus musculus
agctcagagcctggtaccactgcga

SEQ ID NO: 7416 - DNA, 25 bp, Mus musculus
agctcagctcaccaaatccaacgca

SEQ ID NO: 7417 - DNA, 25 bp, Mus musculus
agctcaggcagaacagtgggcagca

SEQ ID NO: 7418 - DNA, 25 bp, Mus musculus
agctcaggctgaaaatcaagaagat

SEQ ID NO: 7419 - DNA, 25 bp, Mus musculus
agctcagggcaagcacaggccttgg

SEQ ID NO: 7420 - DNA, 25 bp, Mus musculus
agctcagggtctacatttcactcaa

SEQ ID NO: 7421 - DNA, 25 bp, Mus musculus
agctcagggtcttcatttcactcaa

SEQ ID NO: 7422 - DNA, 25 bp, Mus musculus
agctcagtatcagcagcatggccgg

SEQ ID NO: 7423 - DNA, 25 bp, Mus musculus
agctcagtcacctcagcagcgagtc

SEQ ID NO: 7424 - DNA, 25 bp, Mus musculus
agctcagtgaaaagaactccgcaga

SEQ ID NO: 7425 - DNA, 25 bp, Mus musculus
agctcagtgctggaaagcctagtgg

SEQ ID NO: 7426 - DNA, 25 bp, Mus musculus
agctcagtgggaagtgaacgcgcac

SEQ ID NO: 7427 - DNA, 25 bp, Mus musculus
agctcagttccgacagctctgtccg

SEQ ID NO: 7428 - DNA, 25 bp, Mus musculus
agctcatctgtggatactgccgtac

SEQ ID NO: 7429 - DNA, 25 bp, Mus musculus
agctcatgctgaagggccttttgaa

SEQ ID NO: 7430 - DNA, 25 bp, Mus musculus
agctcatgctgatgggccttttgaa

SEQ ID NO: 7431 - DNA, 25 bp, Mus musculus
agctcattcttttgttatggcagcc

SEQ ID NO: 7432 - DNA, 25 bp, Mus musculus
agctccaagtagagaggctgcaaca

SEQ ID NO: 7433 - DNA, 25 bp, Mus musculus
agctccagaggcagggatccaccac

SEQ ID NO: 7434 - DNA, 25 bp, Mus musculus
agctccagctagcttgaacttgcag

SEQ ID NO: 7435 - DNA, 25 bp, Mus musculus
agctccatcagacgcttcatatatg

SEQ ID NO: 7436 - DNA, 25 bp, Mus musculus
agctcccagaaaagtgaatcctgaa

SEQ ID NO: 7437 - DNA, 25 bp, Mus musculus
agctcccagcgggatatggaggact

SEQ ID NO: 7438 - DNA, 25 bp, Mus musculus
agctcccgaggtggccgatcgaatt

SEQ ID NO: 7439 - DNA, 25 bp, Mus musculus
agctcccgtccgtgttcaagaaaga

SEQ ID NO: 7440 - DNA, 25 bp, Mus musculus
agctccctgtcactggctgacaagg

SEQ ID NO: 7441 - DNA, 25 bp, Mus musculus
agctcccttgccttttggtttccag

SEQ ID NO: 7442 - DNA, 25 bp, Mus musculus
agctccgacaggtgcgggaccagca

SEQ ID NO: 7443 - DNA, 25 bp, Mus musculus
agctccgcgggagagccgaaatgcc

SEQ ID NO: 7444 - DNA, 25 bp, Mus musculus
agctccggaagaccctccaaagaag

SEQ ID NO: 7445 - DNA, 25 bp, Mus musculus
agctcctcattgcagttccctgaag

SEQ ID NO: 7446 - DNA, 25 bp, Mus musculus
agctcctccaaatagtcggcatcca

SEQ ID NO: 7447 - DNA, 25 bp, Mus musculus
agctcctccggcagtgtgcgggcca

SEQ ID NO: 7448 - DNA, 25 bp, Mus musculus
agctcctctgtgtccagcctcaatt

SEQ ID NO: 7449 - DNA, 25 bp, Mus musculus
agctcctggacaaccgaaaactgga

SEQ ID NO: 7450 - DNA, 25 bp, Mus musculus
agctcctgttacatgcacggcattg

SEQ ID NO: 7451 - DNA, 25 bp, Mus musculus
agctcctgtttgaagaccttggaac

SEQ ID NO: 7452 - DNA, 25 bp, Mus musculus
agctccttcacgtcagccgaacaga

SEQ ID NO: 7453 - DNA, 25 bp, Mus musculus
agctcgagccgggaaaactggacag

SEQ ID NO: 7454 - DNA, 25 bp, Mus musculus
agctcgcggcccagctcagaatggt

SEQ ID NO: 7455 - DNA, 25 bp, Mus musculus
agctcggaggacactaagcagatga

SEQ ID NO: 7456 - DNA, 25 bp, Mus musculus
agctcgggctggttaaatgacttgc

SEQ ID NO: 7457 - DNA, 25 bp, Mus musculus
agctcgggtgatgtgtgccccacag

SEQ ID NO: 7458 - DNA, 25 bp, Mus musculus
agctcggtcatcactcaggctcctt

SEQ ID NO: 7459 - DNA, 25 bp, Mus musculus
agctctaaggaaaaccacggaggag

SEQ ID NO: 7460 - DNA, 25 bp, Mus musculus
agctctagtgcttcctgtaccggga

SEQ ID NO: 7461 - DNA, 25 bp, Mus musculus
agctctatcacgacccctccaatga

SEQ ID NO: 7462 - DNA, 25 bp, Mus musculus
agctctatgggcgaggacccaggca

SEQ ID NO: 7463 - DNA, 25 bp, Mus musculus
agctctatgtgggaggccaagcccg

SEQ ID NO: 7464 - DNA, 25 bp, Mus musculus
agctctcaaacggaagtgccgccta

SEQ ID NO: 7465 - DNA, 25 bp, Mus musculus
agctctcagccaccatttttcgaaa

SEQ ID NO: 7466 - DNA, 25 bp, Mus musculus
agctctcagctgtcccaggtgcagt

SEQ ID NO: 7467 - DNA, 25 bp, Mus musculus
agctctcccctgtcagtgctctgag

SEQ ID NO: 7468 - DNA, 25 bp, Mus musculus
agctctcgtagactgctataaacca

SEQ ID NO: 7469 - DNA, 25 bp, Mus musculus
agctctctgactctgcaggatggtg

SEQ ID NO: 7470 - DNA, 25 bp, Mus musculus
agctctgaacatgtccgagtttgtc

SEQ ID NO: 7471 - DNA, 25 bp, Mus musculus
agctctgcggataaagagagacttg

SEQ ID NO: 7472 - DNA, 25 bp, Mus musculus
agctctggaaaggacctgtcaccca

SEQ ID NO: 7473 - DNA, 25 bp, Mus musculus
agctctgtgaactcgtctgctctca

SEQ ID NO: 7474 - DNA, 25 bp, Mus musculus
agctcttgggcatgttgtcaggaga

SEQ ID NO: 7475 - DNA, 25 bp, Mus musculus
agctctttgccttgttagcagccgt

SEQ ID NO: 7476 - DNA, 25 bp, Mus musculus
agctgaaaaagagagcggctggtct

SEQ ID NO: 7477 - DNA, 25 bp, Mus musculus
agctgaaaacgggttctgcggaaag

SEQ ID NO: 7478 - DNA, 25 bp, Mus musculus
agctgaaaagcctcaggaggctgga

SEQ ID NO: 7479 - DNA, 25 bp, Mus musculus
agctgaaacagcttcttctggctca

SEQ ID NO: 7480 - DNA, 25 bp, Mus musculus
agctgaaatcagcagaaatggtgtc

SEQ ID NO: 7481 - DNA, 25 bp, Mus musculus
agctgaacgatgaagggaaactgtc

SEQ ID NO: 7482 - DNA, 25 bp, Mus musculus
agctgaagaacccacaggttctgag

SEQ ID NO: 7483 - DNA, 25 bp, Mus musculus
agctgaagaaccgacaggttctgag

SEQ ID NO: 7484 - DNA, 25 bp, Mus musculus
agctgaagcctcaggcacagcctgt

SEQ ID NO: 7485 - DNA, 25 bp, Mus musculus
agctgaagcgtcacatgattaccca

SEQ ID NO: 7486 - DNA, 25 bp, Mus musculus
agctgaatacgatgaagtcagggca

SEQ ID NO: 7487 - DNA, 25 bp, Mus musculus
agctgaatggtgttcccacgcctgt

SEQ ID NO: 7488 - DNA, 25 bp, Mus musculus
agctgacagtgtggtaccacagcga

SEQ ID NO: 7489 - DNA, 25 bp, Mus musculus
agctgacccgtgacctgctgcggaa

SEQ ID NO: 7490 - DNA, 25 bp, Mus musculus
agctgactctgaaaagccctgccta

SEQ ID NO: 7491 - DNA, 25 bp, Mus musculus
agctgactggttggacagcatacgg

SEQ ID NO: 7492 - DNA, 25 bp, Mus musculus
agctgacttcttctggctgcataga

SEQ ID NO: 7493 - DNA, 25 bp, Mus musculus
agctgagaacataccctgccacctg

SEQ ID NO: 7494 - DNA, 25 bp, Mus musculus
agctgagaggagaccacaggataca

SEQ ID NO: 7495 - DNA, 25 bp, Mus musculus
agctgagaggcatcctattgaaggg

SEQ ID NO: 7496 - DNA, 25 bp, Mus musculus
agctgaggactcctccgcagtgcag

SEQ ID NO: 7497 - DNA, 25 bp, Mus musculus
agctgaggctgctgccgaagccaag

SEQ ID NO: 7498 - DNA, 25 bp, Mus musculus
agctgagggctttcgggtcacttac

SEQ ID NO: 7499 - DNA, 25 bp, Mus musculus
agctgaggtggagactaccttctgg

SEQ ID NO: 7500 - DNA, 25 bp, Mus musculus
agctgagtacttggctccttggttc

SEQ ID NO: 7501 - DNA, 25 bp, Mus musculus
agctgagtgaggagatgagccacct

SEQ ID NO: 7502 - DNA, 25 bp, Mus musculus
agctgagtgagtggccacattgatg

SEQ ID NO: 7503 - DNA, 25 bp, Mus musculus
agctgatccacgactacttggacaa

SEQ ID NO: 7504 - DNA, 25 bp, Mus musculus
agctgatgacaaacctgaagaccac

SEQ ID NO: 7505 - DNA, 25 bp, Mus musculus
agctgatgatgatcctgaacttctg

SEQ ID NO: 7506 - DNA, 25 bp, Mus musculus
agctgatgcagatgttcctcccttt

SEQ ID NO: 7507 - DNA, 25 bp, Mus musculus
agctgatgcttacgctccccttaca

SEQ ID NO: 7508 - DNA, 25 bp, Mus musculus
agctgatgggcctgagcagaaagaa

SEQ ID NO: 7509 - DNA, 25 bp, Mus musculus
agctgatgtcgtcgtcatgatgctg

SEQ ID NO: 7510 - DNA, 25 bp, Mus musculus
agctgattattggtgacagacagac

SEQ ID NO: 7511 - DNA, 25 bp, Mus musculus
agctgatttggacggcccgctctcc

SEQ ID NO: 7512 - DNA, 25 bp, Mus musculus
agctgcaagctctcgaggccacttg

SEQ ID NO: 7513 - DNA, 25 bp, Mus musculus
agctgcacagcagaggtaatcctgt

SEQ ID NO: 7514 - DNA, 25 bp, Mus musculus
agctgcacaggagcgtttcctgggc

SEQ ID NO: 7515 - DNA, 25 bp, Mus musculus
agctgcacagtctcggagctgaagg

SEQ ID NO: 7516 - DNA, 25 bp, Mus musculus
agctgcaccaagtgaggacggagac

SEQ ID NO: 7517 - DNA, 25 bp, Mus musculus
agctgcagaacttggtcgccatccc

SEQ ID NO: 7518 - DNA, 25 bp, Mus musculus
agctgcagcagcacacggcgttcat

SEQ ID NO: 7519 - DNA, 25 bp, Mus musculus
agctgcagcagcaggttcgggccct

SEQ ID NO: 7520 - DNA, 25 bp, Mus musculus
agctgcaggtcatctcagtactaca

SEQ ID NO: 7521 - DNA, 25 bp, Mus musculus
agctgcagtcagactcagaacttgg

SEQ ID NO: 7522 - DNA, 25 bp, Mus musculus
agctgcatgtgtttgtggcccagtg

SEQ ID NO: 7523 - DNA, 25 bp, Mus musculus
agctgccaccttcgatggaacgcac

SEQ ID NO: 7524 - DNA, 25 bp, Mus musculus
agctgccactgactgtactgcaaaa

SEQ ID NO: 7525 - DNA, 25 bp, Mus musculus
agctgccagttcctctcggagtgcc

SEQ ID NO: 7526 - DNA, 25 bp, Mus musculus
agctgcccatcgactttccagaaga

SEQ ID NO: 7527 - DNA, 25 bp, Mus musculus
agctgcctccattggccagcatgag

SEQ ID NO: 7528 - DNA, 25 bp, Mus musculus
agctgcctggtgctgaaaggtcctt

SEQ ID NO: 7529 - DNA, 25 bp, Mus musculus
agctgcgcgaccagcgctggaactg

SEQ ID NO: 7530 - DNA, 25 bp, Mus musculus
agctgcgggagctctctgaagttct

SEQ ID NO: 7531 - DNA, 25 bp, Mus musculus
agctgcggtcacctcggcgtacaca

SEQ ID NO: 7532 - DNA, 25 bp, Mus musculus
agctgcggtcacgtcggcgtacaca

SEQ ID NO: 7533 - DNA, 25 bp, Mus musculus
agctgctcaaagaccgtggcatggg

SEQ ID NO: 7534 - DNA, 25 bp, Mus musculus
agctgctcagactgcctgctcacag

SEQ ID NO: 7535 - DNA, 25 bp, Mus musculus
agctgctcctgttgacccgggacac

SEQ ID NO: 7536 - DNA, 25 bp, Mus musculus
agctgctgaagaaaccacctaccct

SEQ ID NO: 7537 - DNA, 25 bp, Mus musculus
agctgctgatgtcagttaactctga

SEQ ID NO: 7538 - DNA, 25 bp, Mus musculus
agctgctggaccctaggacagagca

SEQ ID NO: 7539 - DNA, 25 bp, Mus musculus
agctgctgtatgagcaagcgatgga

SEQ ID NO: 7540 - DNA, 25 bp, Mus musculus
agctgctgtcaaagttggacatggg

SEQ ID NO: 7541 - DNA, 25 bp, Mus musculus
agctgctgtcaatgttggacatggg

SEQ ID NO: 7542 - DNA, 25 bp, Mus musculus
agctgctgtgtctcaagcaaaacca

SEQ ID NO: 7543 - DNA, 25 bp, Mus musculus
agctgcttataagactcacgggcac

SEQ ID NO: 7544 - DNA, 25 bp, Mus musculus
agctgcttcgacatgagaaccggaa

SEQ ID NO: 7545 - DNA, 25 bp, Mus musculus
agctgcttgcgggatggcatacaca

SEQ ID NO: 7546 - DNA, 25 bp, Mus musculus
agctgcttgtgacatactgtcgcag

SEQ ID NO: 7547 - DNA, 25 bp, Mus musculus
agctggaaatattcttctgggtgag

SEQ ID NO: 7548 - DNA, 25 bp, Mus musculus
agctggaacctcaaggccctcagga

SEQ ID NO: 7549 - DNA, 25 bp, Mus musculus
agctggaacctctaggccctcagga

SEQ ID NO: 7550 - DNA, 25 bp, Mus musculus
agctggacaacaaagccccgaggat

SEQ ID NO: 7551 - DNA, 25 bp, Mus musculus
agctggacagttccatcctttgcat

SEQ ID NO: 7552 - DNA, 25 bp, Mus musculus
agctggaccccgaaagggccactca

SEQ ID NO: 7553 - DNA, 25 bp, Mus musculus
agctggacgatgagagcagcagccc

SEQ ID NO: 7554 - DNA, 25 bp, Mus musculus
agctggacgggctctggacgaccat

SEQ ID NO: 7555 - DNA, 25 bp, Mus musculus
agctggagcagagcctgctattgga

SEQ ID NO: 7556 - DNA, 25 bp, Mus musculus
agctggagcccttagctgatgggca

SEQ ID NO: 7557 - DNA, 25 bp, Mus musculus
agctggagtctcagctgcaccgcct

SEQ ID NO: 7558 - DNA, 25 bp, Mus musculus
agctggatcaggcaagctccagcac

SEQ ID NO: 7559 - DNA, 25 bp, Mus musculus
agctggatcctgcacacagggccgt

SEQ ID NO: 7560 - DNA, 25 bp, Mus musculus
agctggatgggctcttcaggcgcta

SEQ ID NO: 7561 - DNA, 25 bp, Mus musculus
agctggattagcttggaagcagttc

SEQ ID NO: 7562 - DNA, 25 bp, Mus musculus
agctggcaaacggactgttgcttcc

SEQ ID NO: 7563 - DNA, 25 bp, Mus musculus
agctggcccgagagctcaagatcct

SEQ ID NO: 7564 - DNA, 25 bp, Mus musculus
agctggcccggcttcggcaagagct

SEQ ID NO: 7565 - DNA, 25 bp, Mus musculus
agctggcccttagtttgagccgaga

SEQ ID NO: 7566 - DNA, 25 bp, Mus musculus
agctggcctcgaactgtggtcctcc

SEQ ID NO: 7567 - DNA, 25 bp, Mus musculus
agctggcggtgcagaccaagcgtgt

SEQ ID NO: 7568 - DNA, 25 bp, Mus musculus
agctggctggttggagttcaccgca

SEQ ID NO: 7569 - DNA, 25 bp, Mus musculus
agctggcttcctacccgaggccgag

SEQ ID NO: 7570 - DNA, 25 bp, Mus musculus
agctgggcactgtaggtcaatctcc

SEQ ID NO: 7571 - DNA, 25 bp, Mus musculus
agctggtccagagtgggcccctgac

SEQ ID NO: 7572 - DNA, 25 bp, Mus musculus
agctggtcctcactggcagcagcga

SEQ ID NO: 7573 - DNA, 25 bp, Mus musculus
agctggtgccaaagagggaccatgc

SEQ ID NO: 7574 - DNA, 25 bp, Mus musculus
agctggtgcccttgaaggagaccat

SEQ ID NO: 7575 - DNA, 25 bp, Mus musculus
agctggttcccctcctgacgacggg

SEQ ID NO: 7576 - DNA, 25 bp, Mus musculus
agctgtaccactcgcctgctaggcg

SEQ ID NO: 7577 - DNA, 25 bp, Mus musculus
agctgtaccgaaactactgccaccg

SEQ ID NO: 7578 - DNA, 25 bp, Mus musculus
agctgtacctctactccttcatcag

SEQ ID NO: 7579 - DNA, 25 bp, Mus musculus
agctgtaggactaggtgttgcagct

SEQ ID NO: 7580 - DNA, 25 bp, Mus musculus
agctgtccaggtttattgctgctgg

SEQ ID NO: 7581 - DNA, 25 bp, Mus musculus
agctgtccctggagacctccttgca

SEQ ID NO: 7582 - DNA, 25 bp, Mus musculus
agctgtccttgccacgttacttttg

SEQ ID NO: 7583 - DNA, 25 bp, Mus musculus
agctgtcgcagcttatcttcgtgcc

SEQ ID NO: 7584 - DNA, 25 bp, Mus musculus
agctgtctcggcagctccgggacca

SEQ ID NO: 7585 - DNA, 25 bp, Mus musculus
agctgtctggctcaaggcctctcca

SEQ ID NO: 7586 - DNA, 25 bp, Mus musculus
agctgtgcaacgaggctcggattga

SEQ ID NO: 7587 - DNA, 25 bp, Mus musculus
agctgtgcaacgtggctcggattga

SEQ ID NO: 7588 - DNA, 25 bp, Mus musculus
agctgtgcacaagctgaccaagcgc

SEQ ID NO: 7589 - DNA, 25 bp, Mus musculus
agctgtgcccaggagtgaataccca

SEQ ID NO: 7590 - DNA, 25 bp, Mus musculus
agctgtggatgaaggccatgttaga

SEQ ID NO: 7591 - DNA, 25 bp, Mus musculus
agctgtggatgccatgctggtccat

SEQ ID NO: 7592 - DNA, 25 bp, Mus musculus
agctgtggcatgtttatttctactg

SEQ ID NO: 7593 - DNA, 25 bp, Mus musculus
agctgtggccactggaagactctca

SEQ ID NO: 7594 - DNA, 25 bp, Mus musculus
agctgtggcttacaaagagagttcc

SEQ ID NO: 7595 - DNA, 25 bp, Mus musculus
agctgtggtagctccgcacccagat

SEQ ID NO: 7596 - DNA, 25 bp, Mus musculus
agctgttgcgcagccattggtacct

SEQ ID NO: 7597 - DNA, 25 bp, Mus musculus
agctgttgggcccactgcctatgca

SEQ ID NO: 7598 - DNA, 25 bp, Mus musculus
agctgtttgacaccatctccctgct

SEQ ID NO: 7599 - DNA, 25 bp, Mus musculus
agcttatcctggacatgtttggaga

SEQ ID NO: 7600 - DNA, 25 bp, Mus musculus
agcttatggccaaacagaatgcaca

SEQ ID NO: 7601 - DNA, 25 bp, Mus musculus
agcttcaagaaacagtcgtttgtct

SEQ ID NO: 7602 - DNA, 25 bp, Mus musculus
agcttcagcgcaccagagcagcagc

SEQ ID NO: 7603 - DNA, 25 bp, Mus musculus
agcttccattctaaaggtgccagga

SEQ ID NO: 7604 - DNA, 25 bp, Mus musculus
agcttcccagccttgcttactactg

SEQ ID NO: 7605 - DNA, 25 bp, Mus musculus
agcttccggtttgagcagccaagat

SEQ ID NO: 7606 - DNA, 25 bp, Mus musculus
agcttcctgggcacctgactcagga

SEQ ID NO: 7607 - DNA, 25 bp, Mus musculus
agcttcctggtgttctggctggaga

SEQ ID NO: 7608 - DNA, 25 bp, Mus musculus
agcttcgccctatgagcctgtgacc

SEQ ID NO: 7609 - DNA, 25 bp, Mus musculus
agcttctatttctggaggcctggga

SEQ ID NO: 7610 - DNA, 25 bp, Mus musculus
agcttctcaagttcttccacgagaa

SEQ ID NO: 7611 - DNA, 25 bp, Mus musculus
agcttctctgaacagacgcatccag

SEQ ID NO: 7612 - DNA, 25 bp, Mus musculus
agcttctggccctcatccaggacat

SEQ ID NO: 7613 - DNA, 25 bp, Mus musculus
agcttctggtagttctcgggccgga

SEQ ID NO: 7614 - DNA, 25 bp, Mus musculus
agcttcttcagtagctgagagtaag

SEQ ID NO: 7615 - DNA, 25 bp, Mus musculus
agcttgaagagaggtcccgggacct

SEQ ID NO: 7616 - DNA, 25 bp, Mus musculus
agcttgcactcttggcccacctgta

SEQ ID NO: 7617 - DNA, 25 bp, Mus musculus
agcttgcagaaatcacgctggatcc

SEQ ID NO: 7618 - DNA, 25 bp, Mus musculus
agcttggagacttggacacgggtcc

SEQ ID NO: 7619 - DNA, 25 bp, Mus musculus
agcttggccattgccacctgtgtgc

SEQ ID NO: 7620 - DNA, 25 bp, Mus musculus
agcttggcttggttcagttcaaaga

SEQ ID NO: 7621 - DNA, 25 bp, Mus musculus
agcttggtcctggtcgtcctctaca

SEQ ID NO: 7622 - DNA, 25 bp, Mus musculus
agcttggtgttggtggcacaagtca

SEQ ID NO: 7623 - DNA, 25 bp, Mus musculus
agcttgtggcttcgagactggtcaa

SEQ ID NO: 7624 - DNA, 25 bp, Mus musculus
agcttgtggtccaccagaggtggaa

SEQ ID NO: 7625 - DNA, 25 bp, Mus musculus
agctttagttgtacacccctcctgc

SEQ ID NO: 7626 - DNA, 25 bp, Mus musculus
agctttcaccatgggtgtcattggt

SEQ ID NO: 7627 - DNA, 25 bp, Mus musculus
agctttcatcatttggctgagcaca

SEQ ID NO: 7628 - DNA, 25 bp, Mus musculus
agctttcgggatgccatgcgacttg

SEQ ID NO: 7629 - DNA, 25 bp, Mus musculus
agctttgcacctgtagcagacacca

SEQ ID NO: 7630 - DNA, 25 bp, Mus musculus
agctttgcggtttgtccattctcag

SEQ ID NO: 7631 - DNA, 25 bp, Mus musculus
agctttggcaccgacaggagactcc

SEQ ID NO: 7632 - DNA, 25 bp, Mus musculus
agctttggttccagtagaggctgca

SEQ ID NO: 7633 - DNA, 25 bp, Mus musculus
agctttgtggatccacttgtgacca

SEQ ID NO: 7634 - DNA, 25 bp, Mus musculus
agcttttgctccagacagtcccagg

SEQ ID NO: 7635 - DNA, 25 bp, Mus musculus
aggaaaaggccgaggcacattgtcg

SEQ ID NO: 7636 - DNA, 25 bp, Mus musculus
aggaaacaatcccttggcaagagcg

SEQ ID NO: 7637 - DNA, 25 bp, Mus musculus
aggaaacagcaaaggcaccttgaag

SEQ ID NO: 7638 - DNA, 25 bp, Mus musculus
aggaaacgccagtcttctcagcaca

SEQ ID NO: 7639 - DNA, 25 bp, Mus musculus
aggaaacggacccacaccctgagcg

SEQ ID NO: 7640 - DNA, 25 bp, Mus musculus
aggaaactgggctcacctggaccaa

SEQ ID NO: 7641 - DNA, 25 bp, Mus musculus
aggaaacttcgcagtgagccaccag

SEQ ID NO: 7642 - DNA, 25 bp, Mus musculus
aggaaagggaccgactcagagtgac

SEQ ID NO: 7643 - DNA, 25 bp, Mus musculus
aggaaatccacgtcggctgggatgc

SEQ ID NO: 7644 - DNA, 25 bp, Mus musculus
aggaaatgttgtttcgccagtgaaa

SEQ ID NO: 7645 - DNA, 25 bp, Mus musculus
aggaaattcattgaggccgcccaga

SEQ ID NO: 7646 - DNA, 25 bp, Mus musculus
aggaaattcctggtactacggctgt

SEQ ID NO: 7647 - DNA, 25 bp, Mus musculus
aggaaattgcacgaggcccgagccg

SEQ ID NO: 7648 - DNA, 25 bp, Mus musculus
aggaaatttacctgtccgaggcaca

SEQ ID NO: 7649 - DNA, 25 bp, Mus musculus
aggaacaaccccagagactcacggc

SEQ ID NO: 7650 - DNA, 25 bp, Mus musculus
aggaacacccagaaacaggccagaa

SEQ ID NO: 7651 - DNA, 25 bp, Mus musculus
aggaacagaagttgatattgactcc

SEQ ID NO: 7652 - DNA, 25 bp, Mus musculus
aggaacataattcggaaatgggcaa

SEQ ID NO: 7653 - DNA, 25 bp, Mus musculus
aggaacataattgggaaatgggcaa

SEQ ID NO: 7654 - DNA, 25 bp, Mus musculus
aggaaccctgctatctgctgagaaa

SEQ ID NO: 7655 - DNA, 25 bp, Mus musculus
aggaacctgagcacagagtccgggt

SEQ ID NO: 7656 - DNA, 25 bp, Mus musculus
aggaacgagagaagcatttccagaa

SEQ ID NO: 7657 - DNA, 25 bp, Mus musculus
aggaacggcctgtgcatcgacaaga

SEQ ID NO: 7658 - DNA, 25 bp, Mus musculus
aggaactctgtgagccggagagaaa

SEQ ID NO: 7659 - DNA, 25 bp, Mus musculus
aggaactgaggaagcggctgacacc

SEQ ID NO: 7660 - DNA, 25 bp, Mus musculus
aggaactgaggcagtggttcttcag

SEQ ID NO: 7661 - DNA, 25 bp, Mus musculus
aggaactgcctacccagatcagcag

SEQ ID NO: 7662 - DNA, 25 bp, Mus musculus
aggaactggccgacgctgtcctggc

SEQ ID NO: 7663 - DNA, 25 bp, Mus musculus
aggaacttcaccagaaggaggtcac

SEQ ID NO: 7664 - DNA, 25 bp, Mus musculus
aggaacttttcatcctgaagtacag

SEQ ID NO: 7665 - DNA, 25 bp, Mus musculus
aggaagaacaagaaggaactcgagt

SEQ ID NO: 7666 - DNA, 25 bp, Mus musculus
aggaagagaaggaatcagagctctg

SEQ ID NO: 7667 - DNA, 25 bp, Mus musculus
aggaagagagccaaccagcaaaaaa

SEQ ID NO: 7668 - DNA, 25 bp, Mus musculus
aggaagagcactgccagctgcagca

SEQ ID NO: 7669 - DNA, 25 bp, Mus musculus
aggaagaggctgaaacaccacacga

SEQ ID NO: 7670 - DNA, 25 bp, Mus musculus
aggaagagggcgctgtgtcaacagt

SEQ ID NO: 7671 - DNA, 25 bp, Mus musculus
aggaagagggcggtgtgtcaacagt

SEQ ID NO: 7672 - DNA, 25 bp, Mus musculus
aggaagatgtataccgaggcccagc

SEQ ID NO: 7673 - DNA, 25 bp, Mus musculus
aggaagattttggaaacctgcattc

SEQ ID NO: 7674 - DNA, 25 bp, Mus musculus
aggaagccagatattggacctacaa

SEQ ID NO: 7675 - DNA, 25 bp, Mus musculus
aggaagccagccaacgagctcacct

SEQ ID NO: 7676 - DNA, 25 bp, Mus musculus
aggaagccattacccactgctgccg

SEQ ID NO: 7677 - DNA, 25 bp, Mus musculus
aggaagcctgcacagtccccagcaa

SEQ ID NO: 7678 - DNA, 25 bp, Mus musculus
aggaagcctggaattcttgcccgca

SEQ ID NO: 7679 - DNA, 25 bp, Mus musculus
aggaagcctggatttcttgcccgca

SEQ ID NO: 7680 - DNA, 25 bp, Mus musculus
aggaagcggcactccgcgcactggt

SEQ ID NO: 7681 - DNA, 25 bp, Mus musculus
aggaagcggctgacacccctacagt

SEQ ID NO: 7682 - DNA, 25 bp, Mus musculus
aggaaggagtgctcttattctccac

SEQ ID NO: 7683 - DNA, 25 bp, Mus musculus
aggaaggcctacaaggatggcctca

SEQ ID NO: 7684 - DNA, 25 bp, Mus musculus
aggaagggtggcatcacagtgtccc

SEQ ID NO: 7685 - DNA, 25 bp, Mus musculus
aggaagtacaaatgcggcctgcccc

SEQ ID NO: 7686 - DNA, 25 bp, Mus musculus
aggaagtcagacatatgaaactgag

SEQ ID NO: 7687 - DNA, 25 bp, Mus musculus
aggaagtcgagttccagcgtgcacc

SEQ ID NO: 7688 - DNA, 25 bp, Mus musculus
aggaagtgcatcttcatacaccacc

SEQ ID NO: 7689 - DNA, 25 bp, Mus musculus
aggaagtggaatttgaacccaggca

SEQ ID NO: 7690 - DNA, 25 bp, Mus musculus
aggaatagcgttcattgttactggc

SEQ ID NO: 7691 - DNA, 25 bp, Mus musculus
aggaatcatgcacccggttctatca

SEQ ID NO: 7692 - DNA, 25 bp, Mus musculus
aggaatccaaaatgctacaaagaag

SEQ ID NO: 7693 - DNA, 25 bp, Mus musculus
aggaatgctgccaaggtcctacaag

SEQ ID NO: 7694 - DNA, 25 bp, Mus musculus
aggaatggagctacctggtgactca

SEQ ID NO: 7695 - DNA, 25 bp, Mus musculus
aggaatgtcacagcgtctggagtca

SEQ ID NO: 7696 - DNA, 25 bp, Mus musculus
aggaattcctggatccccagggcca

SEQ ID NO: 7697 - DNA, 25 bp, Mus musculus
aggacaaagcaaaatctacctgaag

SEQ ID NO: 7698 - DNA, 25 bp, Mus musculus
aggacaaagtcatccctgcactcgc

SEQ ID NO: 7699 - DNA, 25 bp, Mus musculus
aggacaacaaacttttcctgacagg

SEQ ID NO: 7700 - DNA, 25 bp, Mus musculus
aggacaacctgctgcccggtgccat

SEQ ID NO: 7701 - DNA, 25 bp, Mus musculus
aggacaagacattcaggcccaaacg

SEQ ID NO: 7702 - DNA, 25 bp, Mus musculus
aggacaaggacaaagcactgcccag

SEQ ID NO: 7703 - DNA, 25 bp, Mus musculus
aggacaaggccctacccaggcctat

SEQ ID NO: 7704 - DNA, 25 bp, Mus musculus
aggacaatattaagcatgtccctgg

SEQ ID NO: 7705 - DNA, 25 bp, Mus musculus
aggacaatggagtccggagctcgcc

SEQ ID NO: 7706 - DNA, 25 bp, Mus musculus
aggacacactggctcctttgccgca

SEQ ID NO: 7707 - DNA, 25 bp, Mus musculus
aggacacaggctttctccctccggt

SEQ ID NO: 7708 - DNA, 25 bp, Mus musculus
aggacacagtagagcggattgttcg

SEQ ID NO: 7709 - DNA, 25 bp, Mus musculus
aggacactaagtaagaacaccttca

SEQ ID NO: 7710 - DNA, 25 bp, Mus musculus
aggacactgcatttactcaaacccg

SEQ ID NO: 7711 - DNA, 25 bp, Mus musculus
aggacagccgtgaccatgcagacaa

SEQ ID NO: 7712 - DNA, 25 bp, Mus musculus
aggacagcctcctggctgccgacga

SEQ ID NO: 7713 - DNA, 25 bp, Mus musculus
aggacaggctgacggtcacctctcc

SEQ ID NO: 7714 - DNA, 25 bp, Mus musculus
aggacataggccctcccattccaga

SEQ ID NO: 7715 - DNA, 25 bp, Mus musculus
aggacatcagaattctctgcccctg

SEQ ID NO: 7716 - DNA, 25 bp, Mus musculus
aggacatcttcacgcggcacgacat

SEQ ID NO: 7717 - DNA, 25 bp, Mus musculus
aggacatgactcaacggtgcacagt

SEQ ID NO: 7718 - DNA, 25 bp, Mus musculus
aggacattacggagcgcctcatcct

SEQ ID NO: 7719 - DNA, 25 bp, Mus musculus
aggacatttttctacacctggacaa

SEQ ID NO: 7720 - DNA, 25 bp, Mus musculus
aggaccacaagattttcccctcctg

SEQ ID NO: 7721 - DNA, 25 bp, Mus musculus
aggaccacctttttggcaatctatg

SEQ ID NO: 7722 - DNA, 25 bp, Mus musculus
aggaccagccatgggtcaagaggct

SEQ ID NO: 7723 - DNA, 25 bp, Mus musculus
aggaccaggccaatgagtaccgcgt

SEQ ID NO: 7724 - DNA, 25 bp, Mus musculus
aggaccatccatccactgaaacatt

SEQ ID NO: 7725 - DNA, 25 bp, Mus musculus
aggaccatggtggaagcacatctgg

SEQ ID NO: 7726 - DNA, 25 bp, Mus musculus
aggaccgagtcttggtggctgacaa

SEQ ID NO: 7727 - DNA, 25 bp, Mus musculus
aggaccggcctgtcctgcacacaga

SEQ ID NO: 7728 - DNA, 25 bp, Mus musculus
aggacctttggctgcagatgccaca

SEQ ID NO: 7729 - DNA, 25 bp, Mus musculus
aggacgacgcacttcctccgagtcg

SEQ ID NO: 7730 - DNA, 25 bp, Mus musculus
aggacgagcctcctttcatcgacca

SEQ ID NO: 7731 - DNA, 25 bp, Mus musculus
aggacgcccagatggtgcacagcaa

SEQ ID NO: 7732 - DNA, 25 bp, Mus musculus
aggacgctccttcagacctcagtgc

SEQ ID NO: 7733 - DNA, 25 bp, Mus musculus
aggacggcttcacgccattggccgt

SEQ ID NO: 7734 - DNA, 25 bp, Mus musculus
aggacggtgcccacagcgacgaaga

SEQ ID NO: 7735 - DNA, 25 bp, Mus musculus
aggacgtttcagtgctttgggaatg

SEQ ID NO: 7736 - DNA, 25 bp, Mus musculus
aggacgtttgatgcccggcccctga

SEQ ID NO: 7737 - DNA, 25 bp, Mus musculus
aggactccatcactgtccacacaag

SEQ ID NO: 7738 - DNA, 25 bp, Mus musculus
aggactctagccttctccatccatg

SEQ ID NO: 7739 - DNA, 25 bp, Mus musculus
aggactctgaccaagtagcgcagag

SEQ ID NO: 7740 - DNA, 25 bp, Mus musculus
aggactctgcccttctaagtaaacg

SEQ ID NO: 7741 - DNA, 25 bp, Mus musculus
aggactgaacccctgcgtaggagca

SEQ ID NO: 7742 - DNA, 25 bp, Mus musculus
aggactgaccacatctaccacggaa

SEQ ID NO: 7743 - DNA, 25 bp, Mus musculus
aggactgcctgaccctcaacatcta

SEQ ID NO: 7744 - DNA, 25 bp, Mus musculus
aggactggctgtgaccctctctgtg

SEQ ID NO: 7745 - DNA, 25 bp, Mus musculus
aggactgggagtgcttccgagccat

SEQ ID NO: 7746 - DNA, 25 bp, Mus musculus
aggactgtcccgacggcagcgacga

SEQ ID NO: 7747 - DNA, 25 bp, Mus musculus
aggactgtccgtgtgttcctgctct

SEQ ID NO: 7748 - DNA, 25 bp, Mus musculus
aggacttccgggaccatgctgagca

SEQ ID NO: 7749 - DNA, 25 bp, Mus musculus
aggacttgatcaacttctgccttag

SEQ ID NO: 7750 - DNA, 25 bp, Mus musculus
aggactttgatgtggctaatgacat

SEQ ID NO: 7751 - DNA, 25 bp, Mus musculus
aggagaactttgactggccagccgc

SEQ ID NO: 7752 - DNA, 25 bp, Mus musculus
aggagaagcccctagtggacctgca

SEQ ID NO: 7753 - DNA, 25 bp, Mus musculus
aggagaagccgctgttgccaggaca

SEQ ID NO: 7754 - DNA, 25 bp, Mus musculus
aggagaagccggtcagcctcgccat

SEQ ID NO: 7755 - DNA, 25 bp, Mus musculus
aggagaagctgcgttccctaaccca

SEQ ID NO: 7756 - DNA, 25 bp, Mus musculus
aggagaatctcagaccttttcaaag

SEQ ID NO: 7757 - DNA, 25 bp, Mus musculus
aggagaatgcgctgttgccaaattg

SEQ ID NO: 7758 - DNA, 25 bp, Mus musculus
aggagaattggcgagaaggtatcca

SEQ ID NO: 7759 - DNA, 25 bp, Mus musculus
aggagacactaaccagaagctacgg

SEQ ID NO: 7760 - DNA, 25 bp, Mus musculus
aggagaccacgtccaccttctgcgg

SEQ ID NO: 7761 - DNA, 25 bp, Mus musculus
aggagaccattcaggccctccgagc

SEQ ID NO: 7762 - DNA, 25 bp, Mus musculus
aggagacccaaagtctcctagtgag

SEQ ID NO: 7763 - DNA, 25 bp, Mus musculus
aggagacccctgtccaggcagagaa

SEQ ID NO: 7764 - DNA, 25 bp, Mus musculus
aggagaccgagcttggccctgccct

SEQ ID NO: 7765 - DNA, 25 bp, Mus musculus
aggagacctcaccacggagcccttt

SEQ ID NO: 7766 - DNA, 25 bp, Mus musculus
aggagacggctagctggctgctggc

SEQ ID NO: 7767 - DNA, 25 bp, Mus musculus
aggagactattgaacagaaaaggaa

SEQ ID NO: 7768 - DNA, 25 bp, Mus musculus
aggagactgaccttgccccaagtca

SEQ ID NO: 7769 - DNA, 25 bp, Mus musculus
aggagagacagcgagacgagcttct

SEQ ID NO: 7770 - DNA, 25 bp, Mus musculus
aggagagcatcatggacctggagaa

SEQ ID NO: 7771 - DNA, 25 bp, Mus musculus
aggagaggcccgtgtctggaataac

SEQ ID NO: 7772 - DNA, 25 bp, Mus musculus
aggagaggccttgatgtcaagtgct

SEQ ID NO: 7773 - DNA, 25 bp, Mus musculus
aggagatcctcctccggaagggtgt

SEQ ID NO: 7774 - DNA, 25 bp, Mus musculus
aggagatcgagacctactgccgcct

SEQ ID NO: 7775 - DNA, 25 bp, Mus musculus
aggagatcgcccaggtacacagcaa

SEQ ID NO: 7776 - DNA, 25 bp, Mus musculus
aggagatgagccacctggaggttca

SEQ ID NO: 7777 - DNA, 25 bp, Mus musculus
aggagcacactgaccaggtcctgca

SEQ ID NO: 7778 - DNA, 25 bp, Mus musculus
aggagcaccgactacgtccctcgtt

SEQ ID NO: 7779 - DNA, 25 bp, Mus musculus
aggagcagattgtcgcccagcagga

SEQ ID NO: 7780 - DNA, 25 bp, Mus musculus
aggagcagcgtgtccacctggaaga

SEQ ID NO: 7781 - DNA, 25 bp, Mus musculus
aggagcagcttcgagtggatgctct

SEQ ID NO: 7782 - DNA, 25 bp, Mus musculus
aggagcagtcaggttcacaagaaaa

SEQ ID NO: 7783 - DNA, 25 bp, Mus musculus
aggagcagtcgagcggcatgaccat

SEQ ID NO: 7784 - DNA, 25 bp, Mus musculus
aggagccacacaagccgactggcag

SEQ ID NO: 7785 - DNA, 25 bp, Mus musculus
aggagccgcattgaccaagcccaga

SEQ ID NO: 7786 - DNA, 25 bp, Mus musculus
aggagccggaggagaccagaggttt

SEQ ID NO: 7787 - DNA, 25 bp, Mus musculus
aggagccgtagctgctgatttacga

SEQ ID NO: 7788 - DNA, 25 bp, Mus musculus
aggagcctctttcttctccagcgat

SEQ ID NO: 7789 - DNA, 25 bp, Mus musculus
aggagcctgatctggttagtgcaat

SEQ ID NO: 7790 - DNA, 25 bp, Mus musculus
aggagcgcaaggcaactctgccctc

SEQ ID NO: 7791 - DNA, 25 bp, Mus musculus
aggagcgccaagaagcctcacggct

SEQ ID NO: 7792 - DNA, 25 bp, Mus musculus
aggagcgccaagtagcctcacggct

SEQ ID NO: 7793 - DNA, 25 bp, Mus musculus
aggagcgctcgcagccttgtgactg

SEQ ID NO: 7794 - DNA, 25 bp, Mus musculus
aggagcgctgcgtcattgttagaac

SEQ ID NO: 7795 - DNA, 25 bp, Mus musculus
aggagcgcttccagagtgacagcag

SEQ ID NO: 7796 - DNA, 25 bp, Mus musculus
aggagcgctttgcagcaaatgccca

SEQ ID NO: 7797 - DNA, 25 bp, Mus musculus
aggagcggttccagagcatgcatgc

SEQ ID NO: 7798 - DNA, 25 bp, Mus musculus
aggagctaacccagaaggtggccca

SEQ ID NO: 7799 - DNA, 25 bp, Mus musculus
aggagctagagagtctccatcctgg

SEQ ID NO: 7800 - DNA, 25 bp, Mus musculus
aggagctatggatttggtgtccagt

SEQ ID NO: 7801 - DNA, 25 bp, Mus musculus
aggagctcatcaaagcccagaaggt

SEQ ID NO: 7802 - DNA, 25 bp, Mus musculus
aggagctccaccatcatcttcagct

SEQ ID NO: 7803 - DNA, 25 bp, Mus musculus
aggagctcggagaagactctgcttt

SEQ ID NO: 7804 - DNA, 25 bp, Mus musculus
aggagctgccccttggcctatggct

SEQ ID NO: 7805 - DNA, 25 bp, Mus musculus
aggagctgctaaagaggatgatgat

SEQ ID NO: 7806 - DNA, 25 bp, Mus musculus
aggagctggaccacgctctcaacga

SEQ ID NO: 7807 - DNA, 25 bp, Mus musculus
aggagctggccgtcatccaggacac

SEQ ID NO: 7808 - DNA, 25 bp, Mus musculus
aggagctgtacgctgacatcgatgc

SEQ ID NO: 7809 - DNA, 25 bp, Mus musculus
aggagctgtacggtgacatcgatgc

SEQ ID NO: 7810 - DNA, 25 bp, Mus musculus
aggagcttctctctgcatcattggg

SEQ ID NO: 7811 - DNA, 25 bp, Mus musculus
aggaggaaacaatcccttggcaaga

SEQ ID NO: 7812 - DNA, 25 bp, Mus musculus
aggaggaacacaagctcacagctgt

SEQ ID NO: 7813 - DNA, 25 bp, Mus musculus
aggaggaacacgtcctaccagctgc

SEQ ID NO: 7814 - DNA, 25 bp, Mus musculus
aggaggaacctgagcacagagtccg

SEQ ID NO: 7815 - DNA, 25 bp, Mus musculus
aggaggacaggcacagcatcgacat

SEQ ID NO: 7816 - DNA, 25 bp, Mus musculus
aggaggacctatgcactggccctgc

SEQ ID NO: 7817 - DNA, 25 bp, Mus musculus
aggaggactacattccctacccaag

SEQ ID NO: 7818 - DNA, 25 bp, Mus musculus
aggaggactccggactccgcgatca

SEQ ID NO: 7819 - DNA, 25 bp, Mus musculus
aggaggacttccgtttgcagaacag

SEQ ID NO: 7820 - DNA, 25 bp, Mus musculus
aggaggagacgctgtcgtttatccg

SEQ ID NO: 7821 - DNA, 25 bp, Mus musculus
aggaggagctaagttcgaaagatgc

SEQ ID NO: 7822 - DNA, 25 bp, Mus musculus
aggaggagctgacggttcacctttc

SEQ ID NO: 7823 - DNA, 25 bp, Mus musculus
aggaggagcttcgaaccatggacca

SEQ ID NO: 7824 - DNA, 25 bp, Mus musculus
aggaggaggctattcagattgctgc

SEQ ID NO: 7825 - DNA, 25 bp, Mus musculus
aggaggatacaaagcgaaaattcat

SEQ ID NO: 7826 - DNA, 25 bp, Mus musculus
aggaggatgactctaacaagctcgg

SEQ ID NO: 7827 - DNA, 25 bp, Mus musculus
aggaggatgcacagaagacccaact

SEQ ID NO: 7828 - DNA, 25 bp, Mus musculus
aggaggcaaacgtcgccctgggtct

SEQ ID NO: 7829 - DNA, 25 bp, Mus musculus
aggaggcagccaggatttaataaac

SEQ ID NO: 7830 - DNA, 25 bp, Mus musculus
aggaggcatgaaacttgtgaactgt

SEQ ID NO: 7831 - DNA, 25 bp, Mus musculus
aggaggccagacaagagcactgaat

SEQ ID NO: 7832 - DNA, 25 bp, Mus musculus
aggaggccatgcatatcttaaggaa

SEQ ID NO: 7833 - DNA, 25 bp, Mus musculus
aggaggccatggaccctgtctcggt

SEQ ID NO: 7834 - DNA, 25 bp, Mus musculus
aggagggatggcagttagacctcaa

SEQ ID NO: 7835 - DNA, 25 bp, Mus musculus
aggagggattagacccaggctctgt

SEQ ID NO: 7836 - DNA, 25 bp, Mus musculus
aggagggcatcatggcaggaccaga

SEQ ID NO: 7837 - DNA, 25 bp, Mus musculus
aggagggtatatgggcatagccaat

SEQ ID NO: 7838 - DNA, 25 bp, Mus musculus
aggagggtgagatgcctgacttccc

SEQ ID NO: 7839 - DNA, 25 bp, Mus musculus
aggagtaaggattggtggcatctct

SEQ ID NO: 7840 - DNA, 25 bp, Mus musculus
aggagtaccaggaggtgatgaactc

SEQ ID NO: 7841 - DNA, 25 bp, Mus musculus
aggagtacctggacattgtgcggca

SEQ ID NO: 7842 - DNA, 25 bp, Mus musculus
aggagtcaacagaagcacaaagttt

SEQ ID NO: 7843 - DNA, 25 bp, Mus musculus
aggagtcccggatcctgtgccctga

SEQ ID NO: 7844 - DNA, 25 bp, Mus musculus
aggagtctctcgctctggtttcccc

SEQ ID NO: 7845 - DNA, 25 bp, Mus musculus
aggagtctctcggtctggtttcccc

SEQ ID NO: 7846 - DNA, 25 bp, Mus musculus
aggagtctgctgtccatttgaaaat

SEQ ID NO: 7847 - DNA, 25 bp, Mus musculus
aggagtgcaaacaccccagtgtctc

SEQ ID NO: 7848 - DNA, 25 bp, Mus musculus
aggagtgccccttcctgcacatcga

SEQ ID NO: 7849 - DNA, 25 bp, Mus musculus
aggagtgtgcccactgcagtcgagc

SEQ ID NO: 7850 - DNA, 25 bp, Mus musculus
aggagtttttggtgacagacaacag

SEQ ID NO: 7851 - DNA, 25 bp, Mus musculus
aggatacagcctacaacaccaagag

SEQ ID NO: 7852 - DNA, 25 bp, Mus musculus
aggatacagtgacggactcgcagcc

SEQ ID NO: 7853 - DNA, 25 bp, Mus musculus
aggatagttgatttcctgatgcccc

SEQ ID NO: 7854 - DNA, 25 bp, Mus musculus
aggatatcgtctggcctgggctgcc

SEQ ID NO: 7855 - DNA, 25 bp, Mus musculus
aggatattgagaccctacatggctc

SEQ ID NO: 7856 - DNA, 25 bp, Mus musculus
aggatattgccaggagaagcaaaac

SEQ ID NO: 7857 - DNA, 25 bp, Mus musculus
aggatccctaacaggttcttgagag

SEQ ID NO: 7858 - DNA, 25 bp, Mus musculus
aggatccgggcccaacacgtacatt

SEQ ID NO: 7859 - DNA, 25 bp, Mus musculus
aggatccgtacccacacaagttcca

SEQ ID NO: 7860 - DNA, 25 bp, Mus musculus
aggatcctaagacgcatccctgcag

SEQ ID NO: 7861 - DNA, 25 bp, Mus musculus
aggatcctcgatgagcctggccgag

SEQ ID NO: 7862 - DNA, 25 bp, Mus musculus
aggatcctggcttcgtgcctgcctt

SEQ ID NO: 7863 - DNA, 25 bp, Mus musculus
aggatcgatgctctaaatactgaag

SEQ ID NO: 7864 - DNA, 25 bp, Mus musculus
aggatcggctcttcccacctacggt

SEQ ID NO: 7865 - DNA, 25 bp, Mus musculus
aggatctgcctcgtctctgagtgct

SEQ ID NO: 7866 - DNA, 25 bp, Mus musculus
aggatcttcgaaaccaccttgttca

SEQ ID NO: 7867 - DNA, 25 bp, Mus musculus
aggatgaaggcaccccgcttcgtga

SEQ ID NO: 7868 - DNA, 25 bp, Mus musculus
aggatgaaggcagcccgcttcgtga

SEQ ID NO: 7869 - DNA, 25 bp, Mus musculus
aggatgagctccctaacagttgtct

SEQ ID NO: 7870 - DNA, 25 bp, Mus musculus
aggatgaggtatacagcctgacagc

SEQ ID NO: 7871 - DNA, 25 bp, Mus musculus
aggatgcagaccctcccggtggcct

SEQ ID NO: 7872 - DNA, 25 bp, Mus musculus
aggatgcctggtccatgggcacaaa

SEQ ID NO: 7873 - DNA, 25 bp, Mus musculus
aggatgccttttgggcagccgtagt

SEQ ID NO: 7874 - DNA, 25 bp, Mus musculus
aggatgcggtgttggacacctatga

SEQ ID NO: 7875 - DNA, 25 bp, Mus musculus
aggatgctgctgagggccttccttc

SEQ ID NO: 7876 - DNA, 25 bp, Mus musculus
aggatggaaccctcacctgcagtga

SEQ ID NO: 7877 - DNA, 25 bp, Mus musculus
aggatggaggtgtcaggcttcttca

SEQ ID NO: 7878 - DNA, 25 bp, Mus musculus
aggatggattttatggtgcagacat

SEQ ID NO: 7879 - DNA, 25 bp, Mus musculus
aggatggcaggacagcccagccaca

SEQ ID NO: 7880 - DNA, 25 bp, Mus musculus
aggatggcgtccttcgggcacttcc

SEQ ID NO: 7881 - DNA, 25 bp, Mus musculus
aggatggctcaccagcactgtgagc

SEQ ID NO: 7882 - DNA, 25 bp, Mus musculus
aggatggtcaggacggactctctgt

SEQ ID NO: 7883 - DNA, 25 bp, Mus musculus
aggatggtgcgcaccgaccctctct

SEQ ID NO: 7884 - DNA, 25 bp, Mus musculus
aggatggtgtctctcgaagattcat

SEQ ID NO: 7885 - DNA, 25 bp, Mus musculus
aggatggttccccaggcgccagagg

SEQ ID NO: 7886 - DNA, 25 bp, Mus musculus
aggatgtgatcctactgacagccat

SEQ ID NO: 7887 - DNA, 25 bp, Mus musculus
aggatgtggccatggactttacgcc

SEQ ID NO: 7888 - DNA, 25 bp, Mus musculus
aggatgtgttgagcgtggccttctc

SEQ ID NO: 7889 - DNA, 25 bp, Mus musculus
aggatgttgacaagatggagaattc

SEQ ID NO: 7890 - DNA, 25 bp, Mus musculus
aggatgtttagcaaccctgataatg

SEQ ID NO: 7891 - DNA, 25 bp, Mus musculus
aggattaacatgaccaaagatgttg

SEQ ID NO: 7892 - DNA, 25 bp, Mus musculus
aggattaatgtccagacttggttcc

SEQ ID NO: 7893 - DNA, 25 bp, Mus musculus
aggattctgaggtccggccagtggc

SEQ ID NO: 7894 - DNA, 25 bp, Mus musculus
aggatttgaacagcctgtggccgtc

SEQ ID NO: 7895 - DNA, 25 bp, Mus musculus
aggatttgttctgcttcctgatggg

SEQ ID NO: 7896 - DNA, 25 bp, Mus musculus
aggcaaagagtatatacctgctgac

SEQ ID NO: 7897 - DNA, 25 bp, Mus musculus
aggcaaagcgtcaggtccagcgtcc

SEQ ID NO: 7898 - DNA, 25 bp, Mus musculus
aggcaaaggtgcaagatacaggctt

SEQ ID NO: 7899 - DNA, 25 bp, Mus musculus
aggcaaccaaggcagacagtgtctg

SEQ ID NO: 7900 - DNA, 25 bp, Mus musculus
aggcaactcagtgagaccttgactc

SEQ ID NO: 7901 - DNA, 25 bp, Mus musculus
aggcaagcttcacacccagcctgag

SEQ ID NO: 7902 - DNA, 25 bp, Mus musculus
aggcaatgaagagcccatctagcaa

SEQ ID NO: 7903 - DNA, 25 bp, Mus musculus
aggcacaaacaaagaccctcaagaa

SEQ ID NO: 7904 - DNA, 25 bp, Mus musculus
aggcacagactggtgatcggagtct

SEQ ID NO: 7905 - DNA, 25 bp, Mus musculus
aggcacagcatcgacattacctcag

SEQ ID NO: 7906 - DNA, 25 bp, Mus musculus
aggcacaggacagccaggtcacaag

SEQ ID NO: 7907 - DNA, 25 bp, Mus musculus
aggcaccaccgacccagaggaggct

SEQ ID NO: 7908 - DNA, 25 bp, Mus musculus
aggcaccaggaaaatgtccacaccg

SEQ ID NO: 7909 - DNA, 25 bp, Mus musculus
aggcaccggaagctgagaactccac

SEQ ID NO: 7910 - DNA, 25 bp, Mus musculus
aggcaccggagcgaaggcgtttctc

SEQ ID NO: 7911 - DNA, 25 bp, Mus musculus
aggcacgtgctgtctctagggctcc

SEQ ID NO: 7912 - DNA, 25 bp, Mus musculus
aggcactggaagaggctccccagct

SEQ ID NO: 7913 - DNA, 25 bp, Mus musculus
aggcactgggccacacaaagccttg

SEQ ID NO: 7914 - DNA, 25 bp, Mus musculus
aggcactgtgttgctatggttagca

SEQ ID NO: 7915 - DNA, 25 bp, Mus musculus
aggcagactcaatcaaaatttgcca

SEQ ID NO: 7916 - DNA, 25 bp, Mus musculus
aggcagagcgtgaaccaccagatgg

SEQ ID NO: 7917 - DNA, 25 bp, Mus musculus
aggcagagtgtcttttggcgctttc

SEQ ID NO: 7918 - DNA, 25 bp, Mus musculus
aggcagatgtcgtgccaaagactgc

SEQ ID NO: 7919 - DNA, 25 bp, Mus musculus
aggcagcagggcactctctcagtac

SEQ ID NO: 7920 - DNA, 25 bp, Mus musculus
aggcagccaggatttaataaacaac

SEQ ID NO: 7921 - DNA, 25 bp, Mus musculus
aggcagcccgctacgtgatgcgcag

SEQ ID NO: 7922 - DNA, 25 bp, Mus musculus
aggcagcccgcttcgtgatgcgcag

SEQ ID NO: 7923 - DNA, 25 bp, Mus musculus
aggcagcctgactgtggttgtactg

SEQ ID NO: 7924 - DNA, 25 bp, Mus musculus
aggcagcgacagtgcgagctttccc

SEQ ID NO: 7925 - DNA, 25 bp, Mus musculus
aggcagctcagacgcccagtcgtca

SEQ ID NO: 7926 - DNA, 25 bp, Mus musculus
aggcagctgcgctcctgacagccag

SEQ ID NO: 7927 - DNA, 25 bp, Mus musculus
aggcaggcggcggagacattcccct

SEQ ID NO: 7928 - DNA, 25 bp, Mus musculus
aggcaggctcagtgccttgctccca

SEQ ID NO: 7929 - DNA, 25 bp, Mus musculus
aggcaggtggctagcatgaccaagc

SEQ ID NO: 7930 - DNA, 25 bp, Mus musculus
aggcagtcttcagcctattatcaaa

SEQ ID NO: 7931 - DNA, 25 bp, Mus musculus
aggcagtgatgcagccggcaatcca

SEQ ID NO: 7932 - DNA, 25 bp, Mus musculus
aggcagtgatgctgccggcaatcca

SEQ ID NO: 7933 - DNA, 25 bp, Mus musculus
aggcatcacaagcatggccacagcc

SEQ ID NO: 7934 - DNA, 25 bp, Mus musculus
aggcatccaggctgtggtcgaagtc

SEQ ID NO: 7935 - DNA, 25 bp, Mus musculus
aggcatcggagacaccccgaaccag

SEQ ID NO: 7936 - DNA, 25 bp, Mus musculus
aggcatctgtgcctccggaccaagg

SEQ ID NO: 7937 - DNA, 25 bp, Mus musculus
aggcatgccttacctggctcctctg

SEQ ID NO: 7938 - DNA, 25 bp, Mus musculus
aggcattcgaagaccccagagaact

SEQ ID NO: 7939 - DNA, 25 bp, Mus musculus
aggcattgatttcccagctgacccg

SEQ ID NO: 7940 - DNA, 25 bp, Mus musculus
aggccaaaaatacgctgacgcagga

SEQ ID NO: 7941 - DNA, 25 bp, Mus musculus
aggccaaagagcagcacccagacat

SEQ ID NO: 7942 - DNA, 25 bp, Mus musculus
aggccaacccataggcgacacagca

SEQ ID NO: 7943 - DNA, 25 bp, Mus musculus
aggccaagcacaggctggtgctgct

SEQ ID NO: 7944 - DNA, 25 bp, Mus musculus
aggccaagcatgcagatcctggtga

SEQ ID NO: 7945 - DNA, 25 bp, Mus musculus
aggccaagcatggagatcctggtga

SEQ ID NO: 7946 - DNA, 25 bp, Mus musculus
aggccaaggaagacccggaaatcag

SEQ ID NO: 7947 - DNA, 25 bp, Mus musculus
aggccaagtcaaggaagccgtgaag

SEQ ID NO: 7948 - DNA, 25 bp, Mus musculus
aggccaagttcacgcagcctctgct

SEQ ID NO: 7949 - DNA, 25 bp, Mus musculus
aggccaatcaagctccttcaacagc

SEQ ID NO: 7950 - DNA, 25 bp, Mus musculus
aggccaatgagtaccgcgtgaagct

SEQ ID NO: 7951 - DNA, 25 bp, Mus musculus
aggccaatgccttagatctttctga

SEQ ID NO: 7952 - DNA, 25 bp, Mus musculus
aggccacaagaagagaaatatcctg

SEQ ID NO: 7953 - DNA, 25 bp, Mus musculus
aggccacagaaccacaaaactgcca

SEQ ID NO: 7954 - DNA, 25 bp, Mus musculus
aggccagaaggctgtcgaacccttg

SEQ ID NO: 7955 - DNA, 25 bp, Mus musculus
aggccagatgcctctgtgccgcctt

SEQ ID NO: 7956 - DNA, 25 bp, Mus musculus
aggccagatgggtccagcttcaaca

SEQ ID NO: 7957 - DNA, 25 bp, Mus musculus
aggccagcacgttcaatatttgatg

SEQ ID NO: 7958 - DNA, 25 bp, Mus musculus
aggccagcagccagggtcgttctcc

SEQ ID NO: 7959 - DNA, 25 bp, Mus musculus
aggccaggccaccaagaaggccgtc

SEQ ID NO: 7960 - DNA, 25 bp, Mus musculus
aggccaggtttgtgtgcaaagccga

SEQ ID NO: 7961 - DNA, 25 bp, Mus musculus
aggccagtgcacctttgacccaatg

SEQ ID NO: 7962 - DNA, 25 bp, Mus musculus
aggccagtgtggatggctttcaaac

SEQ ID NO: 7963 - DNA, 25 bp, Mus musculus
aggccagttcatggctcctgtggaa

SEQ ID NO: 7964 - DNA, 25 bp, Mus musculus
aggccatcacggagcaccgggagct

SEQ ID NO: 7965 - DNA, 25 bp, Mus musculus
aggccatccacttagcacggcagca

SEQ ID NO: 7966 - DNA, 25 bp, Mus musculus
aggccatcccaggtggcgagcctga

SEQ ID NO: 7967 - DNA, 25 bp, Mus musculus
aggccatgaactggcaaagcaagag

SEQ ID NO: 7968 - DNA, 25 bp, Mus musculus
aggccatgacgatgggcaaactgca

SEQ ID NO: 7969 - DNA, 25 bp, Mus musculus
aggccatggagaacagcgagtgctc

SEQ ID NO: 7970 - DNA, 25 bp, Mus musculus
aggcccacaaacagacggcagtcca

SEQ ID NO: 7971 - DNA, 25 bp, Mus musculus
aggcccacagagcacgcccatgtgg

SEQ ID NO: 7972 - DNA, 25 bp, Mus musculus
aggcccacagctagagcgtggcaga

SEQ ID NO: 7973 - DNA, 25 bp, Mus musculus
aggcccacgttgagtcgcacggttt

SEQ ID NO: 7974 - DNA, 25 bp, Mus musculus
aggcccacgttgtgtcgcacggttt

SEQ ID NO: 7975 - DNA, 25 bp, Mus musculus
aggcccagcctcgtgatgaggaata

SEQ ID NO: 7976 - DNA, 25 bp, Mus musculus
aggccccgagagtacagtgacttct

SEQ ID NO: 7977 - DNA, 25 bp, Mus musculus
aggccccgctacagtagaagagctg

SEQ ID NO: 7978 - DNA, 25 bp, Mus musculus
aggcccgagggcagctcatgcgcat

SEQ ID NO: 7979 - DNA, 25 bp, Mus musculus
aggcccgcaagtcgcaactgcagag

SEQ ID NO: 7980 - DNA, 25 bp, Mus musculus
aggcccgctgggacttactgacaga

SEQ ID NO: 7981 - DNA, 25 bp, Mus musculus
aggcccgtgcccaagtccacgaata

SEQ ID NO: 7982 - DNA, 25 bp, Mus musculus
aggccctccaggagaaacaggtcct

SEQ ID NO: 7983 - DNA, 25 bp, Mus musculus
aggccctgccgcaagtcccgtggag

SEQ ID NO: 7984 - DNA, 25 bp, Mus musculus
aggccctggaccagtgcatgacagc

SEQ ID NO: 7985 - DNA, 25 bp, Mus musculus
aggccctggccagcacgagaattct

SEQ ID NO: 7986 - DNA, 25 bp, Mus musculus
aggccctgggactgaatcggcctgt

SEQ ID NO: 7987 - DNA, 25 bp, Mus musculus
aggccctgttttctgggccaccagt

SEQ ID NO: 7988 - DNA, 25 bp, Mus musculus
aggccgacagtcacggcggccactg

SEQ ID NO: 7989 - DNA, 25 bp, Mus musculus
aggccgaccaggtacagggcaccgt

SEQ ID NO: 7990 - DNA, 25 bp, Mus musculus
aggccgagaacatccttgggaagga

SEQ ID NO: 7991 - DNA, 25 bp, Mus musculus
aggccgagaaggaggtgacacgcat

SEQ ID NO: 7992 - DNA, 25 bp, Mus musculus
aggccgagctgctgaacctgaggaa

SEQ ID NO: 7993 - DNA, 25 bp, Mus musculus
aggccgatgagctgcctgttctgca

SEQ ID NO: 7994 - DNA, 25 bp, Mus musculus
aggccgcaccggttcaaggaagact

SEQ ID NO: 7995 - DNA, 25 bp, Mus musculus
aggccgcagcagatccagctccaag

SEQ ID NO: 7996 - DNA, 25 bp, Mus musculus
aggccgcagcagtcctgatggcacg

SEQ ID NO: 7997 - DNA, 25 bp, Mus musculus
aggccgcttgccttcctactgcaga

SEQ ID NO: 7998 - DNA, 25 bp, Mus musculus
aggccggagattacgcttcgggact

SEQ ID NO: 7999 - DNA, 25 bp, Mus musculus
aggccggagatttcgcttcgggact

SEQ ID NO: 8000 - DNA, 25 bp, Mus musculus
aggccgtctaccatgtgctgaacat

SEQ ID NO: 8001 - DNA, 25 bp, Mus musculus
aggccgtggtactgaagctcaagag

SEQ ID NO: 8002 - DNA, 25 bp, Mus musculus
aggccgtgtgtcaccctgaccacgt

SEQ ID NO: 8003 - DNA, 25 bp, Mus musculus
aggcctactgaagcctgacctgaag

SEQ ID NO: 8004 - DNA, 25 bp, Mus musculus
aggcctactggttctggaagggcca

SEQ ID NO: 8005 - DNA, 25 bp, Mus musculus
aggcctagtagctccaagtcagaca

SEQ ID NO: 8006 - DNA, 25 bp, Mus musculus
aggcctcagtgtccaaggctgcttc

SEQ ID NO: 8007 - DNA, 25 bp, Mus musculus
aggcctccacgcaggtaccatgctg

SEQ ID NO: 8008 - DNA, 25 bp, Mus musculus
aggcctccacgctggtaccatgctg

SEQ ID NO: 8009 - DNA, 25 bp, Mus musculus
aggcctccttgtccattcctgtcag

SEQ ID NO: 8010 - DNA, 25 bp, Mus musculus
aggcctcggcgttcgccttgcagga

SEQ ID NO: 8011 - DNA, 25 bp, Mus musculus
aggcctctaggccacacaagcctgg

SEQ ID NO: 8012 - DNA, 25 bp, Mus musculus
aggcctctcggtgcacctgctgtga

SEQ ID NO: 8013 - DNA, 25 bp, Mus musculus
aggcctgcccagctgccatcgatgg

SEQ ID NO: 8014 - DNA, 25 bp, Mus musculus
aggcctgcctcatcagcctgggcta

SEQ ID NO: 8015 - DNA, 25 bp, Mus musculus
aggcctggagccagcaatgcgctct

SEQ ID NO: 8016 - DNA, 25 bp, Mus musculus
aggcctggagcctgacctcccggga

SEQ ID NO: 8017 - DNA, 25 bp, Mus musculus
aggcctggagcctgcaatgcgctct

SEQ ID NO: 8018 - DNA, 25 bp, Mus musculus
aggcctggatcaatgcagccacgca

SEQ ID NO: 8019 - DNA, 25 bp, Mus musculus
aggcctgtccctcagcagatttagc

SEQ ID NO: 8020 - DNA, 25 bp, Mus musculus
aggcctgtgccgagctctccctgtg

SEQ ID NO: 8021 - DNA, 25 bp, Mus musculus
aggccttccttgacttctatcacag

SEQ ID NO: 8022 - DNA, 25 bp, Mus musculus
aggccttctggattctatcactaat

SEQ ID NO: 8023 - DNA, 25 bp, Mus musculus
aggccttgttttagtcttttctgag

SEQ ID NO: 8024 - DNA, 25 bp, Mus musculus
aggcgaagctacagctgcgctacca

SEQ ID NO: 8025 - DNA, 25 bp, Mus musculus
aggcgagttcatattggctcacagt

SEQ ID NO: 8026 - DNA, 25 bp, Mus musculus
aggcgagttcattttggctcacagt

SEQ ID NO: 8027 - DNA, 25 bp, Mus musculus
aggcgccctgccctgatacagggta

SEQ ID NO: 8028 - DNA, 25 bp, Mus musculus
aggcgctcagtttccaccatgaatc

SEQ ID NO: 8029 - DNA, 25 bp, Mus musculus
aggcggacccagagctggatcctga

SEQ ID NO: 8030 - DNA, 25 bp, Mus musculus
aggcggacgacgacctggacagcaa

SEQ ID NO: 8031 - DNA, 25 bp, Mus musculus
aggcggcccactgtgcagcctgtga

SEQ ID NO: 8032 - DNA, 25 bp, Mus musculus
aggcggctccaggatgttatacaaa

SEQ ID NO: 8033 - DNA, 25 bp, Mus musculus
aggcgtgcaaaaggaacgcattcag

SEQ ID NO: 8034 - DNA, 25 bp, Mus musculus
aggcgtttctcactcatgacgctgc

SEQ ID NO: 8035 - DNA, 25 bp, Mus musculus
aggctaaccccgctctggaggcctt

SEQ ID NO: 8036 - DNA, 25 bp, Mus musculus
aggctacacactggacactcaaagc

SEQ ID NO: 8037 - DNA, 25 bp, Mus musculus
aggctacggtgctcctgatggcttg

SEQ ID NO: 8038 - DNA, 25 bp, Mus musculus
aggctactcgacagtctctgctggg

SEQ ID NO: 8039 - DNA, 25 bp, Mus musculus
aggctactgaaagatgaagccactg

SEQ ID NO: 8040 - DNA, 25 bp, Mus musculus
aggctagcctccgtctgcacaaggt

SEQ ID NO: 8041 - DNA, 25 bp, Mus musculus
aggctatccctgtgcggcagcaggc

SEQ ID NO: 8042 - DNA, 25 bp, Mus musculus
aggctatgtgagctggttgccccca

SEQ ID NO: 8043 - DNA, 25 bp, Mus musculus
aggctcactgcaagccggtggccag

SEQ ID NO: 8044 - DNA, 25 bp, Mus musculus
aggctcagatcagcgccctggagga

SEQ ID NO: 8045 - DNA, 25 bp, Mus musculus
aggctcagatccgatttctaaaggc

SEQ ID NO: 8046 - DNA, 25 bp, Mus musculus
aggctcagctgacacagttcgtgac

SEQ ID NO: 8047 - DNA, 25 bp, Mus musculus
aggctccaaagctcctgtggctgaa

SEQ ID NO: 8048 - DNA, 25 bp, Mus musculus
aggctccaccttccacagggtgatc

SEQ ID NO: 8049 - DNA, 25 bp, Mus musculus
aggctccctggtggccaacaactgg

SEQ ID NO: 8050 - DNA, 25 bp, Mus musculus
aggctccgaggcatgcagcaagcag

SEQ ID NO: 8051 - DNA, 25 bp, Mus musculus
aggctccgaggcttgcagcaagcag

SEQ ID NO: 8052 - DNA, 25 bp, Mus musculus
aggctccgcctctataatagcctca

SEQ ID NO: 8053 - DNA, 25 bp, Mus musculus
aggctccggcctgagctaagtcagc

SEQ ID NO: 8054 - DNA, 25 bp, Mus musculus
aggctcctgttgcacatgcccgcat

SEQ ID NO: 8055 - DNA, 25 bp, Mus musculus
aggctcgcagcgaagcgtgcagccc

SEQ ID NO: 8056 - DNA, 25 bp, Mus musculus
aggctcgggttgatgtgctagaaca

SEQ ID NO: 8057 - DNA, 25 bp, Mus musculus
aggctctagggctgcagataaggct

SEQ ID NO: 8058 - DNA, 25 bp, Mus musculus
aggctctggctgcaaatcctgttct

SEQ ID NO: 8059 - DNA, 25 bp, Mus musculus
aggctctttcttgtggatatatcac

SEQ ID NO: 8060 - DNA, 25 bp, Mus musculus
aggctgataatgctgtgaacaagaa

SEQ ID NO: 8061 - DNA, 25 bp, Mus musculus
aggctgatgatgatttcgtgaggaa

SEQ ID NO: 8062 - DNA, 25 bp, Mus musculus
aggctgatggattctggacgagctc

SEQ ID NO: 8063 - DNA, 25 bp, Mus musculus
aggctgccattaggaccctgcaggc

SEQ ID NO: 8064 - DNA, 25 bp, Mus musculus
aggctgcgtattgctgtgtagctga

SEQ ID NO: 8065 - DNA, 25 bp, Mus musculus
aggctgctattgaaagagagtatgc

SEQ ID NO: 8066 - DNA, 25 bp, Mus musculus
aggctgctcagcagggccacacgca

SEQ ID NO: 8067 - DNA, 25 bp, Mus musculus
aggctggaagggatcgatcacaacc

SEQ ID NO: 8068 - DNA, 25 bp, Mus musculus
aggctggagcattcacctgtctcag

SEQ ID NO: 8069 - DNA, 25 bp, Mus musculus
aggctggcaagctggcaaacggact

SEQ ID NO: 8070 - DNA, 25 bp, Mus musculus
aggctggctgcatcccaacgacaaa

SEQ ID NO: 8071 - DNA, 25 bp, Mus musculus
aggctgggtctgaggacgttgggca

SEQ ID NO: 8072 - DNA, 25 bp, Mus musculus
aggctggtctcaaacgaagagattc

SEQ ID NO: 8073 - DNA, 25 bp, Mus musculus
aggctggtgtctacaagctgacagg

SEQ ID NO: 8074 - DNA, 25 bp, Mus musculus
aggctgtgctgtatgccaaggctct

SEQ ID NO: 8075 - DNA, 25 bp, Mus musculus
aggcttccagtttggttggcagagg

SEQ ID NO: 8076 - DNA, 25 bp, Mus musculus
aggcttcccagtggcacaggctgat

SEQ ID NO: 8077 - DNA, 25 bp, Mus musculus
aggcttccccagagacggcgactat

SEQ ID NO: 8078 - DNA, 25 bp, Mus musculus
aggcttgggtgcaactgaaagagca

SEQ ID NO: 8079 - DNA, 25 bp, Mus musculus
aggctttctccctccggtggttgca

SEQ ID NO: 8080 - DNA, 25 bp, Mus musculus
aggctttgctagttggcagggtccc

SEQ ID NO: 8081 - DNA, 25 bp, Mus musculus
aggcttttcttacagctcctgggtc

SEQ ID NO: 8082 - DNA, 25 bp, Mus musculus
agggaaacccttacagctttcacat

SEQ ID NO: 8083 - DNA, 25 bp, Mus musculus
agggaaaccctttcagctttcacat

SEQ ID NO: 8084 - DNA, 25 bp, Mus musculus
agggaaagtttgatggctgcttctg

SEQ ID NO: 8085 - DNA, 25 bp, Mus musculus
agggaaattggagcggcacaataga

SEQ ID NO: 8086 - DNA, 25 bp, Mus musculus
agggaacagactgcccatagtcgta

SEQ ID NO: 8087 - DNA, 25 bp, Mus musculus
agggaacttgagatgagcaaagaaa

SEQ ID NO: 8088 - DNA, 25 bp, Mus musculus
agggaactttaacggcaagcaagct

SEQ ID NO: 8089 - DNA, 25 bp, Mus musculus
agggaaggatgcgatgcactcccca

SEQ ID NO: 8090 - DNA, 25 bp, Mus musculus
agggaatctgcggtactttgaacgg

SEQ ID NO: 8091 - DNA, 25 bp, Mus musculus
agggaatcttgacttcctcaagcct

SEQ ID NO: 8092 - DNA, 25 bp, Mus musculus
agggacacacgcagacacgcacact

SEQ ID NO: 8093 - DNA, 25 bp, Mus musculus
agggacacatgttggcagatgtcgt

SEQ ID NO: 8094 - DNA, 25 bp, Mus musculus
agggacatcgcacttctggatttaa

SEQ ID NO: 8095 - DNA, 25 bp, Mus musculus
agggaccaggacatgtgacgtttta

SEQ ID NO: 8096 - DNA, 25 bp, Mus musculus
agggaccctgctcagtcgctgctct

SEQ ID NO: 8097 - DNA, 25 bp, Mus musculus
agggaccgcagtgccagcataaagc

SEQ ID NO: 8098 - DNA, 25 bp, Mus musculus
agggacgagacacctctggcctttg

SEQ ID NO: 8099 - DNA, 25 bp, Mus musculus
agggacgtgcctacctcttcaactc

SEQ ID NO: 8100 - DNA, 25 bp, Mus musculus
agggactactgcactccttcgacct

SEQ ID NO: 8101 - DNA, 25 bp, Mus musculus
agggactatgctaccggtcactggg

SEQ ID NO: 8102 - DNA, 25 bp, Mus musculus
agggactatgcttccggtcactggg

SEQ ID NO: 8103 - DNA, 25 bp, Mus musculus
agggactatgtttctctgagcacca

SEQ ID NO: 8104 - DNA, 25 bp, Mus musculus
agggactcagcaagcctagtcctgc

SEQ ID NO: 8105 - DNA, 25 bp, Mus musculus
agggactcagctccgaattacgtat

SEQ ID NO: 8106 - DNA, 25 bp, Mus musculus
agggactgaagttcagagggacatt

SEQ ID NO: 8107 - DNA, 25 bp, Mus musculus
agggactgcaggcagcctacaccct

SEQ ID NO: 8108 - DNA, 25 bp, Mus musculus
agggactggcgcactcacagctttc

SEQ ID NO: 8109 - DNA, 25 bp, Mus musculus
agggagactgtgacttccacatcct

SEQ ID NO: 8110 - DNA, 25 bp, Mus musculus
agggagctgctcagatcctcagccc

SEQ ID NO: 8111 - DNA, 25 bp, Mus musculus
agggagcttcgttactcacttgaag

SEQ ID NO: 8112 - DNA, 25 bp, Mus musculus
agggagtcaaccatacatgtatgca

SEQ ID NO: 8113 - DNA, 25 bp, Mus musculus
agggagtggatcacacccgtgccat

SEQ ID NO: 8114 - DNA, 25 bp, Mus musculus
agggagtgttgtggaattgcccaca

SEQ ID NO: 8115 - DNA, 25 bp, Mus musculus
agggagtttcagaaaggccccgcat

SEQ ID NO: 8116 - DNA, 25 bp, Mus musculus
agggatccccgcctttcaaagagag

SEQ ID NO: 8117 - DNA, 25 bp, Mus musculus
agggatgctggttcccatgccagcg

SEQ ID NO: 8118 - DNA, 25 bp, Mus musculus
agggatggccatagaacagatgtgc

SEQ ID NO: 8119 - DNA, 25 bp, Mus musculus
agggattcccgatggtcaccggcac

SEQ ID NO: 8120 - DNA, 25 bp, Mus musculus
agggattggacacgctatggtaaac

SEQ ID NO: 8121 - DNA, 25 bp, Mus musculus
agggattgtggttgtaagccttgca

SEQ ID NO: 8122 - DNA, 25 bp, Mus musculus
agggcaacacagagaccccgaggaa

SEQ ID NO: 8123 - DNA, 25 bp, Mus musculus
agggcaacccggaggagaactaatg

SEQ ID NO: 8124 - DNA, 25 bp, Mus musculus
agggcacatctgctggataacacgg

SEQ ID NO: 8125 - DNA, 25 bp, Mus musculus
agggcacccaccacgtcaatgtgaa

SEQ ID NO: 8126 - DNA, 25 bp, Mus musculus
agggcactgaaaccctcagcccttg

SEQ ID NO: 8127 - DNA, 25 bp, Mus musculus
agggcagacaagcagtctgtgcact

SEQ ID NO: 8128 - DNA, 25 bp, Mus musculus
agggcagcaacgcaagttcatcagc

SEQ ID NO: 8129 - DNA, 25 bp, Mus musculus
agggcaggtagcctttctccagtca

SEQ ID NO: 8130 - DNA, 25 bp, Mus musculus
agggcaggtatgtcccctgtgcagc

SEQ ID NO: 8131 - DNA, 25 bp, Mus musculus
agggcagtcagggacgtgcctacct

SEQ ID NO: 8132 - DNA, 25 bp, Mus musculus
agggcatcatctccggctctgtctg

SEQ ID NO: 8133 - DNA, 25 bp, Mus musculus
agggcatccagtatatcttcaacga

SEQ ID NO: 8134 - DNA, 25 bp, Mus musculus
agggcatcctgagcctttggacctt

SEQ ID NO: 8135 - DNA, 25 bp, Mus musculus
agggcattctttcagaagcaccggg

SEQ ID NO: 8136 - DNA, 25 bp, Mus musculus
agggccaagatgtcctgctgtttat

SEQ ID NO: 8137 - DNA, 25 bp, Mus musculus
agggccattccggaccaggcaagaa

SEQ ID NO: 8138 - DNA, 25 bp, Mus musculus
agggccccagtcttccactcttgga

SEQ ID NO: 8139 - DNA, 25 bp, Mus musculus
agggccccgtggatcttggagcaaa

SEQ ID NO: 8140 - DNA, 25 bp, Mus musculus
agggccggctcctgctactgcaggc

SEQ ID NO: 8141 - DNA, 25 bp, Mus musculus
agggcctgagaaccgctcccactag

SEQ ID NO: 8142 - DNA, 25 bp, Mus musculus
agggcctggatctcacagggcctta

SEQ ID NO: 8143 - DNA, 25 bp, Mus musculus
agggcctgtgggatccgacctctga

SEQ ID NO: 8144 - DNA, 25 bp, Mus musculus
agggcctgtgtcaccctcgggtgaa

SEQ ID NO: 8145 - DNA, 25 bp, Mus musculus
agggcggagtacctgaagaccttca

SEQ ID NO: 8146 - DNA, 25 bp, Mus musculus
agggcggccatggtccagccctgaa

SEQ ID NO: 8147 - DNA, 25 bp, Mus musculus
agggcggtgtccatgtacacaagga

SEQ ID NO: 8148 - DNA, 25 bp, Mus musculus
agggcggttcctcacaagtttctgc

SEQ ID NO: 8149 - DNA, 25 bp, Mus musculus
agggctaaattcatgggttccccag

SEQ ID NO: 8150 - DNA, 25 bp, Mus musculus
agggctacggctaccagcagggcta

SEQ ID NO: 8151 - DNA, 25 bp, Mus musculus
agggctactcagtgctcggcagcct

SEQ ID NO: 8152 - DNA, 25 bp, Mus musculus
agggctatgcctggatttccccacg

SEQ ID NO: 8153 - DNA, 25 bp, Mus musculus
agggctccgccttgggtcctcctgg

SEQ ID NO: 8154 - DNA, 25 bp, Mus musculus
agggctccgcggacagaccgacaga

SEQ ID NO: 8155 - DNA, 25 bp, Mus musculus
agggctcggctctgtatgaaagcag

SEQ ID NO: 8156 - DNA, 25 bp, Mus musculus
agggctcgtaccactgcgagtgtga

SEQ ID NO: 8157 - DNA, 25 bp, Mus musculus
agggctcgtacctctgcgagtgtga

SEQ ID NO: 8158 - DNA, 25 bp, Mus musculus
agggctctgcacgaaggaggaccat

SEQ ID NO: 8159 - DNA, 25 bp, Mus musculus
agggctgcagataaggctgttgcca

SEQ ID NO: 8160 - DNA, 25 bp, Mus musculus
agggctgcatggagcaagccagtct

SEQ ID NO: 8161 - DNA, 25 bp, Mus musculus
agggctggccactccagtgcctatt

SEQ ID NO: 8162 - DNA, 25 bp, Mus musculus
agggctggcggcactgatgtacaca

SEQ ID NO: 8163 - DNA, 25 bp, Mus musculus
agggctggctctacctgaccgtcaa

SEQ ID NO: 8164 - DNA, 25 bp, Mus musculus
agggcttatgaagtccctggctgag

SEQ ID NO: 8165 - DNA, 25 bp, Mus musculus
agggcttccagcaggatgcggccca

SEQ ID NO: 8166 - DNA, 25 bp, Mus musculus
agggcttccagctggatgcggccca

SEQ ID NO: 8167 - DNA, 25 bp, Mus musculus
agggcttcccctccgttctgagcta

SEQ ID NO: 8168 - DNA, 25 bp, Mus musculus
agggcttccggcagcttgaccctct

SEQ ID NO: 8169 - DNA, 25 bp, Mus musculus
agggcttcggtgatgccgcactcat

SEQ ID NO: 8170 - DNA, 25 bp, Mus musculus
agggcttcttccctgtgcgctgttg

SEQ ID NO: 8171 - DNA, 25 bp, Mus musculus
agggctttgccatccctggctccag

SEQ ID NO: 8172 - DNA, 25 bp, Mus musculus
agggctttggtttgagagcaacaag

SEQ ID NO: 8173 - DNA, 25 bp, Mus musculus
agggtatcagccaggagcagatgca

SEQ ID NO: 8174 - DNA, 25 bp, Mus musculus
agggtcaacaagcagctgcatctgg

SEQ ID NO: 8175 - DNA, 25 bp, Mus musculus
agggtccaacctgtgttattgtcag

SEQ ID NO: 8176 - DNA, 25 bp, Mus musculus
agggtcgtgtggtgggccggcagaa

SEQ ID NO: 8177 - DNA, 25 bp, Mus musculus
agggtctccatctgtgccttgtatt

SEQ ID NO: 8178 - DNA, 25 bp, Mus musculus
agggtgagatcctctccgaagagga

SEQ ID NO: 8179 - DNA, 25 bp, Mus musculus
agggtgcatgccaggaagtgcccac

SEQ ID NO: 8180 - DNA, 25 bp, Mus musculus
agggtgccccgctgccctgtctgta

SEQ ID NO: 8181 - DNA, 25 bp, Mus musculus
agggtgccctgtgggccctagcctt

SEQ ID NO: 8182 - DNA, 25 bp, Mus musculus
agggtgctcggaatgagctctttgc

SEQ ID NO: 8183 - DNA, 25 bp, Mus musculus
agggtggctccgtccgtcttatcag

SEQ ID NO: 8184 - DNA, 25 bp, Mus musculus
agggtgttccgccatgttgatgcaa

SEQ ID NO: 8185 - DNA, 25 bp, Mus musculus
agggttcccaatgttagagtgctgc

SEQ ID NO: 8186 - DNA, 25 bp, Mus musculus
agggttgagacaactgttgcaagcc

SEQ ID NO: 8187 - DNA, 25 bp, Mus musculus
aggtaaaactaccactgctgctcag

SEQ ID NO: 8188 - DNA, 25 bp, Mus musculus
aggtaagaagtatggagaaacggct

SEQ ID NO: 8189 - DNA, 25 bp, Mus musculus
aggtaatcaaggaggatgctgctga

SEQ ID NO: 8190 - DNA, 25 bp, Mus musculus
aggtaccagtgagggcgcctgctca

SEQ ID NO: 8191 - DNA, 25 bp, Mus musculus
aggtaccagtgggtccgctgcaaac

SEQ ID NO: 8192 - DNA, 25 bp, Mus musculus
aggtaccatgaagctggagttggct

SEQ ID NO: 8193 - DNA, 25 bp, Mus musculus
aggtacggacactagaggagctcct

SEQ ID NO: 8194 - DNA, 25 bp, Mus musculus
aggtactggcctatctcctccgcag

SEQ ID NO: 8195 - DNA, 25 bp, Mus musculus
aggtagaagaagaagggatacacag

SEQ ID NO: 8196 - DNA, 25 bp, Mus musculus
aggtagaccacttactctttcagag

SEQ ID NO: 8197 - DNA, 25 bp, Mus musculus
aggtagccatggtgacaagcagaca

SEQ ID NO: 8198 - DNA, 25 bp, Mus musculus
aggtatacagcctgacagccaccct

SEQ ID NO: 8199 - DNA, 25 bp, Mus musculus
aggtattagataacttggaactgga

SEQ ID NO: 8200 - DNA, 25 bp, Mus musculus
aggtattagatatcttggaactgga

SEQ ID NO: 8201 - DNA, 25 bp, Mus musculus
aggtcaaagcgagtgtcatcctcag

SEQ ID NO: 8202 - DNA, 25 bp, Mus musculus
aggtcaagtcttgcctgggccacag

SEQ ID NO: 8203 - DNA, 25 bp, Mus musculus
aggtcacatggcttgctcgaggccc

SEQ ID NO: 8204 - DNA, 25 bp, Mus musculus
aggtcaccaaaatcaagagaagccc

SEQ ID NO: 8205 - DNA, 25 bp, Mus musculus
aggtcactcttcagtttccatcatc

SEQ ID NO: 8206 - DNA, 25 bp, Mus musculus
aggtcacttatgtctgcctgtgcga

SEQ ID NO: 8207 - DNA, 25 bp, Mus musculus
aggtcccatgcccttccttcagctg

SEQ ID NO: 8208 - DNA, 25 bp, Mus musculus
aggtccgaccatgtacacgcctgga

SEQ ID NO: 8209 - DNA, 25 bp, Mus musculus
aggtcctacaggaacaccagggaag

SEQ ID NO: 8210 - DNA, 25 bp, Mus musculus
aggtcctgtaataaagagggatccg

SEQ ID NO: 8211 - DNA, 25 bp, Mus musculus
aggtccttccacagaagcgtccctg

SEQ ID NO: 8212 - DNA, 25 bp, Mus musculus
aggtcgagctgtactcccgctacag

SEQ ID NO: 8213 - DNA, 25 bp, Mus musculus
aggtcgagctgttctcccgctacag

SEQ ID NO: 8214 - DNA, 25 bp, Mus musculus
aggtcgcccagttccaccaagagaa

SEQ ID NO: 8215 - DNA, 25 bp, Mus musculus
aggtcgccttgctcacacgggactg

SEQ ID NO: 8216 - DNA, 25 bp, Mus musculus
aggtcgctctggatatccaggccta

SEQ ID NO: 8217 - DNA, 25 bp, Mus musculus
aggtcgcttacctggaaaagtggca

SEQ ID NO: 8218 - DNA, 25 bp, Mus musculus
aggtctacctcaaccagcagagcgg

SEQ ID NO: 8219 - DNA, 25 bp, Mus musculus
aggtctcatccctggcgtcacatga

SEQ ID NO: 8220 - DNA, 25 bp, Mus musculus
aggtctggagccagttgctgagcca

SEQ ID NO: 8221 - DNA, 25 bp, Mus musculus
aggtctgtcctctgtgaaatcaagg

SEQ ID NO: 8222 - DNA, 25 bp, Mus musculus
aggtcttacacttcattggattccg

SEQ ID NO: 8223 - DNA, 25 bp, Mus musculus
aggtcttccccactagccctagtga

SEQ ID NO: 8224 - DNA, 25 bp, Mus musculus
aggtctttaccccagaagaagctgt

SEQ ID NO: 8225 - DNA, 25 bp, Mus musculus
aggtgaacaaggacccagaggtgat

SEQ ID NO: 8226 - DNA, 25 bp, Mus musculus
aggtgaagtgctaaaacagttaaca

SEQ ID NO: 8227 - DNA, 25 bp, Mus musculus
aggtgacatagttttggccaaagtt

SEQ ID NO: 8228 - DNA, 25 bp, Mus musculus
aggtgaccccacactgcgggaccag

SEQ ID NO: 8229 - DNA, 25 bp, Mus musculus
aggtgaccctctgaagctcatctgc

SEQ ID NO: 8230 - DNA, 25 bp, Mus musculus
aggtgacggccaaccaggagcagat

SEQ ID NO: 8231 - DNA, 25 bp, Mus musculus
aggtgaggtcacatgcccaaggccc

SEQ ID NO: 8232 - DNA, 25 bp, Mus musculus
aggtgagtacagacagccctctggg

SEQ ID NO: 8233 - DNA, 25 bp, Mus musculus
aggtgcaagatacaggcttggacca

SEQ ID NO: 8234 - DNA, 25 bp, Mus musculus
aggtgcagacgtaagccctggtgat

SEQ ID NO: 8235 - DNA, 25 bp, Mus musculus
aggtgcaggcccagttgtcacctcc

SEQ ID NO: 8236 - DNA, 25 bp, Mus musculus
aggtgccagccaacccggaggcgct

SEQ ID NO: 8237 - DNA, 25 bp, Mus musculus
aggtgccccagctcactgacctaag

SEQ ID NO: 8238 - DNA, 25 bp, Mus musculus
aggtgcctgctcttccccatgaggg

SEQ ID NO: 8239 - DNA, 25 bp, Mus musculus
aggtgcgccttgaagagatgtcctg

SEQ ID NO: 8240 - DNA, 25 bp, Mus musculus
aggtgcgggactccatccccgctga

SEQ ID NO: 8241 - DNA, 25 bp, Mus musculus
aggtgctaaaggagcttctgggtca

SEQ ID NO: 8242 - DNA, 25 bp, Mus musculus
aggtgctccacgcaagctttcttag

SEQ ID NO: 8243 - DNA, 25 bp, Mus musculus
aggtgctccctgagtacctacctgc

SEQ ID NO: 8244 - DNA, 25 bp, Mus musculus
aggtgctgctctgcttgtttgatga

SEQ ID NO: 8245 - DNA, 25 bp, Mus musculus
aggtgctgtctgtctgctctagcaa

SEQ ID NO: 8246 - DNA, 25 bp, Mus musculus
aggtggaagctgtccccagtcccag

SEQ ID NO: 8247 - DNA, 25 bp, Mus musculus
aggtggaccaccgaaacacgtgcac

SEQ ID NO: 8248 - DNA, 25 bp, Mus musculus
aggtggatggtgtgcagacacaaca

SEQ ID NO: 8249 - DNA, 25 bp, Mus musculus
aggtggcacggaggtatagctacca

SEQ ID NO: 8250 - DNA, 25 bp, Mus musculus
aggtggcagaccactggtacccggc

SEQ ID NO: 8251 - DNA, 25 bp, Mus musculus
aggtggcccctgtgctgttattgca

SEQ ID NO: 8252 - DNA, 25 bp, Mus musculus
aggtggctggatccaaacaaaccaa

SEQ ID NO: 8253 - DNA, 25 bp, Mus musculus
aggtggctgtgctgtagactctgtt

SEQ ID NO: 8254 - DNA, 25 bp, Mus musculus
aggtgggagtactgtgagattccat

SEQ ID NO: 8255 - DNA, 25 bp, Mus musculus
aggtggtggcatttcatctctcagg

SEQ ID NO: 8256 - DNA, 25 bp, Mus musculus
aggtggtggctcatccagctacagc

SEQ ID NO: 8257 - DNA, 25 bp, Mus musculus
aggtggtggtttccttcttcttcag

SEQ ID NO: 8258 - DNA, 25 bp, Mus musculus
aggtggttcacaatcacttataact

SEQ ID NO: 8259 - DNA, 25 bp, Mus musculus
aggtgtacatgactgcacatgccta

SEQ ID NO: 8260 - DNA, 25 bp, Mus musculus
aggtgtcatggctgattgctgttac

SEQ ID NO: 8261 - DNA, 25 bp, Mus musculus
aggtgtcccacagccaggtccagga

SEQ ID NO: 8262 - DNA, 25 bp, Mus musculus
aggtgtgctctgaacaagccgagac

SEQ ID NO: 8263 - DNA, 25 bp, Mus musculus
aggtgttcagtcagctgagcctcgg

SEQ ID NO: 8264 - DNA, 25 bp, Mus musculus
aggtgttcagtctgctgagcctcgg

SEQ ID NO: 8265 - DNA, 25 bp, Mus musculus
aggtgttccacccaactcaagagtg

SEQ ID NO: 8266 - DNA, 25 bp, Mus musculus
aggtgttcttactgatggagcagga

SEQ ID NO: 8267 - DNA, 25 bp, Mus musculus
aggtgttttccgctgtgtccccatc

SEQ ID NO: 8268 - DNA, 25 bp, Mus musculus
aggttaagctggcactggccgtttt

SEQ ID NO: 8269 - DNA, 25 bp, Mus musculus
aggttacatcccagtggaaggagcc

SEQ ID NO: 8270 - DNA, 25 bp, Mus musculus
aggttacatccctgtggaaggagcc

SEQ ID NO: 8271 - DNA, 25 bp, Mus musculus
aggttactccaccttgtacgacaag

SEQ ID NO: 8272 - DNA, 25 bp, Mus musculus
aggttatggattgagaacaagttgc

SEQ ID NO: 8273 - DNA, 25 bp, Mus musculus
aggttcagccaccaaggcgtgcagc

SEQ ID NO: 8274 - DNA, 25 bp, Mus musculus
aggttcaggagagctacaggcagca

SEQ ID NO: 8275 - DNA, 25 bp, Mus musculus
aggttcccggcacagaaccctgctg

SEQ ID NO: 8276 - DNA, 25 bp, Mus musculus
aggttcccggcagagaaccctgctg

SEQ ID NO: 8277 - DNA, 25 bp, Mus musculus
aggttctacattccaccgtgtggtt

SEQ ID NO: 8278 - DNA, 25 bp, Mus musculus
aggttctggcgtagagccctccgat

SEQ ID NO: 8279 - DNA, 25 bp, Mus musculus
aggttcttttgaaacagccatgcgg

SEQ ID NO: 8280 - DNA, 25 bp, Mus musculus
aggttgggagtctaatggcccttca

SEQ ID NO: 8281 - DNA, 25 bp, Mus musculus
aggttgtgatgtggtggtcatccca

SEQ ID NO: 8282 - DNA, 25 bp, Mus musculus
aggtttattgatccagcacattggg

SEQ ID NO: 8283 - DNA, 25 bp, Mus musculus
aggtttattgatgcagcacattggg

SEQ ID NO: 8284 - DNA, 25 bp, Mus musculus
aggtttattgctgctggaagactcc

SEQ ID NO: 8285 - DNA, 25 bp, Mus musculus
aggtttctgttacaagctgtgaatc

SEQ ID NO: 8286 - DNA, 25 bp, Mus musculus
agtaaatcacacaaaaatccagcag

SEQ ID NO: 8287 - DNA, 25 bp, Mus musculus
agtaaatgaaatcgtggagaccaac

SEQ ID NO: 8288 - DNA, 25 bp, Mus musculus
agtaacaagcttgcgctgcagacag

SEQ ID NO: 8289 - DNA, 25 bp, Mus musculus
agtaacagcggccaaatccagctaa

SEQ ID NO: 8290 - DNA, 25 bp, Mus musculus
agtaaccgctgctcctgtttccact

SEQ ID NO: 8291 - DNA, 25 bp, Mus musculus
agtaactaagagatatgcccggaaa

SEQ ID NO: 8292 - DNA, 25 bp, Mus musculus
agtaagaaaggtgcctcctggccta

SEQ ID NO: 8293 - DNA, 25 bp, Mus musculus
agtaagaacaccttcaactacaagc

SEQ ID NO: 8294 - DNA, 25 bp, Mus musculus
agtaagaggagcgacaactcccgtg

SEQ ID NO: 8295 - DNA, 25 bp, Mus musculus
agtaagcgcattcttagccacaggg

SEQ ID NO: 8296 - DNA, 25 bp, Mus musculus
agtaatcccatcacaagctttcagg

SEQ ID NO: 8297 - DNA, 25 bp, Mus musculus
agtaatctcccggaaccgtgtgcta

SEQ ID NO: 8298 - DNA, 25 bp, Mus musculus
agtaatgaacatggccgccttccta

SEQ ID NO: 8299 - DNA, 25 bp, Mus musculus
agtaatgcagcagcagggaagagaa

SEQ ID NO: 8300 - DNA, 25 bp, Mus musculus
agtaatggacaaatgggccagcctc

SEQ ID NO: 8301 - DNA, 25 bp, Mus musculus
agtacaaggagtgcttctccctgta

SEQ ID NO: 8302 - DNA, 25 bp, Mus musculus
agtacacccaagatctcacatggct

SEQ ID NO: 8303 - DNA, 25 bp, Mus musculus
agtacactcatttctatggtggcag

SEQ ID NO: 8304 - DNA, 25 bp, Mus musculus
agtacagtgacttctcatactgcag

SEQ ID NO: 8305 - DNA, 25 bp, Mus musculus
agtacagtgccttgtagtggacaaa

SEQ ID NO: 8306 - DNA, 25 bp, Mus musculus
agtacagttgaccaaaagcgtgcca

SEQ ID NO: 8307 - DNA, 25 bp, Mus musculus
agtacagttgatggaaagaaggatg

SEQ ID NO: 8308 - DNA, 25 bp, Mus musculus
agtacagttggccatattgaagatc

SEQ ID NO: 8309 - DNA, 25 bp, Mus musculus
agtacatagctttcccacactgaag

SEQ ID NO: 8310 - DNA, 25 bp, Mus musculus
agtacatcatccacatgcccaaggg

SEQ ID NO: 8311 - DNA, 25 bp, Mus musculus
agtacatcctgcctggtggagctcg

SEQ ID NO: 8312 - DNA, 25 bp, Mus musculus
agtacattagcagccgcatggctgg

SEQ ID NO: 8313 - DNA, 25 bp, Mus musculus
agtaccaaccctattgccagcatct

SEQ ID NO: 8314 - DNA, 25 bp, Mus musculus
agtaccacacttgcttttttccagt

SEQ ID NO: 8315 - DNA, 25 bp, Mus musculus
agtaccacgggaccctggtgctaca

SEQ ID NO: 8316 - DNA, 25 bp, Mus musculus
agtaccactcctcccgaggacatgg

SEQ ID NO: 8317 - DNA, 25 bp, Mus musculus
agtaccaggaggtgatgaactccaa

SEQ ID NO: 8318 - DNA, 25 bp, Mus musculus
agtaccaggccatgctgagtgtgga

SEQ ID NO: 8319 - DNA, 25 bp, Mus musculus
agtaccatcagtctggaacacagcc

SEQ ID NO: 8320 - DNA, 25 bp, Mus musculus
agtacccaagtgagcgcctaatcca

SEQ ID NO: 8321 - DNA, 25 bp, Mus musculus
agtacccaatagcaatcctcctgag

SEQ ID NO: 8322 - DNA, 25 bp, Mus musculus
agtacccagcctgcaagcaacgtgg

SEQ ID NO: 8323 - DNA, 25 bp, Mus musculus
agtacccatacacacacttgccatg

SEQ ID NO: 8324 - DNA, 25 bp, Mus musculus
agtaccctcttcttatgtggaggcc

SEQ ID NO: 8325 - DNA, 25 bp, Mus musculus
agtaccgtaaaaaaccagacagcat

SEQ ID NO: 8326 - DNA, 25 bp, Mus musculus
agtaccgtggtaccggcgctctcct

SEQ ID NO: 8327 - DNA, 25 bp, Mus musculus
agtaccgtggtagcggcgctctcct

SEQ ID NO: 8328 - DNA, 25 bp, Mus musculus
agtaccgttgtcagcacacagcgtt

SEQ ID NO: 8329 - DNA, 25 bp, Mus musculus
agtacctaagtcctggcaccacaaa

SEQ ID NO: 8330 - DNA, 25 bp, Mus musculus
agtacctccgcaagcgctttggtgg

SEQ ID NO: 8331 - DNA, 25 bp, Mus musculus
agtacctgttgagtcagatcttcag

SEQ ID NO: 8332 - DNA, 25 bp, Mus musculus
agtacgaccttagttgggaccagca

SEQ ID NO: 8333 - DNA, 25 bp, Mus musculus
agtacgattccatcatcaaagtcca

SEQ ID NO: 8334 - DNA, 25 bp, Mus musculus
agtacgtggagaagatggagaacca

SEQ ID NO: 8335 - DNA, 25 bp, Mus musculus
agtactacggctgcctgcgggaccg

SEQ ID NO: 8336 - DNA, 25 bp, Mus musculus
agtactggacaacgtgctctatgca

SEQ ID NO: 8337 - DNA, 25 bp, Mus musculus
agtactggatgaggctgtgcctgcc

SEQ ID NO: 8338 - DNA, 25 bp, Mus musculus
agtactgggccaatttcgcaagaaa

SEQ ID NO: 8339 - DNA, 25 bp, Mus musculus
agtacttccaaagaatgaccacaac

SEQ ID NO: 8340 - DNA, 25 bp, Mus musculus
agtacttctgcctggctgatggcca

SEQ ID NO: 8341 - DNA, 25 bp, Mus musculus
agtacttgtcaagactgcagaagag

SEQ ID NO: 8342 - DNA, 25 bp, Mus musculus
agtactttagtcctgaggactcaag

SEQ ID NO: 8343 - DNA, 25 bp, Mus musculus
agtactttgccagcattgcagccat

SEQ ID NO: 8344 - DNA, 25 bp, Mus musculus
agtagaactcccagccctcagctgt

SEQ ID NO: 8345 - DNA, 25 bp, Mus musculus
agtagaactctgtttgtcacaagtg

SEQ ID NO: 8346 - DNA, 25 bp, Mus musculus
agtagacatgaaacagcccctgatc

SEQ ID NO: 8347 - DNA, 25 bp, Mus musculus
agtagacttggaccggactgtccag

SEQ ID NO: 8348 - DNA, 25 bp, Mus musculus
agtagagccaccgacagctgcatat

SEQ ID NO: 8349 - DNA, 25 bp, Mus musculus
agtagaggagaaaattcctatggtc

SEQ ID NO: 8350 - DNA, 25 bp, Mus musculus
agtagatgcacaggtgcgccttgaa

SEQ ID NO: 8351 - DNA, 25 bp, Mus musculus
agtagattggcaaaatataggacac

SEQ ID NO: 8352 - DNA, 25 bp, Mus musculus
agtaggaaaaatacatgcatggaac

SEQ ID NO: 8353 - DNA, 25 bp, Mus musculus
agtaggaagaggaccccagattgtc

SEQ ID NO: 8354 - DNA, 25 bp, Mus musculus
agtaggtctgcagaaatatcttcag

SEQ ID NO: 8355 - DNA, 25 bp, Mus musculus
agtagtctgagtttctgaccaacag

SEQ ID NO: 8356 - DNA, 25 bp, Mus musculus
agtagtggcactagcagtcttggca

SEQ ID NO: 8357 - DNA, 25 bp, Mus musculus
agtatacctgccgacccgagagtac

SEQ ID NO: 8358 - DNA, 25 bp, Mus musculus
agtatacgaagcagagccgcaaccc

SEQ ID NO: 8359 - DNA, 25 bp, Mus musculus
agtatagcaccatcaccttattagg

SEQ ID NO: 8360 - DNA, 25 bp, Mus musculus
agtatagtctccctaccagctttag

SEQ ID NO: 8361 - DNA, 25 bp, Mus musculus
agtatatcccgaagctacgcaaaga

SEQ ID NO: 8362 - DNA, 25 bp, Mus musculus
agtatatcttcaacgatgaccccag

SEQ ID NO: 8363 - DNA, 25 bp, Mus musculus
agtatcagcctttgagtctcaggag

SEQ ID NO: 8364 - DNA, 25 bp, Mus musculus
agtatccgagatactcgctttggga

SEQ ID NO: 8365 - DNA, 25 bp, Mus musculus
agtatcgacccaaactgtgatgtgg

SEQ ID NO: 8366 - DNA, 25 bp, Mus musculus
agtatcgacccatactgtgatgtgg

SEQ ID NO: 8367 - DNA, 25 bp, Mus musculus
agtatcgccggaatgaactcttcct

SEQ ID NO: 8368 - DNA, 25 bp, Mus musculus
agtatcggttgtgatactgccctga

SEQ ID NO: 8369 - DNA, 25 bp, Mus musculus
agtatctcgggccacaggaccttaa

SEQ ID NO: 8370 - DNA, 25 bp, Mus musculus
agtatgagcttgtttacccagagcc

SEQ ID NO: 8371 - DNA, 25 bp, Mus musculus
agtatgatggcaacctcctgcggcg

SEQ ID NO: 8372 - DNA, 25 bp, Mus musculus
agtatgatggcatcctcctgcggcg

SEQ ID NO: 8373 - DNA, 25 bp, Mus musculus
agtatgctaaaagatactgcaatgc

SEQ ID NO: 8374 - DNA, 25 bp, Mus musculus
agtatgggctcattttacatgtttg

SEQ ID NO: 8375 - DNA, 25 bp, Mus musculus
agtatgtccccagaattgtgtttgt

SEQ ID NO: 8376 - DNA, 25 bp, Mus musculus
agtatgtcctgcaagttttaaagaa

SEQ ID NO: 8377 - DNA, 25 bp, Mus musculus
agtatgtctaacaagcactgctatg

SEQ ID NO: 8378 - DNA, 25 bp, Mus musculus
agtatgtgacgagggccgcagtttt

SEQ ID NO: 8379 - DNA, 25 bp, Mus musculus
agtattcagtctcggctctcccctg

SEQ ID NO: 8380 - DNA, 25 bp, Mus musculus
agtattcattcaacaggccctgggc

SEQ ID NO: 8381 - DNA, 25 bp, Mus musculus
agtattcccagcatggtctagatgg

SEQ ID NO: 8382 - DNA, 25 bp, Mus musculus
agtattccctagacaacttgccaag

SEQ ID NO: 8383 - DNA, 25 bp, Mus musculus
agtattccctagtcaacttgccaag

SEQ ID NO: 8384 - DNA, 25 bp, Mus musculus
agtattgcttccatcctgacctgca

SEQ ID NO: 8385 - DNA, 25 bp, Mus musculus
agtattgtaacagctgaagtctctt

SEQ ID NO: 8386 - DNA, 25 bp, Mus musculus
agtatttggaagaacgggctatgag

SEQ ID NO: 8387 - DNA, 25 bp, Mus musculus
agtattttcacatcagtgacagcca

SEQ ID NO: 8388 - DNA, 25 bp, Mus musculus
agtattttcctcaagtcccatgact

SEQ ID NO: 8389 - DNA, 25 bp, Mus musculus
agtcaaagccatagcctcggcctcg

SEQ ID NO: 8390 - DNA, 25 bp, Mus musculus
agtcaacagaagcacaaagtttgga

SEQ ID NO: 8391 - DNA, 25 bp, Mus musculus
agtcaactttgctacctggaaccag

SEQ ID NO: 8392 - DNA, 25 bp, Mus musculus
agtcaagccagctcacagcacttca

SEQ ID NO: 8393 - DNA, 25 bp, Mus musculus
agtcaaggaggaagtagcgaatgcc

SEQ ID NO: 8394 - DNA, 25 bp, Mus musculus
agtcaagtgatgctttattcagccg

SEQ ID NO: 8395 - DNA, 25 bp, Mus musculus
agtcaatgccctggagatcgagctg

SEQ ID NO: 8396 - DNA, 25 bp, Mus musculus
agtcaatggagtgtggatctgtacc

SEQ ID NO: 8397 - DNA, 25 bp, Mus musculus
agtcaattccaagatcctgctgcct

SEQ ID NO: 8398 - DNA, 25 bp, Mus musculus
agtcacagatccagccaaatgcaac

SEQ ID NO: 8399 - DNA, 25 bp, Mus musculus
agtcacagtgctgggctcaaccctt

SEQ ID NO: 8400 - DNA, 25 bp, Mus musculus
agtcaccattgtccaaactcagagg

SEQ ID NO: 8401 - DNA, 25 bp, Mus musculus
agtcagaagggtcccctaatcaagg

SEQ ID NO: 8402 - DNA, 25 bp, Mus musculus
agtcagacatatgaaactgaggaga

SEQ ID NO: 8403 - DNA, 25 bp, Mus musculus
agtcagagctgtccctgcggcagct

SEQ ID NO: 8404 - DNA, 25 bp, Mus musculus
agtcagatgtacagtccgcagggca

SEQ ID NO: 8405 - DNA, 25 bp, Mus musculus
agtcagcagtacttcagtgccccag

SEQ ID NO: 8406 - DNA, 25 bp, Mus musculus
agtcagcagtctgcggagcttttgc

SEQ ID NO: 8407 - DNA, 25 bp, Mus musculus
agtcagcccacgttccttcttaaag

SEQ ID NO: 8408 - DNA, 25 bp, Mus musculus
agtcagccgggcctcagtctcagct

SEQ ID NO: 8409 - DNA, 25 bp, Mus musculus
agtcagcgacttgttcaaaactgtc

SEQ ID NO: 8410 - DNA, 25 bp, Mus musculus
agtcagcttgcgaaggcagaccacg

SEQ ID NO: 8411 - DNA, 25 bp, Mus musculus
agtcaggaaaagtcaccttctgttg

SEQ ID NO: 8412 - DNA, 25 bp, Mus musculus
agtcaggaccgtgttctcaaggagc

SEQ ID NO: 8413 - DNA, 25 bp, Mus musculus
agtcaggaggagtccccgtcccagg

SEQ ID NO: 8414 - DNA, 25 bp, Mus musculus
agtcagggacgtgcctacctcttca

SEQ ID NO: 8415 - DNA, 25 bp, Mus musculus
agtcagtaataaaatgactgaccgg

SEQ ID NO: 8416 - DNA, 25 bp, Mus musculus
agtcagtgggaactacaagaaagga

SEQ ID NO: 8417 - DNA, 25 bp, Mus musculus
agtcagtgggaagtacaagaaagga

SEQ ID NO: 8418 - DNA, 25 bp, Mus musculus
agtcatatttcccacgttgttcatg

SEQ ID NO: 8419 - DNA, 25 bp, Mus musculus
agtcatccccgcaacagcttctgag

SEQ ID NO: 8420 - DNA, 25 bp, Mus musculus
agtcatccggcctctgtcagtgttt

SEQ ID NO: 8421 - DNA, 25 bp, Mus musculus
agtcatggaccaacacaagctcagc

SEQ ID NO: 8422 - DNA, 25 bp, Mus musculus
agtcatggcaacagcgtgcacctcg

SEQ ID NO: 8423 - DNA, 25 bp, Mus musculus
agtcattccgccctgtcctgacgtg

SEQ ID NO: 8424 - DNA, 25 bp, Mus musculus
agtcattccgccgtgtcctgacgtg

SEQ ID NO: 8425 - DNA, 25 bp, Mus musculus
agtccaaaggctatggttttgtatc

SEQ ID NO: 8426 - DNA, 25 bp, Mus musculus
agtccaacagctaatggctcatttg

SEQ ID NO: 8427 - DNA, 25 bp, Mus musculus
agtccaaccttgatcccagcaacgt

SEQ ID NO: 8428 - DNA, 25 bp, Mus musculus
agtccaagccgaatgtcccatgcac

SEQ ID NO: 8429 - DNA, 25 bp, Mus musculus
agtccaagtcttctatgttccaaac

SEQ ID NO: 8430 - DNA, 25 bp, Mus musculus
agtccacagcccaggtcaaggtcca

SEQ ID NO: 8431 - DNA, 25 bp, Mus musculus
agtccacgcagttacagtccagcta

SEQ ID NO: 8432 - DNA, 25 bp, Mus musculus
agtccagaaatctaatatcatccag

SEQ ID NO: 8433 - DNA, 25 bp, Mus musculus
agtccagagtactttagtcctgagg

SEQ ID NO: 8434 - DNA, 25 bp, Mus musculus
agtccagcacatggaactagttcag

SEQ ID NO: 8435 - DNA, 25 bp, Mus musculus
agtccagcacttagcctgggtcgcc

SEQ ID NO: 8436 - DNA, 25 bp, Mus musculus
agtccagccaggagtcccggatcct

SEQ ID NO: 8437 - DNA, 25 bp, Mus musculus
agtccagcgattgtccaagaattcc

SEQ ID NO: 8438 - DNA, 25 bp, Mus musculus
agtccagctacaaccccttcgagga

SEQ ID NO: 8439 - DNA, 25 bp, Mus musculus
agtccagctcggtcatcactcaggc

SEQ ID NO: 8440 - DNA, 25 bp, Mus musculus
agtccaggctgtcattgaatggtct

SEQ ID NO: 8441 - DNA, 25 bp, Mus musculus
agtccaggtgctggacaatgaaaac

SEQ ID NO: 8442 - DNA, 25 bp, Mus musculus
agtccagttgccttctctcagtaag

SEQ ID NO: 8443 - DNA, 25 bp, Mus musculus
agtccatgctcaacaccgtgctgca

SEQ ID NO: 8444 - DNA, 25 bp, Mus musculus
agtccatgctgaaaaacctctcccg

SEQ ID NO: 8445 - DNA, 25 bp, Mus musculus
agtccatgtatctgtcagctaaagg

SEQ ID NO: 8446 - DNA, 25 bp, Mus musculus
agtccatgttctccgaaaatcttgg

SEQ ID NO: 8447 - DNA, 25 bp, Mus musculus
agtccatgttgctgaaagctgtttg

SEQ ID NO: 8448 - DNA, 25 bp, Mus musculus
agtcccaaaggaggctattagagag

SEQ ID NO: 8449 - DNA, 25 bp, Mus musculus
agtcccaagtccaagatccctgcaa

SEQ ID NO: 8450 - DNA, 25 bp, Mus musculus
agtcccagaacagcacggccttggt

SEQ ID NO: 8451 - DNA, 25 bp, Mus musculus
agtcccagatgatgcccgccagcgt

SEQ ID NO: 8452 - DNA, 25 bp, Mus musculus
agtcccagcatgtcaacaccctggg

SEQ ID NO: 8453 - DNA, 25 bp, Mus musculus
agtcccgagctgtgcgcagcaaaca

SEQ ID NO: 8454 - DNA, 25 bp, Mus musculus
agtcccgcaaacaacttatcagtag

SEQ ID NO: 8455 - DNA, 25 bp, Mus musculus
agtcccgggccacaaatgttcttgc

SEQ ID NO: 8456 - DNA, 25 bp, Mus musculus
agtccctcaaggcactgattgaaaa

SEQ ID NO: 8457 - DNA, 25 bp, Mus musculus
agtccctgagctggacgggaagaca

SEQ ID NO: 8458 - DNA, 25 bp, Mus musculus
agtccctgctatcaatggagcattg

SEQ ID NO: 8459 - DNA, 25 bp, Mus musculus
agtccctgctgagagtactgtcgtc

SEQ ID NO: 8460 - DNA, 25 bp, Mus musculus
agtccgctggatttcctacaagttg

SEQ ID NO: 8461 - DNA, 25 bp, Mus musculus
agtccgggcacaggatgagaataat

SEQ ID NO: 8462 - DNA, 25 bp, Mus musculus
agtcctacggcattatggagattgc

SEQ ID NO: 8463 - DNA, 25 bp, Mus musculus
agtcctagcacggtatgggcctgcc

SEQ ID NO: 8464 - DNA, 25 bp, Mus musculus
agtcctcagacaccacattcctggt

SEQ ID NO: 8465 - DNA, 25 bp, Mus musculus
agtcctcagacagcacattcctggt

SEQ ID NO: 8466 - DNA, 25 bp, Mus musculus
agtcctccgggcagctgcttgtctt

SEQ ID NO: 8467 - DNA, 25 bp, Mus musculus
agtcctccgttccatcccagtaatg

SEQ ID NO: 8468 - DNA, 25 bp, Mus musculus
agtcctcgcccttatctgatggtag

SEQ ID NO: 8469 - DNA, 25 bp, Mus musculus
agtcctcgcggctgcttcacattac

SEQ ID NO: 8470 - DNA, 25 bp, Mus musculus
agtcctcgcgtgtcggtgcttccta

SEQ ID NO: 8471 - DNA, 25 bp, Mus musculus
agtcctcgtttctgctgccagttca

SEQ ID NO: 8472 - DNA, 25 bp, Mus musculus
agtcctgaagaaaggataaagttca

SEQ ID NO: 8473 - DNA, 25 bp, Mus musculus
agtcctgcagccatctttttaattg

SEQ ID NO: 8474 - DNA, 25 bp, Mus musculus
agtcctgccacaggccctgggagga

SEQ ID NO: 8475 - DNA, 25 bp, Mus musculus
agtcctgccccataaacattgagga

SEQ ID NO: 8476 - DNA, 25 bp, Mus musculus
agtcctggcaccacaaacacagagg

SEQ ID NO: 8477 - DNA, 25 bp, Mus musculus
agtcctggctattccagagcttgct

SEQ ID NO: 8478 - DNA, 25 bp, Mus musculus
agtccttgatagaagcagcgcctga

SEQ ID NO: 8479 - DNA, 25 bp, Mus musculus
agtcgagtcgttacttactaagtcg

SEQ ID NO: 8480 - DNA, 25 bp, Mus musculus
agtcgagttccagcgtgcacctaat

SEQ ID NO: 8481 - DNA, 25 bp, Mus musculus
agtcgccaaaaacaaatgggccagg

SEQ ID NO: 8482 - DNA, 25 bp, Mus musculus
agtcgctctaattcttggtctccaa

SEQ ID NO: 8483 - DNA, 25 bp, Mus musculus
agtcgcttcaaagtagggctccaga

SEQ ID NO: 8484 - DNA, 25 bp, Mus musculus
agtcggagccaatgtgcagtcacag

SEQ ID NO: 8485 - DNA, 25 bp, Mus musculus
agtcggatgtggtcgtgcctgttcc

SEQ ID NO: 8486 - DNA, 25 bp, Mus musculus
agtcggcgtctttctacgtatctca

SEQ ID NO: 8487 - DNA, 25 bp, Mus musculus
agtcgggatataagcccagaagaga

SEQ ID NO: 8488 - DNA, 25 bp, Mus musculus
agtcgggccggcatcttttctgaga

SEQ ID NO: 8489 - DNA, 25 bp, Mus musculus
agtcgggctcaaagtccagccagcc

SEQ ID NO: 8490 - DNA, 25 bp, Mus musculus
agtcgtcgatgccagcttcttcttg

SEQ ID NO: 8491 - DNA, 25 bp, Mus musculus
agtcgtgctctgttggtatagagga

SEQ ID NO: 8492 - DNA, 25 bp, Mus musculus
agtctaaggctctcctggaagggta

SEQ ID NO: 8493 - DNA, 25 bp, Mus musculus
agtctaccagacagagtcaccacca

SEQ ID NO: 8494 - DNA, 25 bp, Mus musculus
agtctagacagcgttgcaaattcca

SEQ ID NO: 8495 - DNA, 25 bp, Mus musculus
agtctatataaactggccaatgaag

SEQ ID NO: 8496 - DNA, 25 bp, Mus musculus
agtctattgcaagttccattacaag

SEQ ID NO: 8497 - DNA, 25 bp, Mus musculus
agtctcacatgggacgcctggagag

SEQ ID NO: 8498 - DNA, 25 bp, Mus musculus
agtctcagacaagtactgcctccag

SEQ ID NO: 8499 - DNA, 25 bp, Mus musculus
agtctcagctcttggccagtgtcat

SEQ ID NO: 8500 - DNA, 25 bp, Mus musculus
agtctcccattagaatatcagtttc

SEQ ID NO: 8501 - DNA, 25 bp, Mus musculus
agtctcccttgggtgaaagagcaga

SEQ ID NO: 8502 - DNA, 25 bp, Mus musculus
agtctctaagcttgtggtccaccag

SEQ ID NO: 8503 - DNA, 25 bp, Mus musculus
agtctctacacatctgacagtccag

SEQ ID NO: 8504 - DNA, 25 bp, Mus musculus
agtctctagcttcgccatgtacatg

SEQ ID NO: 8505 - DNA, 25 bp, Mus musculus
agtctctcccaatgaccagacactg

SEQ ID NO: 8506 - DNA, 25 bp, Mus musculus
agtctctgcaactggaggtagcagc

SEQ ID NO: 8507 - DNA, 25 bp, Mus musculus
agtctctggacaagaacggtgtgga

SEQ ID NO: 8508 - DNA, 25 bp, Mus musculus
agtctctggacgacttcacagactt

SEQ ID NO: 8509 - DNA, 25 bp, Mus musculus
agtctgagtcagagatcgtcccgga

SEQ ID NO: 8510 - DNA, 25 bp, Mus musculus
agtctgattaaagtcatccacttgc

SEQ ID NO: 8511 - DNA, 25 bp, Mus musculus
agtctgcaatgaccccaaggtgcca

SEQ ID NO: 8512 - DNA, 25 bp, Mus musculus
agtctgcagagagcccacatggagt

SEQ ID NO: 8513 - DNA, 25 bp, Mus musculus
agtctgccggctggagagcacaact

SEQ ID NO: 8514 - DNA, 25 bp, Mus musculus
agtctgcgtggctcactgtcaccag

SEQ ID NO: 8515 - DNA, 25 bp, Mus musculus
agtctgggatggtttccgaaggcca

SEQ ID NO: 8516 - DNA, 25 bp, Mus musculus
agtctggtagttagccccggacagc

SEQ ID NO: 8517 - DNA, 25 bp, Mus musculus
agtctgtcattcaccgggctctcta

SEQ ID NO: 8518 - DNA, 25 bp, Mus musculus
agtctgtgacctccagttccaaggg

SEQ ID NO: 8519 - DNA, 25 bp, Mus musculus
agtctgtgtcagaggatcccaccca

SEQ ID NO: 8520 - DNA, 25 bp, Mus musculus
agtctgttgggagttttcactttca

SEQ ID NO: 8521 - DNA, 25 bp, Mus musculus
agtcttcagcctattatcaaaacgg

SEQ ID NO: 8522 - DNA, 25 bp, Mus musculus
agtcttcatcacagatggcagtgtg

SEQ ID NO: 8523 - DNA, 25 bp, Mus musculus
agtcttcattcagttaccttccagg

SEQ ID NO: 8524 - DNA, 25 bp, Mus musculus
agtcttcgtggcttatttgccttca

SEQ ID NO: 8525 - DNA, 25 bp, Mus musculus
agtcttctggcaagtcgtggctttg

SEQ ID NO: 8526 - DNA, 25 bp, Mus musculus
agtcttgaagggagatgggaccctt

SEQ ID NO: 8527 - DNA, 25 bp, Mus musculus
agtcttgacattcttcagggctgca

SEQ ID NO: 8528 - DNA, 25 bp, Mus musculus
agtcttggcatcttcgaagtaagga

SEQ ID NO: 8529 - DNA, 25 bp, Mus musculus
agtctttagacctctgctgggtgtg

SEQ ID NO: 8530 - DNA, 25 bp, Mus musculus
agtctttgacttcctgggttaccag

SEQ ID NO: 8531 - DNA, 25 bp, Mus musculus
agtgaaaatgctggtgtggcctccc

SEQ ID NO: 8532 - DNA, 25 bp, Mus musculus
agtgaaaccgacctggactgcattt

SEQ ID NO: 8533 - DNA, 25 bp, Mus musculus
agtgaaaccggccacgtacctggtg

SEQ ID NO: 8534 - DNA, 25 bp, Mus musculus
agtgaaagacgccatcgatgacgtg

SEQ ID NO: 8535 - DNA, 25 bp, Mus musculus
agtgaaaggctacttcctggctgga

SEQ ID NO: 8536 - DNA, 25 bp, Mus musculus
agtgaaatgcaaagtccttcgcaag

SEQ ID NO: 8537 - DNA, 25 bp, Mus musculus
agtgaacaagaagacccctgccctg

SEQ ID NO: 8538 - DNA, 25 bp, Mus musculus
agtgaacctcttccccaagatcctg

SEQ ID NO: 8539 - DNA, 25 bp, Mus musculus
agtgaacttcccatcatgcaccagg

SEQ ID NO: 8540 - DNA, 25 bp, Mus musculus
agtgaagacactcggaggaagatca

SEQ ID NO: 8541 - DNA, 25 bp, Mus musculus
agtgaagattcacggctggcaccca

SEQ ID NO: 8542 - DNA, 25 bp, Mus musculus
agtgaagcaacccatagaacccggg

SEQ ID NO: 8543 - DNA, 25 bp, Mus musculus
agtgaaggaagctctggttgaccat

SEQ ID NO: 8544 - DNA, 25 bp, Mus musculus
agtgaaggagatcctcctccggaag

SEQ ID NO: 8545 - DNA, 25 bp, Mus musculus
agtgaaggatttgagccccctgccg

SEQ ID NO: 8546 - DNA, 25 bp, Mus musculus
agtgaaggccctgtaccaagtgagc

SEQ ID NO: 8547 - DNA, 25 bp, Mus musculus
agtgaagtcctagaagtttctgagg

SEQ ID NO: 8548 - DNA, 25 bp, Mus musculus
agtgaatacccttcaccctggcagt

SEQ ID NO: 8549 - DNA, 25 bp, Mus musculus
agtgaatgagcacggcaatgtgcca

SEQ ID NO: 8550 - DNA, 25 bp, Mus musculus
agtgaattccttcatcgtcagcacg

SEQ ID NO: 8551 - DNA, 25 bp, Mus musculus
agtgacaaagaagatgaacagcctc

SEQ ID NO: 8552 - DNA, 25 bp, Mus musculus
agtgacaaagtgactgaaagactca

SEQ ID NO: 8553 - DNA, 25 bp, Mus musculus
agtgacaacacctcagtgactaccc

SEQ ID NO: 8554 - DNA, 25 bp, Mus musculus
agtgacaacagtgctacagtttgaa

SEQ ID NO: 8555 - DNA, 25 bp, Mus musculus
agtgacaccacctggcaggaaccca

SEQ ID NO: 8556 - DNA, 25 bp, Mus musculus
agtgacagccatgctggtttgctgc

SEQ ID NO: 8557 - DNA, 25 bp, Mus musculus
agtgacagttctgggctacggtctc

SEQ ID NO: 8558 - DNA, 25 bp, Mus musculus
agtgacatcattaagtccagatctg

SEQ ID NO: 8559 - DNA, 25 bp, Mus musculus
agtgaccaacagaagggaccggagc

SEQ ID NO: 8560 - DNA, 25 bp, Mus musculus
agtgaccaggttctccttcttaggg

SEQ ID NO: 8561 - DNA, 25 bp, Mus musculus
agtgaccagttcctcttcttaattc

SEQ ID NO: 8562 - DNA, 25 bp, Mus musculus
agtgaccatcaacaaattcttccag

SEQ ID NO: 8563 - DNA, 25 bp, Mus musculus
agtgaccccaacaagttacaagaag

SEQ ID NO: 8564 - DNA, 25 bp, Mus musculus
agtgacccctgaggagtgtcagcta

SEQ ID NO: 8565 - DNA, 25 bp, Mus musculus
agtgacccgcctggaacaaagcctt

SEQ ID NO: 8566 - DNA, 25 bp, Mus musculus
agtgaccctcagaccagcccagaga

SEQ ID NO: 8567 - DNA, 25 bp, Mus musculus
agtgaccgttacaatcctggctatc

SEQ ID NO: 8568 - DNA, 25 bp, Mus musculus
agtgaccttacaccgaaccatctca

SEQ ID NO: 8569 - DNA, 25 bp, Mus musculus
agtgacggtcatcggtttcttcaag

SEQ ID NO: 8570 - DNA, 25 bp, Mus musculus
agtgactcctctttgtccgaggtgc

SEQ ID NO: 8571 - DNA, 25 bp, Mus musculus
agtgactggccacgctcatgtgctc

SEQ ID NO: 8572 - DNA, 25 bp, Mus musculus
agtgacttcagattttccttccccg

SEQ ID NO: 8573 - DNA, 25 bp, Mus musculus
agtgactttctctctactgtaggag

SEQ ID NO: 8574 - DNA, 25 bp, Mus musculus
agtgagaccccctcagaggctgacc

SEQ ID NO: 8575 - DNA, 25 bp, Mus musculus
agtgagatttctgaccaaacggttc

SEQ ID NO: 8576 - DNA, 25 bp, Mus musculus
agtgagcaagcacctgctgtgtgat

SEQ ID NO: 8577 - DNA, 25 bp, Mus musculus
agtgagcactactcggagacccata

SEQ ID NO: 8578 - DNA, 25 bp, Mus musculus
agtgagctcctatgggaacatccga

SEQ ID NO: 8579 - DNA, 25 bp, Mus musculus
agtgagctcttggagatttcaggga

SEQ ID NO: 8580 - DNA, 25 bp, Mus musculus
agtgagctgcctgcgtcccaaagaa

SEQ ID NO: 8581 - DNA, 25 bp, Mus musculus
agtgaggataatggacagccctgtc

SEQ ID NO: 8582 - DNA, 25 bp, Mus musculus
agtgaggtacattgcagttctgaag

SEQ ID NO: 8583 - DNA, 25 bp, Mus musculus
agtgagtgcccaaagacgagcagcg

SEQ ID NO: 8584 - DNA, 25 bp, Mus musculus
agtgataaagatgcctcagtggtgg

SEQ ID NO: 8585 - DNA, 25 bp, Mus musculus
agtgatacagtgcaacgcctccgcc

SEQ ID NO: 8586 - DNA, 25 bp, Mus musculus
agtgatatagctcggccttcaggca

SEQ ID NO: 8587 - DNA, 25 bp, Mus musculus
agtgatatagctgggccttcaggca

SEQ ID NO: 8588 - DNA, 25 bp, Mus musculus
agtgatccacagtaacgaccccgtg

SEQ ID NO: 8589 - DNA, 25 bp, Mus musculus
agtgatcccttgcaagatctgtggg

SEQ ID NO: 8590 - DNA, 25 bp, Mus musculus
agtgatcgctctcgtgaacgcaagg

SEQ ID NO: 8591 - DNA, 25 bp, Mus musculus
agtgatgatgaccttgcctggaaca

SEQ ID NO: 8592 - DNA, 25 bp, Mus musculus
agtgatgcccaacaagggccccagt

SEQ ID NO: 8593 - DNA, 25 bp, Mus musculus
agtgatggagcacgcgctgctcaat

SEQ ID NO: 8594 - DNA, 25 bp, Mus musculus
agtgatgtaatctgctgtctgtggc

SEQ ID NO: 8595 - DNA, 25 bp, Mus musculus
agtgattccttgtccagtgagctgc

SEQ ID NO: 8596 - DNA, 25 bp, Mus musculus
agtgattcggatgatgctggagatc

SEQ ID NO: 8597 - DNA, 25 bp, Mus musculus
agtgattctctgatcctggtgggaa

SEQ ID NO: 8598 - DNA, 25 bp, Mus musculus
agtgatttctctactggaccctacc

SEQ ID NO: 8599 - DNA, 25 bp, Mus musculus
agtgatttctcttctggaccctacc

SEQ ID NO: 8600 - DNA, 25 bp, Mus musculus
agtgatttggtatgctgtttgcaag

SEQ ID NO: 8601 - DNA, 25 bp, Mus musculus
agtgcaagaaacttcaatctgccaa

SEQ ID NO: 8602 - DNA, 25 bp, Mus musculus
agtgcaaggtgttctccaagaccag

SEQ ID NO: 8603 - DNA, 25 bp, Mus musculus
agtgcaatttatggccgagggatag

SEQ ID NO: 8604 - DNA, 25 bp, Mus musculus
agtgcacactgagcaggagacaaga

SEQ ID NO: 8605 - DNA, 25 bp, Mus musculus
agtgcacagaaaccgcctgctggga

SEQ ID NO: 8606 - DNA, 25 bp, Mus musculus
agtgcaccgaaatgactgcgattgg

SEQ ID NO: 8607 - DNA, 25 bp, Mus musculus
agtgcactgactcgcgagaacgtcg

SEQ ID NO: 8608 - DNA, 25 bp, Mus musculus
agtgcactgactggcgagaacgtcg

SEQ ID NO: 8609 - DNA, 25 bp, Mus musculus
agtgcagacagcagatcctttcaca

SEQ ID NO: 8610 - DNA, 25 bp, Mus musculus
agtgcagactcttcctctagatgaa

SEQ ID NO: 8611 - DNA, 25 bp, Mus musculus
agtgcagcccctagtggacgtgttc

SEQ ID NO: 8612 - DNA, 25 bp, Mus musculus
agtgcagccgcaagaccctcttcta

SEQ ID NO: 8613 - DNA, 25 bp, Mus musculus
agtgcaggaaccactgaagcctcag

SEQ ID NO: 8614 - DNA, 25 bp, Mus musculus
agtgcaggagccacactgactgtgt

SEQ ID NO: 8615 - DNA, 25 bp, Mus musculus
agtgcaggtgccctacaagagaatc

SEQ ID NO: 8616 - DNA, 25 bp, Mus musculus
agtgcagtttcgatggaaaatgaag

SEQ ID NO: 8617 - DNA, 25 bp, Mus musculus
agtgcatacacctgggctggcgctg

SEQ ID NO: 8618 - DNA, 25 bp, Mus musculus
agtgccagcagtgggcggccagctt

SEQ ID NO: 8619 - DNA, 25 bp, Mus musculus
agtgccagccgtactattcacaaca

SEQ ID NO: 8620 - DNA, 25 bp, Mus musculus
agtgccatacctgagctcttaagag

SEQ ID NO: 8621 - DNA, 25 bp, Mus musculus
agtgccatggaggacctgcaggaca

SEQ ID NO: 8622 - DNA, 25 bp, Mus musculus
agtgccatggcgctcctcttctaca

SEQ ID NO: 8623 - DNA, 25 bp, Mus musculus
agtgccattcggagcgacgcactgc

SEQ ID NO: 8624 - DNA, 25 bp, Mus musculus
agtgcccacgttctcctgttgtgaa

SEQ ID NO: 8625 - DNA, 25 bp, Mus musculus
agtgcccataacacagaacccctgt

SEQ ID NO: 8626 - DNA, 25 bp, Mus musculus
agtgccccatgagactggtggattt

SEQ ID NO: 8627 - DNA, 25 bp, Mus musculus
agtgccccggaagtcaactgaaatg

SEQ ID NO: 8628 - DNA, 25 bp, Mus musculus
agtgcccggcaccactatgagtctc

SEQ ID NO: 8629 - DNA, 25 bp, Mus musculus
agtgccctctgcagctgaataaccc

SEQ ID NO: 8630 - DNA, 25 bp, Mus musculus
agtgccctgaaaaccctctgagagg

SEQ ID NO: 8631 - DNA, 25 bp, Mus musculus
agtgccctggagacaactattccgg

SEQ ID NO: 8632 - DNA, 25 bp, Mus musculus
agtgccctgggctctgcaacatctg

SEQ ID NO: 8633 - DNA, 25 bp, Mus musculus
agtgccgcgaaatggctatcgaagc

SEQ ID NO: 8634 - DNA, 25 bp, Mus musculus
agtgcctgcaaacctcattagccca

SEQ ID NO: 8635 - DNA, 25 bp, Mus musculus
agtgcctggtggatgcccgcatgct

SEQ ID NO: 8636 - DNA, 25 bp, Mus musculus
agtgcctttgatgtgctgagcttca

SEQ ID NO: 8637 - DNA, 25 bp, Mus musculus
agtgcgaggtcgtccctgtcgtaca

SEQ ID NO: 8638 - DNA, 25 bp, Mus musculus
agtgcgatgcggtgacgcctctaaa

SEQ ID NO: 8639 - DNA, 25 bp, Mus musculus
agtgcgtcgggccaaacaagtgcaa

SEQ ID NO: 8640 - DNA, 25 bp, Mus musculus
agtgcgtggcccatgggccagtccc

SEQ ID NO: 8641 - DNA, 25 bp, Mus musculus
agtgctaccaaacccgacgacaagg

SEQ ID NO: 8642 - DNA, 25 bp, Mus musculus
agtgctagggatccccgcctttcaa

SEQ ID NO: 8643 - DNA, 25 bp, Mus musculus
agtgctccaagacctgcggaactgg

SEQ ID NO: 8644 - DNA, 25 bp, Mus musculus
agtgctccaagagctgcggaactgg

SEQ ID NO: 8645 - DNA, 25 bp, Mus musculus
agtgctcccggaagccagaaacttt

SEQ ID NO: 8646 - DNA, 25 bp, Mus musculus
agtgctcctatatctccagctgcct

SEQ ID NO: 8647 - DNA, 25 bp, Mus musculus
agtgctcggatgtgtacctgctgca

SEQ ID NO: 8648 - DNA, 25 bp, Mus musculus
agtgctgaagatgggttctttgtgc

SEQ ID NO: 8649 - DNA, 25 bp, Mus musculus
agtgctgatgatgaggaactgacca

SEQ ID NO: 8650 - DNA, 25 bp, Mus musculus
agtgctgcccagcatggacaacatc

SEQ ID NO: 8651 - DNA, 25 bp, Mus musculus
agtgctgcccaggatggacaacatc

SEQ ID NO: 8652 - DNA, 25 bp, Mus musculus
agtgctgccgtgtcctccgttgact

SEQ ID NO: 8653 - DNA, 25 bp, Mus musculus
agtgctgcctgccttcgcagggcat

SEQ ID NO: 8654 - DNA, 25 bp, Mus musculus
agtgctgctcacagtgctcatagcc

SEQ ID NO: 8655 - DNA, 25 bp, Mus musculus
agtgctgctctaagggcggccgacc

SEQ ID NO: 8656 - DNA, 25 bp, Mus musculus
agtgctgctgaagtcctccacggag

SEQ ID NO: 8657 - DNA, 25 bp, Mus musculus
agtgctggccgcaccgtgttggtca

SEQ ID NO: 8658 - DNA, 25 bp, Mus musculus
agtgctgggctcaacccttgtccca

SEQ ID NO: 8659 - DNA, 25 bp, Mus musculus
agtgctgggctgtgacttgctgcct

SEQ ID NO: 8660 - DNA, 25 bp, Mus musculus
agtgcttaggagtctaccagacaga

SEQ ID NO: 8661 - DNA, 25 bp, Mus musculus
agtgcttagttcaaaccattcatct

SEQ ID NO: 8662 - DNA, 25 bp, Mus musculus
agtgcttcggcacaacgccctcatt

SEQ ID NO: 8663 - DNA, 25 bp, Mus musculus
agtgctttcaagctcccacatacag

SEQ ID NO: 8664 - DNA, 25 bp, Mus musculus
agtgctttttgcatggcccaaaggg

SEQ ID NO: 8665 - DNA, 25 bp, Mus musculus
agtggaagaaaaacacccctgagca

SEQ ID NO: 8666 - DNA, 25 bp, Mus musculus
agtggaatgagaaagtgacgcagtc

SEQ ID NO: 8667 - DNA, 25 bp, Mus musculus
agtggaatttgaacccaggcagtct

SEQ ID NO: 8668 - DNA, 25 bp, Mus musculus
agtggaccacaatgctccttttgag

SEQ ID NO: 8669 - DNA, 25 bp, Mus musculus
agtggaccagacacgggagctttgt

SEQ ID NO: 8670 - DNA, 25 bp, Mus musculus
agtggacgagcacgctcgaccccaa

SEQ ID NO: 8671 - DNA, 25 bp, Mus musculus
agtggacgtatatcccagttctcag

SEQ ID NO: 8672 - DNA, 25 bp, Mus musculus
agtggacgtcaacatctgtaaccag

SEQ ID NO: 8673 - DNA, 25 bp, Mus musculus
agtggactcggcctcaatgagagaa

SEQ ID NO: 8674 - DNA, 25 bp, Mus musculus
agtggagaaccacaaaaagcagatg

SEQ ID NO: 8675 - DNA, 25 bp, Mus musculus
agtggagagagagctagttaacttc

SEQ ID NO: 8676 - DNA, 25 bp, Mus musculus
agtggaggccaagaacccagctgac

SEQ ID NO: 8677 - DNA, 25 bp, Mus musculus
agtggaggtgccaaaggagtcttct

SEQ ID NO: 8678 - DNA, 25 bp, Mus musculus
agtggagtgggtaaatgtcttgaac

SEQ ID NO: 8679 - DNA, 25 bp, Mus musculus
agtggatcaattccatgttaagtga

SEQ ID NO: 8680 - DNA, 25 bp, Mus musculus
agtggatcagctggagaaagtgctc

SEQ ID NO: 8681 - DNA, 25 bp, Mus musculus
agtggatgacctgcctccattgtct

SEQ ID NO: 8682 - DNA, 25 bp, Mus musculus
agtggatgctgtggcccctgactgc

SEQ ID NO: 8683 - DNA, 25 bp, Mus musculus
agtggcaatgagactgagcctgcga

SEQ ID NO: 8684 - DNA, 25 bp, Mus musculus
agtggcacacactacctgcatctgc

SEQ ID NO: 8685 - DNA, 25 bp, Mus musculus
agtggcaccagcttcctcgtaagtg

SEQ ID NO: 8686 - DNA, 25 bp, Mus musculus
agtggcatccactgtatcatcggcc

SEQ ID NO: 8687 - DNA, 25 bp, Mus musculus
agtggcatcttctgatacccgtcag

SEQ ID NO: 8688 - DNA, 25 bp, Mus musculus
agtggccattccctgggagttacag

SEQ ID NO: 8689 - DNA, 25 bp, Mus musculus
agtggcctgcaagttattccaaaca

SEQ ID NO: 8690 - DNA, 25 bp, Mus musculus
agtggcctggcctatctgaatggtt

SEQ ID NO: 8691 - DNA, 25 bp, Mus musculus
agtggccttacgtctctgcccagag

SEQ ID NO: 8692 - DNA, 25 bp, Mus musculus
agtggctacttcagcagcagcccca

SEQ ID NO: 8693 - DNA, 25 bp, Mus musculus
agtggctaggcttaaatattctacc

SEQ ID NO: 8694 - DNA, 25 bp, Mus musculus
agtggctcctttagcaaactccggg

SEQ ID NO: 8695 - DNA, 25 bp, Mus musculus
agtggctctctccttgtgcagcctg

SEQ ID NO: 8696 - DNA, 25 bp, Mus musculus
agtggctgcccttcaggaacgctgt

SEQ ID NO: 8697 - DNA, 25 bp, Mus musculus
agtgggaaaagaggctctctacatc

SEQ ID NO: 8698 - DNA, 25 bp, Mus musculus
agtgggacaccatgaagtacagttg

SEQ ID NO: 8699 - DNA, 25 bp, Mus musculus
agtgggaccccagggccttctgtat

SEQ ID NO: 8700 - DNA, 25 bp, Mus musculus
agtgggaccctcagacagagcgctg

SEQ ID NO: 8701 - DNA, 25 bp, Mus musculus
agtgggaccctcagcctaccctgaa

SEQ ID NO: 8702 - DNA, 25 bp, Mus musculus
agtgggaggctgattttgagccata

SEQ ID NO: 8703 - DNA, 25 bp, Mus musculus
agtgggaggctgtttttgagccata

SEQ ID NO: 8704 - DNA, 25 bp, Mus musculus
agtgggagtccctggacttagaaca

SEQ ID NO: 8705 - DNA, 25 bp, Mus musculus
agtgggattacatgacaccagagca

SEQ ID NO: 8706 - DNA, 25 bp, Mus musculus
agtgggcacccatcctggccaactt

SEQ ID NO: 8707 - DNA, 25 bp, Mus musculus
agtgggcaccgatcgcacgggcttc

SEQ ID NO: 8708 - DNA, 25 bp, Mus musculus
agtgggcactggacaacattctgat

SEQ ID NO: 8709 - DNA, 25 bp, Mus musculus
agtgggcagggaccttcttcccaga

SEQ ID NO: 8710 - DNA, 25 bp, Mus musculus
agtgggctttgcaggaggccacaca

SEQ ID NO: 8711 - DNA, 25 bp, Mus musculus
agtgggtgccactgtcaaacctgca

SEQ ID NO: 8712 - DNA, 25 bp, Mus musculus
agtgggttcatctccgaccgcctta

SEQ ID NO: 8713 - DNA, 25 bp, Mus musculus
agtggtacccggcaattcaggatga

SEQ ID NO: 8714 - DNA, 25 bp, Mus musculus
agtggtaccggcgtgtgtacaagtc

SEQ ID NO: 8715 - DNA, 25 bp, Mus musculus
agtggtagcagctacagtggctcca

SEQ ID NO: 8716 - DNA, 25 bp, Mus musculus
agtggtccagatatgaagtttgcat

SEQ ID NO: 8717 - DNA, 25 bp, Mus musculus
agtggtccttcagcaccatcagcag

SEQ ID NO: 8718 - DNA, 25 bp, Mus musculus
agtggtcggtaggacacagccgtct

SEQ ID NO: 8719 - DNA, 25 bp, Mus musculus
agtggtgagaaaacagaccccaaag

SEQ ID NO: 8720 - DNA, 25 bp, Mus musculus
agtggtgcagctgggtttgacaaac

SEQ ID NO: 8721 - DNA, 25 bp, Mus musculus
agtggtgcggtatctggtccaagat

SEQ ID NO: 8722 - DNA, 25 bp, Mus musculus
agtggttatgacaacctgcattagc

SEQ ID NO: 8723 - DNA, 25 bp, Mus musculus
agtggttctactgcggtctgtggat

SEQ ID NO: 8724 - DNA, 25 bp, Mus musculus
agtggttcttcgagtttggctttgt

SEQ ID NO: 8725 - DNA, 25 bp, Mus musculus
agtggttgatagtcagcttcgaatc

SEQ ID NO: 8726 - DNA, 25 bp, Mus musculus
agtggtttatgtaccatcccatctc

SEQ ID NO: 8727 - DNA, 25 bp, Mus musculus
agtgtaaagattcctgtaaagtgcc

SEQ ID NO: 8728 - DNA, 25 bp, Mus musculus
agtgtaacacgttctgtggcagagc

SEQ ID NO: 8729 - DNA, 25 bp, Mus musculus
agtgtaagactggaacaacagggcc

SEQ ID NO: 8730 - DNA, 25 bp, Mus musculus
agtgtagctggcgtgtcaaaagcag

SEQ ID NO: 8731 - DNA, 25 bp, Mus musculus
agtgtaggatcattttccattatgg

SEQ ID NO: 8732 - DNA, 25 bp, Mus musculus
agtgtaggtgacaaacaagatgccc

SEQ ID NO: 8733 - DNA, 25 bp, Mus musculus
agtgtagttggccaacaagcaacag

SEQ ID NO: 8734 - DNA, 25 bp, Mus musculus
agtgtatacctcctagcatctcagc

SEQ ID NO: 8735 - DNA, 25 bp, Mus musculus
agtgtatcatcaatacatgcgatgc

SEQ ID NO: 8736 - DNA, 25 bp, Mus musculus
agtgtatcatcattacatgcgatgc

SEQ ID NO: 8737 - DNA, 25 bp, Mus musculus
agtgtatgaaatcccttggctctgc

SEQ ID NO: 8738 - DNA, 25 bp, Mus musculus
agtgtatgaggaacccctgtgaagg

SEQ ID NO: 8739 - DNA, 25 bp, Mus musculus
agtgtatgaggatcccctgtgaagg

SEQ ID NO: 8740 - DNA, 25 bp, Mus musculus
agtgtcaccaaaatctacaactact

SEQ ID NO: 8741 - DNA, 25 bp, Mus musculus
agtgtcagacttcccgacaggccag

SEQ ID NO: 8742 - DNA, 25 bp, Mus musculus
agtgtcagcggaaccacgagggtca

SEQ ID NO: 8743 - DNA, 25 bp, Mus musculus
agtgtcatgaatacttccgacccca

SEQ ID NO: 8744 - DNA, 25 bp, Mus musculus
agtgtccccactgtgagggtgtgct

SEQ ID NO: 8745 - DNA, 25 bp, Mus musculus
agtgtcccggacactggaggaccag

SEQ ID NO: 8746 - DNA, 25 bp, Mus musculus
agtgtccctctccatgaaagttgtc

SEQ ID NO: 8747 - DNA, 25 bp, Mus musculus
agtgtccctgttcattgtgctcccg

SEQ ID NO: 8748 - DNA, 25 bp, Mus musculus
agtgtcctcctgcacactggacaga

SEQ ID NO: 8749 - DNA, 25 bp, Mus musculus
agtgtccttcgagataccactgcag

SEQ ID NO: 8750 - DNA, 25 bp, Mus musculus
agtgtccttggttataaactacgat

SEQ ID NO: 8751 - DNA, 25 bp, Mus musculus
agtgtcggtggctgagtatcaccgc

SEQ ID NO: 8752 - DNA, 25 bp, Mus musculus
agtgtcttgcaatggctcttcagtc

SEQ ID NO: 8753 - DNA, 25 bp, Mus musculus
agtgtgaagggaagccgtgccttaa

SEQ ID NO: 8754 - DNA, 25 bp, Mus musculus
agtgtgacatcaccccatgggaaag

SEQ ID NO: 8755 - DNA, 25 bp, Mus musculus
agtgtgaccagtaccgcaccatcct

SEQ ID NO: 8756 - DNA, 25 bp, Mus musculus
agtgtgacgggctgcctgactgctt

SEQ ID NO: 8757 - DNA, 25 bp, Mus musculus
agtgtgagcgctactggcctttgta

SEQ ID NO: 8758 - DNA, 25 bp, Mus musculus
agtgtgattgccaggtaggagccaa

SEQ ID NO: 8759 - DNA, 25 bp, Mus musculus
agtgtgattgtactcgcacgggcta

SEQ ID NO: 8760 - DNA, 25 bp, Mus musculus
agtgtgattgtagtcgcacgggcta

SEQ ID NO: 8761 - DNA, 25 bp, Mus musculus
agtgtggagccttgtcccagcagct

SEQ ID NO: 8762 - DNA, 25 bp, Mus musculus
agtgtggagtcccaaggagcaatac

SEQ ID NO: 8763 - DNA, 25 bp, Mus musculus
agtgtgggatacaaacacattgcag

SEQ ID NO: 8764 - DNA, 25 bp, Mus musculus
agtgtgggctccaagcgtggcttct

SEQ ID NO: 8765 - DNA, 25 bp, Mus musculus
agtgtggtaccagccgtgtcggact

SEQ ID NO: 8766 - DNA, 25 bp, Mus musculus
agtgtgtacacaccaccggccatga

SEQ ID NO: 8767 - DNA, 25 bp, Mus musculus
agtgtgtctccctgctgcgggacag

SEQ ID NO: 8768 - DNA, 25 bp, Mus musculus
agtgtgtctgtaaacgttctgtccc

SEQ ID NO: 8769 - DNA, 25 bp, Mus musculus
agtgtgtgaacacagaaggctcctt

SEQ ID NO: 8770 - DNA, 25 bp, Mus musculus
agtgtgtgaacagagaaggctcctt

SEQ ID NO: 8771 - DNA, 25 bp, Mus musculus
agtgtgtgctacagcgctgctgtca

SEQ ID NO: 8772 - DNA, 25 bp, Mus musculus
agtgtgtttgaggtaccaagagcta

SEQ ID NO: 8773 - DNA, 25 bp, Mus musculus
agtgtgtttgctctcttaaccctgc

SEQ ID NO: 8774 - DNA, 25 bp, Mus musculus
agtgtgtttgtaaagatcttgcaga

SEQ ID NO: 8775 - DNA, 25 bp, Mus musculus
agtgttcccaacaaccagcagacag

SEQ ID NO: 8776 - DNA, 25 bp, Mus musculus
agtgttccgttttgcttactacaag

SEQ ID NO: 8777 - DNA, 25 bp, Mus musculus
agtgttgcaggagaaacttcagtct

SEQ ID NO: 8778 - DNA, 25 bp, Mus musculus
agtgttgccttggaccttgtggaga

SEQ ID NO: 8779 - DNA, 25 bp, Mus musculus
agtgtttcatcaacagccagaccgt

SEQ ID NO: 8780 - DNA, 25 bp, Mus musculus
agtgtttgctgcagaaggaaggaaa

SEQ ID NO: 8781 - DNA, 25 bp, Mus musculus
agtgtttgtggccacaccccagaag

SEQ ID NO: 8782 - DNA, 25 bp, Mus musculus
agttaaagagatcgccactcctacc

SEQ ID NO: 8783 - DNA, 25 bp, Mus musculus
agttaactctgagaagtcgtcctct

SEQ ID NO: 8784 - DNA, 25 bp, Mus musculus
agttaacttctatctgctgtagtcc

SEQ ID NO: 8785 - DNA, 25 bp, Mus musculus
agttaaggaggatacactttccaca

SEQ ID NO: 8786 - DNA, 25 bp, Mus musculus
agttacaaatcagagggcaggcttg

SEQ ID NO: 8787 - DNA, 25 bp, Mus musculus
agttacactcctcgtgcggtcgggc

SEQ ID NO: 8788 - DNA, 25 bp, Mus musculus
agttacactcctggtgcggtcgggc

SEQ ID NO: 8789 - DNA, 25 bp, Mus musculus
agttacatccgtgactctgctgcag

SEQ ID NO: 8790 - DNA, 25 bp, Mus musculus
agttaccttgacgatgtcccattta

SEQ ID NO: 8791 - DNA, 25 bp, Mus musculus
agttacggtggcttcagagcaaagg

SEQ ID NO: 8792 - DNA, 25 bp, Mus musculus
agttacgtcaatatggagaggcacc

SEQ ID NO: 8793 - DNA, 25 bp, Mus musculus
agttactcttctttggatcccggcg

SEQ ID NO: 8794 - DNA, 25 bp, Mus musculus
agttactgtcttgcaaggtgacttc

SEQ ID NO: 8795 - DNA, 25 bp, Mus musculus
agttagagaggattttacgtcgcag

SEQ ID NO: 8796 - DNA, 25 bp, Mus musculus
agttagctgatgttttcagagttgg

SEQ ID NO: 8797 - DNA, 25 bp, Mus musculus
agttaggaggcgcttcattcagtcc

SEQ ID NO: 8798 - DNA, 25 bp, Mus musculus
agttaggatcctccagcctctacct

SEQ ID NO: 8799 - DNA, 25 bp, Mus musculus
agttaggcccacagggctccctgat

SEQ ID NO: 8800 - DNA, 25 bp, Mus musculus
agttagtagtgctgttaggagtccc

SEQ ID NO: 8801 - DNA, 25 bp, Mus musculus
agttataccctgactgtaattgaag

SEQ ID NO: 8802 - DNA, 25 bp, Mus musculus
agttatataactgtacctgacccca

SEQ ID NO: 8803 - DNA, 25 bp, Mus musculus
agttatcgaagcctgaaccagagca

SEQ ID NO: 8804 - DNA, 25 bp, Mus musculus
agttatgcagaaaagccggatgaaa

SEQ ID NO: 8805 - DNA, 25 bp, Mus musculus
agttcaaactctgaagcacccacag

SEQ ID NO: 8806 - DNA, 25 bp, Mus musculus
agttcaacgggcagggcgccagctt

SEQ ID NO: 8807 - DNA, 25 bp, Mus musculus
agttcaagaagatagtggaacgcag

SEQ ID NO: 8808 - DNA, 25 bp, Mus musculus
agttcacatgagactctgaatgtag

SEQ ID NO: 8809 - DNA, 25 bp, Mus musculus
agttcaccgggcaactcctgaagat

SEQ ID NO: 8810 - DNA, 25 bp, Mus musculus
agttcacgacagagaagcagccaat

SEQ ID NO: 8811 - DNA, 25 bp, Mus musculus
agttcacgatggactgcgcagcgcc

SEQ ID NO: 8812 - DNA, 25 bp, Mus musculus
agttcagggcacagcggagtgaaaa

SEQ ID NO: 8813 - DNA, 25 bp, Mus musculus
agttcaggttgagcacatcaaggca

SEQ ID NO: 8814 - DNA, 25 bp, Mus musculus
agttcagtaagtcagccaatagccc

SEQ ID NO: 8815 - DNA, 25 bp, Mus musculus
agttcatagagatgagtgttgagca

SEQ ID NO: 8816 - DNA, 25 bp, Mus musculus
agttcatcacgttgacctttaagga

SEQ ID NO: 8817 - DNA, 25 bp, Mus musculus
agttcatcagccacatcaagtgcag

SEQ ID NO: 8818 - DNA, 25 bp, Mus musculus
agttcatccattccatgtgtttcag

SEQ ID NO: 8819 - DNA, 25 bp, Mus musculus
agttcatcggaatacagccttggcc

SEQ ID NO: 8820 - DNA, 25 bp, Mus musculus
agttccactcccgaattctggacat

SEQ ID NO: 8821 - DNA, 25 bp, Mus musculus
agttccagaagatgcggcgggacct

SEQ ID NO: 8822 - DNA, 25 bp, Mus musculus
agttccagagcctgtgggttgagaa

SEQ ID NO: 8823 - DNA, 25 bp, Mus musculus
agttccagcaccacagagcaaagcc

SEQ ID NO: 8824 - DNA, 25 bp, Mus musculus
agttccagcacctcagagcaaagcc

SEQ ID NO: 8825 - DNA, 25 bp, Mus musculus
agttccctggagctgtgcatacggc

SEQ ID NO: 8826 - DNA, 25 bp, Mus musculus
agttccctgttcctgtgcggctgcc

SEQ ID NO: 8827 - DNA, 25 bp, Mus musculus
agttccggaaggaacggagcaagat

SEQ ID NO: 8828 - DNA, 25 bp, Mus musculus
agttccgggcatagatggcattgat

SEQ ID NO: 8829 - DNA, 25 bp, Mus musculus
agttcctaccggagcacgtgcaact

SEQ ID NO: 8830 - DNA, 25 bp, Mus musculus
agttcctcatcctgcgactcatggg

SEQ ID NO: 8831 - DNA, 25 bp, Mus musculus
agttcctccgctatgcccagggatc

SEQ ID NO: 8832 - DNA, 25 bp, Mus musculus
agttcctccgctttgcccagggatc

SEQ ID NO: 8833 - DNA, 25 bp, Mus musculus
agttcctctcggagtgcctcacatc

SEQ ID NO: 8834 - DNA, 25 bp, Mus musculus
agttcctgaaacaggcttcaagcca

SEQ ID NO: 8835 - DNA, 25 bp, Mus musculus
agttcctgaactttaagaggctaca

SEQ ID NO: 8836 - DNA, 25 bp, Mus musculus
agttcctgccttttctcaccacgga

SEQ ID NO: 8837 - DNA, 25 bp, Mus musculus
agttcctggatgtcacgagtatccg

SEQ ID NO: 8838 - DNA, 25 bp, Mus musculus
agttcgacacccagtacccctatgg

SEQ ID NO: 8839 - DNA, 25 bp, Mus musculus
agttcgttatctagccaaggaaaat

SEQ ID NO: 8840 - DNA, 25 bp, Mus musculus
agttctaccagagggctgctaaacc

SEQ ID NO: 8841 - DNA, 25 bp, Mus musculus
agttctacgtgggagtctgtgcatt

SEQ ID NO: 8842 - DNA, 25 bp, Mus musculus
agttctactgctgaaacagccgccg

SEQ ID NO: 8843 - DNA, 25 bp, Mus musculus
agttctaggcgcctgtgaacagcca

SEQ ID NO: 8844 - DNA, 25 bp, Mus musculus
agttctcagaagcactcagctacct

SEQ ID NO: 8845 - DNA, 25 bp, Mus musculus
agttctcaggattcagaccaaagaa

SEQ ID NO: 8846 - DNA, 25 bp, Mus musculus
agttctccagtacatccaggacagc

SEQ ID NO: 8847 - DNA, 25 bp, Mus musculus
agttctgctgaggacaacggtcaga

SEQ ID NO: 8848 - DNA, 25 bp, Mus musculus
agttctggtctgcacagcacccaca

SEQ ID NO: 8849 - DNA, 25 bp, Mus musculus
agttctgtgttgagccactgggcca

SEQ ID NO: 8850 - DNA, 25 bp, Mus musculus
agttcttaagctcactcatgtggtt

SEQ ID NO: 8851 - DNA, 25 bp, Mus musculus
agttcttctcccttgctgcaaccta

SEQ ID NO: 8852 - DNA, 25 bp, Mus musculus
agttctttccccaggctactcgaca

SEQ ID NO: 8853 - DNA, 25 bp, Mus musculus
agttgaaacgtttggatgaggagct

SEQ ID NO: 8854 - DNA, 25 bp, Mus musculus
agttgaacgcctgctgctgccttga

SEQ ID NO: 8855 - DNA, 25 bp, Mus musculus
agttgaagaagaagcagtatgccaa

SEQ ID NO: 8856 - DNA, 25 bp, Mus musculus
agttgaagttcaaggccctgccttc

SEQ ID NO: 8857 - DNA, 25 bp, Mus musculus
agttgacagtcaggtgaccctctga

SEQ ID NO: 8858 - DNA, 25 bp, Mus musculus
agttgaccaaaagcgtgccagccat

SEQ ID NO: 8859 - DNA, 25 bp, Mus musculus
agttgacctgtttagagaagaaaga

SEQ ID NO: 8860 - DNA, 25 bp, Mus musculus
agttgacctttcctgctgccctgag

SEQ ID NO: 8861 - DNA, 25 bp, Mus musculus
agttgactaccgaccttgcgcgacc

SEQ ID NO: 8862 - DNA, 25 bp, Mus musculus
agttgactaccgtccttgcgcgacc

SEQ ID NO: 8863 - DNA, 25 bp, Mus musculus
agttgagccgttgcgcagtcctgcg

SEQ ID NO: 8864 - DNA, 25 bp, Mus musculus
agttgaggatacattgtctcttcgg

SEQ ID NO: 8865 - DNA, 25 bp, Mus musculus
agttgagtggcctaagttggttcca

SEQ ID NO: 8866 - DNA, 25 bp, Mus musculus
agttgattatctagaccacagtaag

SEQ ID NO: 8867 - DNA, 25 bp, Mus musculus
agttgcaatcaaagatctcttcatc

SEQ ID NO: 8868 - DNA, 25 bp, Mus musculus
agttgcacagccacagactgctcag

SEQ ID NO: 8869 - DNA, 25 bp, Mus musculus
agttgcagcagaaatcctgggaatc

SEQ ID NO: 8870 - DNA, 25 bp, Mus musculus
agttgcatcatctgcctcctgagca

SEQ ID NO: 8871 - DNA, 25 bp, Mus musculus
agttgccacccaagcgtccagaact

SEQ ID NO: 8872 - DNA, 25 bp, Mus musculus
agttgccgttgtcccctctggctct

SEQ ID NO: 8873 - DNA, 25 bp, Mus musculus
agttgcctctaacttcagcaagcgc

SEQ ID NO: 8874 - DNA, 25 bp, Mus musculus
agttgccttctctcagtaagctgcc

SEQ ID NO: 8875 - DNA, 25 bp, Mus musculus
agttgctaaaagtgagcctgacttt

SEQ ID NO: 8876 - DNA, 25 bp, Mus musculus
agttggccaggatcatctgttgaac

SEQ ID NO: 8877 - DNA, 25 bp, Mus musculus
agttggctaggcaactggaagaaaa

SEQ ID NO: 8878 - DNA, 25 bp, Mus musculus
agttggctggctttgacccttccca

SEQ ID NO: 8879 - DNA, 25 bp, Mus musculus
agttgggagtttatcgacttcggca

SEQ ID NO: 8880 - DNA, 25 bp, Mus musculus
agttgggctggttggaaatgccaca

SEQ ID NO: 8881 - DNA, 25 bp, Mus musculus
agttggtgcgctacctgttggctaa

SEQ ID NO: 8882 - DNA, 25 bp, Mus musculus
agttggtggtcctcgccaccctggc

SEQ ID NO: 8883 - DNA, 25 bp, Mus musculus
agttggttccagagtcacattctcc

SEQ ID NO: 8884 - DNA, 25 bp, Mus musculus
agttgtacacaaggatgagttcttc

SEQ ID NO: 8885 - DNA, 25 bp, Mus musculus
agttgtcagactcctgtgctttcgg

SEQ ID NO: 8886 - DNA, 25 bp, Mus musculus
agttgttaactgtaaagtcagagga

SEQ ID NO: 8887 - DNA, 25 bp, Mus musculus
agttgttaccatcgcgcctacctga

SEQ ID NO: 8888 - DNA, 25 bp, Mus musculus
agttgttcgaagtcattgaaacgga

SEQ ID NO: 8889 - DNA, 25 bp, Mus musculus
agttgtttagactgccgtctgcact

SEQ ID NO: 8890 - DNA, 25 bp, Mus musculus
agtttacagtcatcacatgtcccca

SEQ ID NO: 8891 - DNA, 25 bp, Mus musculus
agtttactagtccagtatggagtgg

SEQ ID NO: 8892 - DNA, 25 bp, Mus musculus
agtttagcactagaggagtctggga

SEQ ID NO: 8893 - DNA, 25 bp, Mus musculus
agtttaggacactgcatttactcaa

SEQ ID NO: 8894 - DNA, 25 bp, Mus musculus
agtttaggactcagtggactcggcc

SEQ ID NO: 8895 - DNA, 25 bp, Mus musculus
agtttatcgacttcggcatggacct

SEQ ID NO: 8896 - DNA, 25 bp, Mus musculus
agtttcatcaactctcttaccggga

SEQ ID NO: 8897 - DNA, 25 bp, Mus musculus
agtttcccaaatgcctacaacacag

SEQ ID NO: 8898 - DNA, 25 bp, Mus musculus
agtttccccacttctgaagacttgg

SEQ ID NO: 8899 - DNA, 25 bp, Mus musculus
agtttctctaaccaagactcccaag

SEQ ID NO: 8900 - DNA, 25 bp, Mus musculus
agtttctctgagagccacggccgag

SEQ ID NO: 8901 - DNA, 25 bp, Mus musculus
agtttctgctcctcacagaacgctt

SEQ ID NO: 8902 - DNA, 25 bp, Mus musculus
agtttgactacagggccttcgcagc

SEQ ID NO: 8903 - DNA, 25 bp, Mus musculus
agtttgagaagctgacccgggcgct

SEQ ID NO: 8904 - DNA, 25 bp, Mus musculus
agtttgatccttcttcgaaaatcta

SEQ ID NO: 8905 - DNA, 25 bp, Mus musculus
agtttgatgctgcttgctgttttgc

SEQ ID NO: 8906 - DNA, 25 bp, Mus musculus
agtttgatgctggttgctgttttgc

SEQ ID NO: 8907 - DNA, 25 bp, Mus musculus
agtttgatgttcctatcggttctcg

SEQ ID NO: 8908 - DNA, 25 bp, Mus musculus
agtttgcacaccagccactgcctgg

SEQ ID NO: 8909 - DNA, 25 bp, Mus musculus
agtttgcccaagtgcagcatgtgtc

SEQ ID NO: 8910 - DNA, 25 bp, Mus musculus
agtttgcctcggctgcggccttcac

SEQ ID NO: 8911 - DNA, 25 bp, Mus musculus
agtttgctgatcgacaccgtccgct

SEQ ID NO: 8912 - DNA, 25 bp, Mus musculus
agtttggagcttggccattggcaac

SEQ ID NO: 8913 - DNA, 25 bp, Mus musculus
agtttggcgcccagtggccctgacc

SEQ ID NO: 8914 - DNA, 25 bp, Mus musculus
agtttggcttacgaaattcacgacg

SEQ ID NO: 8915 - DNA, 25 bp, Mus musculus
agtttgggcgagtcaaagatgcact

SEQ ID NO: 8916 - DNA, 25 bp, Mus musculus
agtttgtaaacatcagcgatctctc

SEQ ID NO: 8917 - DNA, 25 bp, Mus musculus
agtttgtcactgtgctgcaaaagcg

SEQ ID NO: 8918 - DNA, 25 bp, Mus musculus
agtttgtccctgattctgatgatat

SEQ ID NO: 8919 - DNA, 25 bp, Mus musculus
agtttgtgacattcgaggatgtggc

SEQ ID NO: 8920 - DNA, 25 bp, Mus musculus
agtttgtggacctgagacttggtct

SEQ ID NO: 8921 - DNA, 25 bp, Mus musculus
agtttgttcaagattggctcccaag

SEQ ID NO: 8922 - DNA, 25 bp, Mus musculus
agttttccaagttcccagcagccca

SEQ ID NO: 8923 - DNA, 25 bp, Mus musculus
agttttccctgagagcacttttgag

SEQ ID NO: 8924 - DNA, 25 bp, Mus musculus
agttttctgcagacactctggtgga

SEQ ID NO: 8925 - DNA, 25 bp, Mus musculus
agttttgctcggactctagctccga

SEQ ID NO: 8926 - DNA, 25 bp, Mus musculus
agttttgtcggattctaacaccagg

SEQ ID NO: 8927 - DNA, 25 bp, Mus musculus
ataaacagcacagtcccatccaggt

SEQ ID NO: 8928 - DNA, 25 bp, Mus musculus
ataaaccagtgtgaaggaggagaga

SEQ ID NO: 8929 - DNA, 25 bp, Mus musculus
ataaaccatccttgctacagcctag

SEQ ID NO: 8930 - DNA, 25 bp, Mus musculus
ataaacgactttgggagagagagga

SEQ ID NO: 8931 - DNA, 25 bp, Mus musculus
ataaagaaatctgttaacaggccat

SEQ ID NO: 8932 - DNA, 25 bp, Mus musculus
ataaagatgacctctccccaactgc

SEQ ID NO: 8933 - DNA, 25 bp, Mus musculus
ataaagcagctgtcacacttcaaag

SEQ ID NO: 8934 - DNA, 25 bp, Mus musculus
ataaagccactcttgtatctgagct

SEQ ID NO: 8935 - DNA, 25 bp, Mus musculus
ataaagctgctcaaagaccgtggca

SEQ ID NO: 8936 - DNA, 25 bp, Mus musculus
ataaatagtgctgcctttgaagctg

SEQ ID NO: 8937 - DNA, 25 bp, Mus musculus
ataaatatctgaagacccacgtggg

SEQ ID NO: 8938 - DNA, 25 bp, Mus musculus
ataaatgcacatggttcaaaattcc

SEQ ID NO: 8939 - DNA, 25 bp, Mus musculus
ataacaaagatactggagtactgac

SEQ ID NO: 8940 - DNA, 25 bp, Mus musculus
ataacaacaagccagaaatcagtgt

SEQ ID NO: 8941 - DNA, 25 bp, Mus musculus
ataacaatgatgtcaaaccgcaggg

SEQ ID NO: 8942 - DNA, 25 bp, Mus musculus
ataacattgccggtggacttccagg

SEQ ID NO: 8943 - DNA, 25 bp, Mus musculus
ataacccctatctgcggcccgtgaa

SEQ ID NO: 8944 - DNA, 25 bp, Mus musculus
ataacctcatcaagcccttcctaag

SEQ ID NO: 8945 - DNA, 25 bp, Mus musculus
ataacgccaggttcttggacttgct

SEQ ID NO: 8946 - DNA, 25 bp, Mus musculus
ataactggagatactttgagcaaag

SEQ ID NO: 8947 - DNA, 25 bp, Mus musculus
ataactgggaaaaaggcatatgcta

SEQ ID NO: 8948 - DNA, 25 bp, Mus musculus
ataacttacagtcctctctgaagac

SEQ ID NO: 8949 - DNA, 25 bp, Mus musculus
ataactttgagaaacctgtggtcat

SEQ ID NO: 8950 - DNA, 25 bp, Mus musculus
ataagaaagcccatgagaaggtgac

SEQ ID NO: 8951 - DNA, 25 bp, Mus musculus
ataagaacatctcagctctaaagcg

SEQ ID NO: 8952 - DNA, 25 bp, Mus musculus
ataagaacattatcaacctcctggg

SEQ ID NO: 8953 - DNA, 25 bp, Mus musculus
ataagacgagaggtggcggacaatc

SEQ ID NO: 8954 - DNA, 25 bp, Mus musculus
ataagagccaagatgaagcaccggg

SEQ ID NO: 8955 - DNA, 25 bp, Mus musculus
ataagcacggccaggctacagcgca

SEQ ID NO: 8956 - DNA, 25 bp, Mus musculus
ataagccaaagagcctggtgtgaca

SEQ ID NO: 8957 - DNA, 25 bp, Mus musculus
ataagccagagcatcgttcttccag

SEQ ID NO: 8958 - DNA, 25 bp, Mus musculus
ataagccagagcttcgttcttccag

SEQ ID NO: 8959 - DNA, 25 bp, Mus musculus
ataagcccagccttgttctacgcca

SEQ ID NO: 8960 - DNA, 25 bp, Mus musculus
ataagccttctgagatagtagatgt

SEQ ID NO: 8961 - DNA, 25 bp, Mus musculus
ataagctaaggatcctcccctgctc

SEQ ID NO: 8962 - DNA, 25 bp, Mus musculus
ataaggactccccttctgctacatc

SEQ ID NO: 8963 - DNA, 25 bp, Mus musculus
ataaggcgggacatttctttgatct

SEQ ID NO: 8964 - DNA, 25 bp, Mus musculus
ataaggttggccaatctcgcacagg

SEQ ID NO: 8965 - DNA, 25 bp, Mus musculus
ataatcaaggaggatacgggtctgt

SEQ ID NO: 8966 - DNA, 25 bp, Mus musculus
ataatcagagcccatgaagcccagg

SEQ ID NO: 8967 - DNA, 25 bp, Mus musculus
ataatccagtttgtgccagccgacg

SEQ ID NO: 8968 - DNA, 25 bp, Mus musculus
ataatcctcaggtctgcccctacaa

SEQ ID NO: 8969 - DNA, 25 bp, Mus musculus
ataatgaggatgatgcaaaggcagc

SEQ ID NO: 8970 - DNA, 25 bp, Mus musculus
ataatgcagataggatgtttaacag

SEQ ID NO: 8971 - DNA, 25 bp, Mus musculus
ataatgctgtgaacaagaaacagac

SEQ ID NO: 8972 - DNA, 25 bp, Mus musculus
ataatgtgacatactggcccctctg

SEQ ID NO: 8973 - DNA, 25 bp, Mus musculus
ataatgttcactttcagcagtcagc

SEQ ID NO: 8974 - DNA, 25 bp, Mus musculus
ataattataagagggtcacaggcac

SEQ ID NO: 8975 - DNA, 25 bp, Mus musculus
ataattccttaaggcacatacctga

SEQ ID NO: 8976 - DNA, 25 bp, Mus musculus
ataattggcacctacgcccagacgg

SEQ ID NO: 8977 - DNA, 25 bp, Mus musculus
atacaccagaaaacgctgtcctgtg

SEQ ID NO: 8978 - DNA, 25 bp, Mus musculus
atacagaaagctggagggaatgtca

SEQ ID NO: 8979 - DNA, 25 bp, Mus musculus
atacagaggacatggtgcggcttcg

SEQ ID NO: 8980 - DNA, 25 bp, Mus musculus
atacagcctgacagccaccctgaag

SEQ ID NO: 8981 - DNA, 25 bp, Mus musculus
atacaggacggagcagcggccgttc

SEQ ID NO: 8982 - DNA, 25 bp, Mus musculus
atacaggtaggcctttccctgaagc

SEQ ID NO: 8983 - DNA, 25 bp, Mus musculus
atacaggtgccacgaaggtgctgcc

SEQ ID NO: 8984 - DNA, 25 bp, Mus musculus
atacaggtgccaggaaggtgctgcc

SEQ ID NO: 8985 - DNA, 25 bp, Mus musculus
atacagtgcttttccagtgcccctc

SEQ ID NO: 8986 - DNA, 25 bp, Mus musculus
atacatcccagggacttgggcaggg

SEQ ID NO: 8987 - DNA, 25 bp, Mus musculus
atacatgggcggcagctcccgccga

SEQ ID NO: 8988 - DNA, 25 bp, Mus musculus
atacatgtcagatcaagaggaggag

SEQ ID NO: 8989 - DNA, 25 bp, Mus musculus
atacatgttccggtgtacagtacag

SEQ ID NO: 8990 - DNA, 25 bp, Mus musculus
ataccaaagctgtgctgaccccact

SEQ ID NO: 8991 - DNA, 25 bp, Mus musculus
ataccaccacgacagcaggcggata

SEQ ID NO: 8992 - DNA, 25 bp, Mus musculus
ataccagacggtgcagaggctcatc

SEQ ID NO: 8993 - DNA, 25 bp, Mus musculus
atacccagatgagctccagtgtgtg

SEQ ID NO: 8994 - DNA, 25 bp, Mus musculus
atacccatccatgttgatacaaatg

SEQ ID NO: 8995 - DNA, 25 bp, Mus musculus
ataccccgggttcagcaaggctctc

SEQ ID NO: 8996 - DNA, 25 bp, Mus musculus
ataccctatttgtgcccctgttggt

SEQ ID NO: 8997 - DNA, 25 bp, Mus musculus
ataccctgtgtatgttgtgcccagc

SEQ ID NO: 8998 - DNA, 25 bp, Mus musculus
ataccggccacgctacatcgtggtg

SEQ ID NO: 8999 - DNA, 25 bp, Mus musculus
ataccgggacacaggaatgctgcca

SEQ ID NO: 9000 - DNA, 25 bp, Mus musculus
ataccgggagccacgacgcatgctg

SEQ ID NO: 9001 - DNA, 25 bp, Mus musculus
atacctgcgcatccacgcggtgaag

SEQ ID NO: 9002 - DNA, 25 bp, Mus musculus
atacctgtgaactgtccctaccgcg

SEQ ID NO: 9003 - DNA, 25 bp, Mus musculus
atacgactacgccttcgtctctcag

SEQ ID NO: 9004 - DNA, 25 bp, Mus musculus
atacgccagtgacgaccagagccag

SEQ ID NO: 9005 - DNA, 25 bp, Mus musculus
atacgggaaccgagtccgcatcaga

SEQ ID NO: 9006 - DNA, 25 bp, Mus musculus
atacgtacttcaccggtcctgcctt

SEQ ID NO: 9007 - DNA, 25 bp, Mus musculus
atacgttgtaggttgtcgtcgtcag

SEQ ID NO: 9008 - DNA, 25 bp, Mus musculus
atactacgagcccatgcacgacgtc

SEQ ID NO: 9009 - DNA, 25 bp, Mus musculus
atactacgagccgatgcacgacgtc

SEQ ID NO: 9010 - DNA, 25 bp, Mus musculus
atactatcaccataaagacacaaag

SEQ ID NO: 9011 - DNA, 25 bp, Mus musculus
atactcacaggcttcctggacaaaa

SEQ ID NO: 9012 - DNA, 25 bp, Mus musculus
atactcatcgccacaagaagccgga

SEQ ID NO: 9013 - DNA, 25 bp, Mus musculus
atactcatcgcctcaagaagccgga

SEQ ID NO: 9014 - DNA, 25 bp, Mus musculus
atactctgtcaaagggtgaaacaaa

SEQ ID NO: 9015 - DNA, 25 bp, Mus musculus
atactgggcggctggctcctggacc

SEQ ID NO: 9016 - DNA, 25 bp, Mus musculus
atactgttgacaaccgcacccctgg

SEQ ID NO: 9017 - DNA, 25 bp, Mus musculus
atacttctgacactgagagctctat

SEQ ID NO: 9018 - DNA, 25 bp, Mus musculus
atacttctgcggtacctgcaccagc

SEQ ID NO: 9019 - DNA, 25 bp, Mus musculus
atacttggaccagcgagtgccctac

SEQ ID NO: 9020 - DNA, 25 bp, Mus musculus
atagaaacgtctgggcaagggttca

SEQ ID NO: 9021 - DNA, 25 bp, Mus musculus
atagaaccatccaagcattcctggg

SEQ ID NO: 9022 - DNA, 25 bp, Mus musculus
atagaacccgggaggagcacccata

SEQ ID NO: 9023 - DNA, 25 bp, Mus musculus
atagaagtgtgcatcccagcctttc

SEQ ID NO: 9024 - DNA, 25 bp, Mus musculus
atagaattcaccgagagcaagcgcc

SEQ ID NO: 9025 - DNA, 25 bp, Mus musculus
atagaattctaggtcttgggaggag

SEQ ID NO: 9026 - DNA, 25 bp, Mus musculus
atagacctgggtgtgaattccacca

SEQ ID NO: 9027 - DNA, 25 bp, Mus musculus
atagacctttcccagggtgcagccc

SEQ ID NO: 9028 - DNA, 25 bp, Mus musculus
atagagatcacatatcgagcgaaga

SEQ ID NO: 9029 - DNA, 25 bp, Mus musculus
atagcaggacctccagacacaccgt

SEQ ID NO: 9030 - DNA, 25 bp, Mus musculus
atagcattcttggtttacctggatc

SEQ ID NO: 9031 - DNA, 25 bp, Mus musculus
atagccaccagtcttagcagaacag

SEQ ID NO: 9032 - DNA, 25 bp, Mus musculus
atagcccagcgcaagggtcactgcg

SEQ ID NO: 9033 - DNA, 25 bp, Mus musculus
atagcctggaccagtcctgtctgcc

SEQ ID NO: 9034 - DNA, 25 bp, Mus musculus
atagccttgaggaccagccccatag

SEQ ID NO: 9035 - DNA, 25 bp, Mus musculus
atagctcgagccagagccaccatga

SEQ ID NO: 9036 - DNA, 25 bp, Mus musculus
atagctgtgcccactgccgtgctca

SEQ ID NO: 9037 - DNA, 25 bp, Mus musculus
atagcttgaatattgccttaaaagg

SEQ ID NO: 9038 - DNA, 25 bp, Mus musculus
ataggacacaccgactcaacagagg

SEQ ID NO: 9039 - DNA, 25 bp, Mus musculus
ataggcagagtgtcttttggcgctt

SEQ ID NO: 9040 - DNA, 25 bp, Mus musculus
ataggccaggcttgtgtcaaactca

SEQ ID NO: 9041 - DNA, 25 bp, Mus musculus
ataggccctcccattccagaagcag

SEQ ID NO: 9042 - DNA, 25 bp, Mus musculus
atagggcacagtggctggaaaagaa

SEQ ID NO: 9043 - DNA, 25 bp, Mus musculus
atagggtctctccacattgtccaga

SEQ ID NO: 9044 - DNA, 25 bp, Mus musculus
ataggtagcactgggcttctttcag

SEQ ID NO: 9045 - DNA, 25 bp, Mus musculus
ataggtcagctaccctggcgagcag

SEQ ID NO: 9046 - DNA, 25 bp, Mus musculus
atagtaattgtcgtcactgtggcct

SEQ ID NO: 9047 - DNA, 25 bp, Mus musculus
atagtaccatcatgccccgactgag

SEQ ID NO: 9048 - DNA, 25 bp, Mus musculus
atagtactgcactttgctgcacaga

SEQ ID NO: 9049 - DNA, 25 bp, Mus musculus
atagtagatgattggctaaacctgt

SEQ ID NO: 9050 - DNA, 25 bp, Mus musculus
atagtcacattaccatgcctaggtg

SEQ ID NO: 9051 - DNA, 25 bp, Mus musculus
atagtgacgacactacgtgcaaaag

SEQ ID NO: 9052 - DNA, 25 bp, Mus musculus
atagtggtgagaaaacagaccccaa

SEQ ID NO: 9053 - DNA, 25 bp, Mus musculus
atataacctcacagaaggagaggac

SEQ ID NO: 9054 - DNA, 25 bp, Mus musculus
atataacctcactgaaggagaggac

SEQ ID NO: 9055 - DNA, 25 bp, Mus musculus
atataacgatctgcccgcactggag

SEQ ID NO: 9056 - DNA, 25 bp, Mus musculus
atatagcagtggatccaatagagag

SEQ ID NO: 9057 - DNA, 25 bp, Mus musculus
atatagcggccggaagagggtccac

SEQ ID NO: 9058 - DNA, 25 bp, Mus musculus
atatatccagtgatggagaaggagg

SEQ ID NO: 9059 - DNA, 25 bp, Mus musculus
atatatccagtgttggagaaggagg

SEQ ID NO: 9060 - DNA, 25 bp, Mus musculus
atatatcgccggacgcctccaaaag

SEQ ID NO: 9061 - DNA, 25 bp, Mus musculus
atatcaatgagtccctgaccctggg

SEQ ID NO: 9062 - DNA, 25 bp, Mus musculus
atatcaatgagtgcctgaccctggg

SEQ ID NO: 9063 - DNA, 25 bp, Mus musculus
atatcacggagtatcagagcattct

SEQ ID NO: 9064 - DNA, 25 bp, Mus musculus
atatcacttgtgctgagtacactca

SEQ ID NO: 9065 - DNA, 25 bp, Mus musculus
atatccccaagtgggaactgtttct

SEQ ID NO: 9066 - DNA, 25 bp, Mus musculus
atatccgacaaagggataactcaca

SEQ ID NO: 9067 - DNA, 25 bp, Mus musculus
atatccgagcaactgaaaaagacaa

SEQ ID NO: 9068 - DNA, 25 bp, Mus musculus
atatcctaccttcccttggctcata

SEQ ID NO: 9069 - DNA, 25 bp, Mus musculus
atatccttcagtggcatagagtcag

SEQ ID NO: 9070 - DNA, 25 bp, Mus musculus
atatcgacccctctgggagccgtaa

SEQ ID NO: 9071 - DNA, 25 bp, Mus musculus
atatcgatgagtctgagcagcccgg

SEQ ID NO: 9072 - DNA, 25 bp, Mus musculus
atatcgatgagtgtgagcagcccgg

SEQ ID NO: 9073 - DNA, 25 bp, Mus musculus
atatcgccggaatcccttctgcttt

SEQ ID NO: 9074 - DNA, 25 bp, Mus musculus
atatctaccgagctctgcgcactgc

SEQ ID NO: 9075 - DNA, 25 bp, Mus musculus
atatctagcctcatcaaactctcca

SEQ ID NO: 9076 - DNA, 25 bp, Mus musculus
atatctcacagacaagttttcgccg

SEQ ID NO: 9077 - DNA, 25 bp, Mus musculus
atatctcggaacttgcgccggcagc

SEQ ID NO: 9078 - DNA, 25 bp, Mus musculus
atatcttactgtcggagcagcggtc

SEQ ID NO: 9079 - DNA, 25 bp, Mus musculus
atatgacatctgcaatatctggtgc

SEQ ID NO: 9080 - DNA, 25 bp, Mus musculus
atatgaccacactaaccatcatgag

SEQ ID NO: 9081 - DNA, 25 bp, Mus musculus
atatgagaacatgccgcataaatga

SEQ ID NO: 9082 - DNA, 25 bp, Mus musculus
atatgagagcagactttaatcccag

SEQ ID NO: 9083 - DNA, 25 bp, Mus musculus
atatgagtgatgacaaaccctttct

SEQ ID NO: 9084 - DNA, 25 bp, Mus musculus
atatgatgttgattctaagagtccc

SEQ ID NO: 9085 - DNA, 25 bp, Mus musculus
atatgcctttaatcacacccctcag

SEQ ID NO: 9086 - DNA, 25 bp, Mus musculus
atatggaagggctggattgatctcc

SEQ ID NO: 9087 - DNA, 25 bp, Mus musculus
atatggagaggcacccagcccacgt

SEQ ID NO: 9088 - DNA, 25 bp, Mus musculus
atatggtactcccattcagctgcag

SEQ ID NO: 9089 - DNA, 25 bp, Mus musculus
atatgtcaaaggaaaccaaacacca

SEQ ID NO: 9090 - DNA, 25 bp, Mus musculus
atatgtgcagatacattcagagcag

SEQ ID NO: 9091 - DNA, 25 bp, Mus musculus
atatgttcagcaccgaaaaggagat

SEQ ID NO: 9092 - DNA, 25 bp, Mus musculus
atattaagaaattcggtcatgccag

SEQ ID NO: 9093 - DNA, 25 bp, Mus musculus
atattaaggcaaaaaggctgtgtgt

SEQ ID NO: 9094 - DNA, 25 bp, Mus musculus
atattatgggctggatacaaaatgg

SEQ ID NO: 9095 - DNA, 25 bp, Mus musculus
atattcatcatattttaccaaggag

SEQ ID NO: 9096 - DNA, 25 bp, Mus musculus
atattccctgcccaaaaaattcctg

SEQ ID NO: 9097 - DNA, 25 bp, Mus musculus
atattcttctgggtgaggatggctc

SEQ ID NO: 9098 - DNA, 25 bp, Mus musculus
atattgacgaatgcgggactgggag

SEQ ID NO: 9099 - DNA, 25 bp, Mus musculus
atattgagaccctacatggctccct

SEQ ID NO: 9100 - DNA, 25 bp, Mus musculus
atattgatgaatgcgagcaccatca

SEQ ID NO: 9101 - DNA, 25 bp, Mus musculus
atattgatgagtctgaggaccgtga

SEQ ID NO: 9102 - DNA, 25 bp, Mus musculus
atattgatgagtgtgaggaccgtga

SEQ ID NO: 9103 - DNA, 25 bp, Mus musculus
atattgccactgagcgtgcccaggg

SEQ ID NO: 9104 - DNA, 25 bp, Mus musculus
atattgcctttccatccattaccag

SEQ ID NO: 9105 - DNA, 25 bp, Mus musculus
atattgctgtgatgggtgaggccca

SEQ ID NO: 9106 - DNA, 25 bp, Mus musculus
atatttcagcagcttattgccaaag

SEQ ID NO: 9107 - DNA, 25 bp, Mus musculus
atatttctagagctgagtctcagag

SEQ ID NO: 9108 - DNA, 25 bp, Mus musculus
atcaaaaacaatcttgaggagcggg

SEQ ID NO: 9109 - DNA, 25 bp, Mus musculus
atcaaacaatgaataccaccccagg

SEQ ID NO: 9110 - DNA, 25 bp, Mus musculus
atcaaacaggtgttggcccggacca

SEQ ID NO: 9111 - DNA, 25 bp, Mus musculus
atcaacagctccacctccatatttg

SEQ ID NO: 9112 - DNA, 25 bp, Mus musculus
atcaacgaggccagcggcagccgca

SEQ ID NO: 9113 - DNA, 25 bp, Mus musculus
atcaacgaggtagagcgtttggatg

SEQ ID NO: 9114 - DNA, 25 bp, Mus musculus
atcaagacccttttcaccaagacac

SEQ ID NO: 9115 - DNA, 25 bp, Mus musculus
atcaagagacacatgaccaagatgg

SEQ ID NO: 9116 - DNA, 25 bp, Mus musculus
atcaagagcggagcggaagctaaga

SEQ ID NO: 9117 - DNA, 25 bp, Mus musculus
atcaagaggaggatacaaagcgaaa

SEQ ID NO: 9118 - DNA, 25 bp, Mus musculus
atcaagaggcacaccccactgagca

SEQ ID NO: 9119 - DNA, 25 bp, Mus musculus
atcaagagggttgccaaggagctag

SEQ ID NO: 9120 - DNA, 25 bp, Mus musculus
atcaagagtgaaaaacctgaagaga

SEQ ID NO: 9121 - DNA, 25 bp, Mus musculus
atcaagatcgtgtctgccgtgcgga

SEQ ID NO: 9122 - DNA, 25 bp, Mus musculus
atcaagcatgtcaggccatcacatg

SEQ ID NO: 9123 - DNA, 25 bp, Mus musculus
atcaaggacagcgaggccctccagg

SEQ ID NO: 9124 - DNA, 25 bp, Mus musculus
atcaaggcactgttccgcaagggca

SEQ ID NO: 9125 - DNA, 25 bp, Mus musculus
atcaaggctggctttgcaggagacc

SEQ ID NO: 9126 - DNA, 25 bp, Mus musculus
atcaagtagacatgaaacagcccct

SEQ ID NO: 9127 - DNA, 25 bp, Mus musculus
atcaatctttccaagaccaggcatc

SEQ ID NO: 9128 - DNA, 25 bp, Mus musculus
atcaattcctcaatgactagaaccc

SEQ ID NO: 9129 - DNA, 25 bp, Mus musculus
atcacaatggacagtcttgacctga

SEQ ID NO: 9130 - DNA, 25 bp, Mus musculus
atcacagaagtgaagcgggcacacc

SEQ ID NO: 9131 - DNA, 25 bp, Mus musculus
atcacagatgccagcggtcacagag

SEQ ID NO: 9132 - DNA, 25 bp, Mus musculus
atcacaggccgatgactgcggtgga

SEQ ID NO: 9133 - DNA, 25 bp, Mus musculus
atcacagtcgctctggctgccgctt

SEQ ID NO: 9134 - DNA, 25 bp, Mus musculus
atcacatctggaagcggagctggag

SEQ ID NO: 9135 - DNA, 25 bp, Mus musculus
atcacatcttggcaggttcttttga

SEQ ID NO: 9136 - DNA, 25 bp, Mus musculus
atcaccaagcctcctgacggcagtg

SEQ ID NO: 9137 - DNA, 25 bp, Mus musculus
atcaccacccgctctggaaaggtct

SEQ ID NO: 9138 - DNA, 25 bp, Mus musculus
atcaccatgatttatactgtgacag

SEQ ID NO: 9139 - DNA, 25 bp, Mus musculus
atcaccattggcaggcacgcccatg

SEQ ID NO: 9140 - DNA, 25 bp, Mus musculus
atcacccagaactttgccagcagca

SEQ ID NO: 9141 - DNA, 25 bp, Mus musculus
atcacccttactcgacaacggctgg

SEQ ID NO: 9142 - DNA, 25 bp, Mus musculus
atcaccgaggacgtgggtgccacca

SEQ ID NO: 9143 - DNA, 25 bp, Mus musculus
atcaccgaggagaagccgctgttgc

SEQ ID NO: 9144 - DNA, 25 bp, Mus musculus
atcaccggccttgcagccaggaaag

SEQ ID NO: 9145 - DNA, 25 bp, Mus musculus
atcacctctgggaaaggaaaaatgg

SEQ ID NO: 9146 - DNA, 25 bp, Mus musculus
atcacgaccctcaagggacatgaag

SEQ ID NO: 9147 - DNA, 25 bp, Mus musculus
atcacgctcatcagtatgtggccag

SEQ ID NO: 9148 - DNA, 25 bp, Mus musculus
atcacggagtatcagagcattctgg

SEQ ID NO: 9149 - DNA, 25 bp, Mus musculus
atcactatcagtgacccctgaggag

SEQ ID NO: 9150 - DNA, 25 bp, Mus musculus
atcactcactctttggagatgtgaa

SEQ ID NO: 9151 - DNA, 25 bp, Mus musculus
atcactgaagcgacccctcgaggca

SEQ ID NO: 9152 - DNA, 25 bp, Mus musculus
atcactgggactgtggcctggcctg

SEQ ID NO: 9153 - DNA, 25 bp, Mus musculus
atcacttgtacagcgacagcacaga

SEQ ID NO: 9154 - DNA, 25 bp, Mus musculus
atcagaaacacaaccgctgccgagg

SEQ ID NO: 9155 - DNA, 25 bp, Mus musculus
atcagaaactagaacgagaggcccg

SEQ ID NO: 9156 - DNA, 25 bp, Mus musculus
atcagaagtgttcagtgcctgccag

SEQ ID NO: 9157 - DNA, 25 bp, Mus musculus
atcagaagtgttgagtgcctgccag

SEQ ID NO: 9158 - DNA, 25 bp, Mus musculus
atcagaatggcactacatcgccacc

SEQ ID NO: 9159 - DNA, 25 bp, Mus musculus
atcagacagtgacgaggtgcctcca

SEQ ID NO: 9160 - DNA, 25 bp, Mus musculus
atcagacatgcagcgctggctggga

SEQ ID NO: 9161 - DNA, 25 bp, Mus musculus
atcagacctaccgagtgctgctggg

SEQ ID NO: 9162 - DNA, 25 bp, Mus musculus
atcagacgccacagggcttgatgcc

SEQ ID NO: 9163 - DNA, 25 bp, Mus musculus
atcagacttgtgagccagacgggct

SEQ ID NO: 9164 - DNA, 25 bp, Mus musculus
atcagagccactggcgacagagata

SEQ ID NO: 9165 - DNA, 25 bp, Mus musculus
atcagagcccatgaagcccaggatg

SEQ ID NO: 9166 - DNA, 25 bp, Mus musculus
atcagagttcaatcagaacaacgga

SEQ ID NO: 9167 - DNA, 25 bp, Mus musculus
atcagcaaaaatacatgggctcctg

SEQ ID NO: 9168 - DNA, 25 bp, Mus musculus
atcagcaaccgctggaagctggcca

SEQ ID NO: 9169 - DNA, 25 bp, Mus musculus
atcagcacaagcagaggcggctcaa

SEQ ID NO: 9170 - DNA, 25 bp, Mus musculus
atcagcagctggtgagtgccacgct

SEQ ID NO: 9171 - DNA, 25 bp, Mus musculus
atcagcagtgggaacggacctacct

SEQ ID NO: 9172 - DNA, 25 bp, Mus musculus
atcagcggctggtggagttcatgac

SEQ ID NO: 9173 - DNA, 25 bp, Mus musculus
atcaggaagcagagtccacgcgctg

SEQ ID NO: 9174 - DNA, 25 bp, Mus musculus
atcaggagaacagatcagtggagga

SEQ ID NO: 9175 - DNA, 25 bp, Mus musculus
atcaggctgtaaacttcctggctgt

SEQ ID NO: 9176 - DNA, 25 bp, Mus musculus
atcagtaatggaatcctacgccttc

SEQ ID NO: 9177 - DNA, 25 bp, Mus musculus
atcagtaatttagccggctttgagg

SEQ ID NO: 9178 - DNA, 25 bp, Mus musculus
atcagtacgagaagatggcggagaa

SEQ ID NO: 9179 - DNA, 25 bp, Mus musculus
atcagtgacccctgaggagtgtcag

SEQ ID NO: 9180 - DNA, 25 bp, Mus musculus
atcagtgagaaggaggacattaagg

SEQ ID NO: 9181 - DNA, 25 bp, Mus musculus
atcagtgcttcgtgagcttctttga

SEQ ID NO: 9182 - DNA, 25 bp, Mus musculus
atcagtggatggtcgccccggattg

SEQ ID NO: 9183 - DNA, 25 bp, Mus musculus
atcatatcagccaatctactgacag

SEQ ID NO: 9184 - DNA, 25 bp, Mus musculus
atcatcaagcgagccgccctggagt

SEQ ID NO: 9185 - DNA, 25 bp, Mus musculus
atcatcaccgtcactctcaacatgg

SEQ ID NO: 9186 - DNA, 25 bp, Mus musculus
atcatcagggtctggaatccttacc

SEQ ID NO: 9187 - DNA, 25 bp, Mus musculus
atcatcccggcatgactgtgacctg

SEQ ID NO: 9188 - DNA, 25 bp, Mus musculus
atcatcctcagatttgccatccagg

SEQ ID NO: 9189 - DNA, 25 bp, Mus musculus
atcatcctccgtggtggcgctgagc

SEQ ID NO: 9190 - DNA, 25 bp, Mus musculus
atcatctttggtggccgtagacctg

SEQ ID NO: 9191 - DNA, 25 bp, Mus musculus
atcatgaagctgacagagcctcagg

SEQ ID NO: 9192 - DNA, 25 bp, Mus musculus
atcatgattgtgaggagggccatca

SEQ ID NO: 9193 - DNA, 25 bp, Mus musculus
atcatgggcggcaagccccggcatt

SEQ ID NO: 9194 - DNA, 25 bp, Mus musculus
atcatggtgtggctttagacttcag

SEQ ID NO: 9195 - DNA, 25 bp, Mus musculus
atcatgtaccaaaacctgcagcaag

SEQ ID NO: 9196 - DNA, 25 bp, Mus musculus
atcatgtcatcaggcagcggaaggc

SEQ ID NO: 9197 - DNA, 25 bp, Mus musculus
atcatgtggcactaacacccgttcc

SEQ ID NO: 9198 - DNA, 25 bp, Mus musculus
atcattaccattgggcaagccattg

SEQ ID NO: 9199 - DNA, 25 bp, Mus musculus
atcattatacccaaagattatccag

SEQ ID NO: 9200 - DNA, 25 bp, Mus musculus
atcattcattgagcgcaggacctga

SEQ ID NO: 9201 - DNA, 25 bp, Mus musculus
atcattccacagaggaaccgaagcc

SEQ ID NO: 9202 - DNA, 25 bp, Mus musculus
atcattctgcccagcacaggctctg

SEQ ID NO: 9203 - DNA, 25 bp, Mus musculus
atcattgaccgggaggccttctcac

SEQ ID NO: 9204 - DNA, 25 bp, Mus musculus
atcattgccgtgactcgaaatcccc

SEQ ID NO: 9205 - DNA, 25 bp, Mus musculus
atcatttcaaacctttgtgggccag

SEQ ID NO: 9206 - DNA, 25 bp, Mus musculus
atccaacggcgccacctaatggcag

SEQ ID NO: 9207 - DNA, 25 bp, Mus musculus
atccaagcactgaggcgcctgaacc

SEQ ID NO: 9208 - DNA, 25 bp, Mus musculus
atccaaggatttcaaagtgctttgc

SEQ ID NO: 9209 - DNA, 25 bp, Mus musculus
atccaagtgcccagaacaatccctg

SEQ ID NO: 9210 - DNA, 25 bp, Mus musculus
atccaatcgaagtgtctaaagacag

SEQ ID NO: 9211 - DNA, 25 bp, Mus musculus
atccaatgtgctgccaactttgaga

SEQ ID NO: 9212 - DNA, 25 bp, Mus musculus
atccacacaggagaatcgatatcag

SEQ ID NO: 9213 - DNA, 25 bp, Mus musculus
atccacactccctgtctgttgggtc

SEQ ID NO: 9214 - DNA, 25 bp, Mus musculus
atccaccctgctctgaagggtatag

SEQ ID NO: 9215 - DNA, 25 bp, Mus musculus
atccaccggcacaggcctgagctga

SEQ ID NO: 9216 - DNA, 25 bp, Mus musculus
atccacgcggtgaaggaccatgggc

SEQ ID NO: 9217 - DNA, 25 bp, Mus musculus
atccacggatagtctgccacccgag

SEQ ID NO: 9218 - DNA, 25 bp, Mus musculus
atccagacgtgcagcagcctcagga

SEQ ID NO: 9219 - DNA, 25 bp, Mus musculus
atccagcaaacacgcggacagcaag

SEQ ID NO: 9220 - DNA, 25 bp, Mus musculus
atccaggacatgactcaacggtgca

SEQ ID NO: 9221 - DNA, 25 bp, Mus musculus
atccaggtgtggcacgcggaacacc

SEQ ID NO: 9222 - DNA, 25 bp, Mus musculus
atccagtactttgccagcattgcag

SEQ ID NO: 9223 - DNA, 25 bp, Mus musculus
atccagtgtagccagctcagcgctg

SEQ ID NO: 9224 - DNA, 25 bp, Mus musculus
atccatctccagttaactcgctaca

SEQ ID NO: 9225 - DNA, 25 bp, Mus musculus
atcccaacagttcctgggcttgtcc

SEQ ID NO: 9226 - DNA, 25 bp, Mus musculus
atcccaacatttgacacacaaaggc

SEQ ID NO: 9227 - DNA, 25 bp, Mus musculus
atcccaaccactatggcagctgctg

SEQ ID NO: 9228 - DNA, 25 bp, Mus musculus
atcccaagattggaggtttacctct

SEQ ID NO: 9229 - DNA, 25 bp, Mus musculus
atcccaagctgcagggaacccactt

SEQ ID NO: 9230 - DNA, 25 bp, Mus musculus
atcccaatcctgagggctgccctga

SEQ ID NO: 9231 - DNA, 25 bp, Mus musculus
atcccagagtggtggctgatgatcc

SEQ ID NO: 9232 - DNA, 25 bp, Mus musculus
atcccaggccggtccaagatcacat

SEQ ID NO: 9233 - DNA, 25 bp, Mus musculus
atcccaggctcatatagcttcactg

SEQ ID NO: 9234 - DNA, 25 bp, Mus musculus
atcccagggtgacattaagcagcaa

SEQ ID NO: 9235 - DNA, 25 bp, Mus musculus
atcccatcaataccctggtgggtgc

SEQ ID NO: 9236 - DNA, 25 bp, Mus musculus
atccccaagatgttggatgctgagg

SEQ ID NO: 9237 - DNA, 25 bp, Mus musculus
atccccaagtctgtggactggagag

SEQ ID NO: 9238 - DNA, 25 bp, Mus musculus
atccccagagcccatatagagccat

SEQ ID NO: 9239 - DNA, 25 bp, Mus musculus
atccccagctgagctggtccagtgt

SEQ ID NO: 9240 - DNA, 25 bp, Mus musculus
atccccatcagcagcctgcgtgaga

SEQ ID NO: 9241 - DNA, 25 bp, Mus musculus
atccccgaaaatttgagactgctcc

SEQ ID NO: 9242 - DNA, 25 bp, Mus musculus
atcccgaagtgacctgccaggctca

SEQ ID NO: 9243 - DNA, 25 bp, Mus musculus
atcccggcctggaccacagagtgtg

SEQ ID NO: 9244 - DNA, 25 bp, Mus musculus
atcccgggcgcctggcagtgtgacg

SEQ ID NO: 9245 - DNA, 25 bp, Mus musculus
atccctaagagcaagcgccaaaaaa

SEQ ID NO: 9246 - DNA, 25 bp, Mus musculus
atccctctggctgagtgggagagcc

SEQ ID NO: 9247 - DNA, 25 bp, Mus musculus
atccctgacgacatgggatcaaaag

SEQ ID NO: 9248 - DNA, 25 bp, Mus musculus
atccctgagcgctgggtctgcgacc

SEQ ID NO: 9249 - DNA, 25 bp, Mus musculus
atccctgggttacccctgtctctgg

SEQ ID NO: 9250 - DNA, 25 bp, Mus musculus
atcccttggccctgagaacagtgaa

SEQ ID NO: 9251 - DNA, 25 bp, Mus musculus
atccgaaaggacatgagtggccatt

SEQ ID NO: 9252 - DNA, 25 bp, Mus musculus
atccgagatactcgctttgggaagt

SEQ ID NO: 9253 - DNA, 25 bp, Mus musculus
atccgagtatggctgaaaagagaca

SEQ ID NO: 9254 - DNA, 25 bp, Mus musculus
atccgcagcaatccagatctctatg

SEQ ID NO: 9255 - DNA, 25 bp, Mus musculus
atccgcaggcgctgagagacagaca

SEQ ID NO: 9256 - DNA, 25 bp, Mus musculus
atccgcgacagcttccttcagcagc

SEQ ID NO: 9257 - DNA, 25 bp, Mus musculus
atccggacactacggcaggaactaa

SEQ ID NO: 9258 - DNA, 25 bp, Mus musculus
atccggatccgcaggcgctgagaga

SEQ ID NO: 9259 - DNA, 25 bp, Mus musculus
atccggcctctgtcagtgtttggtt

SEQ ID NO: 9260 - DNA, 25 bp, Mus musculus
atccggcggccgatgaacgccttta

SEQ ID NO: 9261 - DNA, 25 bp, Mus musculus
atccggctcctgttcgctgctttca

SEQ ID NO: 9262 - DNA, 25 bp, Mus musculus
atccggctggctggcttagctgtgc

SEQ ID NO: 9263 - DNA, 25 bp, Mus musculus
atccgggcccagcaggcctgcattg

SEQ ID NO: 9264 - DNA, 25 bp, Mus musculus
atccgggctgaatctggcaccaggg

SEQ ID NO: 9265 - DNA, 25 bp, Mus musculus
atcctaaaatgactgagctcttcca

SEQ ID NO: 9266 - DNA, 25 bp, Mus musculus
atcctaggcaatgcagactatgtct

SEQ ID NO: 9267 - DNA, 25 bp, Mus musculus
atcctcaagaggctagagcggcccc

SEQ ID NO: 9268 - DNA, 25 bp, Mus musculus
atcctcaagcccctcagacaatgaa

SEQ ID NO: 9269 - DNA, 25 bp, Mus musculus
atcctcaccacctcaagagcaggag

SEQ ID NO: 9270 - DNA, 25 bp, Mus musculus
atcctcacttcctgagggtgccctg

SEQ ID NO: 9271 - DNA, 25 bp, Mus musculus
atcctcctactcaggcacatcaagt

SEQ ID NO: 9272 - DNA, 25 bp, Mus musculus
atcctcctactctggcacatcaagt

SEQ ID NO: 9273 - DNA, 25 bp, Mus musculus
atcctcctgcttcctgggatgttgg

SEQ ID NO: 9274 - DNA, 25 bp, Mus musculus
atcctctggaactggcaatgttgtt

SEQ ID NO: 9275 - DNA, 25 bp, Mus musculus
atcctctggctccatgctgaccagg

SEQ ID NO: 9276 - DNA, 25 bp, Mus musculus
atcctgaaacaagacggccagttca

SEQ ID NO: 9277 - DNA, 25 bp, Mus musculus
atcctgaccaatgggctggtgtctg

SEQ ID NO: 9278 - DNA, 25 bp, Mus musculus
atcctgacgaggttccagaggtgga

SEQ ID NO: 9279 - DNA, 25 bp, Mus musculus
atcctgatgctaccctgaggcaccg

SEQ ID NO: 9280 - DNA, 25 bp, Mus musculus
atcctgctctgtcacctccagatgg

SEQ ID NO: 9281 - DNA, 25 bp, Mus musculus
atcctggaactcagcgagatcaccc

SEQ ID NO: 9282 - DNA, 25 bp, Mus musculus
atcctggcctatctctgactctctt

SEQ ID NO: 9283 - DNA, 25 bp, Mus musculus
atcctgggcataactaaccccgaag

SEQ ID NO: 9284 - DNA, 25 bp, Mus musculus
atcctgggccttgggctaccttgca

SEQ ID NO: 9285 - DNA, 25 bp, Mus musculus
atcctgggtgctgtgatcctgggct

SEQ ID NO: 9286 - DNA, 25 bp, Mus musculus
atcctggtcgggacatgcccggaag

SEQ ID NO: 9287 - DNA, 25 bp, Mus musculus
atcctgtatcagctctggaatggac

SEQ ID NO: 9288 - DNA, 25 bp, Mus musculus
atcctgtcatccttaccaatggcct

SEQ ID NO: 9289 - DNA, 25 bp, Mus musculus
atcctgtcatgcagtgtcccaaaca

SEQ ID NO: 9290 - DNA, 25 bp, Mus musculus
atcctgtgacaagcgcaagctgaag

SEQ ID NO: 9291 - DNA, 25 bp, Mus musculus
atcctgtgcccaagccttccataga

SEQ ID NO: 9292 - DNA, 25 bp, Mus musculus
atcctgtgggccagtggccgtgcaa

SEQ ID NO: 9293 - DNA, 25 bp, Mus musculus
atccttaaatttagagcattcgcag

SEQ ID NO: 9294 - DNA, 25 bp, Mus musculus
atccttaggaatgctttggtgtctc

SEQ ID NO: 9295 - DNA, 25 bp, Mus musculus
atccttcaagcttgtcatctcccag

SEQ ID NO: 9296 - DNA, 25 bp, Mus musculus
atccttcagtggcatagagtcagct

SEQ ID NO: 9297 - DNA, 25 bp, Mus musculus
atccttctcccttcgacagagtgtg

SEQ ID NO: 9298 - DNA, 25 bp, Mus musculus
atccttctggccatgctgatggcag

SEQ ID NO: 9299 - DNA, 25 bp, Mus musculus
atccttgattggcatgtggcaaaca

SEQ ID NO: 9300 - DNA, 25 bp, Mus musculus
atcctttccttgagcaagttccagt

SEQ ID NO: 9301 - DNA, 25 bp, Mus musculus
atcgaagccacacgaaggccagcag

SEQ ID NO: 9302 - DNA, 25 bp, Mus musculus
atcgaatcatcagggtctggaatcc

SEQ ID NO: 9303 - DNA, 25 bp, Mus musculus
atcgacactgtaggcactgaaggct

SEQ ID NO: 9304 - DNA, 25 bp, Mus musculus
atcgagaagcagtgctctgacccca

SEQ ID NO: 9305 - DNA, 25 bp, Mus musculus
atcgagacctactgccgcctcatag

SEQ ID NO: 9306 - DNA, 25 bp, Mus musculus
atcgagagccgtgagctgagtgaca

SEQ ID NO: 9307 - DNA, 25 bp, Mus musculus
atcgagctgagacgcacagtcaatg

SEQ ID NO: 9308 - DNA, 25 bp, Mus musculus
atcgaggcagcacaaccagcctagg

SEQ ID NO: 9309 - DNA, 25 bp, Mus musculus
atcgatatgggagggccgagtcacc

SEQ ID NO: 9310 - DNA, 25 bp, Mus musculus
atcgatctcccaaggatactgaggg

SEQ ID NO: 9311 - DNA, 25 bp, Mus musculus
atcgatctcccatggatactgaggg

SEQ ID NO: 9312 - DNA, 25 bp, Mus musculus
atcgatgatgaatggtctgggttaa

SEQ ID NO: 9313 - DNA, 25 bp, Mus musculus
atcgatgattactctggaagtggag

SEQ ID NO: 9314 - DNA, 25 bp, Mus musculus
atcgattgcctctgattcttgaatg

SEQ ID NO: 9315 - DNA, 25 bp, Mus musculus
atcgcacgtccacaccggtgcggag

SEQ ID NO: 9316 - DNA, 25 bp, Mus musculus
atcgcagctccaagaggaggcaggt

SEQ ID NO: 9317 - DNA, 25 bp, Mus musculus
atcgcaggccagaggacgctccttc

SEQ ID NO: 9318 - DNA, 25 bp, Mus musculus
atcgcagggccctctgtgccaggca

SEQ ID NO: 9319 - DNA, 25 bp, Mus musculus
atcgccaatggtgagctttggagct

SEQ ID NO: 9320 - DNA, 25 bp, Mus musculus
atcgcccccggaaggagcttaccag

SEQ ID NO: 9321 - DNA, 25 bp, Mus musculus
atcgcccggcgccttggttacatct

SEQ ID NO: 9322 - DNA, 25 bp, Mus musculus
atcgccctgaggagacccacaaggg

SEQ ID NO: 9323 - DNA, 25 bp, Mus musculus
atcgcctggtggtattaccagtatc

SEQ ID NO: 9324 - DNA, 25 bp, Mus musculus
atcgcgatgacgccctgcctttggc

SEQ ID NO: 9325 - DNA, 25 bp, Mus musculus
atcgcgcctacctgagcatgctttc

SEQ ID NO: 9326 - DNA, 25 bp, Mus musculus
atcgcggctggagtgtcagtgctcc

SEQ ID NO: 9327 - DNA, 25 bp, Mus musculus
atcgcggtcctgctactcgctcgtg

SEQ ID NO: 9328 - DNA, 25 bp, Mus musculus
atcgctaatacccaggatgtcaggg

SEQ ID NO: 9329 - DNA, 25 bp, Mus musculus
atcgctacttccagaccatcaaaat

SEQ ID NO: 9330 - DNA, 25 bp, Mus musculus
atcgctttaacctgctgcccacgga

SEQ ID NO: 9331 - DNA, 25 bp, Mus musculus
atcggaaccgctgggaggagcctga

SEQ ID NO: 9332 - DNA, 25 bp, Mus musculus
atcggagcccaagtccagcaaggag

SEQ ID NO: 9333 - DNA, 25 bp, Mus musculus
atcggataccagtatgggcacaaaa

SEQ ID NO: 9334 - DNA, 25 bp, Mus musculus
atcggatgaggagcctgcttcctga

SEQ ID NO: 9335 - DNA, 25 bp, Mus musculus
atcggcctccaacgtgtaagtaaag

SEQ ID NO: 9336 - DNA, 25 bp, Mus musculus
atcggcctgagcgtggctgacctca

SEQ ID NO: 9337 - DNA, 25 bp, Mus musculus
atcggcgattggctccaagagcgat

SEQ ID NO: 9338 - DNA, 25 bp, Mus musculus
atcggcggcacgaggacctcttgca

SEQ ID NO: 9339 - DNA, 25 bp, Mus musculus
atcggcggcctcactatcgctggga

SEQ ID NO: 9340 - DNA, 25 bp, Mus musculus
atcggcggctgcctggccgttggcg

SEQ ID NO: 9341 - DNA, 25 bp, Mus musculus
atcgtgccaaatgggataacattgc

SEQ ID NO: 9342 - DNA, 25 bp, Mus musculus
atcgtgtacagctgggtgatccgca

SEQ ID NO: 9343 - DNA, 25 bp, Mus musculus
atcgtgtgatctcactctcaggaga

SEQ ID NO: 9344 - DNA, 25 bp, Mus musculus
atcgtgttacggttgggccagccac

SEQ ID NO: 9345 - DNA, 25 bp, Mus musculus
atcgttcacccaaagtacaacttct

SEQ ID NO: 9346 - DNA, 25 bp, Mus musculus
atctaactgacaaactcatgatgga

SEQ ID NO: 9347 - DNA, 25 bp, Mus musculus
atctaaggaagaagatgaagtgaca

SEQ ID NO: 9348 - DNA, 25 bp, Mus musculus
atctacagccccactgagatcactg

SEQ ID NO: 9349 - DNA, 25 bp, Mus musculus
atctacataacaaccgcatccagca

SEQ ID NO: 9350 - DNA, 25 bp, Mus musculus
atctaccctaagtgccttgggtttg

SEQ ID NO: 9351 - DNA, 25 bp, Mus musculus
atctacgtgtcacctcttaccacat

SEQ ID NO: 9352 - DNA, 25 bp, Mus musculus
atctactatggcaaccgcagcctgg

SEQ ID NO: 9353 - DNA, 25 bp, Mus musculus
atctagcctcatcaaactctccaag

SEQ ID NO: 9354 - DNA, 25 bp, Mus musculus
atctatgaccgctatggccgggaag

SEQ ID NO: 9355 - DNA, 25 bp, Mus musculus
atctatgctcttggttcccatggac

SEQ ID NO: 9356 - DNA, 25 bp, Mus musculus
atctcaaagaaggacccagaggata

SEQ ID NO: 9357 - DNA, 25 bp, Mus musculus
atctcacaacacagccgattcctgg

SEQ ID NO: 9358 - DNA, 25 bp, Mus musculus
atctcacagacaagttttcgccgct

SEQ ID NO: 9359 - DNA, 25 bp, Mus musculus
atctcaccaaatcgaccgacatctg

SEQ ID NO: 9360 - DNA, 25 bp, Mus musculus
atctcagaacagaccccgacagcag

SEQ ID NO: 9361 - DNA, 25 bp, Mus musculus
atctcagcaggtgacaggctccggg

SEQ ID NO: 9362 - DNA, 25 bp, Mus musculus
atctcagtgccctccaaaacgcagg

SEQ ID NO: 9363 - DNA, 25 bp, Mus musculus
atctccaatcagctcatttcaccag

SEQ ID NO: 9364 - DNA, 25 bp, Mus musculus
atctccagaggaggacagattgctc

SEQ ID NO: 9365 - DNA, 25 bp, Mus musculus
atctcccaatttcagagaccgaagc

SEQ ID NO: 9366 - DNA, 25 bp, Mus musculus
atctcccatttctactccgtatcgg

SEQ ID NO: 9367 - DNA, 25 bp, Mus musculus
atctccgaccgccttatcagtcagg

SEQ ID NO: 9368 - DNA, 25 bp, Mus musculus
atctccgaggtgacttttcgacagt

SEQ ID NO: 9369 - DNA, 25 bp, Mus musculus
atctcctccctaggacgttaggatt

SEQ ID NO: 9370 - DNA, 25 bp, Mus musculus
atctcggacctaatccgccagagca

SEQ ID NO: 9371 - DNA, 25 bp, Mus musculus
atctcggtcactgtgggaggatgac

SEQ ID NO: 9372 - DNA, 25 bp, Mus musculus
atctcgtgaaatggaagggctggtc

SEQ ID NO: 9373 - DNA, 25 bp, Mus musculus
atctctagaagccacttcccacaga

SEQ ID NO: 9374 - DNA, 25 bp, Mus musculus
atctctagttaagcgggcagcacgc

SEQ ID NO: 9375 - DNA, 25 bp, Mus musculus
atctctctactctgataatagccag

SEQ ID NO: 9376 - DNA, 25 bp, Mus musculus
atctctgagtttggacttgtaaaca

SEQ ID NO: 9377 - DNA, 25 bp, Mus musculus
atctctggactataagtactacaag

SEQ ID NO: 9378 - DNA, 25 bp, Mus musculus
atctcttcattaacctctccaggca

SEQ ID NO: 9379 - DNA, 25 bp, Mus musculus
atctcttgatgctatccccgacaac

SEQ ID NO: 9380 - DNA, 25 bp, Mus musculus
atctgaagtggctgtggtatggaaa

SEQ ID NO: 9381 - DNA, 25 bp, Mus musculus
atctgaagttggaggcctgcagtgt

SEQ ID NO: 9382 - DNA, 25 bp, Mus musculus
atctgaatcccaaggtgggcagctg

SEQ ID NO: 9383 - DNA, 25 bp, Mus musculus
atctgacactgccttccttcttggc

SEQ ID NO: 9384 - DNA, 25 bp, Mus musculus
atctgaccatgcagaatgagatgag

SEQ ID NO: 9385 - DNA, 25 bp, Mus musculus
atctgagaacctgggccagggagac

SEQ ID NO: 9386 - DNA, 25 bp, Mus musculus
atctgagcaggctggacctctgtga

SEQ ID NO: 9387 - DNA, 25 bp, Mus musculus
atctgatcagccaacccgcgcattg

SEQ ID NO: 9388 - DNA, 25 bp, Mus musculus
atctgatcagcctacccgcgcattg

SEQ ID NO: 9389 - DNA, 25 bp, Mus musculus
atctgatttgaaggcagactcaatc

SEQ ID NO: 9390 - DNA, 25 bp, Mus musculus
atctgcaaacgggaaggaggagacc

SEQ ID NO: 9391 - DNA, 25 bp, Mus musculus
atctgcaagcagacctgtgcccggg

SEQ ID NO: 9392 - DNA, 25 bp, Mus musculus
atctgcaagcagtcctgtgcccggg

SEQ ID NO: 9393 - DNA, 25 bp, Mus musculus
atctgcaatctctgagatgacagca

SEQ ID NO: 9394 - DNA, 25 bp, Mus musculus
atctgccaacctgtgcgcctgggta

SEQ ID NO: 9395 - DNA, 25 bp, Mus musculus
atctgccactagaaaaaggccaaaa

SEQ ID NO: 9396 - DNA, 25 bp, Mus musculus
atctgcctcaagtgacggcgaccca

SEQ ID NO: 9397 - DNA, 25 bp, Mus musculus
atctgcgccacctgggcgtcagcga

SEQ ID NO: 9398 - DNA, 25 bp, Mus musculus
atctgcggcccgtgaagaagcccaa

SEQ ID NO: 9399 - DNA, 25 bp, Mus musculus
atctgctgcccaaactaactccatg

SEQ ID NO: 9400 - DNA, 25 bp, Mus musculus
atctgctgcccgtgcaagtcctgct

SEQ ID NO: 9401 - DNA, 25 bp, Mus musculus
atctgcttaaatggcgtgtgcgtag

SEQ ID NO: 9402 - DNA, 25 bp, Mus musculus
atctggaacgagctgcattcctcca

SEQ ID NO: 9403 - DNA, 25 bp, Mus musculus
atctggactggagccaacaagcagc

SEQ ID NO: 9404 - DNA, 25 bp, Mus musculus
atctggagcccatgctgcctcctgg

SEQ ID NO: 9405 - DNA, 25 bp, Mus musculus
atctggatctgcctggaatgctctg

SEQ ID NO: 9406 - DNA, 25 bp, Mus musculus
atctgggacataggcggacagcccc

SEQ ID NO: 9407 - DNA, 25 bp, Mus musculus
atctgggacgatgcccgagaaggca

SEQ ID NO: 9408 - DNA, 25 bp, Mus musculus
atctgggcagtgaattagttcgcta

SEQ ID NO: 9409 - DNA, 25 bp, Mus musculus
atctgggcggtcttgaccccgtgtg

SEQ ID NO: 9410 - DNA, 25 bp, Mus musculus
atctggtaaccatggccacctccaa

SEQ ID NO: 9411 - DNA, 25 bp, Mus musculus
atctggtgctttggccctgatggca

SEQ ID NO: 9412 - DNA, 25 bp, Mus musculus
atctgtacgaacctccaccatcaag

SEQ ID NO: 9413 - DNA, 25 bp, Mus musculus
atctgtcagctaaagggccctcttg

SEQ ID NO: 9414 - DNA, 25 bp, Mus musculus
atctgtcagctcaatgcgcgcacct

SEQ ID NO: 9415 - DNA, 25 bp, Mus musculus
atctgtccgagtagcccaaaccaca

SEQ ID NO: 9416 - DNA, 25 bp, Mus musculus
atctgtccgtcagagaatgaagtgc

SEQ ID NO: 9417 - DNA, 25 bp, Mus musculus
atctgtctgctggagtatccccggg

SEQ ID NO: 9418 - DNA, 25 bp, Mus musculus
atctgtctggaggagtatgaagacg

SEQ ID NO: 9419 - DNA, 25 bp, Mus musculus
atctgtgctctcctgcggctctctg

SEQ ID NO: 9420 - DNA, 25 bp, Mus musculus
atctgtgggagccgtctgcactcag

SEQ ID NO: 9421 - DNA, 25 bp, Mus musculus
atctgttctatgtctgcctgtgcca

SEQ ID NO: 9422 - DNA, 25 bp, Mus musculus
atctgttctctacagacagggtgaa

SEQ ID NO: 9423 - DNA, 25 bp, Mus musculus
atctgtttcaccagtggaactacag

SEQ ID NO: 9424 - DNA, 25 bp, Mus musculus
atcttaaggcacaaacaaagaccct

SEQ ID NO: 9425 - DNA, 25 bp, Mus musculus
atcttagacggaagcctgggctttg

SEQ ID NO: 9426 - DNA, 25 bp, Mus musculus
atcttagctgcaaagccatcccgag

SEQ ID NO: 9427 - DNA, 25 bp, Mus musculus
atcttagctgcatagccatcccgag

SEQ ID NO: 9428 - DNA, 25 bp, Mus musculus
atcttcacgcggcacgacatccggg

SEQ ID NO: 9429 - DNA, 25 bp, Mus musculus
atcttcatcatcctccctcttggga

SEQ ID NO: 9430 - DNA, 25 bp, Mus musculus
atcttcatcatcgtccctcttggga

SEQ ID NO: 9431 - DNA, 25 bp, Mus musculus
atcttcatccagttcggcctctact

SEQ ID NO: 9432 - DNA, 25 bp, Mus musculus
atcttcccacggtggtcactgtgct

SEQ ID NO: 9433 - DNA, 25 bp, Mus musculus
atcttcctgaggacgtcagagaaaa

SEQ ID NO: 9434 - DNA, 25 bp, Mus musculus
atcttcgagactttgttaggagcca

SEQ ID NO: 9435 - DNA, 25 bp, Mus musculus
atcttctatttggttagtgccacca

SEQ ID NO: 9436 - DNA, 25 bp, Mus musculus
atcttctctgataaatacggactgc

SEQ ID NO: 9437 - DNA, 25 bp, Mus musculus
atcttctgcccaatctcttcctgag

SEQ ID NO: 9438 - DNA, 25 bp, Mus musculus
atcttctggccaattccttcctctg

SEQ ID NO: 9439 - DNA, 25 bp, Mus musculus
atcttctggccatttccttcctctg

SEQ ID NO: 9440 - DNA, 25 bp, Mus musculus
atcttcttgtctcagagagcagtag

SEQ ID NO: 9441 - DNA, 25 bp, Mus musculus
atcttctttatggtaaccgagctct

SEQ ID NO: 9442 - DNA, 25 bp, Mus musculus
atcttgaaagctcccaagcctgagc

SEQ ID NO: 9443 - DNA, 25 bp, Mus musculus
atcttgacaccacgactctgtcact

SEQ ID NO: 9444 - DNA, 25 bp, Mus musculus
atcttgagtgcaccaagccagcagc

SEQ ID NO: 9445 - DNA, 25 bp, Mus musculus
atcttgattcctgttgccggcctgg

SEQ ID NO: 9446 - DNA, 25 bp, Mus musculus
atcttgcgaagtccccaagctcttc

SEQ ID NO: 9447 - DNA, 25 bp, Mus musculus
atcttgcggcacaggaagggcacgt

SEQ ID NO: 9448 - DNA, 25 bp, Mus musculus
atcttggcaccacagcgagcctgga

SEQ ID NO: 9449 - DNA, 25 bp, Mus musculus
atcttggcttctagccctgagcagg

SEQ ID NO: 9450 - DNA, 25 bp, Mus musculus
atcttgggcatccttatcatcctta

SEQ ID NO: 9451 - DNA, 25 bp, Mus musculus
atcttgggtatggatgaactttctg

SEQ ID NO: 9452 - DNA, 25 bp, Mus musculus
atcttggtaagcgaaacagactcag

SEQ ID NO: 9453 - DNA, 25 bp, Mus musculus
atcttgtcgctttgcttctccacca

SEQ ID NO: 9454 - DNA, 25 bp, Mus musculus
atctttccaagaccaggcatctata

SEQ ID NO: 9455 - DNA, 25 bp, Mus musculus
atctttctacctcttgtcatctgcc

SEQ ID NO: 9456 - DNA, 25 bp, Mus musculus
atcttttcgacgcaacttcagctcc

SEQ ID NO: 9457 - DNA, 25 bp, Mus musculus
atcttttttgtgttgccctcccctg

SEQ ID NO: 9458 - DNA, 25 bp, Mus musculus
atgaaaaattcagtggccttaggcc

SEQ ID NO: 9459 - DNA, 25 bp, Mus musculus
atgaaacgcagacaacagataagaa

SEQ ID NO: 9460 - DNA, 25 bp, Mus musculus
atgaaacggaggaagcaagatgaag

SEQ ID NO: 9461 - DNA, 25 bp, Mus musculus
atgaaagccacactcagtgggaact

SEQ ID NO: 9462 - DNA, 25 bp, Mus musculus
atgaaagccacagtcagtgggaact

SEQ ID NO: 9463 - DNA, 25 bp, Mus musculus
atgaaaggcgctggcacggacgact

SEQ ID NO: 9464 - DNA, 25 bp, Mus musculus
atgaaagtcggcaggagggcatcat

SEQ ID NO: 9465 - DNA, 25 bp, Mus musculus
atgaaagtgagcaagcacctgctgt

SEQ ID NO: 9466 - DNA, 25 bp, Mus musculus
atgaaatggagacatttggtgcaac

SEQ ID NO: 9467 - DNA, 25 bp, Mus musculus
atgaaattgaagagatggtgttgcg

SEQ ID NO: 9468 - DNA, 25 bp, Mus musculus
atgaacaaggagtccccacctactg

SEQ ID NO: 9469 - DNA, 25 bp, Mus musculus
atgaacacatagaaatccttacagt

SEQ ID NO: 9470 - DNA, 25 bp, Mus musculus
atgaacagacaggtttgtccctccc

SEQ ID NO: 9471 - DNA, 25 bp, Mus musculus
atgaaccacagaatgagataatcca

SEQ ID NO: 9472 - DNA, 25 bp, Mus musculus
atgaaccagaaccagagcagcgcac

SEQ ID NO: 9473 - DNA, 25 bp, Mus musculus
atgaaccccgacaccgtgctgcgag

SEQ ID NO: 9474 - DNA, 25 bp, Mus musculus
atgaacccttcgactgcatctataa

SEQ ID NO: 9475 - DNA, 25 bp, Mus musculus
atgaacccttcgtctgcatctataa

SEQ ID NO: 9476 - DNA, 25 bp, Mus musculus
atgaaccgactcatcatgaactacc

SEQ ID NO: 9477 - DNA, 25 bp, Mus musculus
atgaacgaaccacctggcgctcgag

SEQ ID NO: 9478 - DNA, 25 bp, Mus musculus
atgaactccaacaccccgctggtga

SEQ ID NO: 9479 - DNA, 25 bp, Mus musculus
atgaactccgctatggccccacgga

SEQ ID NO: 9480 - DNA, 25 bp, Mus musculus
atgaacttcactccgacacggacac

SEQ ID NO: 9481 - DNA, 25 bp, Mus musculus
atgaactttacaggcagtgccctga

SEQ ID NO: 9482 - DNA, 25 bp, Mus musculus
atgaagaaagcatgttcagagtgct

SEQ ID NO: 9483 - DNA, 25 bp, Mus musculus
atgaagaaggagtaaaggatttggt

SEQ ID NO: 9484 - DNA, 25 bp, Mus musculus
atgaagaggagaccccacatgctac

SEQ ID NO: 9485 - DNA, 25 bp, Mus musculus
atgaagatgagtccccaaagaaaag

SEQ ID NO: 9486 - DNA, 25 bp, Mus musculus
atgaagatggctgggctgaatgcta

SEQ ID NO: 9487 - DNA, 25 bp, Mus musculus
atgaagcccggaaatacgttcgcaa

SEQ ID NO: 9488 - DNA, 25 bp, Mus musculus
atgaagccctcagctggcagcatgg

SEQ ID NO: 9489 - DNA, 25 bp, Mus musculus
atgaaggagcgacacacgcccatcg

SEQ ID NO: 9490 - DNA, 25 bp, Mus musculus
atgaaggagtcagcggcgcggctgc

SEQ ID NO: 9491 - DNA, 25 bp, Mus musculus
atgaaggagtgcttccgcctctacc

SEQ ID NO: 9492 - DNA, 25 bp, Mus musculus
atgaaggcagagagcagagacatcc

SEQ ID NO: 9493 - DNA, 25 bp, Mus musculus
atgaaggtggtgtagacttgaacag

SEQ ID NO: 9494 - DNA, 25 bp, Mus musculus
atgaagtaaccttgcattcggctgc

SEQ ID NO: 9495 - DNA, 25 bp, Mus musculus
atgaagtaccactcctcccgaggac

SEQ ID NO: 9496 - DNA, 25 bp, Mus musculus
atgaagtccagaactgctgcccgca

SEQ ID NO: 9497 - DNA, 25 bp, Mus musculus
atgaagtggaaaagtccagcagcgg

SEQ ID NO: 9498 - DNA, 25 bp, Mus musculus
atgaataagattgcccttgtcccca

SEQ ID NO: 9499 - DNA, 25 bp, Mus musculus
atgaatacccagatgagctccagtg

SEQ ID NO: 9500 - DNA, 25 bp, Mus musculus
atgaatcggttcagcccctctcact

SEQ ID NO: 9501 - DNA, 25 bp, Mus musculus
atgaatgcaggacgcctccagggtc

SEQ ID NO: 9502 - DNA, 25 bp, Mus musculus
atgaattcagccgagagccaagcct

SEQ ID NO: 9503 - DNA, 25 bp, Mus musculus
atgaattcaggaaggcctgagacca

SEQ ID NO: 9504 - DNA, 25 bp, Mus musculus
atgacaagaggatcaagctgcagat

SEQ ID NO: 9505 - DNA, 25 bp, Mus musculus
atgacaagcgtaaaaagaacctctt

SEQ ID NO: 9506 - DNA, 25 bp, Mus musculus
atgacaatagataagttctcctggg

SEQ ID NO: 9507 - DNA, 25 bp, Mus musculus
atgacaatgcgccaaaattctcctt

SEQ ID NO: 9508 - DNA, 25 bp, Mus musculus
atgacacagcaggacacagctccgg

SEQ ID NO: 9509 - DNA, 25 bp, Mus musculus
atgacaccggctctgacgcagggac

SEQ ID NO: 9510 - DNA, 25 bp, Mus musculus
atgacacttggaggcacacctgtgg

SEQ ID NO: 9511 - DNA, 25 bp, Mus musculus
atgacagctataacaacggaggagg

SEQ ID NO: 9512 - DNA, 25 bp, Mus musculus
atgacagcttcgatgagggcagtgt

SEQ ID NO: 9513 - DNA, 25 bp, Mus musculus
atgacagtaccatcccgtcccgtat

SEQ ID NO: 9514 - DNA, 25 bp, Mus musculus
atgacagtcctttaatagagaagcc

SEQ ID NO: 9515 - DNA, 25 bp, Mus musculus
atgacatccttgtggcctcggcaga

SEQ ID NO: 9516 - DNA, 25 bp, Mus musculus
atgacatgttgtgtgcaggagatat

SEQ ID NO: 9517 - DNA, 25 bp, Mus musculus
atgacattgaatggatgactgggcg

SEQ ID NO: 9518 - DNA, 25 bp, Mus musculus
atgaccaacactgggaaggcacgga

SEQ ID NO: 9519 - DNA, 25 bp, Mus musculus
atgaccacaacctcttcagtggaag

SEQ ID NO: 9520 - DNA, 25 bp, Mus musculus
atgaccatacaggtaggcctttccc

SEQ ID NO: 9521 - DNA, 25 bp, Mus musculus
atgaccggtataaaatggtggtgca

SEQ ID NO: 9522 - DNA, 25 bp, Mus musculus
atgacctggatgcagccctgaacaa

SEQ ID NO: 9523 - DNA, 25 bp, Mus musculus
atgacctgggctacggaactctcct

SEQ ID NO: 9524 - DNA, 25 bp, Mus musculus
atgaccttgagaacgccagcagaca

SEQ ID NO: 9525 - DNA, 25 bp, Mus musculus
atgacgagaaggtccccgcgggcat

SEQ ID NO: 9526 - DNA, 25 bp, Mus musculus
atgacgccgtcaccgcgctgagcgt

SEQ ID NO: 9527 - DNA, 25 bp, Mus musculus
atgacggcccatgggagaagcagaa

SEQ ID NO: 9528 - DNA, 25 bp, Mus musculus
atgactacaaaagccatgtgaagtg

SEQ ID NO: 9529 - DNA, 25 bp, Mus musculus
atgactccggaaaggtgcgagatcc

SEQ ID NO: 9530 - DNA, 25 bp, Mus musculus
atgactctcgggtgaaggccatgga

SEQ ID NO: 9531 - DNA, 25 bp, Mus musculus
atgactgagctcttccaatcccttg

SEQ ID NO: 9532 - DNA, 25 bp, Mus musculus
atgactgcacatgcctaaggaggcc

SEQ ID NO: 9533 - DNA, 25 bp, Mus musculus
atgactgccggagaactttccagag

SEQ ID NO: 9534 - DNA, 25 bp, Mus musculus
atgactggccgcaccctcagctggt

SEQ ID NO: 9535 - DNA, 25 bp, Mus musculus
atgacttgattgtgaccccgtttgc

SEQ ID NO: 9536 - DNA, 25 bp, Mus musculus
atgacttggacactcaggagagcgt

SEQ ID NO: 9537 - DNA, 25 bp, Mus musculus
atgactttctgctctacctggatcc

SEQ ID NO: 9538 - DNA, 25 bp, Mus musculus
atgagaaactggagtcaaagatgag

SEQ ID NO: 9539 - DNA, 25 bp, Mus musculus
atgagaaagtgacgcagtctgacct

SEQ ID NO: 9540 - DNA, 25 bp, Mus musculus
atgagaagaaatagagaccggtatg

SEQ ID NO: 9541 - DNA, 25 bp, Mus musculus
atgagaagacctgggtgctggagcc

SEQ ID NO: 9542 - DNA, 25 bp, Mus musculus
atgagaagagagtgactaacacaca

SEQ ID NO: 9543 - DNA, 25 bp, Mus musculus
atgagaagtttctccctcctgcaag

SEQ ID NO: 9544 - DNA, 25 bp, Mus musculus
atgagaccctttttgctcttcctgc

SEQ ID NO: 9545 - DNA, 25 bp, Mus musculus
atgagacgaaggagcgccaagtagc

SEQ ID NO: 9546 - DNA, 25 bp, Mus musculus
atgagacgaaggtgcgccaagtagc

SEQ ID NO: 9547 - DNA, 25 bp, Mus musculus
atgagagaaaccatcaggaacctgc

SEQ ID NO: 9548 - DNA, 25 bp, Mus musculus
atgagagaggtcctatcaaaaccaa

SEQ ID NO: 9549 - DNA, 25 bp, Mus musculus
atgagatacagctgccagcgccggg

SEQ ID NO: 9550 - DNA, 25 bp, Mus musculus
atgagatggccgtgggatctttcgc

SEQ ID NO: 9551 - DNA, 25 bp, Mus musculus
atgagcagatagatgccccagcagt

SEQ ID NO: 9552 - DNA, 25 bp, Mus musculus
atgagccagcgagagctaggcctgt

SEQ ID NO: 9553 - DNA, 25 bp, Mus musculus
atgagccccaccaaacgatgagtcc

SEQ ID NO: 9554 - DNA, 25 bp, Mus musculus
atgagccctcagacggcaggatggt

SEQ ID NO: 9555 - DNA, 25 bp, Mus musculus
atgagcggtgacacatcctcatgcc

SEQ ID NO: 9556 - DNA, 25 bp, Mus musculus
atgagctcaagcgacaggaggtgtc

SEQ ID NO: 9557 - DNA, 25 bp, Mus musculus
atgagctccgtcgaggactggctgc

SEQ ID NO: 9558 - DNA, 25 bp, Mus musculus
atgaggaaacccagacttgagaaaa

SEQ ID NO: 9559 - DNA, 25 bp, Mus musculus
atgaggacattgacccctgtgagcc

SEQ ID NO: 9560 - DNA, 25 bp, Mus musculus
atgaggaccagagcagtagtttgat

SEQ ID NO: 9561 - DNA, 25 bp, Mus musculus
atgaggagttggtgcgctacctgtt

SEQ ID NO: 9562 - DNA, 25 bp, Mus musculus
atgagggccacgctcgagcatcaag

SEQ ID NO: 9563 - DNA, 25 bp, Mus musculus
atgagggccacggtcgagcatcaag

SEQ ID NO: 9564 - DNA, 25 bp, Mus musculus
atgaggtagacgacattgatgaaga

SEQ ID NO: 9565 - DNA, 25 bp, Mus musculus
atgaggtatacagcctgacagccac

SEQ ID NO: 9566 - DNA, 25 bp, Mus musculus
atgaggttactagacctttcctcca

SEQ ID NO: 9567 - DNA, 25 bp, Mus musculus
atgagtaagaaagcccaggctcaca

SEQ ID NO: 9568 - DNA, 25 bp, Mus musculus
atgagtacattgagaaactggccac

SEQ ID NO: 9569 - DNA, 25 bp, Mus musculus
atgagtaggcatgtggagcactgcc

SEQ ID NO: 9570 - DNA, 25 bp, Mus musculus
atgagtcctccgttccatcccagta

SEQ ID NO: 9571 - DNA, 25 bp, Mus musculus
atgagtgatgacaaaccctttctat

SEQ ID NO: 9572 - DNA, 25 bp, Mus musculus
atgagtgccaggatccggctgcttg

SEQ ID NO: 9573 - DNA, 25 bp, Mus musculus
atgagtgcctgaccctgggcctctg

SEQ ID NO: 9574 - DNA, 25 bp, Mus musculus
atgagtgcctgagcctgggcctctg

SEQ ID NO: 9575 - DNA, 25 bp, Mus musculus
atgagtgtgaggaccgtgaagaccc

SEQ ID NO: 9576 - DNA, 25 bp, Mus musculus
atgagtgtgaggtccgtgaagaccc

SEQ ID NO: 9577 - DNA, 25 bp, Mus musculus
atgagttctcagcttcttgcttcac

SEQ ID NO: 9578 - DNA, 25 bp, Mus musculus
atgagttctcaggttcttgcttcac

SEQ ID NO: 9579 - DNA, 25 bp, Mus musculus
atgagttgagtggagatgcttctgt

SEQ ID NO: 9580 - DNA, 25 bp, Mus musculus
atgagttgctaaaagtgagcctgac

SEQ ID NO: 9581 - DNA, 25 bp, Mus musculus
atgagtttggctggcttctactcaa

SEQ ID NO: 9582 - DNA, 25 bp, Mus musculus
atgagtttggtttccgtgtggacaa

SEQ ID NO: 9583 - DNA, 25 bp, Mus musculus
atgataagtgaccaaacatctgaaa

SEQ ID NO: 9584 - DNA, 25 bp, Mus musculus
atgatagcccactgcaccgcagcag

SEQ ID NO: 9585 - DNA, 25 bp, Mus musculus
atgatattccagcaaaccaccgctc

SEQ ID NO: 9586 - DNA, 25 bp, Mus musculus
atgatcaagcaccaccgggacaaac

SEQ ID NO: 9587 - DNA, 25 bp, Mus musculus
atgatcaagcacgaccgggacaaac

SEQ ID NO: 9588 - DNA, 25 bp, Mus musculus
atgatccacttgtgccgactgccgt

SEQ ID NO: 9589 - DNA, 25 bp, Mus musculus
atgatcctgtcatccttaccaatgg

SEQ ID NO: 9590 - DNA, 25 bp, Mus musculus
atgatcgggcgatgcaaccgagctg

SEQ ID NO: 9591 - DNA, 25 bp, Mus musculus
atgatctcagaaggactggacccgg

SEQ ID NO: 9592 - DNA, 25 bp, Mus musculus
atgatgaagacagcccaggagggaa

SEQ ID NO: 9593 - DNA, 25 bp, Mus musculus
atgatgacctggaaagagccaaacg

SEQ ID NO: 9594 - DNA, 25 bp, Mus musculus
atgatgagaaacctgcgcacggtag

SEQ ID NO: 9595 - DNA, 25 bp, Mus musculus
atgatgagtttggtttccgtgtgga

SEQ ID NO: 9596 - DNA, 25 bp, Mus musculus
atgatgataccagactactgcagct

SEQ ID NO: 9597 - DNA, 25 bp, Mus musculus
atgatgcgatcggtatttacccggg

SEQ ID NO: 9598 - DNA, 25 bp, Mus musculus
atgatggcaagatctcttttgcaga

SEQ ID NO: 9599 - DNA, 25 bp, Mus musculus
atgatggcactcagacggcccgcac

SEQ ID NO: 9600 - DNA, 25 bp, Mus musculus
atgatggcttcgtccccacggagag

SEQ ID NO: 9601 - DNA, 25 bp, Mus musculus
atgatgggtggctatccgccaggcc

SEQ ID NO: 9602 - DNA, 25 bp, Mus musculus
atgatgtagctaccctgcaggatga

SEQ ID NO: 9603 - DNA, 25 bp, Mus musculus
atgatgtcatccagccagctgctcc

SEQ ID NO: 9604 - DNA, 25 bp, Mus musculus
atgatgttgcttttgacttctctaa

SEQ ID NO: 9605 - DNA, 25 bp, Mus musculus
atgatgtttggaagtgataggagcc

SEQ ID NO: 9606 - DNA, 25 bp, Mus musculus
atgattgtttcaggccaaattggga

SEQ ID NO: 9607 - DNA, 25 bp, Mus musculus
atgcaaaacattcagagaaatcacc

SEQ ID NO: 9608 - DNA, 25 bp, Mus musculus
atgcaaagtaaacagggtgccttgt

SEQ ID NO: 9609 - DNA, 25 bp, Mus musculus
atgcaacgggacatcgaacgcgagg

SEQ ID NO: 9610 - DNA, 25 bp, Mus musculus
atgcaactaagttaaggccaaaggc

SEQ ID NO: 9611 - DNA, 25 bp, Mus musculus
atgcaaggagacgtaagccccaatc

SEQ ID NO: 9612 - DNA, 25 bp, Mus musculus
atgcacatggttcaaaattcccaaa

SEQ ID NO: 9613 - DNA, 25 bp, Mus musculus
atgcaccaggcacagctaactccga

SEQ ID NO: 9614 - DNA, 25 bp, Mus musculus
atgcacctggtgttcaaatgcaagc

SEQ ID NO: 9615 - DNA, 25 bp, Mus musculus
atgcactcccatcctcggaagatga

SEQ ID NO: 9616 - DNA, 25 bp, Mus musculus
atgcactttactagggagaagaagt

SEQ ID NO: 9617 - DNA, 25 bp, Mus musculus
atgcactttacttgggagaagaagt

SEQ ID NO: 9618 - DNA, 25 bp, Mus musculus
atgcagaatccgagagggtggtaca

SEQ ID NO: 9619 - DNA, 25 bp, Mus musculus
atgcagacacacaagagattaattt

SEQ ID NO: 9620 - DNA, 25 bp, Mus musculus
atgcagactatcatgacctcatgga

SEQ ID NO: 9621 - DNA, 25 bp, Mus musculus
atgcagagaagagctcatacctcta

SEQ ID NO: 9622 - DNA, 25 bp, Mus musculus
atgcagagcctacagcctgacccag

SEQ ID NO: 9623 - DNA, 25 bp, Mus musculus
atgcagagtaaagatgatagcctcg

SEQ ID NO: 9624 - DNA, 25 bp, Mus musculus
atgcagatgcaaaagtccaggtgct

SEQ ID NO: 9625 - DNA, 25 bp, Mus musculus
atgcagctgccttggcagcccagag

SEQ ID NO: 9626 - DNA, 25 bp, Mus musculus
atgcaggtgtgggtgacctttatct

SEQ ID NO: 9627 - DNA, 25 bp, Mus musculus
atgcatgttcctgctcttttcaaag

SEQ ID NO: 9628 - DNA, 25 bp, Mus musculus
atgccaatggatcccgagattttct

SEQ ID NO: 9629 - DNA, 25 bp, Mus musculus
atgccacaaccgtggacaacattcg

SEQ ID NO: 9630 - DNA, 25 bp, Mus musculus
atgccacactcacggaagatgtcag

SEQ ID NO: 9631 - DNA, 25 bp, Mus musculus
atgccaccgcagtggcctgctggag

SEQ ID NO: 9632 - DNA, 25 bp, Mus musculus
atgccacgaagtcacctccaaggaa

SEQ ID NO: 9633 - DNA, 25 bp, Mus musculus
atgccacgaggcagccgggactttg

SEQ ID NO: 9634 - DNA, 25 bp, Mus musculus
atgccagacacagggctgcgagtct

SEQ ID NO: 9635 - DNA, 25 bp, Mus musculus
atgccagcacacttctcggacagcg

SEQ ID NO: 9636 - DNA, 25 bp, Mus musculus
atgccagttttaaccatcaggtcac

SEQ ID NO: 9637 - DNA, 25 bp, Mus musculus
atgccagttttatccatcaggtcac

SEQ ID NO: 9638 - DNA, 25 bp, Mus musculus
atgccatcatgattgtgaggagggc

SEQ ID NO: 9639 - DNA, 25 bp, Mus musculus
atgccatcgagaggctgcaccacat

SEQ ID NO: 9640 - DNA, 25 bp, Mus musculus
atgcccaaggcccacagctagagcg

SEQ ID NO: 9641 - DNA, 25 bp, Mus musculus
atgcccagaaggctgttctgcatcc

SEQ ID NO: 9642 - DNA, 25 bp, Mus musculus
atgcccagtcctcggcccagagatg

SEQ ID NO: 9643 - DNA, 25 bp, Mus musculus
atgcccatggtcactcggcggctga

SEQ ID NO: 9644 - DNA, 25 bp, Mus musculus
atgcccatgtcacagaccccagagt

SEQ ID NO: 9645 - DNA, 25 bp, Mus musculus
atgccccatataggccataagtggc

SEQ ID NO: 9646 - DNA, 25 bp, Mus musculus
atgcccgcatgcctgcagcgtttag

SEQ ID NO: 9647 - DNA, 25 bp, Mus musculus
atgcccgttggaccacagaggagca

SEQ ID NO: 9648 - DNA, 25 bp, Mus musculus
atgccctggagatcgagctgcaggc

SEQ ID NO: 9649 - DNA, 25 bp, Mus musculus
atgccgaggatctgcagaagcgcct

SEQ ID NO: 9650 - DNA, 25 bp, Mus musculus
atgccgcgctccatcctggtcagga

SEQ ID NO: 9651 - DNA, 25 bp, Mus musculus
atgccgcgctccttcctggtcagga

SEQ ID NO: 9652 - DNA, 25 bp, Mus musculus
atgcctaccccgagggtgtccaaga

SEQ ID NO: 9653 - DNA, 25 bp, Mus musculus
atgcctaccggaaagcctgtgcctc

SEQ ID NO: 9654 - DNA, 25 bp, Mus musculus
atgcctcagttgactccacagatcc

SEQ ID NO: 9655 - DNA, 25 bp, Mus musculus
atgcctgattccaaaaccaccagca

SEQ ID NO: 9656 - DNA, 25 bp, Mus musculus
atgcctggaccctgttcagagggag

SEQ ID NO: 9657 - DNA, 25 bp, Mus musculus
atgcgaccaaatgtgaagcagagag

SEQ ID NO: 9658 - DNA, 25 bp, Mus musculus
atgcgcagcgccagctcgctgagca

SEQ ID NO: 9659 - DNA, 25 bp, Mus musculus
atgcgcagcgcctgctcgctgagca

SEQ ID NO: 9660 - DNA, 25 bp, Mus musculus
atgcggaagcggtgatctgtagcac

SEQ ID NO: 9661 - DNA, 25 bp, Mus musculus
atgcggagcagcacgcagatggaat

SEQ ID NO: 9662 - DNA, 25 bp, Mus musculus
atgcggcagctgtgcattgccatgg

SEQ ID NO: 9663 - DNA, 25 bp, Mus musculus
atgcgggcagcccatccgtctgaca

SEQ ID NO: 9664 - DNA, 25 bp, Mus musculus
atgcgggtgttcacctggtatctgg

SEQ ID NO: 9665 - DNA, 25 bp, Mus musculus
atgctaatgacgacacagccacccg

SEQ ID NO: 9666 - DNA, 25 bp, Mus musculus
atgctactgcaagccacagcgggct

SEQ ID NO: 9667 - DNA, 25 bp, Mus musculus
atgctatctcccagcctgccagagg

SEQ ID NO: 9668 - DNA, 25 bp, Mus musculus
atgctcgcctccttgcagcctttga

SEQ ID NO: 9669 - DNA, 25 bp, Mus musculus
atgctctggaaagaacgctggagca

SEQ ID NO: 9670 - DNA, 25 bp, Mus musculus
atgctctgggagacaccgtgggctt

SEQ ID NO: 9671 - DNA, 25 bp, Mus musculus
atgctgagccacagtacccagtccg

SEQ ID NO: 9672 - DNA, 25 bp, Mus musculus
atgctgagccactgtacccagtccg

SEQ ID NO: 9673 - DNA, 25 bp, Mus musculus
atgctgatctggactcctccgtgcc

SEQ ID NO: 9674 - DNA, 25 bp, Mus musculus
atgctgatgctgctttaccttgtag

SEQ ID NO: 9675 - DNA, 25 bp, Mus musculus
atgctgcctgggaactcgagccagg

SEQ ID NO: 9676 - DNA, 25 bp, Mus musculus
atgctggatgagagcagcctctatg

SEQ ID NO: 9677 - DNA, 25 bp, Mus musculus
atgctggcagccaaaactgttctgg

SEQ ID NO: 9678 - DNA, 25 bp, Mus musculus
atgctgtccgccacacaggtctaca

SEQ ID NO: 9679 - DNA, 25 bp, Mus musculus
atgctgtttctataggtccaacgtc

SEQ ID NO: 9680 - DNA, 25 bp, Mus musculus
atgcttaccgcggaggctccctgaa

SEQ ID NO: 9681 - DNA, 25 bp, Mus musculus
atgcttagccgagaccaacacctgg

SEQ ID NO: 9682 - DNA, 25 bp, Mus musculus
atgcttcctactaccacaaggctca

SEQ ID NO: 9683 - DNA, 25 bp, Mus musculus
atgcttgacagtgctgagcgggaac

SEQ ID NO: 9684 - DNA, 25 bp, Mus musculus
atgctttcaagcgtttagggactgg

SEQ ID NO: 9685 - DNA, 25 bp, Mus musculus
atgctttgccagatggacaatcact

SEQ ID NO: 9686 - DNA, 25 bp, Mus musculus
atggaaaagccgaagttcgaggaca

SEQ ID NO: 9687 - DNA, 25 bp, Mus musculus
atggaaaagcgagggtactggtact

SEQ ID NO: 9688 - DNA, 25 bp, Mus musculus
atggaaaattgtcggtgatctggcc

SEQ ID NO: 9689 - DNA, 25 bp, Mus musculus
atggaaatcattccaaccagacctg

SEQ ID NO: 9690 - DNA, 25 bp, Mus musculus
atggaacacctacatttctaactgg

SEQ ID NO: 9691 - DNA, 25 bp, Mus musculus
atggaacatttgagccaggaagacc

SEQ ID NO: 9692 - DNA, 25 bp, Mus musculus
atggaagatcttcctggagagaatg

SEQ ID NO: 9693 - DNA, 25 bp, Mus musculus
atggaagcgtgagcatgcccgtcag

SEQ ID NO: 9694 - DNA, 25 bp, Mus musculus
atggaaggagccacacaagccgact

SEQ ID NO: 9695 - DNA, 25 bp, Mus musculus
atggaatactctgggtgtctgcaag

SEQ ID NO: 9696 - DNA, 25 bp, Mus musculus
atggaattgtcagccacttgaagaa

SEQ ID NO: 9697 - DNA, 25 bp, Mus musculus
atggacacagcctccagctgcagag

SEQ ID NO: 9698 - DNA, 25 bp, Mus musculus
atggaccaacacaagctcagcaggg

SEQ ID NO: 9699 - DNA, 25 bp, Mus musculus
atggaccgcgtggaccgtgagatca

SEQ ID NO: 9700 - DNA, 25 bp, Mus musculus
atggacctaccaaggccttagtctg

SEQ ID NO: 9701 - DNA, 25 bp, Mus musculus
atggacctaccatggccttagtctg

SEQ ID NO: 9702 - DNA, 25 bp, Mus musculus
atggacgacgccagggagacttgat

SEQ ID NO: 9703 - DNA, 25 bp, Mus musculus
atggacgcagcctcctcactgacat

SEQ ID NO: 9704 - DNA, 25 bp, Mus musculus
atggactcagtgactcccactttcc

SEQ ID NO: 9705 - DNA, 25 bp, Mus musculus
atggactcagtgtctcccactttcc

SEQ ID NO: 9706 - DNA, 25 bp, Mus musculus
atggactcctgtcatatacagcccc

SEQ ID NO: 9707 - DNA, 25 bp, Mus musculus
atggagaaggccaagacctcagaga

SEQ ID NO: 9708 - DNA, 25 bp, Mus musculus
atggagatgacttgattgtgacccc

SEQ ID NO: 9709 - DNA, 25 bp, Mus musculus
atggagcacgcgctgctcaatgacg

SEQ ID NO: 9710 - DNA, 25 bp, Mus musculus
atggagcagaacaaagagacctgga

SEQ ID NO: 9711 - DNA, 25 bp, Mus musculus
atggagccaataaacactttgcaaa

SEQ ID NO: 9712 - DNA, 25 bp, Mus musculus
atggagcccgtcctgttacccaagg

SEQ ID NO: 9713 - DNA, 25 bp, Mus musculus
atggagccgccacatcttgcagcag

SEQ ID NO: 9714 - DNA, 25 bp, Mus musculus
atggagcgccgggtctccaatgcag

SEQ ID NO: 9715 - DNA, 25 bp, Mus musculus
atggagcggaggtcatgttcgcccc

SEQ ID NO: 9716 - DNA, 25 bp, Mus musculus
atggaggaggacaaccaggccccta

SEQ ID NO: 9717 - DNA, 25 bp, Mus musculus
atggaggagtctaatccggccccta

SEQ ID NO: 9718 - DNA, 25 bp, Mus musculus
atggaggcacctgttcccgccagga

SEQ ID NO: 9719 - DNA, 25 bp, Mus musculus
atggaggcctttaagttatagaaca

SEQ ID NO: 9720 - DNA, 25 bp, Mus musculus
atggagggagcccaaaccacctctg

SEQ ID NO: 9721 - DNA, 25 bp, Mus musculus
atggagggcctggacaaccacacca

SEQ ID NO: 9722 - DNA, 25 bp, Mus musculus
atggaggtgtcaggcttcttcagga

SEQ ID NO: 9723 - DNA, 25 bp, Mus musculus
atggagtcagctccccaagcgcagg

SEQ ID NO: 9724 - DNA, 25 bp, Mus musculus
atggatataccaccctggccaccag

SEQ ID NO: 9725 - DNA, 25 bp, Mus musculus
atggatcagcactggccgcgtacgg

SEQ ID NO: 9726 - DNA, 25 bp, Mus musculus
atggatcccaggaccagcctcatca

SEQ ID NO: 9727 - DNA, 25 bp, Mus musculus
atggatccctgctgctccagaatgt

SEQ ID NO: 9728 - DNA, 25 bp, Mus musculus
atggatcttgggaccggccgatgcc

SEQ ID NO: 9729 - DNA, 25 bp, Mus musculus
atggattctggacgagctccaaagg

SEQ ID NO: 9730 - DNA, 25 bp, Mus musculus
atggattgagcggcacccagaagga

SEQ ID NO: 9731 - DNA, 25 bp, Mus musculus
atggatttggacaggagatcttccc

SEQ ID NO: 9732 - DNA, 25 bp, Mus musculus
atggcaacagcaaactccggcccag

SEQ ID NO: 9733 - DNA, 25 bp, Mus musculus
atggcaacagcgtgcacctcggcat

SEQ ID NO: 9734 - DNA, 25 bp, Mus musculus
atggcaacctccagcggcgggagct

SEQ ID NO: 9735 - DNA, 25 bp, Mus musculus
atggcaacctcctgcggcgggagct

SEQ ID NO: 9736 - DNA, 25 bp, Mus musculus
atggcaagttctacgtgggagtctg

SEQ ID NO: 9737 - DNA, 25 bp, Mus musculus
atggcacacgaaacttccaggactt

SEQ ID NO: 9738 - DNA, 25 bp, Mus musculus
atggcactcagaaacggcgttgacg

SEQ ID NO: 9739 - DNA, 25 bp, Mus musculus
atggcagcagagacgggagcaccca

SEQ ID NO: 9740 - DNA, 25 bp, Mus musculus
atggcagcagtgacaatgggctttg

SEQ ID NO: 9741 - DNA, 25 bp, Mus musculus
atggcagcccggtgatgctacagac

SEQ ID NO: 9742 - DNA, 25 bp, Mus musculus
atggcagcgtcgactttggcaggaa

SEQ ID NO: 9743 - DNA, 25 bp, Mus musculus
atggcagttagacctcaagaggaac

SEQ ID NO: 9744 - DNA, 25 bp, Mus musculus
atggcataccaccacgacagcaggc

SEQ ID NO: 9745 - DNA, 25 bp, Mus musculus
atggcatccaccaggagcctctgag

SEQ ID NO: 9746 - DNA, 25 bp, Mus musculus
atggcatcctcttcattcctctcag

SEQ ID NO: 9747 - DNA, 25 bp, Mus musculus
atggccagagatgagcgtgtgaacc

SEQ ID NO: 9748 - DNA, 25 bp, Mus musculus
atggccagcccaagaaccaggaaag

SEQ ID NO: 9749 - DNA, 25 bp, Mus musculus
atggccagctcctacggctcagcta

SEQ ID NO: 9750 - DNA, 25 bp, Mus musculus
atggccaggtgtgcctgccacgctg

SEQ ID NO: 9751 - DNA, 25 bp, Mus musculus
atggcccaatggagccagtttgcac

SEQ ID NO: 9752 - DNA, 25 bp, Mus musculus
atggccctcagtacaattcgtctct

SEQ ID NO: 9753 - DNA, 25 bp, Mus musculus
atggccctgcatgcaaatgtgagtg

SEQ ID NO: 9754 - DNA, 25 bp, Mus musculus
atggccctgctcagactgcccaaga

SEQ ID NO: 9755 - DNA, 25 bp, Mus musculus
atggccggaggctcgccgatgatct

SEQ ID NO: 9756 - DNA, 25 bp, Mus musculus
atggccgtcgcctggttcatcatca

SEQ ID NO: 9757 - DNA, 25 bp, Mus musculus
atggccgtggcaggctagcctccgt

SEQ ID NO: 9758 - DNA, 25 bp, Mus musculus
atggcctaggcgcatcacacacata

SEQ ID NO: 9759 - DNA, 25 bp, Mus musculus
atggcctccgagatcttttcaatgc

SEQ ID NO: 9760 - DNA, 25 bp, Mus musculus
atggcgaggagaccttcaaccgagc

SEQ ID NO: 9761 - DNA, 25 bp, Mus musculus
atggcgaggagagcttcaaccgagc

SEQ ID NO: 9762 - DNA, 25 bp, Mus musculus
atggcggcgagctccatggaccact

SEQ ID NO: 9763 - DNA, 25 bp, Mus musculus
atggcggctccagcggaggacctct

SEQ ID NO: 9764 - DNA, 25 bp, Mus musculus
atggcgggacctgggctatgtatac

SEQ ID NO: 9765 - DNA, 25 bp, Mus musculus
atggctccaaggctgtgacccgcca

SEQ ID NO: 9766 - DNA, 25 bp, Mus musculus
atggctcccacagggaccaaggcag

SEQ ID NO: 9767 - DNA, 25 bp, Mus musculus
atggctccgagcgattcctctgtga

SEQ ID NO: 9768 - DNA, 25 bp, Mus musculus
atggctctgagctctcgcgcgcacg

SEQ ID NO: 9769 - DNA, 25 bp, Mus musculus
atggctcttggacaaatccgagcag

SEQ ID NO: 9770 - DNA, 25 bp, Mus musculus
atggctgacagggtggcttcctacc

SEQ ID NO: 9771 - DNA, 25 bp, Mus musculus
atggctgcacttctacaacaagtgg

SEQ ID NO: 9772 - DNA, 25 bp, Mus musculus
atggctgggtggtacttcaatcaag

SEQ ID NO: 9773 - DNA, 25 bp, Mus musculus
atggctgtggcctaccgcctgctgg

SEQ ID NO: 9774 - DNA, 25 bp, Mus musculus
atggcttgttggagaggcacagact

SEQ ID NO: 9775 - DNA, 25 bp, Mus musculus
atgggaaagcgatggcagtcaccag

SEQ ID NO: 9776 - DNA, 25 bp, Mus musculus
atgggacagtcacccgccattaccg

SEQ ID NO: 9777 - DNA, 25 bp, Mus musculus
atgggaccacagtagagccaccgac

SEQ ID NO: 9778 - DNA, 25 bp, Mus musculus
atgggaccccataagacagcagtgt

SEQ ID NO: 9779 - DNA, 25 bp, Mus musculus
atgggaccctagtccggctccgctt

SEQ ID NO: 9780 - DNA, 25 bp, Mus musculus
atgggaccgtttggctctggccacc

SEQ ID NO: 9781 - DNA, 25 bp, Mus musculus
atgggactctcaggcggaagctcga

SEQ ID NO: 9782 - DNA, 25 bp, Mus musculus
atgggagaaacccttccagaggaag

SEQ ID NO: 9783 - DNA, 25 bp, Mus musculus
atgggagctcgagcatccacagtgg

SEQ ID NO: 9784 - DNA, 25 bp, Mus musculus
atgggataactgagtcgcgcccgct

SEQ ID NO: 9785 - DNA, 25 bp, Mus musculus
atgggcagcatgcagccacttcacc

SEQ ID NO: 9786 - DNA, 25 bp, Mus musculus
atgggcagggcagctactcctccta

SEQ ID NO: 9787 - DNA, 25 bp, Mus musculus
atgggcagggccaccgtggtacctt

SEQ ID NO: 9788 - DNA, 25 bp, Mus musculus
atgggcatctgtccgaggctctact

SEQ ID NO: 9789 - DNA, 25 bp, Mus musculus
atgggccagtcccagcggtaactcg

SEQ ID NO: 9790 - DNA, 25 bp, Mus musculus
atgggcggcagctcccgccgaaaga

SEQ ID NO: 9791 - DNA, 25 bp, Mus musculus
atggggggactctatggcgcacccc

SEQ ID NO: 9792 - DNA, 25 bp, Mus musculus
atgggtcagccgcagacaggccttt

SEQ ID NO: 9793 - DNA, 25 bp, Mus musculus
atgggtgctcctgctgggctcaaga

SEQ ID NO: 9794 - DNA, 25 bp, Mus musculus
atgggtggctatccgccaggccttc

SEQ ID NO: 9795 - DNA, 25 bp, Mus musculus
atgggttctacaacggccgtagcct

SEQ ID NO: 9796 - DNA, 25 bp, Mus musculus
atggtacccatggagcttcccaggg

SEQ ID NO: 9797 - DNA, 25 bp, Mus musculus
atggtcacccacagcaagtttcccg

SEQ ID NO: 9798 - DNA, 25 bp, Mus musculus
atggtcacccactgcaagtttcccg

SEQ ID NO: 9799 - DNA, 25 bp, Mus musculus
atggtcatcagaacatcacagctga

SEQ ID NO: 9800 - DNA, 25 bp, Mus musculus
atggtcatgcctgccctttgaaatt

SEQ ID NO: 9801 - DNA, 25 bp, Mus musculus
atggtccagagccaggaggcaccaa

SEQ ID NO: 9802 - DNA, 25 bp, Mus musculus
atggtccgtgttctcatctgtattg

SEQ ID NO: 9803 - DNA, 25 bp, Mus musculus
atggtctggccactctccactacaa

SEQ ID NO: 9804 - DNA, 25 bp, Mus musculus
atggtgcacagcaacgccctcaatg

SEQ ID NO: 9805 - DNA, 25 bp, Mus musculus
atggtgcacggtgctacgccagcca

SEQ ID NO: 9806 - DNA, 25 bp, Mus musculus
atggtgcatgggaaattgttcactg

SEQ ID NO: 9807 - DNA, 25 bp, Mus musculus
atggtgcccggctggaccgtgttca

SEQ ID NO: 9808 - DNA, 25 bp, Mus musculus
atggtgcggcttcgagagccagact

SEQ ID NO: 9809 - DNA, 25 bp, Mus musculus
atggtgctccactcagttctgctga

SEQ ID NO: 9810 - DNA, 25 bp, Mus musculus
atggtggtggtcgttgtctgcctac

SEQ ID NO: 9811 - DNA, 25 bp, Mus musculus
atggtgttatccctggcagtcgatg

SEQ ID NO: 9812 - DNA, 25 bp, Mus musculus
atggttctggagaagtcgctgagaa

SEQ ID NO: 9813 - DNA, 25 bp, Mus musculus
atggttgaccagcacagcccagaag

SEQ ID NO: 9814 - DNA, 25 bp, Mus musculus
atggttgtcactggcatcctcctgg

SEQ ID NO: 9815 - DNA, 25 bp, Mus musculus
atggttgtgcctccccaggaacctg

SEQ ID NO: 9816 - DNA, 25 bp, Mus musculus
atggttttacatgctgcgggccgcc

SEQ ID NO: 9817 - DNA, 25 bp, Mus musculus
atgtaaactgcttgacaaagtcagc

SEQ ID NO: 9818 - DNA, 25 bp, Mus musculus
atgtaattcaagagagaagcctaag

SEQ ID NO: 9819 - DNA, 25 bp, Mus musculus
atgtacccagtaccaacccacagga

SEQ ID NO: 9820 - DNA, 25 bp, Mus musculus
atgtagcacgcctgctgtcctggcc

SEQ ID NO: 9821 - DNA, 25 bp, Mus musculus
atgtagctaccctgcaggatgagga

SEQ ID NO: 9822 - DNA, 25 bp, Mus musculus
atgtaggcggtaccctgcaccctct

SEQ ID NO: 9823 - DNA, 25 bp, Mus musculus
atgtagtgacgatattgaagttctc

SEQ ID NO: 9824 - DNA, 25 bp, Mus musculus
atgtatatcaggtactgctgtgatg

SEQ ID NO: 9825 - DNA, 25 bp, Mus musculus
atgtatctaagaaaatggctccttg

SEQ ID NO: 9826 - DNA, 25 bp, Mus musculus
atgtatctatgcctgcctacttcaa

SEQ ID NO: 9827 - DNA, 25 bp, Mus musculus
atgtatgacaccaagacccgggagc

SEQ ID NO: 9828 - DNA, 25 bp, Mus musculus
atgtatgagtctgatggctccgtca

SEQ ID NO: 9829 - DNA, 25 bp, Mus musculus
atgtatgagtttcggtatcgcccaa

SEQ ID NO: 9830 - DNA, 25 bp, Mus musculus
atgtattctcatactagactccctg

SEQ ID NO: 9831 - DNA, 25 bp, Mus musculus
atgtcaacaccctgggccaattctg

SEQ ID NO: 9832 - DNA, 25 bp, Mus musculus
atgtcaagtccgagccaaacctgca

SEQ ID NO: 9833 - DNA, 25 bp, Mus musculus
atgtcacagttcacaccagctccgg

SEQ ID NO: 9834 - DNA, 25 bp, Mus musculus
atgtcaccgagtacgtcgtccgagt

SEQ ID NO: 9835 - DNA, 25 bp, Mus musculus
atgtcacctgtacggttgatggaaa

SEQ ID NO: 9836 - DNA, 25 bp, Mus musculus
atgtcagatcaagaggaggagatgt

SEQ ID NO: 9837 - DNA, 25 bp, Mus musculus
atgtcagcaggaataagagagggca

SEQ ID NO: 9838 - DNA, 25 bp, Mus musculus
atgtcagtgaatgggaagaaggttc

SEQ ID NO: 9839 - DNA, 25 bp, Mus musculus
atgtcatcatgagggaattccgatc

SEQ ID NO: 9840 - DNA, 25 bp, Mus musculus
atgtcatccacaaatacttcctgcc

SEQ ID NO: 9841 - DNA, 25 bp, Mus musculus
atgtcatgctgtgtgcaggagagat

SEQ ID NO: 9842 - DNA, 25 bp, Mus musculus
atgtcattgatcagagtgaaccgct

SEQ ID NO: 9843 - DNA, 25 bp, Mus musculus
atgtccacagtttcgaattcaaagc

SEQ ID NO: 9844 - DNA, 25 bp, Mus musculus
atgtcccttcagaaaccagtgagga

SEQ ID NO: 9845 - DNA, 25 bp, Mus musculus
atgtccggctggcaataaactacag

SEQ ID NO: 9846 - DNA, 25 bp, Mus musculus
atgtcctcccactgcagagtgccag

SEQ ID NO: 9847 - DNA, 25 bp, Mus musculus
atgtcctggagctacagagcccacg

SEQ ID NO: 9848 - DNA, 25 bp, Mus musculus
atgtcggaaccacagcctgacctgg

SEQ ID NO: 9849 - DNA, 25 bp, Mus musculus
atgtcgtcctgtcgagtggataagc

SEQ ID NO: 9850 - DNA, 25 bp, Mus musculus
atgtctacccgctgcttactgtgag

SEQ ID NO: 9851 - DNA, 25 bp, Mus musculus
atgtctcagccagcggcgggctgca

SEQ ID NO: 9852 - DNA, 25 bp, Mus musculus
atgtctcctgtccatggtggatgag

SEQ ID NO: 9853 - DNA, 25 bp, Mus musculus
atgtctcggcgcaactggaacgcgt

SEQ ID NO: 9854 - DNA, 25 bp, Mus musculus
atgtctgcctcatcctcaggcggct

SEQ ID NO: 9855 - DNA, 25 bp, Mus musculus
atgtctgctggtaggacatcatgtt

SEQ ID NO: 9856 - DNA, 25 bp, Mus musculus
atgtctgtccgcagctcgcagtggt

SEQ ID NO: 9857 - DNA, 25 bp, Mus musculus
atgtctgtgggtgtaattgatccca

SEQ ID NO: 9858 - DNA, 25 bp, Mus musculus
atgtgaagagtcaagcagacatctc

SEQ ID NO: 9859 - DNA, 25 bp, Mus musculus
atgtgaagatgttgctggccgtgca

SEQ ID NO: 9860 - DNA, 25 bp, Mus musculus
atgtgacatactggcccctctggta

SEQ ID NO: 9861 - DNA, 25 bp, Mus musculus
atgtgacctgctgccctgcaacagt

SEQ ID NO: 9862 - DNA, 25 bp, Mus musculus
atgtgagcgaggatgacccagacgt

SEQ ID NO: 9863 - DNA, 25 bp, Mus musculus
atgtgcgcactgagttgcctgcaga

SEQ ID NO: 9864 - DNA, 25 bp, Mus musculus
atgtgcgtccagagccctctggcca

SEQ ID NO: 9865 - DNA, 25 bp, Mus musculus
atgtgctgagcttcacggcagagga

SEQ ID NO: 9866 - DNA, 25 bp, Mus musculus
atgtggaagccctgcgggcccagct

SEQ ID NO: 9867 - DNA, 25 bp, Mus musculus
atgtggacacctctggttttcagtg

SEQ ID NO: 9868 - DNA, 25 bp, Mus musculus
atgtggacacctgtggttttcagtg

SEQ ID NO: 9869 - DNA, 25 bp, Mus musculus
atgtggacgggaagaaggattcctt

SEQ ID NO: 9870 - DNA, 25 bp, Mus musculus
atgtggactccgcacccaggcaggc

SEQ ID NO: 9871 - DNA, 25 bp, Mus musculus
atgtggcaggcagggaagagacagg

SEQ ID NO: 9872 - DNA, 25 bp, Mus musculus
atgtggccacggagaccaccaccag

SEQ ID NO: 9873 - DNA, 25 bp, Mus musculus
atgtggccacgtgtcctagctgctc

SEQ ID NO: 9874 - DNA, 25 bp, Mus musculus
atgtggcctccctgctccagtagga

SEQ ID NO: 9875 - DNA, 25 bp, Mus musculus
atgtggctgcccactgcggccatta

SEQ ID NO: 9876 - DNA, 25 bp, Mus musculus
atgtgggagcttggtcactgcgacc

SEQ ID NO: 9877 - DNA, 25 bp, Mus musculus
atgtgggaggataccagagagaaca

SEQ ID NO: 9878 - DNA, 25 bp, Mus musculus
atgtggggcctctcctctgacctct

SEQ ID NO: 9879 - DNA, 25 bp, Mus musculus
atgtgggtgccctggaagacatgct

SEQ ID NO: 9880 - DNA, 25 bp, Mus musculus
atgtggtgaagacaggccgcgtgat

SEQ ID NO: 9881 - DNA, 25 bp, Mus musculus
atgtggtggactggctgtaccacaa

SEQ ID NO: 9882 - DNA, 25 bp, Mus musculus
atgtggtggccttgaatcgcaggac

SEQ ID NO: 9883 - DNA, 25 bp, Mus musculus
atgtggttcctgaggactgaacccc

SEQ ID NO: 9884 - DNA, 25 bp, Mus musculus
atgtggttgctgtctccaggaatat

SEQ ID NO: 9885 - DNA, 25 bp, Mus musculus
atgtgtaagtgcaagtgggcgctca

SEQ ID NO: 9886 - DNA, 25 bp, Mus musculus
atgtgtcacacagcgactcccaaag

SEQ ID NO: 9887 - DNA, 25 bp, Mus musculus
atgtgtggtgtcgaatctgcgagaa

SEQ ID NO: 9888 - DNA, 25 bp, Mus musculus
atgtgtgtgctatctgtctggagga

SEQ ID NO: 9889 - DNA, 25 bp, Mus musculus
atgtgttgtccagggcagcctctct

SEQ ID NO: 9890 - DNA, 25 bp, Mus musculus
atgtgtttgacgtagatgatgcaag

SEQ ID NO: 9891 - DNA, 25 bp, Mus musculus
atgtgtttgtggatacccatgatct

SEQ ID NO: 9892 - DNA, 25 bp, Mus musculus
atgttacagagtcccagatcctaat

SEQ ID NO: 9893 - DNA, 25 bp, Mus musculus
atgttacccacaattccactctctg

SEQ ID NO: 9894 - DNA, 25 bp, Mus musculus
atgttattgagttcatagccagaga

SEQ ID NO: 9895 - DNA, 25 bp, Mus musculus
atgttcagcaccgaaaaggagatcc

SEQ ID NO: 9896 - DNA, 25 bp, Mus musculus
atgttccgcagcgacgggacccatt

SEQ ID NO: 9897 - DNA, 25 bp, Mus musculus
atgttccggcacacagacagcctct

SEQ ID NO: 9898 - DNA, 25 bp, Mus musculus
atgttcctgaatgccgcccagaggg

SEQ ID NO: 9899 - DNA, 25 bp, Mus musculus
atgttcctggccaggtgaccccgaa

SEQ ID NO: 9900 - DNA, 25 bp, Mus musculus
atgttcgaaggccacgacaccacca

SEQ ID NO: 9901 - DNA, 25 bp, Mus musculus
atgttcggactgtgcgggccttcgc

SEQ ID NO: 9902 - DNA, 25 bp, Mus musculus
atgttgatgaatctgcagccacaga

SEQ ID NO: 9903 - DNA, 25 bp, Mus musculus
atgttgatgaatgtgcagccacaga

SEQ ID NO: 9904 - DNA, 25 bp, Mus musculus
atgttgcaaaatctactccctgaag

SEQ ID NO: 9905 - DNA, 25 bp, Mus musculus
atgttgcacacctcttcaccagcag

SEQ ID NO: 9906 - DNA, 25 bp, Mus musculus
atgttggaagatgccagcgactgca

SEQ ID NO: 9907 - DNA, 25 bp, Mus musculus
atgttggagacctgggcaatgtgac

SEQ ID NO: 9908 - DNA, 25 bp, Mus musculus
atgttgttaccctgtgtcgctgtgc

SEQ ID NO: 9909 - DNA, 25 bp, Mus musculus
atgtttacagcgcagtcttaccgaa

SEQ ID NO: 9910 - DNA, 25 bp, Mus musculus
atgtttacagcggagtcttaccgaa

SEQ ID NO: 9911 - DNA, 25 bp, Mus musculus
atgtttcggaacctcagaattccag

SEQ ID NO: 9912 - DNA, 25 bp, Mus musculus
atgtttgcggttggatagcattgag

SEQ ID NO: 9913 - DNA, 25 bp, Mus musculus
atgtttgtacaggaagaggccctgg

SEQ ID NO: 9914 - DNA, 25 bp, Mus musculus
attaaaacggcgctcaagtacactt

SEQ ID NO: 9915 - DNA, 25 bp, Mus musculus
attaaagtcatccacttgctggtct

SEQ ID NO: 9916 - DNA, 25 bp, Mus musculus
attaacaagtggtggaatagcctaa

SEQ ID NO: 9917 - DNA, 25 bp, Mus musculus
attaacaggcccaacacacccaaga

SEQ ID NO: 9918 - DNA, 25 bp, Mus musculus
attaacagggttgcagcgcaggctg

SEQ ID NO: 9919 - DNA, 25 bp, Mus musculus
attaaccttgcaagaactcttcagg

SEQ ID NO: 9920 - DNA, 25 bp, Mus musculus
attaaggcctacctatctggaacag

SEQ ID NO: 9921 - DNA, 25 bp, Mus musculus
attacaacggcgagcggacactgga

SEQ ID NO: 9922 - DNA, 25 bp, Mus musculus
attaccaaacctcagactgctggca

SEQ ID NO: 9923 - DNA, 25 bp, Mus musculus
attaccaaacctgagactgctggca

SEQ ID NO: 9924 - DNA, 25 bp, Mus musculus
attaccacaccctgcggatcggcgg

SEQ ID NO: 9925 - DNA, 25 bp, Mus musculus
attaccagcgcctgtccgatgtcct

SEQ ID NO: 9926 - DNA, 25 bp, Mus musculus
attaccaggccgtcgggaagctcct

SEQ ID NO: 9927 - DNA, 25 bp, Mus musculus
attacgtgcattgacttgggatggg

SEQ ID NO: 9928 - DNA, 25 bp, Mus musculus
attacgtgggttataggacaggacg

SEQ ID NO: 9929 - DNA, 25 bp, Mus musculus
attactacaggactgacatcacatg

SEQ ID NO: 9930 - DNA, 25 bp, Mus musculus
attagaaggcataattcctggagca

SEQ ID NO: 9931 - DNA, 25 bp, Mus musculus
attagaaggcattattcctggagca

SEQ ID NO: 9932 - DNA, 25 bp, Mus musculus
attagaagtagagctgacacctcag

SEQ ID NO: 9933 - DNA, 25 bp, Mus musculus
attagagcagtttgaaggtggcccc

SEQ ID NO: 9934 - DNA, 25 bp, Mus musculus
attagagggaaaagaagcaatccca

SEQ ID NO: 9935 - DNA, 25 bp, Mus musculus
attagatgccctcaaatggagttat

SEQ ID NO: 9936 - DNA, 25 bp, Mus musculus
attagatgccctgaaatggagttat

SEQ ID NO: 9937 - DNA, 25 bp, Mus musculus
attagcatgacagggctgcatggag

SEQ ID NO: 9938 - DNA, 25 bp, Mus musculus
attagccgattagctgatgactccg

SEQ ID NO: 9939 - DNA, 25 bp, Mus musculus
attagcgacgagctggaccacgccc

SEQ ID NO: 9940 - DNA, 25 bp, Mus musculus
attaggaactacactggcaccccgg

SEQ ID NO: 9941 - DNA, 25 bp, Mus musculus
attaggccggctggagccctgggag

SEQ ID NO: 9942 - DNA, 25 bp, Mus musculus
attagggcaagggatgaagtaccac

SEQ ID NO: 9943 - DNA, 25 bp, Mus musculus
attataagagggtcacaggcaccag

SEQ ID NO: 9944 - DNA, 25 bp, Mus musculus
attatacagggatgtgacattggag

SEQ ID NO: 9945 - DNA, 25 bp, Mus musculus
attataccttcagccctggacttcg

SEQ ID NO: 9946 - DNA, 25 bp, Mus musculus
attatattatgtctcccagcgtggg

SEQ ID NO: 9947 - DNA, 25 bp, Mus musculus
attatattctacacttccaccccag

SEQ ID NO: 9948 - DNA, 25 bp, Mus musculus
attatattgatgcagaagacctgag

SEQ ID NO: 9949 - DNA, 25 bp, Mus musculus
attatatttctagagctgagtctca

SEQ ID NO: 9950 - DNA, 25 bp, Mus musculus
attatcaggagaacagatcagtgga

SEQ ID NO: 9951 - DNA, 25 bp, Mus musculus
attatccccgaaaatttgagactgc

SEQ ID NO: 9952 - DNA, 25 bp, Mus musculus
attatcgacggcgccgcctcagagg

SEQ ID NO: 9953 - DNA, 25 bp, Mus musculus
attatctcatccacagacaaacttg

SEQ ID NO: 9954 - DNA, 25 bp, Mus musculus
attatgagaagaaatagagaccggt

SEQ ID NO: 9955 - DNA, 25 bp, Mus musculus
attatgagaagaaccaggaggacag

SEQ ID NO: 9956 - DNA, 25 bp, Mus musculus
attatgagaccaactgatgtaccag

SEQ ID NO: 9957 - DNA, 25 bp, Mus musculus
attatgatatccattcctgtgggac

SEQ ID NO: 9958 - DNA, 25 bp, Mus musculus
attatgcaggctaggctgaccctga

SEQ ID NO: 9959 - DNA, 25 bp, Mus musculus
attatggagattgccatcattgcag

SEQ ID NO: 9960 - DNA, 25 bp, Mus musculus
attatgtttgtctgcctgtgctcat

SEQ ID NO: 9961 - DNA, 25 bp, Mus musculus
attattataccttcagccctggact

SEQ ID NO: 9962 - DNA, 25 bp, Mus musculus
attattccttattcagcagtcatgg

SEQ ID NO: 9963 - DNA, 25 bp, Mus musculus
attattcgagaaagcctccttcctg

SEQ ID NO: 9964 - DNA, 25 bp, Mus musculus
attcaaagagaagggctctgagctg

SEQ ID NO: 9965 - DNA, 25 bp, Mus musculus
attcaacgaccctgccatggctcag

SEQ ID NO: 9966 - DNA, 25 bp, Mus musculus
attcaacttacagggcagagccaag

SEQ ID NO: 9967 - DNA, 25 bp, Mus musculus
attcaagcttctatttctggaggcc

SEQ ID NO: 9968 - DNA, 25 bp, Mus musculus
attcaataccgcctgggtatttggg

SEQ ID NO: 9969 - DNA, 25 bp, Mus musculus
attcaatacctcattcctgggtaca

SEQ ID NO: 9970 - DNA, 25 bp, Mus musculus
attcaatagagttcggacaattcag

SEQ ID NO: 9971 - DNA, 25 bp, Mus musculus
attcacacttataccagcctcctgg

SEQ ID NO: 9972 - DNA, 25 bp, Mus musculus
attcacacttctcttgaaagtgcag

SEQ ID NO: 9973 - DNA, 25 bp, Mus musculus
attcaccaggtgacgatacagaaag

SEQ ID NO: 9974 - DNA, 25 bp, Mus musculus
attcacccgcatgagccagcgagag

SEQ ID NO: 9975 - DNA, 25 bp, Mus musculus
attcacctgagggacacttggctgg

SEQ ID NO: 9976 - DNA, 25 bp, Mus musculus
attcactcaagctacacatacacag

SEQ ID NO: 9977 - DNA, 25 bp, Mus musculus
attcagagaggtgacagaacttatt

SEQ ID NO: 9978 - DNA, 25 bp, Mus musculus
attcagagctggagtgagactgtgt

SEQ ID NO: 9979 - DNA, 25 bp, Mus musculus
attcagcattggctcagagagtcag

SEQ ID NO: 9980 - DNA, 25 bp, Mus musculus
attcagctgctctccacagaaacct

SEQ ID NO: 9981 - DNA, 25 bp, Mus musculus
attcaggaaggcctgagaccatgga

SEQ ID NO: 9982 - DNA, 25 bp, Mus musculus
attcaggacgcccagcaccaaaata

SEQ ID NO: 9983 - DNA, 25 bp, Mus musculus
attcagtctcctcgaccacttgccg

SEQ ID NO: 9984 - DNA, 25 bp, Mus musculus
attcagttagcccaccacagaggag

SEQ ID NO: 9985 - DNA, 25 bp, Mus musculus
attcatcactcactctttggagatg

SEQ ID NO: 9986 - DNA, 25 bp, Mus musculus
attcatctggaaagactatcgctga

SEQ ID NO: 9987 - DNA, 25 bp, Mus musculus
attccaactgttagcaatgacgccg

SEQ ID NO: 9988 - DNA, 25 bp, Mus musculus
attccaaggacttatcccaaagcct

SEQ ID NO: 9989 - DNA, 25 bp, Mus musculus
attccaaggctgaagtaaggtttca

SEQ ID NO: 9990 - DNA, 25 bp, Mus musculus
attccacccctgttcacagtcagtg

SEQ ID NO: 9991 - DNA, 25 bp, Mus musculus
attccagagagaaaatgggaccttc

SEQ ID NO: 9992 - DNA, 25 bp, Mus musculus
attccagagtaatcaattggcccag

SEQ ID NO: 9993 - DNA, 25 bp, Mus musculus
attccagatgcctggccaatctgcc

SEQ ID NO: 9994 - DNA, 25 bp, Mus musculus
attccataagtatgcctgccatgag

SEQ ID NO: 9995 - DNA, 25 bp, Mus musculus
attccatggctttgcaccttgcacg

SEQ ID NO: 9996 - DNA, 25 bp, Mus musculus
attcccagagtatggcctcagaacc

SEQ ID NO: 9997 - DNA, 25 bp, Mus musculus
attccccaaggagacagaggccaag

SEQ ID NO: 9998 - DNA, 25 bp, Mus musculus
attccccgagcttccagaaatcctg

SEQ ID NO: 9999 - DNA, 25 bp, Mus musculus
attcccggcctggtggtctcatgcg

SEQ ID NO: 10000 - DNA, 25 bp, Mus musculus
attcccttctcccagggtggtggca

SEQ ID NO: 10001 - DNA, 25 bp, Mus musculus
attcctagctacattcgagactcca

SEQ ID NO: 10002 - DNA, 25 bp, Mus musculus
attcctcacagcaatgaaaagccac

SEQ ID NO: 10003 - DNA, 25 bp, Mus musculus
attcctgtgcacctgggtgccatgc

SEQ ID NO: 10004 - DNA, 25 bp, Mus musculus
attccttgtccagtgagctgcagca

SEQ ID NO: 10005 - DNA, 25 bp, Mus musculus
attcctttgtgatcggctcgggctg

SEQ ID NO: 10006 - DNA, 25 bp, Mus musculus
attcgagtgggcacccgtaagagcc

SEQ ID NO: 10007 - DNA, 25 bp, Mus musculus
attcgagttaatccaagagtgagca

SEQ ID NO: 10008 - DNA, 25 bp, Mus musculus
attcgattagcatgcctgctatgag

SEQ ID NO: 10009 - DNA, 25 bp, Mus musculus
attcgctaccatcgccctgaggaga

SEQ ID NO: 10010 - DNA, 25 bp, Mus musculus
attcgcttagcagaagcccatgcta

SEQ ID NO: 10011 - DNA, 25 bp, Mus musculus
attcggcaccaacgtgatggtgaca

SEQ ID NO: 10012 - DNA, 25 bp, Mus musculus
attcggcttctttttcaacatgctc

SEQ ID NO: 10013 - DNA, 25 bp, Mus musculus
attcggtaccgcctgcactttctgc

SEQ ID NO: 10014 - DNA, 25 bp, Mus musculus
attcgtaagggctggctgaccgtca

SEQ ID NO: 10015 - DNA, 25 bp, Mus musculus
attcgtgtttgtgctgtccagcttc

SEQ ID NO: 10016 - DNA, 25 bp, Mus musculus
attctaccaaaaagggcacaatgcg

SEQ ID NO: 10017 - DNA, 25 bp, Mus musculus
attctaccagacagcttacctctag

SEQ ID NO: 10018 - DNA, 25 bp, Mus musculus
attctagacgtaccgcggagtgcgt

SEQ ID NO: 10019 - DNA, 25 bp, Mus musculus
attctcaagggctgggaaataaagc

SEQ ID NO: 10020 - DNA, 25 bp, Mus musculus
attctcactacaggacatgaagctg

SEQ ID NO: 10021 - DNA, 25 bp, Mus musculus
attctccgagtcaagtcagaggagg

SEQ ID NO: 10022 - DNA, 25 bp, Mus musculus
attctctgttgccagcgccagcagg

SEQ ID NO: 10023 - DNA, 25 bp, Mus musculus
attctcttggactgaccccgacagg

SEQ ID NO: 10024 - DNA, 25 bp, Mus musculus
attctctttgagatgctggttgggc

SEQ ID NO: 10025 - DNA, 25 bp, Mus musculus
attctgccgtgcaggcaggccttga

SEQ ID NO: 10026 - DNA, 25 bp, Mus musculus
attctgctgagacctggagcgtcag

SEQ ID NO: 10027 - DNA, 25 bp, Mus musculus
attctgctgttcctgcccaagagtg

SEQ ID NO: 10028 - DNA, 25 bp, Mus musculus
attctggaactctcttggagggagg

SEQ ID NO: 10029 - DNA, 25 bp, Mus musculus
attctggaggatacaaacaacagca

SEQ ID NO: 10030 - DNA, 25 bp, Mus musculus
attctggccagtggtggaccccaag

SEQ ID NO: 10031 - DNA, 25 bp, Mus musculus
attctggtcactggatcctctggag

SEQ ID NO: 10032 - DNA, 25 bp, Mus musculus
attctggtgctaagaaaccatggca

SEQ ID NO: 10033 - DNA, 25 bp, Mus musculus
attcttccacctcggcggaaaactg

SEQ ID NO: 10034 - DNA, 25 bp, Mus musculus
attcttcccaccccgatgacaatgg

SEQ ID NO: 10035 - DNA, 25 bp, Mus musculus
attcttcgggacacccagtcatctt

SEQ ID NO: 10036 - DNA, 25 bp, Mus musculus
attcttggtctccaaaaacgagaga

SEQ ID NO: 10037 - DNA, 25 bp, Mus musculus
attcttgttcctaggtggacacacc

SEQ ID NO: 10038 - DNA, 25 bp, Mus musculus
attctttgccccatacctttacacg

SEQ ID NO: 10039 - DNA, 25 bp, Mus musculus
attctttgtaagtgaccccaacaag

SEQ ID NO: 10040 - DNA, 25 bp, Mus musculus
attgaaaatatccaactaccgcaca

SEQ ID NO: 10041 - DNA, 25 bp, Mus musculus
attgaaacaatggaggcagcagggc

SEQ ID NO: 10042 - DNA, 25 bp, Mus musculus
attgaaactcgccaggatggtgtct

SEQ ID NO: 10043 - DNA, 25 bp, Mus musculus
attgaaatggcgattgagacgctgc

SEQ ID NO: 10044 - DNA, 25 bp, Mus musculus
attgaacacatatctagcctcatca

SEQ ID NO: 10045 - DNA, 25 bp, Mus musculus
attgaacatgcacagaaagagcttc

SEQ ID NO: 10046 - DNA, 25 bp, Mus musculus
attgaagaaagctgggctgagtctt

SEQ ID NO: 10047 - DNA, 25 bp, Mus musculus
attgaatcccatgtgagccatcatg

SEQ ID NO: 10048 - DNA, 25 bp, Mus musculus
attgaatctctgctctggaaagttc

SEQ ID NO: 10049 - DNA, 25 bp, Mus musculus
attgaatgcactccatcttgcttcc

SEQ ID NO: 10050 - DNA, 25 bp, Mus musculus
attgacccctgtgagccgagctcag

SEQ ID NO: 10051 - DNA, 25 bp, Mus musculus
attgacttgatgcaaaacaccacaa

SEQ ID NO: 10052 - DNA, 25 bp, Mus musculus
attgagaccctacatggctccctgc

SEQ ID NO: 10053 - DNA, 25 bp, Mus musculus
attgagaggatggtgcgcaccgacc

SEQ ID NO: 10054 - DNA, 25 bp, Mus musculus
attgagataagcagagacgggagaa

SEQ ID NO: 10055 - DNA, 25 bp, Mus musculus
attgagcaagggtgaaagagacaga

SEQ ID NO: 10056 - DNA, 25 bp, Mus musculus
attgagcaggtggacatgctagaga

SEQ ID NO: 10057 - DNA, 25 bp, Mus musculus
attgagctggagaagcatatctccc

SEQ ID NO: 10058 - DNA, 25 bp, Mus musculus
attgaggagcccgtgcgccagaaga

SEQ ID NO: 10059 - DNA, 25 bp, Mus musculus
attgagtccagctctaccatcctca

SEQ ID NO: 10060 - DNA, 25 bp, Mus musculus
attgagtgacgtaatccacccaggg

SEQ ID NO: 10061 - DNA, 25 bp, Mus musculus
attgatccttgacgaccccacgcta

SEQ ID NO: 10062 - DNA, 25 bp, Mus musculus
attgatctgcacacaaatgttgcca

SEQ ID NO: 10063 - DNA, 25 bp, Mus musculus
attgatgtgtctaatgggaaagtcc

SEQ ID NO: 10064 - DNA, 25 bp, Mus musculus
attgattcactgagtgagcaggtgt

SEQ ID NO: 10065 - DNA, 25 bp, Mus musculus
attgatttcccagctgacccgaggc

SEQ ID NO: 10066 - DNA, 25 bp, Mus musculus
attgcacagacacccggaagaggag

SEQ ID NO: 10067 - DNA, 25 bp, Mus musculus
attgcagacagcgacacgccgacta

SEQ ID NO: 10068 - DNA, 25 bp, Mus musculus
attgcagatgttagtcaggagggac

SEQ ID NO: 10069 - DNA, 25 bp, Mus musculus
attgcaggccctgtgtcgcgctgac

SEQ ID NO: 10070 - DNA, 25 bp, Mus musculus
attgcagggtttagtgccgctgtga

SEQ ID NO: 10071 - DNA, 25 bp, Mus musculus
attgcagggttttgtgccgctgtga

SEQ ID NO: 10072 - DNA, 25 bp, Mus musculus
attgcatatgcccatagtaccatca

SEQ ID NO: 10073 - DNA, 25 bp, Mus musculus
attgccacaatctctccaggaatgg

SEQ ID NO: 10074 - DNA, 25 bp, Mus musculus
attgccacagcagtgaagttcctac

SEQ ID NO: 10075 - DNA, 25 bp, Mus musculus
attgccagggcaacaggtgtagcag

SEQ ID NO: 10076 - DNA, 25 bp, Mus musculus
attgccatcgtgacggagagccggt

SEQ ID NO: 10077 - DNA, 25 bp, Mus musculus
attgccccagagaagattgaaaatg

SEQ ID NO: 10078 - DNA, 25 bp, Mus musculus
attgccggacaccactgcagaaggg

SEQ ID NO: 10079 - DNA, 25 bp, Mus musculus
attgccgtgactcgaaatccccaga

SEQ ID NO: 10080 - DNA, 25 bp, Mus musculus
attgccttgcccaaacctacgtcta

SEQ ID NO: 10081 - DNA, 25 bp, Mus musculus
attgccttgccctaacctacgtcta

SEQ ID NO: 10082 - DNA, 25 bp, Mus musculus
attgcgggtgggaccctggccattc

SEQ ID NO: 10083 - DNA, 25 bp, Mus musculus
attgctccctcaggcgtgcaaaagg

SEQ ID NO: 10084 - DNA, 25 bp, Mus musculus
attgctcttaaactcggtgtaaccg

SEQ ID NO: 10085 - DNA, 25 bp, Mus musculus
attgctgaaactggcccgaaactgg

SEQ ID NO: 10086 - DNA, 25 bp, Mus musculus
attgctgaaggtttcccgagacaag

SEQ ID NO: 10087 - DNA, 25 bp, Mus musculus
attgctgatgaaggaacatggactt

SEQ ID NO: 10088 - DNA, 25 bp, Mus musculus
attgctgggtatgccctggccctga

SEQ ID NO: 10089 - DNA, 25 bp, Mus musculus
attgcttcctctaccatctgggaga

SEQ ID NO: 10090 - DNA, 25 bp, Mus musculus
attgcttctatgtctacggtgccag

SEQ ID NO: 10091 - DNA, 25 bp, Mus musculus
attggaaccaaagtatgagaacccg

SEQ ID NO: 10092 - DNA, 25 bp, Mus musculus
attggacgtcgtcccttcagccagg

SEQ ID NO: 10093 - DNA, 25 bp, Mus musculus
attggagcatctctaatgtccagca

SEQ ID NO: 10094 - DNA, 25 bp, Mus musculus
attggagctatgactacgtggagga

SEQ ID NO: 10095 - DNA, 25 bp, Mus musculus
attggatttcatgatggagacccat

SEQ ID NO: 10096 - DNA, 25 bp, Mus musculus
attggccagcctctggctctagctc

SEQ ID NO: 10097 - DNA, 25 bp, Mus musculus
attggccgatgccacctcgaacagc

SEQ ID NO: 10098 - DNA, 25 bp, Mus musculus
attggccgccgcttcagtgaagagc

SEQ ID NO: 10099 - DNA, 25 bp, Mus musculus
attggccgtttgatgatggagctcc

SEQ ID NO: 10100 - DNA, 25 bp, Mus musculus
attggcctgttcgacctggaggtga

SEQ ID NO: 10101 - DNA, 25 bp, Mus musculus
attggctcagtcattcttggtggat

SEQ ID NO: 10102 - DNA, 25 bp, Mus musculus
attggctctctgatggacgactact

SEQ ID NO: 10103 - DNA, 25 bp, Mus musculus
attggctctttgtggtcgtggtctg

SEQ ID NO: 10104 - DNA, 25 bp, Mus musculus
attggctgctgacattgacatcgac

SEQ ID NO: 10105 - DNA, 25 bp, Mus musculus
attggctgcttgttgcgcctggagc

SEQ ID NO: 10106 - DNA, 25 bp, Mus musculus
attgggaagactgtctccagtgcaa

SEQ ID NO: 10107 - DNA, 25 bp, Mus musculus
attgggaagccctaaactcggagca

SEQ ID NO: 10108 - DNA, 25 bp, Mus musculus
attgggcagggctatgtgattcctg

SEQ ID NO: 10109 - DNA, 25 bp, Mus musculus
attgggcccggcatgttcccgtcat

SEQ ID NO: 10110 - DNA, 25 bp, Mus musculus
attgggcctgtatccttccccgagg

SEQ ID NO: 10111 - DNA, 25 bp, Mus musculus
attgggcgccagttccggaacgaag

SEQ ID NO: 10112 - DNA, 25 bp, Mus musculus
attgggcgggccattggccacttgc

SEQ ID NO: 10113 - DNA, 25 bp, Mus musculus
attgggcgggcctttggccacttgc

SEQ ID NO: 10114 - DNA, 25 bp, Mus musculus
attgggctaataggcctcattggtc

SEQ ID NO: 10115 - DNA, 25 bp, Mus musculus
attgggctgacttttcttatgctgg

SEQ ID NO: 10116 - DNA, 25 bp, Mus musculus
attggtaccgcgcacaacagaaggg

SEQ ID NO: 10117 - DNA, 25 bp, Mus musculus
attggtctcatctgtccgtcagaga

SEQ ID NO: 10118 - DNA, 25 bp, Mus musculus
attggtggaggtaggaactttgact

SEQ ID NO: 10119 - DNA, 25 bp, Mus musculus
attggtggaggttggaactttgact

SEQ ID NO: 10120 - DNA, 25 bp, Mus musculus
attggtggcctagcaacctccaaag

SEQ ID NO: 10121 - DNA, 25 bp, Mus musculus
attggtgtaggtataccgacaatta

SEQ ID NO: 10122 - DNA, 25 bp, Mus musculus
attggttattgttagactcactgaa

SEQ ID NO: 10123 - DNA, 25 bp, Mus musculus
attggttctgcactgccgcgcctgg

SEQ ID NO: 10124 - DNA, 25 bp, Mus musculus
attggttgcccacaggattgacttg

SEQ ID NO: 10125 - DNA, 25 bp, Mus musculus
attgtaagattgtactccaagccgg

SEQ ID NO: 10126 - DNA, 25 bp, Mus musculus
attgtaggtgaagtgctaaaacagt

SEQ ID NO: 10127 - DNA, 25 bp, Mus musculus
attgtcagcatggtctcctccggct

SEQ ID NO: 10128 - DNA, 25 bp, Mus musculus
attgtcagccacttgaagaaacaag

SEQ ID NO: 10129 - DNA, 25 bp, Mus musculus
attgtccttttaggatgcggccttg

SEQ ID NO: 10130 - DNA, 25 bp, Mus musculus
attgtcgtcactgtggcctttgttc

SEQ ID NO: 10131 - DNA, 25 bp, Mus musculus
attgtctcttcggagccttggcagt

SEQ ID NO: 10132 - DNA, 25 bp, Mus musculus
attgtgagtgtgttgcgagccaagc

SEQ ID NO: 10133 - DNA, 25 bp, Mus musculus
attgtgctcccgctcagcctgcaga

SEQ ID NO: 10134 - DNA, 25 bp, Mus musculus
attgtgctcctgcagcacaatcgag

SEQ ID NO: 10135 - DNA, 25 bp, Mus musculus
attgtggactatcgcacccgctgga

SEQ ID NO: 10136 - DNA, 25 bp, Mus musculus
attgtggcaccgtataagatagagc

SEQ ID NO: 10137 - DNA, 25 bp, Mus musculus
attgtggcctgaggacaggaatact

SEQ ID NO: 10138 - DNA, 25 bp, Mus musculus
attgtggctcttgtgggccagtctg

SEQ ID NO: 10139 - DNA, 25 bp, Mus musculus
attgtgggacccgtggagcacgaca

SEQ ID NO: 10140 - DNA, 25 bp, Mus musculus
attgtgggccaaagcaatgagcgag

SEQ ID NO: 10141 - DNA, 25 bp, Mus musculus
attgtgtaggcggaactcgagtgca

SEQ ID NO: 10142 - DNA, 25 bp, Mus musculus
attgtgtggaccaaggctgggcaca

SEQ ID NO: 10143 - DNA, 25 bp, Mus musculus
attgttcccacagtgcatcattgag

SEQ ID NO: 10144 - DNA, 25 bp, Mus musculus
attgttggttcacagggaagtcgcc

SEQ ID NO: 10145 - DNA, 25 bp, Mus musculus
attgttgtgtctgtggcttccctgg

SEQ ID NO: 10146 - DNA, 25 bp, Mus musculus
attgtttcaggccaaattgggacag

SEQ ID NO: 10147 - DNA, 25 bp, Mus musculus
attgtttgttaaccggcttgattcg

SEQ ID NO: 10148 - DNA, 25 bp, Mus musculus
attgttttgaagaacacctggccaa

SEQ ID NO: 10149 - DNA, 25 bp, Mus musculus
atttaagctcgactacagccgggac

SEQ ID NO: 10150 - DNA, 25 bp, Mus musculus
atttacaagagttttcggccaggtg

SEQ ID NO: 10151 - DNA, 25 bp, Mus musculus
atttaccaagtgtactgcaacagca

SEQ ID NO: 10152 - DNA, 25 bp, Mus musculus
atttaccttatgagcctcccaggag

SEQ ID NO: 10153 - DNA, 25 bp, Mus musculus
atttactggccataccatacacaag

SEQ ID NO: 10154 - DNA, 25 bp, Mus musculus
atttatcggcctggctggaacaggg

SEQ ID NO: 10155 - DNA, 25 bp, Mus musculus
atttatgagcggcttgcttcagcct

SEQ ID NO: 10156 - DNA, 25 bp, Mus musculus
atttattacaccagagccattgaat

SEQ ID NO: 10157 - DNA, 25 bp, Mus musculus
atttcaaagcccaagacgtttcagg

SEQ ID NO: 10158 - DNA, 25 bp, Mus musculus
atttcaaggtggacgaggacggcac

SEQ ID NO: 10159 - DNA, 25 bp, Mus musculus
atttcaaggtggtcgaggacggcac

SEQ ID NO: 10160 - DNA, 25 bp, Mus musculus
atttcaggcaggtgtcaccataccc

SEQ ID NO: 10161 - DNA, 25 bp, Mus musculus
atttccccacaagaactgagagttc

SEQ ID NO: 10162 - DNA, 25 bp, Mus musculus
atttccttatgtcaagaagccttct

SEQ ID NO: 10163 - DNA, 25 bp, Mus musculus
atttcgaccgcatcgcccagatggg

SEQ ID NO: 10164 - DNA, 25 bp, Mus musculus
atttcggaggcactggaatcctagc

SEQ ID NO: 10165 - DNA, 25 bp, Mus musculus
atttcggtcgtagggatctggatga

SEQ ID NO: 10166 - DNA, 25 bp, Mus musculus
atttctacctgaaacttgaagaagg

SEQ ID NO: 10167 - DNA, 25 bp, Mus musculus
atttctagagctgagtctcagagca

SEQ ID NO: 10168 - DNA, 25 bp, Mus musculus
atttctcagctgatgaggcgctagg

SEQ ID NO: 10169 - DNA, 25 bp, Mus musculus
atttctcccgactcagcctacataa

SEQ ID NO: 10170 - DNA, 25 bp, Mus musculus
atttctcgaatgctggcagccaaaa

SEQ ID NO: 10171 - DNA, 25 bp, Mus musculus
atttctcgggattagaagaggctgt

SEQ ID NO: 10172 - DNA, 25 bp, Mus musculus
atttctttgtctggatgatccacca

SEQ ID NO: 10173 - DNA, 25 bp, Mus musculus
atttgaacacctgtctccgctgcag

SEQ ID NO: 10174 - DNA, 25 bp, Mus musculus
atttgaactccgaagggaaatcaag

SEQ ID NO: 10175 - DNA, 25 bp, Mus musculus
atttgaccaggaggccgcagcagtc

SEQ ID NO: 10176 - DNA, 25 bp, Mus musculus
atttgacctcatagatcattctgac

SEQ ID NO: 10177 - DNA, 25 bp, Mus musculus
atttgacggacctaggaaaattctg

SEQ ID NO: 10178 - DNA, 25 bp, Mus musculus
atttgacggagaaggcctggcttcc

SEQ ID NO: 10179 - DNA, 25 bp, Mus musculus
atttgagcaacccttaccccagtga

SEQ ID NO: 10180 - DNA, 25 bp, Mus musculus
atttgatagcctagaagaaagcagg

SEQ ID NO: 10181 - DNA, 25 bp, Mus musculus
atttgatcccgcagctcgccggctt

SEQ ID NO: 10182 - DNA, 25 bp, Mus musculus
atttgatcccgctgctcgccggctt

SEQ ID NO: 10183 - DNA, 25 bp, Mus musculus
atttgatgacacaaacccagaaaag

SEQ ID NO: 10184 - DNA, 25 bp, Mus musculus
atttgatgacgatgctacgggaagc

SEQ ID NO: 10185 - DNA, 25 bp, Mus musculus
atttgattatgtggcacagcaggaa

SEQ ID NO: 10186 - DNA, 25 bp, Mus musculus
atttgcagtgtagttggccaacaag

SEQ ID NO: 10187 - DNA, 25 bp, Mus musculus
atttgccatccctgataaaccacgg

SEQ ID NO: 10188 - DNA, 25 bp, Mus musculus
atttgctcccaagacggactctgag

SEQ ID NO: 10189 - DNA, 25 bp, Mus musculus
atttgctgggataaggcgggacatt

SEQ ID NO: 10190 - DNA, 25 bp, Mus musculus
atttggaaccacagacatcctggaa

SEQ ID NO: 10191 - DNA, 25 bp, Mus musculus
atttggaccaaaggcctgcgtgctg

SEQ ID NO: 10192 - DNA, 25 bp, Mus musculus
atttggaccaaatcagcgcccagcc

SEQ ID NO: 10193 - DNA, 25 bp, Mus musculus
atttggagctgggaactccggctcc

SEQ ID NO: 10194 - DNA, 25 bp, Mus musculus
atttggattctaggacctcctcgaa

SEQ ID NO: 10195 - DNA, 25 bp, Mus musculus
atttgggctgtcagcttcgggccca

SEQ ID NO: 10196 - DNA, 25 bp, Mus musculus
atttggtcagttgggtgcatcatgg

SEQ ID NO: 10197 - DNA, 25 bp, Mus musculus
atttgtatacagatgaggatgaaga

SEQ ID NO: 10198 - DNA, 25 bp, Mus musculus
atttgtctcagcagctggttgagcc

SEQ ID NO: 10199 - DNA, 25 bp, Mus musculus
atttgtctcagctgctggttgagcc

SEQ ID NO: 10200 - DNA, 25 bp, Mus musculus
atttgtcttcggcaaagcggaagtt

SEQ ID NO: 10201 - DNA, 25 bp, Mus musculus
atttgtgaaggcctcggcgttcgcc

SEQ ID NO: 10202 - DNA, 25 bp, Mus musculus
attttaaccccagtgagaacctgca

SEQ ID NO: 10203 - DNA, 25 bp, Mus musculus
attttcagtttagatcttggaggca

SEQ ID NO: 10204 - DNA, 25 bp, Mus musculus
attttccaagtcaagaccgactgaa

SEQ ID NO: 10205 - DNA, 25 bp, Mus musculus
attttccactcacgagagtgcggcc

SEQ ID NO: 10206 - DNA, 25 bp, Mus musculus
attttccatatatcctggttctgcc

SEQ ID NO: 10207 - DNA, 25 bp, Mus musculus
attttctagacacatacaagctgcc

SEQ ID NO: 10208 - DNA, 25 bp, Mus musculus
attttctagacagatacaagctgcc

SEQ ID NO: 10209 - DNA, 25 bp, Mus musculus
attttctgatcctgagccatctctg

SEQ ID NO: 10210 - DNA, 25 bp, Mus musculus
attttcttcagcctcctcgtcctag

SEQ ID NO: 10211 - DNA, 25 bp, Mus musculus
attttgatggcagagcccaagatgt

SEQ ID NO: 10212 - DNA, 25 bp, Mus musculus
attttgcctcagtaccgggatgctg

SEQ ID NO: 10213 - DNA, 25 bp, Mus musculus
attttggagtaagcgcattcttagc

SEQ ID NO: 10214 - DNA, 25 bp, Mus musculus
attttgggagttgcagctacgccag

SEQ ID NO: 10215 - DNA, 25 bp, Mus musculus
attttgtggtggatgcaacccgaaa

SEQ ID NO: 10216 - DNA, 25 bp, Mus musculus
atttttcctctctgcggtgtccagc

SEQ ID NO: 10217 - DNA, 25 bp, Mus musculus
atttttctccaagggcagttgacta

SEQ ID NO: 10218 - DNA, 25 bp, Mus musculus
caaaaaacactgttattgctactgg

SEQ ID NO: 10219 - DNA, 25 bp, Mus musculus
caaaaaacataacttcacgcccctg

SEQ ID NO: 10220 - DNA, 25 bp, Mus musculus
caaaaaactcatacagaacaagaac

SEQ ID NO: 10221 - DNA, 25 bp, Mus musculus
caaaaaagacgtgcttgaaggacgg

SEQ ID NO: 10222 - DNA, 25 bp, Mus musculus
caaaaaagctaagcggcacgaagta

SEQ ID NO: 10223 - DNA, 25 bp, Mus musculus
caaaaaatggccaagctgacagctg

SEQ ID NO: 10224 - DNA, 25 bp, Mus musculus
caaaaaatttgccatttaccgatgg

SEQ ID NO: 10225 - DNA, 25 bp, Mus musculus
caaaaacactggtcctgtaaacaag

SEQ ID NO: 10226 - DNA, 25 bp, Mus musculus
caaaaacagtctcgtaagcccagcc

SEQ ID NO: 10227 - DNA, 25 bp, Mus musculus
caaaaacagttgagctctgtaggga

SEQ ID NO: 10228 - DNA, 25 bp, Mus musculus
caaaaacctgattggcggctattac

SEQ ID NO: 10229 - DNA, 25 bp, Mus musculus
caaaaacggtattatgaaaagctga

SEQ ID NO: 10230 - DNA, 25 bp, Mus musculus
caaaaacgtgttcatccaagtgcca

SEQ ID NO: 10231 - DNA, 25 bp, Mus musculus
caaaaactctgtaaaaatgaccctg

SEQ ID NO: 10232 - DNA, 25 bp, Mus musculus
caaaaactgcaatgtggatccaaga

SEQ ID NO: 10233 - DNA, 25 bp, Mus musculus
caaaaactgcacagccatctgggag

SEQ ID NO: 10234 - DNA, 25 bp, Mus musculus
caaaaacttgcctgttggagaggca

SEQ ID NO: 10235 - DNA, 25 bp, Mus musculus
caaaaagaagatatcaaagcctccc

SEQ ID NO: 10236 - DNA, 25 bp, Mus musculus
caaaaagaagtgaatgtcaccacac

SEQ ID NO: 10237 - DNA, 25 bp, Mus musculus
caaaaagaatacagggaagtttcag

SEQ ID NO: 10238 - DNA, 25 bp, Mus musculus
caaaaagaatgccatatccttccag

SEQ ID NO: 10239 - DNA, 25 bp, Mus musculus
caaaaagagtgagcttatcctggac

SEQ ID NO: 10240 - DNA, 25 bp, Mus musculus
caaaaagatggcaaagcaaggccag

SEQ ID NO: 10241 - DNA, 25 bp, Mus musculus
caaaaagcacttacagggagcggcc

SEQ ID NO: 10242 - DNA, 25 bp, Mus musculus
caaaaagcagctagtgagaccggat

SEQ ID NO: 10243 - DNA, 25 bp, Mus musculus
caaaaagccgaccaagaaccagata

SEQ ID NO: 10244 - DNA, 25 bp, Mus musculus
caaaaaggagaattaatgatagggt

SEQ ID NO: 10245 - DNA, 25 bp, Mus musculus
caaaaaggccaacggcgtcttcagc

SEQ ID NO: 10246 - DNA, 25 bp, Mus musculus
caaaaaggctagaagaataaaggca

SEQ ID NO: 10247 - DNA, 25 bp, Mus musculus
caaaaagggaagagaacttatatgc

SEQ ID NO: 10248 - DNA, 25 bp, Mus musculus
caaaaaggtcagcatcgctgtggtc

SEQ ID NO: 10249 - DNA, 25 bp, Mus musculus
caaaaatacgctgacgcaggaagag

SEQ ID NO: 10250 - DNA, 25 bp, Mus musculus
caaaaatactttgtcggctatctgg

SEQ ID NO: 10251 - DNA, 25 bp, Mus musculus
caaaaatcacgaaacaatgaatcag

SEQ ID NO: 10252 - DNA, 25 bp, Mus musculus
caaaaatcagatgcagagtgagcat

SEQ ID NO: 10253 - DNA, 25 bp, Mus musculus
caaaaatccagcagaaattgtcaaa

SEQ ID NO: 10254 - DNA, 25 bp, Mus musculus
caaaaatctccgctgtttctctgcg

SEQ ID NO: 10255 - DNA, 25 bp, Mus musculus
caaaaatctccggtgtttctctgcg

SEQ ID NO: 10256 - DNA, 25 bp, Mus musculus
caaaaatgccttggcattcaagcat

SEQ ID NO: 10257 - DNA, 25 bp, Mus musculus
caaaaatggaggacacttccaaaat

SEQ ID NO: 10258 - DNA, 25 bp, Mus musculus
caaaaatggatttgcctgtcccacc

SEQ ID NO: 10259 - DNA, 25 bp, Mus musculus
caaaaattgtctctgctttggacta

SEQ ID NO: 10260 - DNA, 25 bp, Mus musculus
caaaaatttggaacttggattgagt

SEQ ID NO: 10261 - DNA, 25 bp, Mus musculus
caaaacaaacccttgtggctccatt

SEQ ID NO: 10262 - DNA, 25 bp, Mus musculus
caaaacaaacgtgaaattcttggct

SEQ ID NO: 10263 - DNA, 25 bp, Mus musculus
caaaacaaccaagacatcacattca

SEQ ID NO: 10264 - DNA, 25 bp, Mus musculus
caaaacaattggctcagtcattctt

SEQ ID NO: 10265 - DNA, 25 bp, Mus musculus
caaaacagctcaaagtggacatgag

SEQ ID NO: 10266 - DNA, 25 bp, Mus musculus
caaaacagctgaggcagctactgga

SEQ ID NO: 10267 - DNA, 25 bp, Mus musculus
caaaacagctgtttgtgacaccaca

SEQ ID NO: 10268 - DNA, 25 bp, Mus musculus
caaaacatgcagtttatgtccagtc

SEQ ID NO: 10269 - DNA, 25 bp, Mus musculus
caaaacatgtctcaatccatagaag

SEQ ID NO: 10270 - DNA, 25 bp, Mus musculus
caaaacattatagagacggacaccc

SEQ ID NO: 10271 - DNA, 25 bp, Mus musculus
caaaaccaaagtggtggtcaccatg

SEQ ID NO: 10272 - DNA, 25 bp, Mus musculus
caaaaccaactgtgatctttacgag

SEQ ID NO: 10273 - DNA, 25 bp, Mus musculus
caaaaccacccagattggctgcttg

SEQ ID NO: 10274 - DNA, 25 bp, Mus musculus
caaaaccactccattgctagaaaga

SEQ ID NO: 10275 - DNA, 25 bp, Mus musculus
caaaaccaggagtgtgtactgaagg

SEQ ID NO: 10276 - DNA, 25 bp, Mus musculus
caaaaccatcacatatgagtctcca

SEQ ID NO: 10277 - DNA, 25 bp, Mus musculus
caaaaccatccgcaagtccctattg

SEQ ID NO: 10278 - DNA, 25 bp, Mus musculus
caaaaccattggtcccatctgtccg

SEQ ID NO: 10279 - DNA, 25 bp, Mus musculus
caaaacctaaagtttcatcaactct

SEQ ID NO: 10280 - DNA, 25 bp, Mus musculus
caaaacctgtctagaaagtgaccag

SEQ ID NO: 10281 - DNA, 25 bp, Mus musculus
caaaacctgtggagtccttcgcctc

SEQ ID NO: 10282 - DNA, 25 bp, Mus musculus
caaaacgacttgagaccattgctga

SEQ ID NO: 10283 - DNA, 25 bp, Mus musculus
caaaacgagattttaatccaagtgc

SEQ ID NO: 10284 - DNA, 25 bp, Mus musculus
caaaacggagctcatgtggtaccca

SEQ ID NO: 10285 - DNA, 25 bp, Mus musculus
caaaacggtatccactgtgttgcca

SEQ ID NO: 10286 - DNA, 25 bp, Mus musculus
caaaactaagcatcaacttctctac

SEQ ID NO: 10287 - DNA, 25 bp, Mus musculus
caaaactactagtgaagaagtcctc

SEQ ID NO: 10288 - DNA, 25 bp, Mus musculus
caaaactatcactttggtgttggcg

SEQ ID NO: 10289 - DNA, 25 bp, Mus musculus
caaaactatgcctctcctgtggtgg

SEQ ID NO: 10290 - DNA, 25 bp, Mus musculus
caaaactgaaaacacagcctatctg

SEQ ID NO: 10291 - DNA, 25 bp, Mus musculus
caaaactgacctgatttctgtactg

SEQ ID NO: 10292 - DNA, 25 bp, Mus musculus
caaaactgcagccatcatcacggca

SEQ ID NO: 10293 - DNA, 25 bp, Mus musculus
caaaactgctaaacgatgaggacca

SEQ ID NO: 10294 - DNA, 25 bp, Mus musculus
caaaactggacttcggtgtaaaatg

SEQ ID NO: 10295 - DNA, 25 bp, Mus musculus
caaaactggcctcagccagctgggc

SEQ ID NO: 10296 - DNA, 25 bp, Mus musculus
caaaactgtctttggactctcagaa

SEQ ID NO: 10297 - DNA, 25 bp, Mus musculus
caaaacttgatcctctcggaattag

SEQ ID NO: 10298 - DNA, 25 bp, Mus musculus
caaaacttgcaagaactccaagctg

SEQ ID NO: 10299 - DNA, 25 bp, Mus musculus
caaaagaaaatcttgacctagcaga

SEQ ID NO: 10300 - DNA, 25 bp, Mus musculus
caaaagaaactcaagggcactgaag

SEQ ID NO: 10301 - DNA, 25 bp, Mus musculus
caaaagaaattgatgagctgacccg

SEQ ID NO: 10302 - DNA, 25 bp, Mus musculus
caaaagaagacatgacagacatata

SEQ ID NO: 10303 - DNA, 25 bp, Mus musculus
caaaagacaggtagtgagcgcttcc

SEQ ID NO: 10304 - DNA, 25 bp, Mus musculus
caaaagaccagaagtaatctgttgg

SEQ ID NO: 10305 - DNA, 25 bp, Mus musculus
caaaagacctggtgcgtacccggag

SEQ ID NO: 10306 - DNA, 25 bp, Mus musculus
caaaagactaaaatatgacggccca

SEQ ID NO: 10307 - DNA, 25 bp, Mus musculus
caaaagagattgaatgaactgagag

SEQ ID NO: 10308 - DNA, 25 bp, Mus musculus
caaaagagcacactaacttggtacg

SEQ ID NO: 10309 - DNA, 25 bp, Mus musculus
caaaagagcccgatttctgaagatc

SEQ ID NO: 10310 - DNA, 25 bp, Mus musculus
caaaagaggtgtttgacctccaaga

SEQ ID NO: 10311 - DNA, 25 bp, Mus musculus
caaaagagtactgtgctgcctcaga

SEQ ID NO: 10312 - DNA, 25 bp, Mus musculus
caaaagagtatccagaagacatgcc

SEQ ID NO: 10313 - DNA, 25 bp, Mus musculus
caaaagatagaggaattggcccgta

SEQ ID NO: 10314 - DNA, 25 bp, Mus musculus
caaaagatatccaaagactcggact

SEQ ID NO: 10315 - DNA, 25 bp, Mus musculus
caaaagcaacccaggctcggtaatc

SEQ ID NO: 10316 - DNA, 25 bp, Mus musculus
caaaagcaatataagttccctggat

SEQ ID NO: 10317 - DNA, 25 bp, Mus musculus
caaaagcagatatagcctcattgcc

SEQ ID NO: 10318 - DNA, 25 bp, Mus musculus
caaaagcagggaggttatgaggctt

SEQ ID NO: 10319 - DNA, 25 bp, Mus musculus
caaaagcatctcaagacgatggatc

SEQ ID NO: 10320 - DNA, 25 bp, Mus musculus
caaaagccaagactcaaatctttaa

SEQ ID NO: 10321 - DNA, 25 bp, Mus musculus
caaaagccaagagtcaaatctttaa

SEQ ID NO: 10322 - DNA, 25 bp, Mus musculus
caaaagcccaagtattcatccaaag

SEQ ID NO: 10323 - DNA, 25 bp, Mus musculus
caaaagcccagcgtcaatgcggttg

SEQ ID NO: 10324 - DNA, 25 bp, Mus musculus
caaaagccctggagaccctcggagt

SEQ ID NO: 10325 - DNA, 25 bp, Mus musculus
caaaagcctattgaacaagaagtca

SEQ ID NO: 10326 - DNA, 25 bp, Mus musculus
caaaagcctcgggatgacaagcctg

SEQ ID NO: 10327 - DNA, 25 bp, Mus musculus
caaaagcgactcagtagtctttcag

SEQ ID NO: 10328 - DNA, 25 bp, Mus musculus
caaaagcgatcgatgtgatggcgcc

SEQ ID NO: 10329 - DNA, 25 bp, Mus musculus
caaaagcgtccagattagatgtcac

SEQ ID NO: 10330 - DNA, 25 bp, Mus musculus
caaaagctaaatctgctgcaaggac

SEQ ID NO: 10331 - DNA, 25 bp, Mus musculus
caaaagctctacaaagagaaggaag

SEQ ID NO: 10332 - DNA, 25 bp, Mus musculus
caaaagctctttgttgtggataaag

SEQ ID NO: 10333 - DNA, 25 bp, Mus musculus
caaaagctgatcagcattattcaca

SEQ ID NO: 10334 - DNA, 25 bp, Mus musculus
caaaaggacagctgtgaggacgaag

SEQ ID NO: 10335 - DNA, 25 bp, Mus musculus
caaaaggaggacattccaggagcct

SEQ ID NO: 10336 - DNA, 25 bp, Mus musculus
caaaaggatccatgccagaaacaag

SEQ ID NO: 10337 - DNA, 25 bp, Mus musculus
caaaaggatggctatatgttgagcc

SEQ ID NO: 10338 - DNA, 25 bp, Mus musculus
caaaaggatgtgcttaaattgctca

SEQ ID NO: 10339 - DNA, 25 bp, Mus musculus
caaaaggcaatcatggtggcgtaac

SEQ ID NO: 10340 - DNA, 25 bp, Mus musculus
caaaaggcttggtctagatcagaca

SEQ ID NO: 10341 - DNA, 25 bp, Mus musculus
caaaaggtatccagtgtgacaggac

SEQ ID NO: 10342 - DNA, 25 bp, Mus musculus
caaaaggtggagtggaggacctgtc

SEQ ID NO: 10343 - DNA, 25 bp, Mus musculus
caaaagtaatgatggcttcgtcccc

SEQ ID NO: 10344 - DNA, 25 bp, Mus musculus
caaaagtacaagcagcgccatgggt

SEQ ID NO: 10345 - DNA, 25 bp, Mus musculus
caaaagtagaagtggtcagctgcag

SEQ ID NO: 10346 - DNA, 25 bp, Mus musculus
caaaagtctgctgtttacgtagact

SEQ ID NO: 10347 - DNA, 25 bp, Mus musculus
caaaagtgaacccactgagccggga

SEQ ID NO: 10348 - DNA, 25 bp, Mus musculus
caaaagtgaagtggagatcccagcc

SEQ ID NO: 10349 - DNA, 25 bp, Mus musculus
caaaagtgatgatgaaatcagatat

SEQ ID NO: 10350 - DNA, 25 bp, Mus musculus
caaaagttacatgaagatcgatgag

SEQ ID NO: 10351 - DNA, 25 bp, Mus musculus
caaaagtttcactcagtcaaatccc

SEQ ID NO: 10352 - DNA, 25 bp, Mus musculus
caaaatacacgaaagtgggagaacg

SEQ ID NO: 10353 - DNA, 25 bp, Mus musculus
caaaatacccagttctcaggaagaa

SEQ ID NO: 10354 - DNA, 25 bp, Mus musculus
caaaatagatggttctggaaagtcc

SEQ ID NO: 10355 - DNA, 25 bp, Mus musculus
caaaatattttgaggcgggagcaga

SEQ ID NO: 10356 - DNA, 25 bp, Mus musculus
caaaatattttgtggcgggagcaga

SEQ ID NO: 10357 - DNA, 25 bp, Mus musculus
caaaatcattgatggcttctgtggc

SEQ ID NO: 10358 - DNA, 25 bp, Mus musculus
caaaatctaacccttacatggattc

SEQ ID NO: 10359 - DNA, 25 bp, Mus musculus
caaaatctgcactgggaaaggaaca

SEQ ID NO: 10360 - DNA, 25 bp, Mus musculus
caaaatgaatgaggaaacggccagt

SEQ ID NO: 10361 - DNA, 25 bp, Mus musculus
caaaatgaatgtcccagaaacgatg

SEQ ID NO: 10362 - DNA, 25 bp, Mus musculus
caaaatgatgatagagaattgacca

SEQ ID NO: 10363 - DNA, 25 bp, Mus musculus
caaaatgattcgaaacccaagtagt

SEQ ID NO: 10364 - DNA, 25 bp, Mus musculus
caaaatgcccgccatggtataataa

SEQ ID NO: 10365 - DNA, 25 bp, Mus musculus
caaaatgctacaaagaagtatatca

SEQ ID NO: 10366 - DNA, 25 bp, Mus musculus
caaaatgctgatccggatgtggaca

SEQ ID NO: 10367 - DNA, 25 bp, Mus musculus
caaaatggacagttggtcagaaacg

SEQ ID NO: 10368 - DNA, 25 bp, Mus musculus
caaaatggtcaagacacaatgacat

SEQ ID NO: 10369 - DNA, 25 bp, Mus musculus
caaaatggtccagatcgtattggaa

SEQ ID NO: 10370 - DNA, 25 bp, Mus musculus
caaaattactccttctacgagggct

SEQ ID NO: 10371 - DNA, 25 bp, Mus musculus
caaaattattgatctaggatatgcc

SEQ ID NO: 10372 - DNA, 25 bp, Mus musculus
caaaattcatttgttcaagttgtgc

SEQ ID NO: 10373 - DNA, 25 bp, Mus musculus
caaaattctgaaagacaacctggcc

SEQ ID NO: 10374 - DNA, 25 bp, Mus musculus
caaaattgccaacttctcacagagc

SEQ ID NO: 10375 - DNA, 25 bp, Mus musculus
caaaattttgtcagaagcactggag

SEQ ID NO: 10376 - DNA, 25 bp, Mus musculus
caaacaaaactcagctgtgaactcc

SEQ ID NO: 10377 - DNA, 25 bp, Mus musculus
caaacaaagggaaagccactgctga

SEQ ID NO: 10378 - DNA, 25 bp, Mus musculus
caaacaaagggatagccactgctga

SEQ ID NO: 10379 - DNA, 25 bp, Mus musculus
caaacaacccttcgctgacctgatt

SEQ ID NO: 10380 - DNA, 25 bp, Mus musculus
caaacaacttatcagtagtgactta

SEQ ID NO: 10381 - DNA, 25 bp, Mus musculus
caaacaagcccgagagtgtcaaggt

SEQ ID NO: 10382 - DNA, 25 bp, Mus musculus
caaacaagcccgtgagtgtcaaggt

SEQ ID NO: 10383 - DNA, 25 bp, Mus musculus
caaacaaggagcatttataactctg

SEQ ID NO: 10384 - DNA, 25 bp, Mus musculus
caaacaagtgcaaatgtcaccctgg

SEQ ID NO: 10385 - DNA, 25 bp, Mus musculus
caaacaatgctgaaagatctaaagg

SEQ ID NO: 10386 - DNA, 25 bp, Mus musculus
caaacaattggtagctggaaacagc

SEQ ID NO: 10387 - DNA, 25 bp, Mus musculus
caaacacaccccatccaaggagatg

SEQ ID NO: 10388 - DNA, 25 bp, Mus musculus
caaacacagcctttgagagcaggag

SEQ ID NO: 10389 - DNA, 25 bp, Mus musculus
caaacacagtatatttctgaaccta

SEQ ID NO: 10390 - DNA, 25 bp, Mus musculus
caaacaccatgtcagtggcaacaga

SEQ ID NO: 10391 - DNA, 25 bp, Mus musculus
caaacacctggcagtccttgataga

SEQ ID NO: 10392 - DNA, 25 bp, Mus musculus
caaacacggaaagcccaagaagcag

SEQ ID NO: 10393 - DNA, 25 bp, Mus musculus
caaacactgggaatggctggaaaac

SEQ ID NO: 10394 - DNA, 25 bp, Mus musculus
caaacacttctaaatttgcccagaa

SEQ ID NO: 10395 - DNA, 25 bp, Mus musculus
caaacagaaagaggatgttgacaag

SEQ ID NO: 10396 - DNA, 25 bp, Mus musculus
caaacagagacacctagagatttaa

SEQ ID NO: 10397 - DNA, 25 bp, Mus musculus
caaacagagggaacaaaggcagccc

SEQ ID NO: 10398 - DNA, 25 bp, Mus musculus
caaacagatggacaaataaacaaac

SEQ ID NO: 10399 - DNA, 25 bp, Mus musculus
caaacagcctgaaatgaagcccttc

SEQ ID NO: 10400 - DNA, 25 bp, Mus musculus
caaacagcgtggtatacttactgaa

SEQ ID NO: 10401 - DNA, 25 bp, Mus musculus
caaacagcgtggtcaagtatgagct

SEQ ID NO: 10402 - DNA, 25 bp, Mus musculus
caaacaggagacattcacctttgcc

SEQ ID NO: 10403 - DNA, 25 bp, Mus musculus
caaacagggcttgcgatgtaagact

SEQ ID NO: 10404 - DNA, 25 bp, Mus musculus
caaacaggtgaacttcagcaaacag

SEQ ID NO: 10405 - DNA, 25 bp, Mus musculus
caaacaggtgttggcccggaccagc

SEQ ID NO: 10406 - DNA, 25 bp, Mus musculus
caaacagtctatttcggcgaatctt

SEQ ID NO: 10407 - DNA, 25 bp, Mus musculus
caaacagtcttctggggagaagctg

SEQ ID NO: 10408 - DNA, 25 bp, Mus musculus
caaacagtgaagatttgggacctgc

SEQ ID NO: 10409 - DNA, 25 bp, Mus musculus
caaacagtgatgaggctgtaatcaa

SEQ ID NO: 10410 - DNA, 25 bp, Mus musculus
caaacataaaggtagagagcgggac

SEQ ID NO: 10411 - DNA, 25 bp, Mus musculus
caaacataaccacgcaacagggact

SEQ ID NO: 10412 - DNA, 25 bp, Mus musculus
caaacataaccaggcaacagggact

SEQ ID NO: 10413 - DNA, 25 bp, Mus musculus
caaacatctcggatagtacctccaa

SEQ ID NO: 10414 - DNA, 25 bp, Mus musculus
caaacatgaccaaacaaggaacctg

SEQ ID NO: 10415 - DNA, 25 bp, Mus musculus
caaacatgcggacctattatttctg

SEQ ID NO: 10416 - DNA, 25 bp, Mus musculus
caaacatggagactgtcgttcgccg

SEQ ID NO: 10417 - DNA, 25 bp, Mus musculus
caaacatgtcaagtccgagccaaac

SEQ ID NO: 10418 - DNA, 25 bp, Mus musculus
caaacattttcaccatttggacaaa

SEQ ID NO: 10419 - DNA, 25 bp, Mus musculus
caaaccaagtgaacatctgagtaac

SEQ ID NO: 10420 - DNA, 25 bp, Mus musculus
caaaccacataaccacatatagcaa

SEQ ID NO: 10421 - DNA, 25 bp, Mus musculus
caaaccacgaggaagcaatccgctg

SEQ ID NO: 10422 - DNA, 25 bp, Mus musculus
caaaccacgaggtagcaatccgctg

SEQ ID NO: 10423 - DNA, 25 bp, Mus musculus
caaaccagccctcatctcttggatg

SEQ ID NO: 10424 - DNA, 25 bp, Mus musculus
caaaccagtcaaagatcccaagaca

SEQ ID NO: 10425 - DNA, 25 bp, Mus musculus
caaacccaaggaggcggtcaccgtg

SEQ ID NO: 10426 - DNA, 25 bp, Mus musculus
caaaccccatgaacccgagtgtggt

SEQ ID NO: 10427 - DNA, 25 bp, Mus musculus
caaacccctgtctacccagaatgga

SEQ ID NO: 10428 - DNA, 25 bp, Mus musculus
caaacccgatgagcaagaagtgact

SEQ ID NO: 10429 - DNA, 25 bp, Mus musculus
caaaccctggtagaagatttacagc

SEQ ID NO: 10430 - DNA, 25 bp, Mus musculus
caaacccttacccacacagtctgga

SEQ ID NO: 10431 - DNA, 25 bp, Mus musculus
caaacccttggctatgtcgacgact

SEQ ID NO: 10432 - DNA, 25 bp, Mus musculus
caaaccgatggaatcaaagcttccc

SEQ ID NO: 10433 - DNA, 25 bp, Mus musculus
caaaccgtgccatggagcttagtac

SEQ ID NO: 10434 - DNA, 25 bp, Mus musculus
caaacctacagccatgccagtgaag

SEQ ID NO: 10435 - DNA, 25 bp, Mus musculus
caaacctccgaatgccatgactgtg

SEQ ID NO: 10436 - DNA, 25 bp, Mus musculus
caaacctgcatgtggacgtcccaaa

SEQ ID NO: 10437 - DNA, 25 bp, Mus musculus
caaacctgctccagcacaagaatgg

SEQ ID NO: 10438 - DNA, 25 bp, Mus musculus
caaacctttcataattccaggccga

SEQ ID NO: 10439 - DNA, 25 bp, Mus musculus
caaacctttggatggatgaatggcc

SEQ ID NO: 10440 - DNA, 25 bp, Mus musculus
caaaccttttgtcagcacttggcag

SEQ ID NO: 10441 - DNA, 25 bp, Mus musculus
caaacgaacattatttcagcataga

SEQ ID NO: 10442 - DNA, 25 bp, Mus musculus
caaacgaagatacagaatggaatga

SEQ ID NO: 10443 - DNA, 25 bp, Mus musculus
caaacgacagaatgaagcaattcgt

SEQ ID NO: 10444 - DNA, 25 bp, Mus musculus
caaacgactgacatgtgagatctcc

SEQ ID NO: 10445 - DNA, 25 bp, Mus musculus
caaacgagacacagtgaaaggctac

SEQ ID NO: 10446 - DNA, 25 bp, Mus musculus
caaacgagggaagcgagaagtcgcc

SEQ ID NO: 10447 - DNA, 25 bp, Mus musculus
caaacgatgagctgctgtatgatcc

SEQ ID NO: 10448 - DNA, 25 bp, Mus musculus
caaacgatgagtcctgaaccattac

SEQ ID NO: 10449 - DNA, 25 bp, Mus musculus
caaacgcggagaacggatcctgatc

SEQ ID NO: 10450 - DNA, 25 bp, Mus musculus
caaacgcggagatcggatcctgatc

SEQ ID NO: 10451 - DNA, 25 bp, Mus musculus
caaacgctacaagaattccttggag

SEQ ID NO: 10452 - DNA, 25 bp, Mus musculus
caaacgctcttccatgacagcttac

SEQ ID NO: 10453 - DNA, 25 bp, Mus musculus
caaacgctgaaccatgacacttttc

SEQ ID NO: 10454 - DNA, 25 bp, Mus musculus
caaacgcttcgattacgatgacaag

SEQ ID NO: 10455 - DNA, 25 bp, Mus musculus
caaacgctttgtgcagtggcagtct

SEQ ID NO: 10456 - DNA, 25 bp, Mus musculus
caaacggaagaggtctttacagagc

SEQ ID NO: 10457 - DNA, 25 bp, Mus musculus
caaacggatagcttgcgatgaagag

SEQ ID NO: 10458 - DNA, 25 bp, Mus musculus
caaacggattcttcggacagagatg

SEQ ID NO: 10459 - DNA, 25 bp, Mus musculus
caaacggcgacctgtacatctggga

SEQ ID NO: 10460 - DNA, 25 bp, Mus musculus
caaacgggagagagaagcaaaggat

SEQ ID NO: 10461 - DNA, 25 bp, Mus musculus
caaacgggtccttcctaactgatag

SEQ ID NO: 10462 - DNA, 25 bp, Mus musculus
caaacggtcagaagcagaagaggca

SEQ ID NO: 10463 - DNA, 25 bp, Mus musculus
caaacgtcacggtgagatgagacag

SEQ ID NO: 10464 - DNA, 25 bp, Mus musculus
caaactaagcaggtattcatgccag

SEQ ID NO: 10465 - DNA, 25 bp, Mus musculus
caaactaaggcaattctagatggga

SEQ ID NO: 10466 - DNA, 25 bp, Mus musculus
caaactaagtttgaatatctggtta

SEQ ID NO: 10467 - DNA, 25 bp, Mus musculus
caaactacaggcgattgccaaccag

SEQ ID NO: 10468 - DNA, 25 bp, Mus musculus
caaactagcaaccactcaggaaaca

SEQ ID NO: 10469 - DNA, 25 bp, Mus musculus
caaactagtgatgctgggtgccggt

SEQ ID NO: 10470 - DNA, 25 bp, Mus musculus
caaactatcctaacaatgccagatg

SEQ ID NO: 10471 - DNA, 25 bp, Mus musculus
caaactatgttttattcagtttaca

SEQ ID NO: 10472 - DNA, 25 bp, Mus musculus
caaactcaaggattccagctgaacg

SEQ ID NO: 10473 - DNA, 25 bp, Mus musculus
caaactcagaggctcagaatgctgg

SEQ ID NO: 10474 - DNA, 25 bp, Mus musculus
caaactcatgaagcatgagaccctg

SEQ ID NO: 10475 - DNA, 25 bp, Mus musculus
caaactcattctgcagaacacaggg

SEQ ID NO: 10476 - DNA, 25 bp, Mus musculus
caaactcattgactgcttcaaaaag

SEQ ID NO: 10477 - DNA, 25 bp, Mus musculus
caaactcattgagtgcttcaaaaag

SEQ ID NO: 10478 - DNA, 25 bp, Mus musculus
caaactccaggatcccagtgtgcgg

SEQ ID NO: 10479 - DNA, 25 bp, Mus musculus
caaactccctatccaggggtggaga

SEQ ID NO: 10480 - DNA, 25 bp, Mus musculus
caaactccctcatctgtcctgtgtg

SEQ ID NO: 10481 - DNA, 25 bp, Mus musculus
caaactcctcaataactgcctattg

SEQ ID NO: 10482 - DNA, 25 bp, Mus musculus
caaactcgagacgaacatcggcgaa

SEQ ID NO: 10483 - DNA, 25 bp, Mus musculus
caaactcggcagcttgggctgctta

SEQ ID NO: 10484 - DNA, 25 bp, Mus musculus
caaactcgggaagtcgaatcgtggg

SEQ ID NO: 10485 - DNA, 25 bp, Mus musculus
caaactcgtgggaggaaccactcca

SEQ ID NO: 10486 - DNA, 25 bp, Mus musculus
caaactctaaaacaaatgggcgaag

SEQ ID NO: 10487 - DNA, 25 bp, Mus musculus
caaactctgacccaatttgattcta

SEQ ID NO: 10488 - DNA, 25 bp, Mus musculus
caaactctgagtaaaagcgttcatc

SEQ ID NO: 10489 - DNA, 25 bp, Mus musculus
caaactctgagttaaagcgttcatc

SEQ ID NO: 10490 - DNA, 25 bp, Mus musculus
caaactctgttgtccttgggtgccg

SEQ ID NO: 10491 - DNA, 25 bp, Mus musculus
caaactctttatatatcagaagctg

SEQ ID NO: 10492 - DNA, 25 bp, Mus musculus
caaactgaaaagagcagaggctggg

SEQ ID NO: 10493 - DNA, 25 bp, Mus musculus
caaactgaaccgtgatgcctttcat

SEQ ID NO: 10494 - DNA, 25 bp, Mus musculus
caaactgagtcgtgtatgtgacaga

SEQ ID NO: 10495 - DNA, 25 bp, Mus musculus
caaactgcatattagtccttcaaac

SEQ ID NO: 10496 - DNA, 25 bp, Mus musculus
caaactgccactgagatttctgcta

SEQ ID NO: 10497 - DNA, 25 bp, Mus musculus
caaactgctcttgatcgggaacagc

SEQ ID NO: 10498 - DNA, 25 bp, Mus musculus
caaactgctgaaaagactgtttctg

SEQ ID NO: 10499 - DNA, 25 bp, Mus musculus
caaactgcttgagtgccatgggaca

SEQ ID NO: 10500 - DNA, 25 bp, Mus musculus
caaactggaaagaggtgatgtgtcg

SEQ ID NO: 10501 - DNA, 25 bp, Mus musculus
caaactggaagtgctttatgtcctc

SEQ ID NO: 10502 - DNA, 25 bp, Mus musculus
caaactgtgtggtgattgcggatgc

SEQ ID NO: 10503 - DNA, 25 bp, Mus musculus
caaactgttccctgagtcagtcatc

SEQ ID NO: 10504 - DNA, 25 bp, Mus musculus
caaacttactgtgtcaccaaggatg

SEQ ID NO: 10505 - DNA, 25 bp, Mus musculus
caaacttcagttgcaatagggagaa

SEQ ID NO: 10506 - DNA, 25 bp, Mus musculus
caaacttctatgttcagagtgatca

SEQ ID NO: 10507 - DNA, 25 bp, Mus musculus
caaacttctggattggctaaagatg

SEQ ID NO: 10508 - DNA, 25 bp, Mus musculus
caaacttgacctaccgcgtgggcct

SEQ ID NO: 10509 - DNA, 25 bp, Mus musculus
caaacttgctgctaaagcttccaaa

SEQ ID NO: 10510 - DNA, 25 bp, Mus musculus
caaacttggtgtacgccttgcttta

SEQ ID NO: 10511 - DNA, 25 bp, Mus musculus
caaactttcgagtgaaggtgatggc

SEQ ID NO: 10512 - DNA, 25 bp, Mus musculus
caaagaaaacagcacatgtgaaacc

SEQ ID NO: 10513 - DNA, 25 bp, Mus musculus
caaagaaagcacatcgtctgtatcc

SEQ ID NO: 10514 - DNA, 25 bp, Mus musculus
caaagaaagcacttcgtctgtatcc

SEQ ID NO: 10515 - DNA, 25 bp, Mus musculus
caaagaaaggtctagctcccgaggt

SEQ ID NO: 10516 - DNA, 25 bp, Mus musculus
caaagaaatctgagcttcaggagga

SEQ ID NO: 10517 - DNA, 25 bp, Mus musculus
caaagaaatctgtgcttcaggagga

SEQ ID NO: 10518 - DNA, 25 bp, Mus musculus
caaagaaccatagccctgggccggg

SEQ ID NO: 10519 - DNA, 25 bp, Mus musculus
caaagaaccttctctgacaagttgt

SEQ ID NO: 10520 - DNA, 25 bp, Mus musculus
caaagaacttagtagtcagccgtaa

SEQ ID NO: 10521 - DNA, 25 bp, Mus musculus
caaagaacttgaaacagagatatcc

SEQ ID NO: 10522 - DNA, 25 bp, Mus musculus
caaagaagaagtctggttccaggaa

SEQ ID NO: 10523 - DNA, 25 bp, Mus musculus
caaagaagaccctacgtctttcaga

SEQ ID NO: 10524 - DNA, 25 bp, Mus musculus
caaagaagagacctctgtggatgcc

SEQ ID NO: 10525 - DNA, 25 bp, Mus musculus
caaagaagatatccgagcaactgaa

SEQ ID NO: 10526 - DNA, 25 bp, Mus musculus
caaagaagctgcattgaacgggagc

SEQ ID NO: 10527 - DNA, 25 bp, Mus musculus
caaagaaggacccagaggatatcaa

SEQ ID NO: 10528 - DNA, 25 bp, Mus musculus
caaagaaggctcaggtggatcgccg

SEQ ID NO: 10529 - DNA, 25 bp, Mus musculus
caaagaagttaaatagctatcccaa

SEQ ID NO: 10530 - DNA, 25 bp, Mus musculus
caaagaatcagctgaagctgcttgt

SEQ ID NO: 10531 - DNA, 25 bp, Mus musculus
caaagaattccatcagatatggtat

SEQ ID NO: 10532 - DNA, 25 bp, Mus musculus
caaagaattggtggaagcccaggag

SEQ ID NO: 10533 - DNA, 25 bp, Mus musculus
caaagacaaagcagggcccgagaaa

SEQ ID NO: 10534 - DNA, 25 bp, Mus musculus
caaagacaacttgaaggtaaagagg

SEQ ID NO: 10535 - DNA, 25 bp, Mus musculus
caaagacaataaaggcaaagttctc

SEQ ID NO: 10536 - DNA, 25 bp, Mus musculus
caaagacaggctcctctgtgagcaa

SEQ ID NO: 10537 - DNA, 25 bp, Mus musculus
caaagacaggctgctctgtgagcaa

SEQ ID NO: 10538 - DNA, 25 bp, Mus musculus
caaagacatctaaccagtgtaagaa

SEQ ID NO: 10539 - DNA, 25 bp, Mus musculus
caaagacatttttgcactagcagat

SEQ ID NO: 10540 - DNA, 25 bp, Mus musculus
caaagaccatggagactgctgagaa

SEQ ID NO: 10541 - DNA, 25 bp, Mus musculus
caaagaccggattggaggccgagta

SEQ ID NO: 10542 - DNA, 25 bp, Mus musculus
caaagacgagcagcgccaggtgcca

SEQ ID NO: 10543 - DNA, 25 bp, Mus musculus
caaagacggaagcttcgtgttgacc

SEQ ID NO: 10544 - DNA, 25 bp, Mus musculus
caaagactccaaagcaacgcgttgc

SEQ ID NO: 10545 - DNA, 25 bp, Mus musculus
caaagactcctatctgatcctggag

SEQ ID NO: 10546 - DNA, 25 bp, Mus musculus
caaagactgggctgctcagtaccgc

SEQ ID NO: 10547 - DNA, 25 bp, Mus musculus
caaagactgtaaagtgcttcatttc

SEQ ID NO: 10548 - DNA, 25 bp, Mus musculus
caaagactgtggcaagattgcattc

SEQ ID NO: 10549 - DNA, 25 bp, Mus musculus
caaagacttccaaggtctcccggct

SEQ ID NO: 10550 - DNA, 25 bp, Mus musculus
caaagacttcgtggtgcaacattta

SEQ ID NO: 10551 - DNA, 25 bp, Mus musculus
caaagagaaaaacgagacaagccaa

SEQ ID NO: 10552 - DNA, 25 bp, Mus musculus
caaagagaacatgtatgctgtgcag

SEQ ID NO: 10553 - DNA, 25 bp, Mus musculus
caaagagaactgctagagaagcaaa

SEQ ID NO: 10554 - DNA, 25 bp, Mus musculus
caaagagacagataaagaagcgagc

SEQ ID NO: 10555 - DNA, 25 bp, Mus musculus
caaagagagatgaggcacagatggt

SEQ ID NO: 10556 - DNA, 25 bp, Mus musculus
caaagagatagactgggtggccaaa

SEQ ID NO: 10557 - DNA, 25 bp, Mus musculus
caaagagcaactggcacctgttgga

SEQ ID NO: 10558 - DNA, 25 bp, Mus musculus
caaagagcacaagccatgtggcaac

SEQ ID NO: 10559 - DNA, 25 bp, Mus musculus
caaagagcagtggatgaaaaagtgg

SEQ ID NO: 10560 - DNA, 25 bp, Mus musculus
caaagagccccgaagctaagagccc

SEQ ID NO: 10561 - DNA, 25 bp, Mus musculus
caaagagcctgatgaaactgtgcac

SEQ ID NO: 10562 - DNA, 25 bp, Mus musculus
caaagagctcattggattgtccagc

SEQ ID NO: 10563 - DNA, 25 bp, Mus musculus
caaagagctttgctcctacagcagt

SEQ ID NO: 10564 - DNA, 25 bp, Mus musculus
caaagaggagattatttcaaaaggc

SEQ ID NO: 10565 - DNA, 25 bp, Mus musculus
caaagaggccgtggtactgaagctc

SEQ ID NO: 10566 - DNA, 25 bp, Mus musculus
caaagaggcggtatcatgttactat

SEQ ID NO: 10567 - DNA, 25 bp, Mus musculus
caaagaggcggtttcatgttactat

SEQ ID NO: 10568 - DNA, 25 bp, Mus musculus
caaagagggcacttctcagagaacg

SEQ ID NO: 10569 - DNA, 25 bp, Mus musculus
caaagaggtactacgcctggagaga

SEQ ID NO: 10570 - DNA, 25 bp, Mus musculus
caaagagtatatacctgctgacact

SEQ ID NO: 10571 - DNA, 25 bp, Mus musculus
caaagataacttcaccttcaaatgc

SEQ ID NO: 10572 - DNA, 25 bp, Mus musculus
caaagatactggagtactgactccc

SEQ ID NO: 10573 - DNA, 25 bp, Mus musculus
caaagatcagtggtacaatgtatta

SEQ ID NO: 10574 - DNA, 25 bp, Mus musculus
caaagatcggcttcccttggagtga

SEQ ID NO: 10575 - DNA, 25 bp, Mus musculus
caaagatcgggctgtgggtgattct

SEQ ID NO: 10576 - DNA, 25 bp, Mus musculus
caaagatctgctggcctgctgggat

SEQ ID NO: 10577 - DNA, 25 bp, Mus musculus
caaagatgatccaatcgaagtgtct

SEQ ID NO: 10578 - DNA, 25 bp, Mus musculus
caaagatgccatccaactttggagg

SEQ ID NO: 10579 - DNA, 25 bp, Mus musculus
caaagatggcagtgttgccattgcc

SEQ ID NO: 10580 - DNA, 25 bp, Mus musculus
caaagatgttgcagctagtcaccag

SEQ ID NO: 10581 - DNA, 25 bp, Mus musculus
caaagattagaacgactccgcaaag

SEQ ID NO: 10582 - DNA, 25 bp, Mus musculus
caaagattccatcaccacctgggag

SEQ ID NO: 10583 - DNA, 25 bp, Mus musculus
caaagatttacagttggaggagaga

SEQ ID NO: 10584 - DNA, 25 bp, Mus musculus
caaagattttgcacgaggattcaca

SEQ ID NO: 10585 - DNA, 25 bp, Mus musculus
caaagattttgctcgaggattcaca

SEQ ID NO: 10586 - DNA, 25 bp, Mus musculus
caaagcaactatacgatggctcaca

SEQ ID NO: 10587 - DNA, 25 bp, Mus musculus
caaagcaaggactctgtgcggcaga

SEQ ID NO: 10588 - DNA, 25 bp, Mus musculus
caaagcaaggatttcaagcataccg

SEQ ID NO: 10589 - DNA, 25 bp, Mus musculus
caaagcaaggtatccatctgtcccc

SEQ ID NO: 10590 - DNA, 25 bp, Mus musculus
caaagcaccgaagcctggtccagat

SEQ ID NO: 10591 - DNA, 25 bp, Mus musculus
caaagcactgaagttgaattttgca

SEQ ID NO: 10592 - DNA, 25 bp, Mus musculus
caaagcactgtagaagacaccaagg

SEQ ID NO: 10593 - DNA, 25 bp, Mus musculus
caaagcagcgtttgcaccatttgga

SEQ ID NO: 10594 - DNA, 25 bp, Mus musculus
caaagcagcttaaaatagaagaaca

SEQ ID NO: 10595 - DNA, 25 bp, Mus musculus
caaagcaggaaagggtgagagcgct

SEQ ID NO: 10596 - DNA, 25 bp, Mus musculus
caaagcagtgtgtaacgtgatcgcg

SEQ ID NO: 10597 - DNA, 25 bp, Mus musculus
caaagcatctgtgaagctcgttaac

SEQ ID NO: 10598 - DNA, 25 bp, Mus musculus
caaagcatgtcgatcttctagatgt

SEQ ID NO: 10599 - DNA, 25 bp, Mus musculus
caaagcatgtcgttcttctagatgt

SEQ ID NO: 10600 - DNA, 25 bp, Mus musculus
caaagcattgtaaggaaaagaagaa

SEQ ID NO: 10601 - DNA, 25 bp, Mus musculus
caaagccaaccacccgatggatgct

SEQ ID NO: 10602 - DNA, 25 bp, Mus musculus
caaagccacaaggtttgtatcctgg

SEQ ID NO: 10603 - DNA, 25 bp, Mus musculus
caaagccagcaactctgggaaagag

SEQ ID NO: 10604 - DNA, 25 bp, Mus musculus
caaagcccaaggatgtgctcaccat

SEQ ID NO: 10605 - DNA, 25 bp, Mus musculus
caaagcccataccagagtggatctg

SEQ ID NO: 10606 - DNA, 25 bp, Mus musculus
caaagccccgaggatcgtcctgtgt

SEQ ID NO: 10607 - DNA, 25 bp, Mus musculus
caaagcccctattagcctcatgtgg

SEQ ID NO: 10608 - DNA, 25 bp, Mus musculus
caaagccctgggtcgcttggaagaa

SEQ ID NO: 10609 - DNA, 25 bp, Mus musculus
caaagccgtattccagacagcagag

SEQ ID NO: 10610 - DNA, 25 bp, Mus musculus
caaagcctccggcttgtgtgcagtt

SEQ ID NO: 10611 - DNA, 25 bp, Mus musculus
caaagcctcggtgatagaaatcttc

SEQ ID NO: 10612 - DNA, 25 bp, Mus musculus
caaagcctgaaagtccttggacttc

SEQ ID NO: 10613 - DNA, 25 bp, Mus musculus
caaagcctgcctcatcagcttgggt

SEQ ID NO: 10614 - DNA, 25 bp, Mus musculus
caaagcctttctgaggccatggaag

SEQ ID NO: 10615 - DNA, 25 bp, Mus musculus
caaagcctttgtcttcttgctgtcc

SEQ ID NO: 10616 - DNA, 25 bp, Mus musculus
caaagcgcaaaagttcccgagtggg

SEQ ID NO: 10617 - DNA, 25 bp, Mus musculus
caaagcgctggataagatagctgag

SEQ ID NO: 10618 - DNA, 25 bp, Mus musculus
caaagcgtcttctttccgacgacag

SEQ ID NO: 10619 - DNA, 25 bp, Mus musculus
caaagcgttccgctcacttggagaa

SEQ ID NO: 10620 - DNA, 25 bp, Mus musculus
caaagcgttccggtcacttggagaa

SEQ ID NO: 10621 - DNA, 25 bp, Mus musculus
caaagctaatggatcagttagaagc

SEQ ID NO: 10622 - DNA, 25 bp, Mus musculus
caaagctagcccacttgagagtatt

SEQ ID NO: 10623 - DNA, 25 bp, Mus musculus
caaagctcagaattcccgtgacatc

SEQ ID NO: 10624 - DNA, 25 bp, Mus musculus
caaagctgacaaactccagagggag

SEQ ID NO: 10625 - DNA, 25 bp, Mus musculus
caaagctgagttccggtcggccctc

SEQ ID NO: 10626 - DNA, 25 bp, Mus musculus
caaagctgcgaagagtgggaaatca

SEQ ID NO: 10627 - DNA, 25 bp, Mus musculus
caaagctggcctcaaagctgtgacc

SEQ ID NO: 10628 - DNA, 25 bp, Mus musculus
caaagctgggatgtggctatgacag

SEQ ID NO: 10629 - DNA, 25 bp, Mus musculus
caaagctgttaaagtgtcatctgac

SEQ ID NO: 10630 - DNA, 25 bp, Mus musculus
caaagctgttgctgagctggatgcc

SEQ ID NO: 10631 - DNA, 25 bp, Mus musculus
caaagcttccagtagaacgatagct

SEQ ID NO: 10632 - DNA, 25 bp, Mus musculus
caaagctttctggaggtgaacaaca

SEQ ID NO: 10633 - DNA, 25 bp, Mus musculus
caaaggaagcagagtgtgtacacac

SEQ ID NO: 10634 - DNA, 25 bp, Mus musculus
caaaggacaaactagctggctaaac

SEQ ID NO: 10635 - DNA, 25 bp, Mus musculus
caaaggagcactctccaggcaagaa

SEQ ID NO: 10636 - DNA, 25 bp, Mus musculus
caaaggagctatgctaacccatgaa

SEQ ID NO: 10637 - DNA, 25 bp, Mus musculus
caaaggaggcctagactcagagtgc

SEQ ID NO: 10638 - DNA, 25 bp, Mus musculus
caaaggaggccttgactcagagtgc

SEQ ID NO: 10639 - DNA, 25 bp, Mus musculus
caaaggagggactttttatgcgaag

SEQ ID NO: 10640 - DNA, 25 bp, Mus musculus
caaaggagtcttctagcttagttca

SEQ ID NO: 10641 - DNA, 25 bp, Mus musculus
caaaggagttctcactggagagcca

SEQ ID NO: 10642 - DNA, 25 bp, Mus musculus
caaaggataactcggagactccagc

SEQ ID NO: 10643 - DNA, 25 bp, Mus musculus
caaaggatccatgtgggaccagcta

SEQ ID NO: 10644 - DNA, 25 bp, Mus musculus
caaaggatgaagttcagcacgtggg

SEQ ID NO: 10645 - DNA, 25 bp, Mus musculus
caaaggcaagcggaatgcaatcgca

SEQ ID NO: 10646 - DNA, 25 bp, Mus musculus
caaaggcacttactgtctaaaccaa

SEQ ID NO: 10647 - DNA, 25 bp, Mus musculus
caaaggcacttagtgtctaaaccaa

SEQ ID NO: 10648 - DNA, 25 bp, Mus musculus
caaaggcagcaagagatgcccaaga

SEQ ID NO: 10649 - DNA, 25 bp, Mus musculus
caaaggcctggataacagaaaatgc

SEQ ID NO: 10650 - DNA, 25 bp, Mus musculus
caaaggcgatttaccagtgacttct

SEQ ID NO: 10651 - DNA, 25 bp, Mus musculus
caaaggcggctacaaggagttcttc

SEQ ID NO: 10652 - DNA, 25 bp, Mus musculus
caaaggctacatccccaacatgctg

SEQ ID NO: 10653 - DNA, 25 bp, Mus musculus
caaaggctacctaaaggacccagag

SEQ ID NO: 10654 - DNA, 25 bp, Mus musculus
caaaggctccacatgctcacctgaa

SEQ ID NO: 10655 - DNA, 25 bp, Mus musculus
caaaggctccatattacacagtatg

SEQ ID NO: 10656 - DNA, 25 bp, Mus musculus
caaaggcttcctcaacgtgaatgac

SEQ ID NO: 10657 - DNA, 25 bp, Mus musculus
caaaggctttgctgcagttcatctt

SEQ ID NO: 10658 - DNA, 25 bp, Mus musculus
caaagggagcttcgttactcacttg

SEQ ID NO: 10659 - DNA, 25 bp, Mus musculus
caaagggcagaaatgcctgcaggcg

SEQ ID NO: 10660 - DNA, 25 bp, Mus musculus
caaagggccctgacattagagtcaa

SEQ ID NO: 10661 - DNA, 25 bp, Mus musculus
caaagggctgctgggcatgtgtgtc

SEQ ID NO: 10662 - DNA, 25 bp, Mus musculus
caaaggggtccttcacatgtacctg

SEQ ID NO: 10663 - DNA, 25 bp, Mus musculus
caaagggtccaggtgaaggtgccac

SEQ ID NO: 10664 - DNA, 25 bp, Mus musculus
caaagggttgactatgtttaacaag

SEQ ID NO: 10665 - DNA, 25 bp, Mus musculus
caaaggtaacaatgtgttcaaaggc

SEQ ID NO: 10666 - DNA, 25 bp, Mus musculus
caaaggtcaaggcagtaaggtgttc

SEQ ID NO: 10667 - DNA, 25 bp, Mus musculus
caaaggtcaagggagtaaggtgttc

SEQ ID NO: 10668 - DNA, 25 bp, Mus musculus
caaaggtcatctatggagccagcac

SEQ ID NO: 10669 - DNA, 25 bp, Mus musculus
caaaggtgaatgaagcccccaactc

SEQ ID NO: 10670 - DNA, 25 bp, Mus musculus
caaaggtgcaagatacaggcttgga

SEQ ID NO: 10671 - DNA, 25 bp, Mus musculus
caaaggtggcatagagtacagccgt

SEQ ID NO: 10672 - DNA, 25 bp, Mus musculus
caaaggttctgaggctcactgcaag

SEQ ID NO: 10673 - DNA, 25 bp, Mus musculus
caaaggttgcgcttccacaaagtca

SEQ ID NO: 10674 - DNA, 25 bp, Mus musculus
caaagtacacatcctgtatgtggga

SEQ ID NO: 10675 - DNA, 25 bp, Mus musculus
caaagtacagattctgggaaaacag

SEQ ID NO: 10676 - DNA, 25 bp, Mus musculus
caaagtagaaaaacactatctcttc

SEQ ID NO: 10677 - DNA, 25 bp, Mus musculus
caaagtagcagcaactgagagggag

SEQ ID NO: 10678 - DNA, 25 bp, Mus musculus
caaagtagggctccagagctcgaag

SEQ ID NO: 10679 - DNA, 25 bp, Mus musculus
caaagtagtagaagtcgccgaagag

SEQ ID NO: 10680 - DNA, 25 bp, Mus musculus
caaagtagtagtccataaagagaca

SEQ ID NO: 10681 - DNA, 25 bp, Mus musculus
caaagtataacacctttggagaggc

SEQ ID NO: 10682 - DNA, 25 bp, Mus musculus
caaagtcaaatattggacatctcca

SEQ ID NO: 10683 - DNA, 25 bp, Mus musculus
caaagtcactgacttccgggagtgg

SEQ ID NO: 10684 - DNA, 25 bp, Mus musculus
caaagtcactttgtccaaggcccag

SEQ ID NO: 10685 - DNA, 25 bp, Mus musculus
caaagtcagcatactgtcaaccttc

SEQ ID NO: 10686 - DNA, 25 bp, Mus musculus
caaagtccttcgatgggaaagagcc

SEQ ID NO: 10687 - DNA, 25 bp, Mus musculus
caaagtccttcgcaagccttatgaa

SEQ ID NO: 10688 - DNA, 25 bp, Mus musculus
caaagtcgctgtgtcatgagattga

SEQ ID NO: 10689 - DNA, 25 bp, Mus musculus
caaagtctcgactgcaatgctaacg

SEQ ID NO: 10690 - DNA, 25 bp, Mus musculus
caaagtcttacacagacgcatcaag

SEQ ID NO: 10691 - DNA, 25 bp, Mus musculus
caaagtgaaggatttcgctaatgtg

SEQ ID NO: 10692 - DNA, 25 bp, Mus musculus
caaagtgaagtataatgtgatcagc

SEQ ID NO: 10693 - DNA, 25 bp, Mus musculus
caaagtgaatcctttccggcctggg

SEQ ID NO: 10694 - DNA, 25 bp, Mus musculus
caaagtgactcaccttgtggtccta

SEQ ID NO: 10695 - DNA, 25 bp, Mus musculus
caaagtgagaggtaccctcctccct

SEQ ID NO: 10696 - DNA, 25 bp, Mus musculus
caaagtgatccacagtgaggacaaa

SEQ ID NO: 10697 - DNA, 25 bp, Mus musculus
caaagtgcagatccacagtcaggac

SEQ ID NO: 10698 - DNA, 25 bp, Mus musculus
caaagtgcagatgtgccagctggaa

SEQ ID NO: 10699 - DNA, 25 bp, Mus musculus
caaagtgcccttaaccaatgaatca

SEQ ID NO: 10700 - DNA, 25 bp, Mus musculus
caaagtgctctgttttgggcagaca

SEQ ID NO: 10701 - DNA, 25 bp, Mus musculus
caaagtggacaaattagttcgagac

SEQ ID NO: 10702 - DNA, 25 bp, Mus musculus
caaagtggacacaagagaccacagt

SEQ ID NO: 10703 - DNA, 25 bp, Mus musculus
caaagtggacatgagtgaacagcag

SEQ ID NO: 10704 - DNA, 25 bp, Mus musculus
caaagtggctgcgtctgactggaca

SEQ ID NO: 10705 - DNA, 25 bp, Mus musculus
caaagtgggaattccccagagataa

SEQ ID NO: 10706 - DNA, 25 bp, Mus musculus
caaagtgggatttcctactgcatca

SEQ ID NO: 10707 - DNA, 25 bp, Mus musculus
caaagtgggtctctggcattgctgc

SEQ ID NO: 10708 - DNA, 25 bp, Mus musculus
caaagtgggtctgtggcattgctgc

SEQ ID NO: 10709 - DNA, 25 bp, Mus musculus
caaagtggtggtcaccatggagcac

SEQ ID NO: 10710 - DNA, 25 bp, Mus musculus
caaagtggtggtcatcacagatgcc

SEQ ID NO: 10711 - DNA, 25 bp, Mus musculus
caaagtgtcatgactgctgaaggaa

SEQ ID NO: 10712 - DNA, 25 bp, Mus musculus
caaagtgtcctatgcgactgccatg

SEQ ID NO: 10713 - DNA, 25 bp, Mus musculus
caaagtgtggtccaggttactccac

SEQ ID NO: 10714 - DNA, 25 bp, Mus musculus
caaagttcaacctgaatttccagga

SEQ ID NO: 10715 - DNA, 25 bp, Mus musculus
caaagttcctgtactcaaagacgga

SEQ ID NO: 10716 - DNA, 25 bp, Mus musculus
caaagttgaccactctaagggacag

SEQ ID NO: 10717 - DNA, 25 bp, Mus musculus
caaagttgaccttcaccaaatttgg

SEQ ID NO: 10718 - DNA, 25 bp, Mus musculus
caaagttgccaaggttcttttggat

SEQ ID NO: 10719 - DNA, 25 bp, Mus musculus
caaagttgttaactgtaaagtcaga

SEQ ID NO: 10720 - DNA, 25 bp, Mus musculus
caaagtttaataggatatggccgaa

SEQ ID NO: 10721 - DNA, 25 bp, Mus musculus
caaagtttggagcttggccattggc

SEQ ID NO: 10722 - DNA, 25 bp, Mus musculus
caaataacactgtcctggcaacgtg

SEQ ID NO: 10723 - DNA, 25 bp, Mus musculus
caaataacgccaggttcttggactt

SEQ ID NO: 10724 - DNA, 25 bp, Mus musculus
caaataaggaaaatgagacatctcc

SEQ ID NO: 10725 - DNA, 25 bp, Mus musculus
caaataaggactccccttctgctac

SEQ ID NO: 10726 - DNA, 25 bp, Mus musculus
caaataaggatgcaactaaaatcag

SEQ ID NO: 10727 - DNA, 25 bp, Mus musculus
caaataaggcagaccagtgaggact

SEQ ID NO: 10728 - DNA, 25 bp, Mus musculus
caaataatgtgacagtatcctttct

SEQ ID NO: 10729 - DNA, 25 bp, Mus musculus
caaataatgtgagagtatcctttct

SEQ ID NO: 10730 - DNA, 25 bp, Mus musculus
caaataattagacaggataagactg

SEQ ID NO: 10731 - DNA, 25 bp, Mus musculus
caaatacagcgtggagactgttcag

SEQ ID NO: 10732 - DNA, 25 bp, Mus musculus
caaatacaggcatgttgatgggaat

SEQ ID NO: 10733 - DNA, 25 bp, Mus musculus
caaatacattcttggaagatccaga

SEQ ID NO: 10734 - DNA, 25 bp, Mus musculus
caaataccgaggagtaaggattggt

SEQ ID NO: 10735 - DNA, 25 bp, Mus musculus
caaataccggaagaatgaagccaag

SEQ ID NO: 10736 - DNA, 25 bp, Mus musculus
caaatacctggtacccactttccag

SEQ ID NO: 10737 - DNA, 25 bp, Mus musculus
caaatacggaaagcttgaagtcgca

SEQ ID NO: 10738 - DNA, 25 bp, Mus musculus
caaatactgttatgagaaaatgcca

SEQ ID NO: 10739 - DNA, 25 bp, Mus musculus
caaatacttcagtatatcccgaagc

SEQ ID NO: 10740 - DNA, 25 bp, Mus musculus
caaatagaggagctaaacctgccca

SEQ ID NO: 10741 - DNA, 25 bp, Mus musculus
caaatagggccaggagagagctagc

SEQ ID NO: 10742 - DNA, 25 bp, Mus musculus
caaatatgaatgtagccagactggt

SEQ ID NO: 10743 - DNA, 25 bp, Mus musculus
caaatatgccagaattctcttgaac

SEQ ID NO: 10744 - DNA, 25 bp, Mus musculus
caaatatgcctgctcaggtggacca

SEQ ID NO: 10745 - DNA, 25 bp, Mus musculus
caaatatggacgtctgtattatgaa

SEQ ID NO: 10746 - DNA, 25 bp, Mus musculus
caaatatgggaaaagtctgttgaac

SEQ ID NO: 10747 - DNA, 25 bp, Mus musculus
caaatattcagccatctggagcgcc

SEQ ID NO: 10748 - DNA, 25 bp, Mus musculus
caaatcaagtaaatgttgtacatat

SEQ ID NO: 10749 - DNA, 25 bp, Mus musculus
caaatcaatgccttggcagatgata

SEQ ID NO: 10750 - DNA, 25 bp, Mus musculus
caaatcagcttctgctatatcatca

SEQ ID NO: 10751 - DNA, 25 bp, Mus musculus
caaatcatgactattgtagatgagc

SEQ ID NO: 10752 - DNA, 25 bp, Mus musculus
caaatcatgcctaagaaagaccctg

SEQ ID NO: 10753 - DNA, 25 bp, Mus musculus
caaatcatggcctctgtgaataccc

SEQ ID NO: 10754 - DNA, 25 bp, Mus musculus
caaatccaaggacaatagtggtgag

SEQ ID NO: 10755 - DNA, 25 bp, Mus musculus
caaatccagagaggaactttgtcct

SEQ ID NO: 10756 - DNA, 25 bp, Mus musculus
caaatccaggatcactgactttgaa

SEQ ID NO: 10757 - DNA, 25 bp, Mus musculus
caaatcccagtcatgaagtcaccct

SEQ ID NO: 10758 - DNA, 25 bp, Mus musculus
caaatccctgagcatctgatggctc

SEQ ID NO: 10759 - DNA, 25 bp, Mus musculus
caaatccggtaagcctggaggcgat

SEQ ID NO: 10760 - DNA, 25 bp, Mus musculus
caaatcctgacgcatgttatcgaag

SEQ ID NO: 10761 - DNA, 25 bp, Mus musculus
caaatcgactgctttgaaagcaccg

SEQ ID NO: 10762 - DNA, 25 bp, Mus musculus
caaatcggcctatgcactctgcaca

SEQ ID NO: 10763 - DNA, 25 bp, Mus musculus
caaatctagtgacaattcaagtaac

SEQ ID NO: 10764 - DNA, 25 bp, Mus musculus
caaatctatctgcagaggcgggcag

SEQ ID NO: 10765 - DNA, 25 bp, Mus musculus
caaatctcggtctcggacccgatct

SEQ ID NO: 10766 - DNA, 25 bp, Mus musculus
caaatcttcagctaaggaaccagtt

SEQ ID NO: 10767 - DNA, 25 bp, Mus musculus
caaatcttcgaaggactcctcgaag

SEQ ID NO: 10768 - DNA, 25 bp, Mus musculus
caaatcttcgacaagagctagaaga

SEQ ID NO: 10769 - DNA, 25 bp, Mus musculus
caaatgaaacagacggcaagagcac

SEQ ID NO: 10770 - DNA, 25 bp, Mus musculus
caaatgaaggatgaacctgaagtag

SEQ ID NO: 10771 - DNA, 25 bp, Mus musculus
caaatgacagatgggctgatacccc

SEQ ID NO: 10772 - DNA, 25 bp, Mus musculus
caaatgatatatcctgcccagaaag

SEQ ID NO: 10773 - DNA, 25 bp, Mus musculus
caaatgatgagatagtagaagttct

SEQ ID NO: 10774 - DNA, 25 bp, Mus musculus
caaatgattgcgtagatggcgctgg

SEQ ID NO: 10775 - DNA, 25 bp, Mus musculus
caaatgcaacctgctggcagagaag

SEQ ID NO: 10776 - DNA, 25 bp, Mus musculus
caaatgcagaaccactcgctggaga

SEQ ID NO: 10777 - DNA, 25 bp, Mus musculus
caaatgcagagaagagctcatacct

SEQ ID NO: 10778 - DNA, 25 bp, Mus musculus
caaatgcatccacaaaaggcggcca

SEQ ID NO: 10779 - DNA, 25 bp, Mus musculus
caaatgcattggctgctgtgaggca

SEQ ID NO: 10780 - DNA, 25 bp, Mus musculus
caaatgccatcgatccaacggtacc

SEQ ID NO: 10781 - DNA, 25 bp, Mus musculus
caaatgccttcctggttgccactag

SEQ ID NO: 10782 - DNA, 25 bp, Mus musculus
caaatgctaagcaaaacagtgtgcc

SEQ ID NO: 10783 - DNA, 25 bp, Mus musculus
caaatgctgagaacctagaagattc

SEQ ID NO: 10784 - DNA, 25 bp, Mus musculus
caaatgcttcaggtaaacgttgaag

SEQ ID NO: 10785 - DNA, 25 bp, Mus musculus
caaatgcttctccagaagagactag

SEQ ID NO: 10786 - DNA, 25 bp, Mus musculus
caaatggaagcgtgagcatgcccgt

SEQ ID NO: 10787 - DNA, 25 bp, Mus musculus
caaatggaatggcttctgaggaagt

SEQ ID NO: 10788 - DNA, 25 bp, Mus musculus
caaatggacagctttactctggaca

SEQ ID NO: 10789 - DNA, 25 bp, Mus musculus
caaatggaccaagatacgttgtagg

SEQ ID NO: 10790 - DNA, 25 bp, Mus musculus
caaatggatcctcccaaagctggac

SEQ ID NO: 10791 - DNA, 25 bp, Mus musculus
caaatggctgatggtaactagcaac

SEQ ID NO: 10792 - DNA, 25 bp, Mus musculus
caaatgggaccagtagtttgccaac

SEQ ID NO: 10793 - DNA, 25 bp, Mus musculus
caaatgggagatggacacttctgag

SEQ ID NO: 10794 - DNA, 25 bp, Mus musculus
caaatgggataacattgccggtgga

SEQ ID NO: 10795 - DNA, 25 bp, Mus musculus
caaatgggccaggaaattgggaacg

SEQ ID NO: 10796 - DNA, 25 bp, Mus musculus
caaatgggcgaagaccaaaaggtga

SEQ ID NO: 10797 - DNA, 25 bp, Mus musculus
caaatgggttattaagaaagtggca

SEQ ID NO: 10798 - DNA, 25 bp, Mus musculus
caaatggtcatctgaattgtagtct

SEQ ID NO: 10799 - DNA, 25 bp, Mus musculus
caaatggtggcgatcagaatcaaaa

SEQ ID NO: 10800 - DNA, 25 bp, Mus musculus
caaatgtgaacagcttccagaggaa

SEQ ID NO: 10801 - DNA, 25 bp, Mus musculus
caaatgtgccgagcttgaagaagaa

SEQ ID NO: 10802 - DNA, 25 bp, Mus musculus
caaatgtggctaggataatgaaaaa

SEQ ID NO: 10803 - DNA, 25 bp, Mus musculus
caaatgttagtccagagaggttatg

SEQ ID NO: 10804 - DNA, 25 bp, Mus musculus
caaatgttgccactgctgttttaga

SEQ ID NO: 10805 - DNA, 25 bp, Mus musculus
caaattaaagatgattcgggagtac

SEQ ID NO: 10806 - DNA, 25 bp, Mus musculus
caaattaagaaggatgtgaacaaca

SEQ ID NO: 10807 - DNA, 25 bp, Mus musculus
caaattacgacccatctgagtggag

SEQ ID NO: 10808 - DNA, 25 bp, Mus musculus
caaattatgggacattcagaatgga

SEQ ID NO: 10809 - DNA, 25 bp, Mus musculus
caaattcacctctgacagcctggag

SEQ ID NO: 10810 - DNA, 25 bp, Mus musculus
caaattcagtctcaaactcagtcac

SEQ ID NO: 10811 - DNA, 25 bp, Mus musculus
caaattccactgaagctgggcagaa

SEQ ID NO: 10812 - DNA, 25 bp, Mus musculus
caaattccagtccatcgggattcag

SEQ ID NO: 10813 - DNA, 25 bp, Mus musculus
caaattcgacttctccgggaacctg

SEQ ID NO: 10814 - DNA, 25 bp, Mus musculus
caaattgaagtgatcccttgcaaga

SEQ ID NO: 10815 - DNA, 25 bp, Mus musculus
caaattgacccagatcagacaaatc

SEQ ID NO: 10816 - DNA, 25 bp, Mus musculus
caaattgccaaaggcaaaggtgcaa

SEQ ID NO: 10817 - DNA, 25 bp, Mus musculus
caaattggccgctcagggaaagttc

SEQ ID NO: 10818 - DNA, 25 bp, Mus musculus
caaattgggtggctattcttgcatc

SEQ ID NO: 10819 - DNA, 25 bp, Mus musculus
caaattgttttgagcaaagttgacc

SEQ ID NO: 10820 - DNA, 25 bp, Mus musculus
caaatttactatgatggacaatctg

SEQ ID NO: 10821 - DNA, 25 bp, Mus musculus
caaatttccacatctgcatagctgc

SEQ ID NO: 10822 - DNA, 25 bp, Mus musculus
caaatttccattgatgaatcggaaa

SEQ ID NO: 10823 - DNA, 25 bp, Mus musculus
caaatttctacctgaaacttgaaga

SEQ ID NO: 10824 - DNA, 25 bp, Mus musculus
caaatttgattatgtggcacagcag

SEQ ID NO: 10825 - DNA, 25 bp, Mus musculus
caaatttggaaaacacaacaagagg

SEQ ID NO: 10826 - DNA, 25 bp, Mus musculus
caaattttggaatttgggcagacac

SEQ ID NO: 10827 - DNA, 25 bp, Mus musculus
caaatttttaccctgcttggaggtg

SEQ ID NO: 10828 - DNA, 25 bp, Mus musculus
caacaaaaacagtctcgtaagccca

SEQ ID NO: 10829 - DNA, 25 bp, Mus musculus
caacaaaaccatcgctaatacccag

SEQ ID NO: 10830 - DNA, 25 bp, Mus musculus
caacaaaactgtggccatccataca

SEQ ID NO: 10831 - DNA, 25 bp, Mus musculus
caacaaaataatgagatgaggacag

SEQ ID NO: 10832 - DNA, 25 bp, Mus musculus
caacaaacctgctacaaaagatact

SEQ ID NO: 10833 - DNA, 25 bp, Mus musculus
caacaaagccaacgtggtaaccagc

SEQ ID NO: 10834 - DNA, 25 bp, Mus musculus
caacaaagccacgtgggatgcaaga

SEQ ID NO: 10835 - DNA, 25 bp, Mus musculus
caacaaagtgcccttaaccaatgaa

SEQ ID NO: 10836 - DNA, 25 bp, Mus musculus
caacaaatactggtaacagagtgat

SEQ ID NO: 10837 - DNA, 25 bp, Mus musculus
caacaaatttttagcgatgtcaaaa

SEQ ID NO: 10838 - DNA, 25 bp, Mus musculus
caacaacagtgatgctagtttgcca

SEQ ID NO: 10839 - DNA, 25 bp, Mus musculus
caacaacagttctgtagagagttta

SEQ ID NO: 10840 - DNA, 25 bp, Mus musculus
caacaacatcaccactgggaagata

SEQ ID NO: 10841 - DNA, 25 bp, Mus musculus
caacaaccaggaatgtattggataa

SEQ ID NO: 10842 - DNA, 25 bp, Mus musculus
caacaacctgtttggcctggccttc

SEQ ID NO: 10843 - DNA, 25 bp, Mus musculus
caacaactcaacagagtgggaaaag

SEQ ID NO: 10844 - DNA, 25 bp, Mus musculus
caacaactccaggaagtatgtctcc

SEQ ID NO: 10845 - DNA, 25 bp, Mus musculus
caacaactctgaaggccattgggca

SEQ ID NO: 10846 - DNA, 25 bp, Mus musculus
caacaacttgaaatccctggaagcc

SEQ ID NO: 10847 - DNA, 25 bp, Mus musculus
caacaacttgttagtcttccgtgtg

SEQ ID NO: 10848 - DNA, 25 bp, Mus musculus
caacaactttgagggtgagatcacc

SEQ ID NO: 10849 - DNA, 25 bp, Mus musculus
caacaagaaaaacttaggattccag

SEQ ID NO: 10850 - DNA, 25 bp, Mus musculus
caacaagaaggacatatttgaggag

SEQ ID NO: 10851 - DNA, 25 bp, Mus musculus
caacaagatcacgttctccgagcag

SEQ ID NO: 10852 - DNA, 25 bp, Mus musculus
caacaaggaaagaggcagagcagct

SEQ ID NO: 10853 - DNA, 25 bp, Mus musculus
caacaaggagacagggatgtaccat

SEQ ID NO: 10854 - DNA, 25 bp, Mus musculus
caacaaggatcctagggaagcacca

SEQ ID NO: 10855 - DNA, 25 bp, Mus musculus
caacaaggatgactagaatgggcca

SEQ ID NO: 10856 - DNA, 25 bp, Mus musculus
caacaaggcatgtggttgaaggcct

SEQ ID NO: 10857 - DNA, 25 bp, Mus musculus
caacaaggcggagaaacacgtgcac

SEQ ID NO: 10858 - DNA, 25 bp, Mus musculus
caacaagtctggtagttagccccgg

SEQ ID NO: 10859 - DNA, 25 bp, Mus musculus
caacaagtggttctactgcggtctg

SEQ ID NO: 10860 - DNA, 25 bp, Mus musculus
caacaagtgtccttggttataaact

SEQ ID NO: 10861 - DNA, 25 bp, Mus musculus
caacaataacggataaggaccgcac

SEQ ID NO: 10862 - DNA, 25 bp, Mus musculus
caacaatagaaggttcaactctctt

SEQ ID NO: 10863 - DNA, 25 bp, Mus musculus
caacaatcctagtaagaaatacctc

SEQ ID NO: 10864 - DNA, 25 bp, Mus musculus
caacaatgacatgcatgaaaggcac

SEQ ID NO: 10865 - DNA, 25 bp, Mus musculus
caacaatgagtacccagacccagag

SEQ ID NO: 10866 - DNA, 25 bp, Mus musculus
caacaatggcaagttctacgtggga

SEQ ID NO: 10867 - DNA, 25 bp, Mus musculus
caacaatgtggagactgctcacaac

SEQ ID NO: 10868 - DNA, 25 bp, Mus musculus
caacaattaatgttccaagtacagg

SEQ ID NO: 10869 - DNA, 25 bp, Mus musculus
caacaattggccaagaaattctgcc

SEQ ID NO: 10870 - DNA, 25 bp, Mus musculus
caacacacagaataatggaacctat

SEQ ID NO: 10871 - DNA, 25 bp, Mus musculus
caacacagaagagaccacgtgctgg

SEQ ID NO: 10872 - DNA, 25 bp, Mus musculus
caacacatcatccacctggaacaag

SEQ ID NO: 10873 - DNA, 25 bp, Mus musculus
caacacatgtgcctggaactgactg

SEQ ID NO: 10874 - DNA, 25 bp, Mus musculus
caacaccaagtgaagctatgactct

SEQ ID NO: 10875 - DNA, 25 bp, Mus musculus
caacaccaagtgtagctatgactct

SEQ ID NO: 10876 - DNA, 25 bp, Mus musculus
caacaccaggtatatggctgacatg

SEQ ID NO: 10877 - DNA, 25 bp, Mus musculus
caacacccctattttcttcatcagg

SEQ ID NO: 10878 - DNA, 25 bp, Mus musculus
caacacctgggctctttggtacctc

SEQ ID NO: 10879 - DNA, 25 bp, Mus musculus
caacacctgtgaaggacaattcccg

SEQ ID NO: 10880 - DNA, 25 bp, Mus musculus
caacacctgtgatggacaattcccg

SEQ ID NO: 10881 - DNA, 25 bp, Mus musculus
caacaccttccgtgggtttactcag

SEQ ID NO: 10882 - DNA, 25 bp, Mus musculus
caacacgggcgagatcaaagcactg

SEQ ID NO: 10883 - DNA, 25 bp, Mus musculus
caacactatttattgtacatgtgtg

SEQ ID NO: 10884 - DNA, 25 bp, Mus musculus
caacactgctaggtttggcaaatat

SEQ ID NO: 10885 - DNA, 25 bp, Mus musculus
caacactgctgctaccgaggcctag

SEQ ID NO: 10886 - DNA, 25 bp, Mus musculus
caacactggcctcataattgcccag

SEQ ID NO: 10887 - DNA, 25 bp, Mus musculus
caacactgggaaggcacggaggaaa

SEQ ID NO: 10888 - DNA, 25 bp, Mus musculus
caacactgtcccctacatagtgggc

SEQ ID NO: 10889 - DNA, 25 bp, Mus musculus
caacagaagatagcgggagtaacac

SEQ ID NO: 10890 - DNA, 25 bp, Mus musculus
caacagaaggcgcaaatacttcttc

SEQ ID NO: 10891 - DNA, 25 bp, Mus musculus
caacagacagctgccttggacacag

SEQ ID NO: 10892 - DNA, 25 bp, Mus musculus
caacagacattctacgaactagtgg

SEQ ID NO: 10893 - DNA, 25 bp, Mus musculus
caacagacgggccatccatgacaag

SEQ ID NO: 10894 - DNA, 25 bp, Mus musculus
caacagagaaagagactaatacttt

SEQ ID NO: 10895 - DNA, 25 bp, Mus musculus
caacagagaaagtgactaatacttt

SEQ ID NO: 10896 - DNA, 25 bp, Mus musculus
caacagagatgtgtgaccagcggca

SEQ ID NO: 10897 - DNA, 25 bp, Mus musculus
caacagagttttgggacgcctcctc

SEQ ID NO: 10898 - DNA, 25 bp, Mus musculus
caacagatctaaggtggaaaaacag

SEQ ID NO: 10899 - DNA, 25 bp, Mus musculus
caacagccaggaaagtctgcaagaa

SEQ ID NO: 10900 - DNA, 25 bp, Mus musculus
caacagcctaatgctgaagcacaat

SEQ ID NO: 10901 - DNA, 25 bp, Mus musculus
caacagcctgcagttcgtgtgggag

SEQ ID NO: 10902 - DNA, 25 bp, Mus musculus
caacagcgagctctctgaggcagaa

SEQ ID NO: 10903 - DNA, 25 bp, Mus musculus
caacagctatgtgatcgctggctat

SEQ ID NO: 10904 - DNA, 25 bp, Mus musculus
caacagctcatctcgatttgactgc

SEQ ID NO: 10905 - DNA, 25 bp, Mus musculus
caacagctcttgagtcgtggtgtgc

SEQ ID NO: 10906 - DNA, 25 bp, Mus musculus
caacagctgtgacaagggtgacacc

SEQ ID NO: 10907 - DNA, 25 bp, Mus musculus
caacagctgtgagaagggtgacacc

SEQ ID NO: 10908 - DNA, 25 bp, Mus musculus
caacaggaagaggaaatgacatgca

SEQ ID NO: 10909 - DNA, 25 bp, Mus musculus
caacaggaggagatcctaaggcccg

SEQ ID NO: 10910 - DNA, 25 bp, Mus musculus
caacaggcatgcaaccaggcaccag

SEQ ID NO: 10911 - DNA, 25 bp, Mus musculus
caacaggccaattggactgggctct

SEQ ID NO: 10912 - DNA, 25 bp, Mus musculus
caacaggcctttgaagaggctcgaa

SEQ ID NO: 10913 - DNA, 25 bp, Mus musculus
caacagggcattttgtaatgcagca

SEQ ID NO: 10914 - DNA, 25 bp, Mus musculus
caacagggtttgagcgaataggtga

SEQ ID NO: 10915 - DNA, 25 bp, Mus musculus
caacaggtgctgtagatctctccga

SEQ ID NO: 10916 - DNA, 25 bp, Mus musculus
caacaggtgtagcagatgaggccct

SEQ ID NO: 10917 - DNA, 25 bp, Mus musculus
caacagtactctgatcatcagcaac

SEQ ID NO: 10918 - DNA, 25 bp, Mus musculus
caacagtagaaattggcgctttcga

SEQ ID NO: 10919 - DNA, 25 bp, Mus musculus
caacagtcaaggtgaaaggttcatg

SEQ ID NO: 10920 - DNA, 25 bp, Mus musculus
caacagtcacaggagaagatcaacc

SEQ ID NO: 10921 - DNA, 25 bp, Mus musculus
caacagtccatacaatattagaaga

SEQ ID NO: 10922 - DNA, 25 bp, Mus musculus
caacagtcctgatgagtcctcctat

SEQ ID NO: 10923 - DNA, 25 bp, Mus musculus
caacagtgcagtggagaaagctgtg

SEQ ID NO: 10924 - DNA, 25 bp, Mus musculus
caacagtgccaacgaggtcttccac

SEQ ID NO: 10925 - DNA, 25 bp, Mus musculus
caacagtgctaatcgagatatttcc

SEQ ID NO: 10926 - DNA, 25 bp, Mus musculus
caacagtgctaatgaagacaatgtc

SEQ ID NO: 10927 - DNA, 25 bp, Mus musculus
caacagtgctacagtttgaaggcca

SEQ ID NO: 10928 - DNA, 25 bp, Mus musculus
caacagtgcttcaacaatgagtcta

SEQ ID NO: 10929 - DNA, 25 bp, Mus musculus
caacagtgcttctacaatgagtcta

SEQ ID NO: 10930 - DNA, 25 bp, Mus musculus
caacagtggtgtgttctccaagtac

SEQ ID NO: 10931 - DNA, 25 bp, Mus musculus
caacagtggtttcaagtacagagcc

SEQ ID NO: 10932 - DNA, 25 bp, Mus musculus
caacagttgtactgcttaagaagca

SEQ ID NO: 10933 - DNA, 25 bp, Mus musculus
caacagtttcttctgttcaagttgc

SEQ ID NO: 10934 - DNA, 25 bp, Mus musculus
caacagtttgaaatggccaactcac

SEQ ID NO: 10935 - DNA, 25 bp, Mus musculus
caacataatggcttttaatgcagcc

SEQ ID NO: 10936 - DNA, 25 bp, Mus musculus
caacatcaacttttctttggagcag

SEQ ID NO: 10937 - DNA, 25 bp, Mus musculus
caacatcagaactttctttataaac

SEQ ID NO: 10938 - DNA, 25 bp, Mus musculus
caacatccaagctgtgtccctcaag

SEQ ID NO: 10939 - DNA, 25 bp, Mus musculus
caacatccttgcactgcacgaagta

SEQ ID NO: 10940 - DNA, 25 bp, Mus musculus
caacatctcatctcacgttcatcag

SEQ ID NO: 10941 - DNA, 25 bp, Mus musculus
caacatctcctcagccagtggcatg

SEQ ID NO: 10942 - DNA, 25 bp, Mus musculus
caacatctgggactataatcaaatg

SEQ ID NO: 10943 - DNA, 25 bp, Mus musculus
caacatctggtaccccaagtttaat

SEQ ID NO: 10944 - DNA, 25 bp, Mus musculus
caacatctgtgaaaccattgtctgg

SEQ ID NO: 10945 - DNA, 25 bp, Mus musculus
caacatcttgagttgatggaagaca

SEQ ID NO: 10946 - DNA, 25 bp, Mus musculus
caacatgagaaatgacctgtatcag

SEQ ID NO: 10947 - DNA, 25 bp, Mus musculus
caacatgcaccatcagtggctcctg

SEQ ID NO: 10948 - DNA, 25 bp, Mus musculus
caacatggcactgggcaagttccgg

SEQ ID NO: 10949 - DNA, 25 bp, Mus musculus
caacatggcctttcttggaagtcaa

SEQ ID NO: 10950 - DNA, 25 bp, Mus musculus
caacatggctgctttacttcgaaaa

SEQ ID NO: 10951 - DNA, 25 bp, Mus musculus
caacatgggaaatcctcttctgtgt

SEQ ID NO: 10952 - DNA, 25 bp, Mus musculus
caacatgtcaagaaatccgacggac

SEQ ID NO: 10953 - DNA, 25 bp, Mus musculus
caacatgtcagagtgggagtcctac

SEQ ID NO: 10954 - DNA, 25 bp, Mus musculus
caacatgttctgcagaattccctgc

SEQ ID NO: 10955 - DNA, 25 bp, Mus musculus
caacatgttgtatggaaccattaca

SEQ ID NO: 10956 - DNA, 25 bp, Mus musculus
caacattcaaatgcagaaagccaaa

SEQ ID NO: 10957 - DNA, 25 bp, Mus musculus
caacattcagagtcgatcatcctac

SEQ ID NO: 10958 - DNA, 25 bp, Mus musculus
caacattcagtatgaagtcattggt

SEQ ID NO: 10959 - DNA, 25 bp, Mus musculus
caacattgcctgtggtcagacctca

SEQ ID NO: 10960 - DNA, 25 bp, Mus musculus
caacattggcgcgagctgggtttct

SEQ ID NO: 10961 - DNA, 25 bp, Mus musculus
caacattgggctatccgagtctgaa

SEQ ID NO: 10962 - DNA, 25 bp, Mus musculus
caacattgtggcaccgtataagata

SEQ ID NO: 10963 - DNA, 25 bp, Mus musculus
caacatttaaagtggactgacccta

SEQ ID NO: 10964 - DNA, 25 bp, Mus musculus
caacatttccccacaagaactgaga

SEQ ID NO: 10965 - DNA, 25 bp, Mus musculus
caacatttgacacacaaaggcagga

SEQ ID NO: 10966 - DNA, 25 bp, Mus musculus
caacattttgatggcagagcccaag

SEQ ID NO: 10967 - DNA, 25 bp, Mus musculus
caacattttttgagctctgctcaga

SEQ ID NO: 10968 - DNA, 25 bp, Mus musculus
caaccaactgcgacctggagctctg

SEQ ID NO: 10969 - DNA, 25 bp, Mus musculus
caaccaagaagaaggtagctgagca

SEQ ID NO: 10970 - DNA, 25 bp, Mus musculus
caaccaagacatgaaggaggccgag

SEQ ID NO: 10971 - DNA, 25 bp, Mus musculus
caaccaagctgagttctgcctgtca

SEQ ID NO: 10972 - DNA, 25 bp, Mus musculus
caaccaaggagaccttgattttgag

SEQ ID NO: 10973 - DNA, 25 bp, Mus musculus
caaccaaggagagcttgattttgag

SEQ ID NO: 10974 - DNA, 25 bp, Mus musculus
caaccaagggaacaagcccaacgca

SEQ ID NO: 10975 - DNA, 25 bp, Mus musculus
caaccaatccacattgtgtacgttc

SEQ ID NO: 10976 - DNA, 25 bp, Mus musculus
caaccaatccactttgtgtacgttc

SEQ ID NO: 10977 - DNA, 25 bp, Mus musculus
caaccaatgtgtttgccaataggct

SEQ ID NO: 10978 - DNA, 25 bp, Mus musculus
caaccacacaatcgaagtggaaata

SEQ ID NO: 10979 - DNA, 25 bp, Mus musculus
caaccacacaatggaagtggaaata

SEQ ID NO: 10980 - DNA, 25 bp, Mus musculus
caaccacacggctgacaatggcgtg

SEQ ID NO: 10981 - DNA, 25 bp, Mus musculus
caaccacacggtgtaccggggactg

SEQ ID NO: 10982 - DNA, 25 bp, Mus musculus
caaccacagtgcaaacacggagagt

SEQ ID NO: 10983 - DNA, 25 bp, Mus musculus
caaccaccaaacatgaccaaacaag

SEQ ID NO: 10984 - DNA, 25 bp, Mus musculus
caaccaccaagggaatttgtgagct

SEQ ID NO: 10985 - DNA, 25 bp, Mus musculus
caaccaccacatgttcgtgctggag

SEQ ID NO: 10986 - DNA, 25 bp, Mus musculus
caaccaccactgctcttaagacagg

SEQ ID NO: 10987 - DNA, 25 bp, Mus musculus
caaccacccgatggatgctgaagtt

SEQ ID NO: 10988 - DNA, 25 bp, Mus musculus
caaccacggcagctggcactagttt

SEQ ID NO: 10989 - DNA, 25 bp, Mus musculus
caaccacggcaggtggcactagttt

SEQ ID NO: 10990 - DNA, 25 bp, Mus musculus
caaccagaaggtgtctgttttcaag

SEQ ID NO: 10991 - DNA, 25 bp, Mus musculus
caaccagagctgcttttcaatatga

SEQ ID NO: 10992 - DNA, 25 bp, Mus musculus
caaccagagggaaaccacagtagtc

SEQ ID NO: 10993 - DNA, 25 bp, Mus musculus
caaccagagtgcagtttcgatggaa

SEQ ID NO: 10994 - DNA, 25 bp, Mus musculus
caaccagataaacctgcaagtccca

SEQ ID NO: 10995 - DNA, 25 bp, Mus musculus
caaccagtgtctatgttgtacagcc

SEQ ID NO: 10996 - DNA, 25 bp, Mus musculus
caaccagttctcagaagcactcagc

SEQ ID NO: 10997 - DNA, 25 bp, Mus musculus
caaccatatttttgagtccccagtc

SEQ ID NO: 10998 - DNA, 25 bp, Mus musculus
caaccatcatggcagtggagtttga

SEQ ID NO: 10999 - DNA, 25 bp, Mus musculus
caaccatcattaagtgacattcatc

SEQ ID NO: 11000 - DNA, 25 bp, Mus musculus
caaccatgaaacttggagagctgga

SEQ ID NO: 11001 - DNA, 25 bp, Mus musculus
caaccattgtttattgggtcacata

SEQ ID NO: 11002 - DNA, 25 bp, Mus musculus
caacccatagaacccgggaggagca

SEQ ID NO: 11003 - DNA, 25 bp, Mus musculus
caaccccatctttgagttctccaga

SEQ ID NO: 11004 - DNA, 25 bp, Mus musculus
caaccccggcgaatggaggagtcac

SEQ ID NO: 11005 - DNA, 25 bp, Mus musculus
caacccctgaaaggtcaatgaagtc

SEQ ID NO: 11006 - DNA, 25 bp, Mus musculus
caacccctttgacatttgtgctgca

SEQ ID NO: 11007 - DNA, 25 bp, Mus musculus
caacccgtgccacaaaggagggaca

SEQ ID NO: 11008 - DNA, 25 bp, Mus musculus
caacccttcgctgacctgattggtt

SEQ ID NO: 11009 - DNA, 25 bp, Mus musculus
caaccgaagacatcaaagcagcgtt

SEQ ID NO: 11010 - DNA, 25 bp, Mus musculus
caaccgaggatggacttgtacacac

SEQ ID NO: 11011 - DNA, 25 bp, Mus musculus
caaccgagggtggagatgcctgact

SEQ ID NO: 11012 - DNA, 25 bp, Mus musculus
caaccgatcattcttctctgacaag

SEQ ID NO: 11013 - DNA, 25 bp, Mus musculus
caaccgccaagactgatgcggaggc

SEQ ID NO: 11014 - DNA, 25 bp, Mus musculus
caaccgctgctactgacactatgtt

SEQ ID NO: 11015 - DNA, 25 bp, Mus musculus
caaccgctttgaggaatatgagtgg

SEQ ID NO: 11016 - DNA, 25 bp, Mus musculus
caaccggatctgcaaggtgctggct

SEQ ID NO: 11017 - DNA, 25 bp, Mus musculus
caaccggcagctgcaactggtgact

SEQ ID NO: 11018 - DNA, 25 bp, Mus musculus
caaccggcttggagcaaattctctc

SEQ ID NO: 11019 - DNA, 25 bp, Mus musculus
caaccggtgggaagatgaactgcga

SEQ ID NO: 11020 - DNA, 25 bp, Mus musculus
caaccgtgtggtgacattgtggtac

SEQ ID NO: 11021 - DNA, 25 bp, Mus musculus
caacctacaatattttgtcctgcac

SEQ ID NO: 11022 - DNA, 25 bp, Mus musculus
caacctagaagtgaaaggaagcgtg

SEQ ID NO: 11023 - DNA, 25 bp, Mus musculus
caacctcaagatccgggacgtggaa

SEQ ID NO: 11024 - DNA, 25 bp, Mus musculus
caacctcagaacacatattgaggag

SEQ ID NO: 11025 - DNA, 25 bp, Mus musculus
caacctcataaaggatggcgggcaa

SEQ ID NO: 11026 - DNA, 25 bp, Mus musculus
caacctctgacaaaggccgcttcta

SEQ ID NO: 11027 - DNA, 25 bp, Mus musculus
caacctgaagcggtgctcagagaca

SEQ ID NO: 11028 - DNA, 25 bp, Mus musculus
caacctgaatgtccggctagacaag

SEQ ID NO: 11029 - DNA, 25 bp, Mus musculus
caacctgcattagctggctacaatc

SEQ ID NO: 11030 - DNA, 25 bp, Mus musculus
caacctgctggcaattgctatcgag

SEQ ID NO: 11031 - DNA, 25 bp, Mus musculus
caacctgctggctattgctatcgag

SEQ ID NO: 11032 - DNA, 25 bp, Mus musculus
caacctggagaaagtgtcccggaca

SEQ ID NO: 11033 - DNA, 25 bp, Mus musculus
caacctggaggaggtgaagaactac

SEQ ID NO: 11034 - DNA, 25 bp, Mus musculus
caacctggctctgtggaatgtgtgg

SEQ ID NO: 11035 - DNA, 25 bp, Mus musculus
caacctggcttgtgtgtactacgag

SEQ ID NO: 11036 - DNA, 25 bp, Mus musculus
caacctgggtcaaggctgtggcatc

SEQ ID NO: 11037 - DNA, 25 bp, Mus musculus
caacctggtaaccaaatgggaagca

SEQ ID NO: 11038 - DNA, 25 bp, Mus musculus
caacctggtctgtggatgaagtgat

SEQ ID NO: 11039 - DNA, 25 bp, Mus musculus
caacctggtgttggacgatggcgct

SEQ ID NO: 11040 - DNA, 25 bp, Mus musculus
caacctgtagttccattggacagac

SEQ ID NO: 11041 - DNA, 25 bp, Mus musculus
caacctgtgagaggctgtggactgc

SEQ ID NO: 11042 - DNA, 25 bp, Mus musculus
caacctgttgggatcatcctaaaat

SEQ ID NO: 11043 - DNA, 25 bp, Mus musculus
caacctgttggtgttcctggtttgg

SEQ ID NO: 11044 - DNA, 25 bp, Mus musculus
caaccttacatgaccagaagcgcta

SEQ ID NO: 11045 - DNA, 25 bp, Mus musculus
caaccttgagaaggaggttctcatg

SEQ ID NO: 11046 - DNA, 25 bp, Mus musculus
caaccttgatcccagcaacgtggat

SEQ ID NO: 11047 - DNA, 25 bp, Mus musculus
caaccttgtgcaccgaaaagggaag

SEQ ID NO: 11048 - DNA, 25 bp, Mus musculus
caacctttcagttctcaagccattc

SEQ ID NO: 11049 - DNA, 25 bp, Mus musculus
caaccttttctgagtctacccaaag

SEQ ID NO: 11050 - DNA, 25 bp, Mus musculus
caacgaaacgtatgctttccttcca

SEQ ID NO: 11051 - DNA, 25 bp, Mus musculus
caacgaacccctgcagtttggtagt

SEQ ID NO: 11052 - DNA, 25 bp, Mus musculus
caacgacaaagtcatgggacctggg

SEQ ID NO: 11053 - DNA, 25 bp, Mus musculus
caacgacacagatgatatttttgcc

SEQ ID NO: 11054 - DNA, 25 bp, Mus musculus
caacgaccctccctggcatatgggt

SEQ ID NO: 11055 - DNA, 25 bp, Mus musculus
caacgagataccaaagattgagacg

SEQ ID NO: 11056 - DNA, 25 bp, Mus musculus
caacgagcgacaaaagccagagcat

SEQ ID NO: 11057 - DNA, 25 bp, Mus musculus
caacgagcgacataagccagagcat

SEQ ID NO: 11058 - DNA, 25 bp, Mus musculus
caacgaggagaagcggatcacagag

SEQ ID NO: 11059 - DNA, 25 bp, Mus musculus
caacgaggatgcaaatgatacaacc

SEQ ID NO: 11060 - DNA, 25 bp, Mus musculus
caacgagtacaggaaggcctttgcc

SEQ ID NO: 11061 - DNA, 25 bp, Mus musculus
caacgagtgtatcaggaacccctgt

SEQ ID NO: 11062 - DNA, 25 bp, Mus musculus
caacgagtgtatgaggaacccctgt

SEQ ID NO: 11063 - DNA, 25 bp, Mus musculus
caacgatatccctggctcagacatc

SEQ ID NO: 11064 - DNA, 25 bp, Mus musculus
caacgatgactatgcagtggtcggt

SEQ ID NO: 11065 - DNA, 25 bp, Mus musculus
caacgatgtagccatgttcctagag

SEQ ID NO: 11066 - DNA, 25 bp, Mus musculus
caacgattgtagttggaggcttgga

SEQ ID NO: 11067 - DNA, 25 bp, Mus musculus
caacgcaaagttcgccgtggaactg

SEQ ID NO: 11068 - DNA, 25 bp, Mus musculus
caacgcagagctaagcaagatgcta

SEQ ID NO: 11069 - DNA, 25 bp, Mus musculus
caacgccaagactgtccggaatgac

SEQ ID NO: 11070 - DNA, 25 bp, Mus musculus
caacgccaagattcagacagaaaaa

SEQ ID NO: 11071 - DNA, 25 bp, Mus musculus
caacgcccacaatgaggtggttaaa

SEQ ID NO: 11072 - DNA, 25 bp, Mus musculus
caacgcctatcagtacatgctgaca

SEQ ID NO: 11073 - DNA, 25 bp, Mus musculus
caacgcctatccctcagagcaagag

SEQ ID NO: 11074 - DNA, 25 bp, Mus musculus
caacgcgtctgtcctcaacagcgga

SEQ ID NO: 11075 - DNA, 25 bp, Mus musculus
caacgctgcaaaatgcaacttgaga

SEQ ID NO: 11076 - DNA, 25 bp, Mus musculus
caacgctgtgtttggctgcagtgct

SEQ ID NO: 11077 - DNA, 25 bp, Mus musculus
caacgcttatgataagaatcaacag

SEQ ID NO: 11078 - DNA, 25 bp, Mus musculus
caacgcttgaagtttcataacatag

SEQ ID NO: 11079 - DNA, 25 bp, Mus musculus
caacggaacgttcttggatgggaca

SEQ ID NO: 11080 - DNA, 25 bp, Mus musculus
caacggaccaaaagcgatcgatgtg

SEQ ID NO: 11081 - DNA, 25 bp, Mus musculus
caacggagacgacatgtttgtgacg

SEQ ID NO: 11082 - DNA, 25 bp, Mus musculus
caacggagatttcagaatggcgttt

SEQ ID NO: 11083 - DNA, 25 bp, Mus musculus
caacggatggtacaaaaagcctcct

SEQ ID NO: 11084 - DNA, 25 bp, Mus musculus
caacggcaattttgggagcagtctc

SEQ ID NO: 11085 - DNA, 25 bp, Mus musculus
caacggccagcaactcatgagccag

SEQ ID NO: 11086 - DNA, 25 bp, Mus musculus
caacggcctgtaattacagctctgg

SEQ ID NO: 11087 - DNA, 25 bp, Mus musculus
caacgggcagcacggcttttccatg

SEQ ID NO: 11088 - DNA, 25 bp, Mus musculus
caacgggtctccacttcaggatatt

SEQ ID NO: 11089 - DNA, 25 bp, Mus musculus
caacggtcagagaaggcacaagagg

SEQ ID NO: 11090 - DNA, 25 bp, Mus musculus
caacggtgacaagagggctccagga

SEQ ID NO: 11091 - DNA, 25 bp, Mus musculus
caacggtggctttccttaatgatga

SEQ ID NO: 11092 - DNA, 25 bp, Mus musculus
caacgtagtgacttattacacctcc

SEQ ID NO: 11093 - DNA, 25 bp, Mus musculus
caacgtatcaaagtgcagtcatggc

SEQ ID NO: 11094 - DNA, 25 bp, Mus musculus
caacgtatgaactatgggtttggat

SEQ ID NO: 11095 - DNA, 25 bp, Mus musculus
caacgtcaacacacggtgccagaag

SEQ ID NO: 11096 - DNA, 25 bp, Mus musculus
caacgtcaaccgcagcgtgtcagac

SEQ ID NO: 11097 - DNA, 25 bp, Mus musculus
caacgtcagatggtgtcatgctaga

SEQ ID NO: 11098 - DNA, 25 bp, Mus musculus
caacgtcatccgaggctgaatttga

SEQ ID NO: 11099 - DNA, 25 bp, Mus musculus
caacgtccgaaccaagctggatgag

SEQ ID NO: 11100 - DNA, 25 bp, Mus musculus
caacgtcggaaatggaagctgaaac

SEQ ID NO: 11101 - DNA, 25 bp, Mus musculus
caacgtgaacgtggagatgaacgca

SEQ ID NO: 11102 - DNA, 25 bp, Mus musculus
caacgtgagcagtttgcacaccagc

SEQ ID NO: 11103 - DNA, 25 bp, Mus musculus
caacgtgattaagctggtgtggcgc

SEQ ID NO: 11104 - DNA, 25 bp, Mus musculus
caacgtgctcaaggctgtgctgcag

SEQ ID NO: 11105 - DNA, 25 bp, Mus musculus
caacgtgggtgatcagcgtgctgca

SEQ ID NO: 11106 - DNA, 25 bp, Mus musculus
caacgtgtaagtaaagcttggagaa

SEQ ID NO: 11107 - DNA, 25 bp, Mus musculus
caacgttgtaaaatataatgtgaac

SEQ ID NO: 11108 - DNA, 25 bp, Mus musculus
caacgtttgcaactgtgttatcagc

SEQ ID NO: 11109 - DNA, 25 bp, Mus musculus
caactaacgtgacagacctctgtgg

SEQ ID NO: 11110 - DNA, 25 bp, Mus musculus
caactaattaaaggcagactggcag

SEQ ID NO: 11111 - DNA, 25 bp, Mus musculus
caactaattgattatttgatgctga

SEQ ID NO: 11112 - DNA, 25 bp, Mus musculus
caactacaagcagaagtcaaggaga

SEQ ID NO: 11113 - DNA, 25 bp, Mus musculus
caactacctctcatgtggcaactct

SEQ ID NO: 11114 - DNA, 25 bp, Mus musculus
caactactacaacctggatggagaa

SEQ ID NO: 11115 - DNA, 25 bp, Mus musculus
caactactccatccatctgaatgga

SEQ ID NO: 11116 - DNA, 25 bp, Mus musculus
caactacttaggaggctatgagtgc

SEQ ID NO: 11117 - DNA, 25 bp, Mus musculus
caactagaggtatttcaaagagagc

SEQ ID NO: 11118 - DNA, 25 bp, Mus musculus
caactagttgaaaagtatcagtcct

SEQ ID NO: 11119 - DNA, 25 bp, Mus musculus
caactatactgtggtctaccgtgac

SEQ ID NO: 11120 - DNA, 25 bp, Mus musculus
caactatagcgacctgcaggacgcg

SEQ ID NO: 11121 - DNA, 25 bp, Mus musculus
caactatagcgagctgcaggacgcg

SEQ ID NO: 11122 - DNA, 25 bp, Mus musculus
caactatagtcctgtgaagtccaag

SEQ ID NO: 11123 - DNA, 25 bp, Mus musculus
caactattgctcaaacatcatgcga

SEQ ID NO: 11124 - DNA, 25 bp, Mus musculus
caactattgctctaacatcatgcga

SEQ ID NO: 11125 - DNA, 25 bp, Mus musculus
caactcaacagagtgggaaaaggtg

SEQ ID NO: 11126 - DNA, 25 bp, Mus musculus
caactcaacgagcactgcagcaaaa

SEQ ID NO: 11127 - DNA, 25 bp, Mus musculus
caactcaacgaggactgcagcaaaa

SEQ ID NO: 11128 - DNA, 25 bp, Mus musculus
caactcatgaaagtagatcctgctc

SEQ ID NO: 11129 - DNA, 25 bp, Mus musculus
caactcccaatctgggagaggtcac

SEQ ID NO: 11130 - DNA, 25 bp, Mus musculus
caactcctcggaaagttacaaactg

SEQ ID NO: 11131 - DNA, 25 bp, Mus musculus
caactcctcttgaccaaggcagtga

SEQ ID NO: 11132 - DNA, 25 bp, Mus musculus
caactcctgctgaaatcgttctcca

SEQ ID NO: 11133 - DNA, 25 bp, Mus musculus
caactcctgttgtagcctctgcggc

SEQ ID NO: 11134 - DNA, 25 bp, Mus musculus
caactcgatcgtgtcgaagaaggca

SEQ ID NO: 11135 - DNA, 25 bp, Mus musculus
caactcgggatgcaggcttcactgt

SEQ ID NO: 11136 - DNA, 25 bp, Mus musculus
caactcgtttgctgtcacgtgcctg

SEQ ID NO: 11137 - DNA, 25 bp, Mus musculus
caactctaactgacggagtctgaga

SEQ ID NO: 11138 - DNA, 25 bp, Mus musculus
caactctaactgtcggagtctgaga

SEQ ID NO: 11139 - DNA, 25 bp, Mus musculus
caactctctagctctggaactgact

SEQ ID NO: 11140 - DNA, 25 bp, Mus musculus
caactctggaatgttggagacaatc

SEQ ID NO: 11141 - DNA, 25 bp, Mus musculus
caactctgggaaagagtctgctcct

SEQ ID NO: 11142 - DNA, 25 bp, Mus musculus
caactctgtggtggacctggagacc

SEQ ID NO: 11143 - DNA, 25 bp, Mus musculus
caactcttacaactccccaggtggt

SEQ ID NO: 11144 - DNA, 25 bp, Mus musculus
caactgaagaagtaccccgagaagc

SEQ ID NO: 11145 - DNA, 25 bp, Mus musculus
caactgaatatgagaggaacgggag

SEQ ID NO: 11146 - DNA, 25 bp, Mus musculus
caactgatatgtctcaaggtgaact

SEQ ID NO: 11147 - DNA, 25 bp, Mus musculus
caactgatgaccttcgtggtgtggc

SEQ ID NO: 11148 - DNA, 25 bp, Mus musculus
caactgatgtccagtgtagagatga

SEQ ID NO: 11149 - DNA, 25 bp, Mus musculus
caactgcagaaagatttgatgagca

SEQ ID NO: 11150 - DNA, 25 bp, Mus musculus
caactgcaggatagcacacctggac

SEQ ID NO: 11151 - DNA, 25 bp, Mus musculus
caactgcatcaacctgcctgggtgg

SEQ ID NO: 11152 - DNA, 25 bp, Mus musculus
caactgcgagcacagtggaaattgt

SEQ ID NO: 11153 - DNA, 25 bp, Mus musculus
caactgcgcacgagtgctgcaggag

SEQ ID NO: 11154 - DNA, 25 bp, Mus musculus
caactgcggctgaaccagggttcat

SEQ ID NO: 11155 - DNA, 25 bp, Mus musculus
caactgctcattcttttgatgtccg

SEQ ID NO: 11156 - DNA, 25 bp, Mus musculus
caactgctctaactctgtgggaagc

SEQ ID NO: 11157 - DNA, 25 bp, Mus musculus
caactgctgctttggctttcaccgc

SEQ ID NO: 11158 - DNA, 25 bp, Mus musculus
caactgctggaggattacaagcatg

SEQ ID NO: 11159 - DNA, 25 bp, Mus musculus
caactgctttcaagctcatccgtac

SEQ ID NO: 11160 - DNA, 25 bp, Mus musculus
caactggaacgcattgaggaaggga

SEQ ID NO: 11161 - DNA, 25 bp, Mus musculus
caactggaaggaagggaactgagaa

SEQ ID NO: 11162 - DNA, 25 bp, Mus musculus
caactggaaggacattttgacattg

SEQ ID NO: 11163 - DNA, 25 bp, Mus musculus
caactggaagttctcttctacaaga

SEQ ID NO: 11164 - DNA, 25 bp, Mus musculus
caactggagcagtgaccacactgaa

SEQ ID NO: 11165 - DNA, 25 bp, Mus musculus
caactggataccgatgggaaaacat

SEQ ID NO: 11166 - DNA, 25 bp, Mus musculus
caactggcacctgttggatctgtga

SEQ ID NO: 11167 - DNA, 25 bp, Mus musculus
caactggcacgttacctgggcggat

SEQ ID NO: 11168 - DNA, 25 bp, Mus musculus
caactggcatataacttgctgtgtg

SEQ ID NO: 11169 - DNA, 25 bp, Mus musculus
caactggcatgttgggccgtatcat

SEQ ID NO: 11170 - DNA, 25 bp, Mus musculus
caactggctcctcggtgactctagg

SEQ ID NO: 11171 - DNA, 25 bp, Mus musculus
caactggctgcaccgaagactggca

SEQ ID NO: 11172 - DNA, 25 bp, Mus musculus
caactggcttcgctttgttcacgag

SEQ ID NO: 11173 - DNA, 25 bp, Mus musculus
caactgggacgacgaaacagccaag

SEQ ID NO: 11174 - DNA, 25 bp, Mus musculus
caactgggcaggttattgccaaacc

SEQ ID NO: 11175 - DNA, 25 bp, Mus musculus
caactgggtgagacgcaggttccct

SEQ ID NO: 11176 - DNA, 25 bp, Mus musculus
caactggtgcagttctccttctggc

SEQ ID NO: 11177 - DNA, 25 bp, Mus musculus
caactggtggacactttcgatgacg

SEQ ID NO: 11178 - DNA, 25 bp, Mus musculus
caactggtggatggtttcctagcct

SEQ ID NO: 11179 - DNA, 25 bp, Mus musculus
caactgtaaagctcttcattgatgg

SEQ ID NO: 11180 - DNA, 25 bp, Mus musculus
caactgtaaccgctataatgaggat

SEQ ID NO: 11181 - DNA, 25 bp, Mus musculus
caactgtagcagcaagaacctcgac

SEQ ID NO: 11182 - DNA, 25 bp, Mus musculus
caactgtagcagttcgtggtgatca

SEQ ID NO: 11183 - DNA, 25 bp, Mus musculus
caactgtaggatgtgagactttccc

SEQ ID NO: 11184 - DNA, 25 bp, Mus musculus
caactgtatggtggccgtgggctac

SEQ ID NO: 11185 - DNA, 25 bp, Mus musculus
caactgtcagtttcgtggcagagag

SEQ ID NO: 11186 - DNA, 25 bp, Mus musculus
caactgtcatgactgatgccgccat

SEQ ID NO: 11187 - DNA, 25 bp, Mus musculus
caactgtcctactctttgaagcaga

SEQ ID NO: 11188 - DNA, 25 bp, Mus musculus
caactgtcgtgtgtgccaatctcta

SEQ ID NO: 11189 - DNA, 25 bp, Mus musculus
caactgtcgttctaaatggctatga

SEQ ID NO: 11190 - DNA, 25 bp, Mus musculus
caactgtgagtgacaccacctggca

SEQ ID NO: 11191 - DNA, 25 bp, Mus musculus
caactgtgcgctggagctgaccctg

SEQ ID NO: 11192 - DNA, 25 bp, Mus musculus
caactgtgtcactatcttcggtaac

SEQ ID NO: 11193 - DNA, 25 bp, Mus musculus
caactgtgtcccctgtaagccggga

SEQ ID NO: 11194 - DNA, 25 bp, Mus musculus
caactgtgtcccgtgtaagccggga

SEQ ID NO: 11195 - DNA, 25 bp, Mus musculus
caactgtgttcatcaaactcctcag

SEQ ID NO: 11196 - DNA, 25 bp, Mus musculus
caactgtgtttgacttggagaagga

SEQ ID NO: 11197 - DNA, 25 bp, Mus musculus
caactgttaagcagtctgaccagcc

SEQ ID NO: 11198 - DNA, 25 bp, Mus musculus
caacttaagaagaaattgcacccaa

SEQ ID NO: 11199 - DNA, 25 bp, Mus musculus
caacttaatgagctgcctcctcagc

SEQ ID NO: 11200 - DNA, 25 bp, Mus musculus
caacttacctgctttccattggatc

SEQ ID NO: 11201 - DNA, 25 bp, Mus musculus
caacttactatggtagaaaagcgaa

SEQ ID NO: 11202 - DNA, 25 bp, Mus musculus
caacttagcatttatacgagggcag

SEQ ID NO: 11203 - DNA, 25 bp, Mus musculus
caacttatcagtagtgacttacagt

SEQ ID NO: 11204 - DNA, 25 bp, Mus musculus
caacttatccaaacctgtggctggt

SEQ ID NO: 11205 - DNA, 25 bp, Mus musculus
caacttatccaatcctgtggctggt

SEQ ID NO: 11206 - DNA, 25 bp, Mus musculus
caacttatgagacaaacattttcac

SEQ ID NO: 11207 - DNA, 25 bp, Mus musculus
caacttattttgtcagcctttgatt

SEQ ID NO: 11208 - DNA, 25 bp, Mus musculus
caacttcaccgcgattggaggcaac

SEQ ID NO: 11209 - DNA, 25 bp, Mus musculus
caacttcacgagcatttgcaagatg

SEQ ID NO: 11210 - DNA, 25 bp, Mus musculus
caacttcaggaaggcacaggactcc

SEQ ID NO: 11211 - DNA, 25 bp, Mus musculus
caacttccctgttgtgtggcacaag

SEQ ID NO: 11212 - DNA, 25 bp, Mus musculus
caacttccttctaggagtggaatgt

SEQ ID NO: 11213 - DNA, 25 bp, Mus musculus
caacttcgagaagagctggccaaag

SEQ ID NO: 11214 - DNA, 25 bp, Mus musculus
caacttctaaggactacaacagtct

SEQ ID NO: 11215 - DNA, 25 bp, Mus musculus
caacttctctacctgctcttctgga

SEQ ID NO: 11216 - DNA, 25 bp, Mus musculus
caacttctctgcatcaactgtatgg

SEQ ID NO: 11217 - DNA, 25 bp, Mus musculus
caacttgaaggtaaagaggaagcat

SEQ ID NO: 11218 - DNA, 25 bp, Mus musculus
caacttgaagtcactggaggctcag

SEQ ID NO: 11219 - DNA, 25 bp, Mus musculus
caacttgaggcgttacaatgaagcc

SEQ ID NO: 11220 - DNA, 25 bp, Mus musculus
caacttgcaagtgtgagagacagca

SEQ ID NO: 11221 - DNA, 25 bp, Mus musculus
caacttgccaagcacagtggagctc

SEQ ID NO: 11222 - DNA, 25 bp, Mus musculus
caacttgccaaggacagtggagctc

SEQ ID NO: 11223 - DNA, 25 bp, Mus musculus
caacttgccactccctactgaataa

SEQ ID NO: 11224 - DNA, 25 bp, Mus musculus
caacttggacatctctcggtagcag

SEQ ID NO: 11225 - DNA, 25 bp, Mus musculus
caacttggaggagtactactttgag

SEQ ID NO: 11226 - DNA, 25 bp, Mus musculus
caacttggctggagtgaggattacc

SEQ ID NO: 11227 - DNA, 25 bp, Mus musculus
caacttgggacaaatcctgactgga

SEQ ID NO: 11228 - DNA, 25 bp, Mus musculus
caacttgggcaggagttggaagaac

SEQ ID NO: 11229 - DNA, 25 bp, Mus musculus
caacttggtgaacatccagaaaacc

SEQ ID NO: 11230 - DNA, 25 bp, Mus musculus
caacttgtggatctgggatgtctga

SEQ ID NO: 11231 - DNA, 25 bp, Mus musculus
caacttgtggatgtgggatgtctga

SEQ ID NO: 11232 - DNA, 25 bp, Mus musculus
caactttactgttgaaaatgtgaaa

SEQ ID NO: 11233 - DNA, 25 bp, Mus musculus
caactttcctatcccagagagtttt

SEQ ID NO: 11234 - DNA, 25 bp, Mus musculus
caactttgccatgctgggacttgga

SEQ ID NO: 11235 - DNA, 25 bp, Mus musculus
caactttgtgaaatagatctgtaaa

SEQ ID NO: 11236 - DNA, 25 bp, Mus musculus
caactttgttggagggtccactaag

SEQ ID NO: 11237 - DNA, 25 bp, Mus musculus
caactttgttgttggcaataatgga

SEQ ID NO: 11238 - DNA, 25 bp, Mus musculus
caactttttggaggatgaaccctct

SEQ ID NO: 11239 - DNA, 25 bp, Mus musculus
caagaaaaagtatgacctgcagcgg

SEQ ID NO: 11240 - DNA, 25 bp, Mus musculus
caagaaaaagtcatatttcccacgt

SEQ ID NO: 11241 - DNA, 25 bp, Mus musculus
caagaaaaatggtttgacactgatt

SEQ ID NO: 11242 - DNA, 25 bp, Mus musculus
caagaaaagatgaacctgagtcagg

SEQ ID NO: 11243 - DNA, 25 bp, Mus musculus
caagaaaagcacaattggaaatcag

SEQ ID NO: 11244 - DNA, 25 bp, Mus musculus
caagaaaatatgctagagttgtgca

SEQ ID NO: 11245 - DNA, 25 bp, Mus musculus
caagaaaatcaaagtcgtcttcacc

SEQ ID NO: 11246 - DNA, 25 bp, Mus musculus
caagaaaatcaatgtcgtcttcacc

SEQ ID NO: 11247 - DNA, 25 bp, Mus musculus
caagaaacagtcgtttgtcttgaag

SEQ ID NO: 11248 - DNA, 25 bp, Mus musculus
caagaaactctttcacaggctggac

SEQ ID NO: 11249 - DNA, 25 bp, Mus musculus
caagaaactggtgcatgacatgagc

SEQ ID NO: 11250 - DNA, 25 bp, Mus musculus
caagaaacttcaatctgccaatgtg

SEQ ID NO: 11251 - DNA, 25 bp, Mus musculus
caagaaagacgggacagtcacagca

SEQ ID NO: 11252 - DNA, 25 bp, Mus musculus
caagaaagatggagatatgactgca

SEQ ID NO: 11253 - DNA, 25 bp, Mus musculus
caagaaagcaatcattgtcccagca

SEQ ID NO: 11254 - DNA, 25 bp, Mus musculus
caagaaagcaatgattgtcccagca

SEQ ID NO: 11255 - DNA, 25 bp, Mus musculus
caagaaagcaggatggaccatagtt

SEQ ID NO: 11256 - DNA, 25 bp, Mus musculus
caagaaaggtgctggaagaagtgaa

SEQ ID NO: 11257 - DNA, 25 bp, Mus musculus
caagaaaggttaccaagtgacaagg

SEQ ID NO: 11258 - DNA, 25 bp, Mus musculus
caagaaagttgaccagtctgttcca

SEQ ID NO: 11259 - DNA, 25 bp, Mus musculus
caagaaattatcagacctccctcca

SEQ ID NO: 11260 - DNA, 25 bp, Mus musculus
caagaaattcagttatcaaccacag

SEQ ID NO: 11261 - DNA, 25 bp, Mus musculus
caagaacaaactacaggcgattgcc

SEQ ID NO: 11262 - DNA, 25 bp, Mus musculus
caagaacaataccaacaccggtgtg

SEQ ID NO: 11263 - DNA, 25 bp, Mus musculus
caagaacattgactaccctgtggac

SEQ ID NO: 11264 - DNA, 25 bp, Mus musculus
caagaaccagagtttgccatgccag

SEQ ID NO: 11265 - DNA, 25 bp, Mus musculus
caagaaccgttaatattggacccag

SEQ ID NO: 11266 - DNA, 25 bp, Mus musculus
caagaacgatcccttcaaagcccgg

SEQ ID NO: 11267 - DNA, 25 bp, Mus musculus
caagaacgcgtagccataaagcgga

SEQ ID NO: 11268 - DNA, 25 bp, Mus musculus
caagaacggctgtgggaaacccaag

SEQ ID NO: 11269 - DNA, 25 bp, Mus musculus
caagaacggtgtggacctcctaatg

SEQ ID NO: 11270 - DNA, 25 bp, Mus musculus
caagaactagttgctcagatgggtc

SEQ ID NO: 11271 - DNA, 25 bp, Mus musculus
caagaactatctattcaggccgcca

SEQ ID NO: 11272 - DNA, 25 bp, Mus musculus
caagaactcagaagactcctcggca

SEQ ID NO: 11273 - DNA, 25 bp, Mus musculus
caagaactcagggagtgtctgagtc

SEQ ID NO: 11274 - DNA, 25 bp, Mus musculus
caagaactccaagctgaacagaagc

SEQ ID NO: 11275 - DNA, 25 bp, Mus musculus
caagaactgacccagttgaaggctg

SEQ ID NO: 11276 - DNA, 25 bp, Mus musculus
caagaactggcctgtcagaatgacc

SEQ ID NO: 11277 - DNA, 25 bp, Mus musculus
caagaactgtcccagcgcattgcgt

SEQ ID NO: 11278 - DNA, 25 bp, Mus musculus
caagaagaaagcagctcatgcagcc

SEQ ID NO: 11279 - DNA, 25 bp, Mus musculus
caagaagaaagtagcccacgtggcc

SEQ ID NO: 11280 - DNA, 25 bp, Mus musculus
caagaagaagcagtgatccaatgcg

SEQ ID NO: 11281 - DNA, 25 bp, Mus musculus
caagaagaagggtgacagcagcagt

SEQ ID NO: 11282 - DNA, 25 bp, Mus musculus
caagaagacctactgcttcgatgct

SEQ ID NO: 11283 - DNA, 25 bp, Mus musculus
caagaagactcaagaaactctttca

SEQ ID NO: 11284 - DNA, 25 bp, Mus musculus
caagaagactttctcttatgctggg

SEQ ID NO: 11285 - DNA, 25 bp, Mus musculus
caagaagagccttggacttactgag

SEQ ID NO: 11286 - DNA, 25 bp, Mus musculus
caagaagagcgacgcgcggactatt

SEQ ID NO: 11287 - DNA, 25 bp, Mus musculus
caagaagaggaacgtcgaaatgaaa

SEQ ID NO: 11288 - DNA, 25 bp, Mus musculus
caagaagaggaaggtcgaaatgaaa

SEQ ID NO: 11289 - DNA, 25 bp, Mus musculus
caagaagaggccgatattgcagctc

SEQ ID NO: 11290 - DNA, 25 bp, Mus musculus
caagaagagggccatacccaatcag

SEQ ID NO: 11291 - DNA, 25 bp, Mus musculus
caagaagagtcaagtttgcctcccg

SEQ ID NO: 11292 - DNA, 25 bp, Mus musculus
caagaagattgttggataaaagcaa

SEQ ID NO: 11293 - DNA, 25 bp, Mus musculus
caagaagcatgctgacagcgtggcg

SEQ ID NO: 11294 - DNA, 25 bp, Mus musculus
caagaagcggctttcagtcgagctg

SEQ ID NO: 11295 - DNA, 25 bp, Mus musculus
caagaagctgttattatctagtggc

SEQ ID NO: 11296 - DNA, 25 bp, Mus musculus
caagaaggaaaatcctaatgcaaac

SEQ ID NO: 11297 - DNA, 25 bp, Mus musculus
caagaaggaactcgagtttgaacaa

SEQ ID NO: 11298 - DNA, 25 bp, Mus musculus
caagaaggaagcacatagagtgtgt

SEQ ID NO: 11299 - DNA, 25 bp, Mus musculus
caagaaggagtctaccgcgacgaat

SEQ ID NO: 11300 - DNA, 25 bp, Mus musculus
caagaaggagtgaggccagctgaca

SEQ ID NO: 11301 - DNA, 25 bp, Mus musculus
caagaaggcacctgtagcagaaggg

SEQ ID NO: 11302 - DNA, 25 bp, Mus musculus
caagaaggcactgccagaactccag

SEQ ID NO: 11303 - DNA, 25 bp, Mus musculus
caagaaggcctccagtttccacgag

SEQ ID NO: 11304 - DNA, 25 bp, Mus musculus
caagaaggctgtgaaaaaatcagtc

SEQ ID NO: 11305 - DNA, 25 bp, Mus musculus
caagaaggtgaagatgacacctttc

SEQ ID NO: 11306 - DNA, 25 bp, Mus musculus
caagaagtaccgatgtgagctgtgc

SEQ ID NO: 11307 - DNA, 25 bp, Mus musculus
caagaagtcagatggcggtgtcaag

SEQ ID NO: 11308 - DNA, 25 bp, Mus musculus
caagaagtgccagaccttggtcagc

SEQ ID NO: 11309 - DNA, 25 bp, Mus musculus
caagaagtgtctggagctcatgagt

SEQ ID NO: 11310 - DNA, 25 bp, Mus musculus
caagaatactcttctagatttggac

SEQ ID NO: 11311 - DNA, 25 bp, Mus musculus
caagaatagagcaatacgctacacg

SEQ ID NO: 11312 - DNA, 25 bp, Mus musculus
caagaatcagagacgggaaagctgc

SEQ ID NO: 11313 - DNA, 25 bp, Mus musculus
caagaatccagtcctgtgtggaagc

SEQ ID NO: 11314 - DNA, 25 bp, Mus musculus
caagaatcggcgtaattccagtgag

SEQ ID NO: 11315 - DNA, 25 bp, Mus musculus
caagaatcgtccacatgctgaccta

SEQ ID NO: 11316 - DNA, 25 bp, Mus musculus
caagaatcgttcttttatctcccac

SEQ ID NO: 11317 - DNA, 25 bp, Mus musculus
caagaatctcccttcccaaaggaca

SEQ ID NO: 11318 - DNA, 25 bp, Mus musculus
caagaatgagtgctacagggccacg

SEQ ID NO: 11319 - DNA, 25 bp, Mus musculus
caagaatgtttgaaggcgtttccgt

SEQ ID NO: 11320 - DNA, 25 bp, Mus musculus
caagaattcaagaaggcaaggaacc

SEQ ID NO: 11321 - DNA, 25 bp, Mus musculus
caagaattccttggagacggtgggc

SEQ ID NO: 11322 - DNA, 25 bp, Mus musculus
caagaattggcctggcccccgtgtt

SEQ ID NO: 11323 - DNA, 25 bp, Mus musculus
caagaatttgaagtacagaatgacg

SEQ ID NO: 11324 - DNA, 25 bp, Mus musculus
caagacaacagtgacgaggagagct

SEQ ID NO: 11325 - DNA, 25 bp, Mus musculus
caagacaaggagtcagagaagcagc

SEQ ID NO: 11326 - DNA, 25 bp, Mus musculus
caagacactccaactggcttcgctt

SEQ ID NO: 11327 - DNA, 25 bp, Mus musculus
caagacactttgcaaacatggagac

SEQ ID NO: 11328 - DNA, 25 bp, Mus musculus
caagacagaattatggtacttcacc

SEQ ID NO: 11329 - DNA, 25 bp, Mus musculus
caagacagcattctctggccatcag

SEQ ID NO: 11330 - DNA, 25 bp, Mus musculus
caagacaggcttcgagcttctgcaa

SEQ ID NO: 11331 - DNA, 25 bp, Mus musculus
caagacagtgacagacatggagtgg

SEQ ID NO: 11332 - DNA, 25 bp, Mus musculus
caagacataaagtcagccgggcctc

SEQ ID NO: 11333 - DNA, 25 bp, Mus musculus
caagacatctaaaaatgttggaacc

SEQ ID NO: 11334 - DNA, 25 bp, Mus musculus
caagacatgaaggaggccgagaaaa

SEQ ID NO: 11335 - DNA, 25 bp, Mus musculus
caagacatgctaaggctagaccgta

SEQ ID NO: 11336 - DNA, 25 bp, Mus musculus
caagacatggagtgtgtgccctgcg

SEQ ID NO: 11337 - DNA, 25 bp, Mus musculus
caagacattgctttctttgatgcca

SEQ ID NO: 11338 - DNA, 25 bp, Mus musculus
caagaccaacttgcagttctgcctg

SEQ ID NO: 11339 - DNA, 25 bp, Mus musculus
caagaccacaagtctccagaaagag

SEQ ID NO: 11340 - DNA, 25 bp, Mus musculus
caagacccaagagaggagatgcagc

SEQ ID NO: 11341 - DNA, 25 bp, Mus musculus
caagacccacatccaggagtgcaaa

SEQ ID NO: 11342 - DNA, 25 bp, Mus musculus
caagacccgaaggaaattctgcagt

SEQ ID NO: 11343 - DNA, 25 bp, Mus musculus
caagacccggatgaggaattcatga

SEQ ID NO: 11344 - DNA, 25 bp, Mus musculus
caagacccgggagctccgctggaat

SEQ ID NO: 11345 - DNA, 25 bp, Mus musculus
caagaccgagctaaccaacatagag

SEQ ID NO: 11346 - DNA, 25 bp, Mus musculus
caagacctatcagaggtggagctga

SEQ ID NO: 11347 - DNA, 25 bp, Mus musculus
caagacctctggaaagatgggtcct

SEQ ID NO: 11348 - DNA, 25 bp, Mus musculus
caagacctctggtaagatgggtcct

SEQ ID NO: 11349 - DNA, 25 bp, Mus musculus
caagacctgtttaacaagaaatacg

SEQ ID NO: 11350 - DNA, 25 bp, Mus musculus
caagaccttcagctccaaaagcgag

SEQ ID NO: 11351 - DNA, 25 bp, Mus musculus
caagaccttcaggtccaaaagcgag

SEQ ID NO: 11352 - DNA, 25 bp, Mus musculus
caagacgagaattgccagtgcccta

SEQ ID NO: 11353 - DNA, 25 bp, Mus musculus
caagacgccagtcacactgaagcag

SEQ ID NO: 11354 - DNA, 25 bp, Mus musculus
caagacggccagttcagggtgatgc

SEQ ID NO: 11355 - DNA, 25 bp, Mus musculus
caagacggccctggtgcagatgttc

SEQ ID NO: 11356 - DNA, 25 bp, Mus musculus
caagacgggcagtttctgcactaca

SEQ ID NO: 11357 - DNA, 25 bp, Mus musculus
caagacggtaagagggagaccaaag

SEQ ID NO: 11358 - DNA, 25 bp, Mus musculus
caagacgtcagtgtgcaccctgaag

SEQ ID NO: 11359 - DNA, 25 bp, Mus musculus
caagacgtttgcaagtggctcaaga

SEQ ID NO: 11360 - DNA, 25 bp, Mus musculus
caagactaccacctaccaggctttg

SEQ ID NO: 11361 - DNA, 25 bp, Mus musculus
caagactcttgagatggtcagaagg

SEQ ID NO: 11362 - DNA, 25 bp, Mus musculus
caagactgcatcatttctgagggtc

SEQ ID NO: 11363 - DNA, 25 bp, Mus musculus
caagactggcaagcacattttaagg

SEQ ID NO: 11364 - DNA, 25 bp, Mus musculus
caagactgtctgcagctgattgcag

SEQ ID NO: 11365 - DNA, 25 bp, Mus musculus
caagacttcatggagaattttcata

SEQ ID NO: 11366 - DNA, 25 bp, Mus musculus
caagacttgagtatgaacgccgggc

SEQ ID NO: 11367 - DNA, 25 bp, Mus musculus
caagagaaagaacacatcgagaact

SEQ ID NO: 11368 - DNA, 25 bp, Mus musculus
caagagaaatcagagtggtgtgaat

SEQ ID NO: 11369 - DNA, 25 bp, Mus musculus
caagagaagaactggttaaacgagg

SEQ ID NO: 11370 - DNA, 25 bp, Mus musculus
caagagaagatcaaagagaatgctg

SEQ ID NO: 11371 - DNA, 25 bp, Mus musculus
caagagaatttcttcattgcccttg

SEQ ID NO: 11372 - DNA, 25 bp, Mus musculus
caagagaatttgagtctgtgcttgt

SEQ ID NO: 11373 - DNA, 25 bp, Mus musculus
caagagacaaccaccaaacatgacc

SEQ ID NO: 11374 - DNA, 25 bp, Mus musculus
caagagaccatcatgaattatgagc

SEQ ID NO: 11375 - DNA, 25 bp, Mus musculus
caagagaccatcttgaattatgagc

SEQ ID NO: 11376 - DNA, 25 bp, Mus musculus
caagagaccctgctctggaaagata

SEQ ID NO: 11377 - DNA, 25 bp, Mus musculus
caagagactgccttggcgaagttac

SEQ ID NO: 11378 - DNA, 25 bp, Mus musculus
caagagacttgtggtcctaggaccc

SEQ ID NO: 11379 - DNA, 25 bp, Mus musculus
caagagagcacaaggaaacaagaac

SEQ ID NO: 11380 - DNA, 25 bp, Mus musculus
caagagaggagatgcagcctgagct

SEQ ID NO: 11381 - DNA, 25 bp, Mus musculus
caagagaggcctgggctcaaggcct

SEQ ID NO: 11382 - DNA, 25 bp, Mus musculus
caagagagggatacaccttcactgt

SEQ ID NO: 11383 - DNA, 25 bp, Mus musculus
caagagatcagggtctttggactac

SEQ ID NO: 11384 - DNA, 25 bp, Mus musculus
caagagatgagagctcggcacaagg

SEQ ID NO: 11385 - DNA, 25 bp, Mus musculus
caagagatgcaagtgaaggcaaaaa

SEQ ID NO: 11386 - DNA, 25 bp, Mus musculus
caagagcactgaatctcctggcact

SEQ ID NO: 11387 - DNA, 25 bp, Mus musculus
caagagccagtgtatggcaataaat

SEQ ID NO: 11388 - DNA, 25 bp, Mus musculus
caagagccatgaagatcctcatgaa

SEQ ID NO: 11389 - DNA, 25 bp, Mus musculus
caagagccctgagggagctcatgga

SEQ ID NO: 11390 - DNA, 25 bp, Mus musculus
caagagcgacctcaagagcaaagca

SEQ ID NO: 11391 - DNA, 25 bp, Mus musculus
caagagcgactgcaagctgaagaga

SEQ ID NO: 11392 - DNA, 25 bp, Mus musculus
caagagcgattaacggatcgtacca

SEQ ID NO: 11393 - DNA, 25 bp, Mus musculus
caagagcggttgcttttaccagaag

SEQ ID NO: 11394 - DNA, 25 bp, Mus musculus
caagagctacagattggagctgatg

SEQ ID NO: 11395 - DNA, 25 bp, Mus musculus
caagagctagatgaagctaacggca

SEQ ID NO: 11396 - DNA, 25 bp, Mus musculus
caagagctgaggattcaggcgaata

SEQ ID NO: 11397 - DNA, 25 bp, Mus musculus
caagagctgcttggtctgaaaccgc

SEQ ID NO: 11398 - DNA, 25 bp, Mus musculus
caagagctggacttcgtcagccaca

SEQ ID NO: 11399 - DNA, 25 bp, Mus musculus
caagagctggatatcaagaagaatg

SEQ ID NO: 11400 - DNA, 25 bp, Mus musculus
caagagcttctcagatcggcagcag

SEQ ID NO: 11401 - DNA, 25 bp, Mus musculus
caagaggacagtattttatgtctac

SEQ ID NO: 11402 - DNA, 25 bp, Mus musculus
caagaggccctgagacctacaggtg

SEQ ID NO: 11403 - DNA, 25 bp, Mus musculus
caagaggctccacacttctggcagg

SEQ ID NO: 11404 - DNA, 25 bp, Mus musculus
caagaggctccagacttctggcagg

SEQ ID NO: 11405 - DNA, 25 bp, Mus musculus
caagaggctcgtatgagtcatgact

SEQ ID NO: 11406 - DNA, 25 bp, Mus musculus
caagaggctcgtttgagtcatgact

SEQ ID NO: 11407 - DNA, 25 bp, Mus musculus
caagaggcttactctgtcacctgtg

SEQ ID NO: 11408 - DNA, 25 bp, Mus musculus
caagagggaccctgtcaaccaggga

SEQ ID NO: 11409 - DNA, 25 bp, Mus musculus
caagagggcactctgcagctagcta

SEQ ID NO: 11410 - DNA, 25 bp, Mus musculus
caagaggtaacactgaggctgacga

SEQ ID NO: 11411 - DNA, 25 bp, Mus musculus
caagaggtagtctgaatgtgaatcc

SEQ ID NO: 11412 - DNA, 25 bp, Mus musculus
caagaggtatctgtctaaccaggcc

SEQ ID NO: 11413 - DNA, 25 bp, Mus musculus
caagagtagagtccagttctcctgg

SEQ ID NO: 11414 - DNA, 25 bp, Mus musculus
caagagtgccgcgaaatggctatcg

SEQ ID NO: 11415 - DNA, 25 bp, Mus musculus
caagagtgcctggtgtgaagccaag

SEQ ID NO: 11416 - DNA, 25 bp, Mus musculus
caagagtgcttccagaattgtgttt

SEQ ID NO: 11417 - DNA, 25 bp, Mus musculus
caagagtggactcgttagaaaagtc

SEQ ID NO: 11418 - DNA, 25 bp, Mus musculus
caagagtggcgactccagaagttgt

SEQ ID NO: 11419 - DNA, 25 bp, Mus musculus
caagagtgtatctgactatgacggc

SEQ ID NO: 11420 - DNA, 25 bp, Mus musculus
caagagttaactggcagcgagggcc

SEQ ID NO: 11421 - DNA, 25 bp, Mus musculus
caagagttaccagactctcagggag

SEQ ID NO: 11422 - DNA, 25 bp, Mus musculus
caagataagacgaaaacattacaca

SEQ ID NO: 11423 - DNA, 25 bp, Mus musculus
caagataatgagcaccccttggttg

SEQ ID NO: 11424 - DNA, 25 bp, Mus musculus
caagatacgaactatagagttagat

SEQ ID NO: 11425 - DNA, 25 bp, Mus musculus
caagatacgttgtaggttgtcgtcg

SEQ ID NO: 11426 - DNA, 25 bp, Mus musculus
caagatactgcaaatacaacttcag

SEQ ID NO: 11427 - DNA, 25 bp, Mus musculus
caagatattatctgggttccctaaa

SEQ ID NO: 11428 - DNA, 25 bp, Mus musculus
caagatatttggtatgttatcgacc

SEQ ID NO: 11429 - DNA, 25 bp, Mus musculus
caagatattttcacctatgctaagg

SEQ ID NO: 11430 - DNA, 25 bp, Mus musculus
caagatcaaaggattggccaaggac

SEQ ID NO: 11431 - DNA, 25 bp, Mus musculus
caagatcaaaggtttggccaaggac

SEQ ID NO: 11432 - DNA, 25 bp, Mus musculus
caagatcaagcccaaacagcagaag

SEQ ID NO: 11433 - DNA, 25 bp, Mus musculus
caagatcaaggactgcccttggtat

SEQ ID NO: 11434 - DNA, 25 bp, Mus musculus
caagatcaatgaaggagaggtactc

SEQ ID NO: 11435 - DNA, 25 bp, Mus musculus
caagatcacattcctcttacaagcc

SEQ ID NO: 11436 - DNA, 25 bp, Mus musculus
caagatccaggaatatgaatttact

SEQ ID NO: 11437 - DNA, 25 bp, Mus musculus
caagatccaggagaatgctctgccc

SEQ ID NO: 11438 - DNA, 25 bp, Mus musculus
caagatcctgcctttcgagctgaag

SEQ ID NO: 11439 - DNA, 25 bp, Mus musculus
caagatcctgtgacgggaaagacca

SEQ ID NO: 11440 - DNA, 25 bp, Mus musculus
caagatctgatcagcttgtctcatg

SEQ ID NO: 11441 - DNA, 25 bp, Mus musculus
caagatctggtgctttggccctgat

SEQ ID NO: 11442 - DNA, 25 bp, Mus musculus
caagatctgtgtgaaatgcagctgc

SEQ ID NO: 11443 - DNA, 25 bp, Mus musculus
caagatcttagaagaggatgcagct

SEQ ID NO: 11444 - DNA, 25 bp, Mus musculus
caagatgaaccatgccttcttactg

SEQ ID NO: 11445 - DNA, 25 bp, Mus musculus
caagatgaaccccagtcccaatggg

SEQ ID NO: 11446 - DNA, 25 bp, Mus musculus
caagatgaagtgtgtgtcagtgagc

SEQ ID NO: 11447 - DNA, 25 bp, Mus musculus
caagatgacctctccagtgtatggc

SEQ ID NO: 11448 - DNA, 25 bp, Mus musculus
caagatgagcaagctaaaagtggtg

SEQ ID NO: 11449 - DNA, 25 bp, Mus musculus
caagatgaggagacgttcgagctgc

SEQ ID NO: 11450 - DNA, 25 bp, Mus musculus
caagatgcaaggttgagggcacctt

SEQ ID NO: 11451 - DNA, 25 bp, Mus musculus
caagatgcggagaattgactgcctc

SEQ ID NO: 11452 - DNA, 25 bp, Mus musculus
caagatgctgcagttgacagtcagg

SEQ ID NO: 11453 - DNA, 25 bp, Mus musculus
caagatgctgctctccattgggatg

SEQ ID NO: 11454 - DNA, 25 bp, Mus musculus
caagatgctgtcagatcgaaaacgg

SEQ ID NO: 11455 - DNA, 25 bp, Mus musculus
caagatgctttcaagcgtttaggga

SEQ ID NO: 11456 - DNA, 25 bp, Mus musculus
caagatggaattcacatccttgtga

SEQ ID NO: 11457 - DNA, 25 bp, Mus musculus
caagatgggcggctctgtaacagcc

SEQ ID NO: 11458 - DNA, 25 bp, Mus musculus
caagatggggaacagctcagcatgc

SEQ ID NO: 11459 - DNA, 25 bp, Mus musculus
caagatggtgatgaaattctgggcc

SEQ ID NO: 11460 - DNA, 25 bp, Mus musculus
caagatggtgccttctagccagcct

SEQ ID NO: 11461 - DNA, 25 bp, Mus musculus
caagatggttgagctggatgctgac

SEQ ID NO: 11462 - DNA, 25 bp, Mus musculus
caagatgtaatagagagagctatcc

SEQ ID NO: 11463 - DNA, 25 bp, Mus musculus
caagatgtaattgagacaagaggga

SEQ ID NO: 11464 - DNA, 25 bp, Mus musculus
caagatgtacggcaagcactggtgt

SEQ ID NO: 11465 - DNA, 25 bp, Mus musculus
caagatgtcactttcctggcaagcc

SEQ ID NO: 11466 - DNA, 25 bp, Mus musculus
caagatgtccatctacaagagaatg

SEQ ID NO: 11467 - DNA, 25 bp, Mus musculus
caagattacccgtatgttatggcag

SEQ ID NO: 11468 - DNA, 25 bp, Mus musculus
caagattccctctgcaaaaaatggc

SEQ ID NO: 11469 - DNA, 25 bp, Mus musculus
caagattcggagaaccaaggtacta

SEQ ID NO: 11470 - DNA, 25 bp, Mus musculus
caagattctggaagacttgaatgca

SEQ ID NO: 11471 - DNA, 25 bp, Mus musculus
caagattggataaaccatgtatcac

SEQ ID NO: 11472 - DNA, 25 bp, Mus musculus
caagattgtaaggaaagctggcagt

SEQ ID NO: 11473 - DNA, 25 bp, Mus musculus
caagattgtgcgacccggggctgaa

SEQ ID NO: 11474 - DNA, 25 bp, Mus musculus
caagattttctacagcatcacaggg

SEQ ID NO: 11475 - DNA, 25 bp, Mus musculus
caagcaaaaattaatattgaagtgc

SEQ ID NO: 11476 - DNA, 25 bp, Mus musculus
caagcaactggctttccgtcactta

SEQ ID NO: 11477 - DNA, 25 bp, Mus musculus
caagcaagagtggagtgttaaccac

SEQ ID NO: 11478 - DNA, 25 bp, Mus musculus
caagcaagcttcctgctaggagcag

SEQ ID NO: 11479 - DNA, 25 bp, Mus musculus
caagcaatagaaattggagttttcc

SEQ ID NO: 11480 - DNA, 25 bp, Mus musculus
caagcacaatattcggcccaaacct

SEQ ID NO: 11481 - DNA, 25 bp, Mus musculus
caagcacaatcagctgcctttggtc

SEQ ID NO: 11482 - DNA, 25 bp, Mus musculus
caagcacaggctggtgctgctcgag

SEQ ID NO: 11483 - DNA, 25 bp, Mus musculus
caagcacatagaaggctggagcgcc

SEQ ID NO: 11484 - DNA, 25 bp, Mus musculus
caagcacatagatggctggagcgcc

SEQ ID NO: 11485 - DNA, 25 bp, Mus musculus
caagcaccggcgacagtgtttgttt

SEQ ID NO: 11486 - DNA, 25 bp, Mus musculus
caagcacctagttttaaagagacag

SEQ ID NO: 11487 - DNA, 25 bp, Mus musculus
caagcactgctatgaagactgaaaa

SEQ ID NO: 11488 - DNA, 25 bp, Mus musculus
caagcactggtgtggaacttcccca

SEQ ID NO: 11489 - DNA, 25 bp, Mus musculus
caagcacttctggtgcctctataac

SEQ ID NO: 11490 - DNA, 25 bp, Mus musculus
caagcacttgaggaatatctcagag

SEQ ID NO: 11491 - DNA, 25 bp, Mus musculus
caagcagaagactgagctgctgatg

SEQ ID NO: 11492 - DNA, 25 bp, Mus musculus
caagcagaagcaccctgagccagtc

SEQ ID NO: 11493 - DNA, 25 bp, Mus musculus
caagcagaagtcaaggagaactgaa

SEQ ID NO: 11494 - DNA, 25 bp, Mus musculus
caagcagagtgctgaaggtgctgtc

SEQ ID NO: 11495 - DNA, 25 bp, Mus musculus
caagcagataaaacgaatgatctcc

SEQ ID NO: 11496 - DNA, 25 bp, Mus musculus
caagcagatatgctgctgcagccgt

SEQ ID NO: 11497 - DNA, 25 bp, Mus musculus
caagcagatatggtgctgcagccgt

SEQ ID NO: 11498 - DNA, 25 bp, Mus musculus
caagcagctaagtataatggttctc

SEQ ID NO: 11499 - DNA, 25 bp, Mus musculus
caagcaggaagatgtagtagaggat

SEQ ID NO: 11500 - DNA, 25 bp, Mus musculus
caagcaggaggacttcaagacgaca

SEQ ID NO: 11501 - DNA, 25 bp, Mus musculus
caagcaggaggcctcaagtgatgaa

SEQ ID NO: 11502 - DNA, 25 bp, Mus musculus
caagcaggtggtgcacagattgtaa

SEQ ID NO: 11503 - DNA, 25 bp, Mus musculus
caagcagtagctggtgttaggcacc

SEQ ID NO: 11504 - DNA, 25 bp, Mus musculus
caagcagtaggctggatgggcattc

SEQ ID NO: 11505 - DNA, 25 bp, Mus musculus
caagcagtcttctgaagtccgagag

SEQ ID NO: 11506 - DNA, 25 bp, Mus musculus
caagcagtgcagttcgggaacagaa

SEQ ID NO: 11507 - DNA, 25 bp, Mus musculus
caagcagttcttgctggcagcagag

SEQ ID NO: 11508 - DNA, 25 bp, Mus musculus
caagcataccgtggtaaaatggaag

SEQ ID NO: 11509 - DNA, 25 bp, Mus musculus
caagcatagagcaaatattcagcca

SEQ ID NO: 11510 - DNA, 25 bp, Mus musculus
caagcatagtgtcgacagtgattcc

SEQ ID NO: 11511 - DNA, 25 bp, Mus musculus
caagcatcatcaaacaactttgttg

SEQ ID NO: 11512 - DNA, 25 bp, Mus musculus
caagcatctctagttaagcgggcag

SEQ ID NO: 11513 - DNA, 25 bp, Mus musculus
caagcatcttgatttgactgagcga

SEQ ID NO: 11514 - DNA, 25 bp, Mus musculus
caagcatgagctcgtcaacataagg

SEQ ID NO: 11515 - DNA, 25 bp, Mus musculus
caagcatggagaacctggtgatgca

SEQ ID NO: 11516 - DNA, 25 bp, Mus musculus
caagcatggagatcctggtgatgca

SEQ ID NO: 11517 - DNA, 25 bp, Mus musculus
caagcattccctagacccatgggaa

SEQ ID NO: 11518 - DNA, 25 bp, Mus musculus
caagccaagccttgagagcagggca

SEQ ID NO: 11519 - DNA, 25 bp, Mus musculus
caagccaagggcacagccggagttg

SEQ ID NO: 11520 - DNA, 25 bp, Mus musculus
caagccaagtcgctgggacttaaca

SEQ ID NO: 11521 - DNA, 25 bp, Mus musculus
caagccaagtgatcattaataaagc

SEQ ID NO: 11522 - DNA, 25 bp, Mus musculus
caagccacaaatgtaccttcaaggg

SEQ ID NO: 11523 - DNA, 25 bp, Mus musculus
caagccacaggattacaagaagcgg

SEQ ID NO: 11524 - DNA, 25 bp, Mus musculus
caagccacattgcaagtatcgaccc

SEQ ID NO: 11525 - DNA, 25 bp, Mus musculus
caagccacattggaagtatcgaccc

SEQ ID NO: 11526 - DNA, 25 bp, Mus musculus
caagccaccatctatgtccacaagg

SEQ ID NO: 11527 - DNA, 25 bp, Mus musculus
caagccactgagactgcttctagaa

SEQ ID NO: 11528 - DNA, 25 bp, Mus musculus
caagccagccgtagtgcctggtacc

SEQ ID NO: 11529 - DNA, 25 bp, Mus musculus
caagccagctgaagaagctcaaaag

SEQ ID NO: 11530 - DNA, 25 bp, Mus musculus
caagccagtgattgctgccattcac

SEQ ID NO: 11531 - DNA, 25 bp, Mus musculus
caagccatacaggaggaatttcagt

SEQ ID NO: 11532 - DNA, 25 bp, Mus musculus
caagccatagacaagatgcagatga

SEQ ID NO: 11533 - DNA, 25 bp, Mus musculus
caagccatcaagtgcagaattcaca

SEQ ID NO: 11534 - DNA, 25 bp, Mus musculus
caagccattaagtcattgtggacac

SEQ ID NO: 11535 - DNA, 25 bp, Mus musculus
caagcccaaggtggttactacaaca

SEQ ID NO: 11536 - DNA, 25 bp, Mus musculus
caagccccacacttgcagtcggtgt

SEQ ID NO: 11537 - DNA, 25 bp, Mus musculus
caagccccagctctcggaagtctgt

SEQ ID NO: 11538 - DNA, 25 bp, Mus musculus
caagccccatggcagcgttgcagat

SEQ ID NO: 11539 - DNA, 25 bp, Mus musculus
caagcccctcctatgattcatctag

SEQ ID NO: 11540 - DNA, 25 bp, Mus musculus
caagcccgacatagaattcaccgag

SEQ ID NO: 11541 - DNA, 25 bp, Mus musculus
caagcccgtgagagtcaaggtgtat

SEQ ID NO: 11542 - DNA, 25 bp, Mus musculus
caagcccgtgagtgtcaaggtgtat

SEQ ID NO: 11543 - DNA, 25 bp, Mus musculus
caagcccgtttcattttagagaaga

SEQ ID NO: 11544 - DNA, 25 bp, Mus musculus
caagccctaaggttgctcttttcag

SEQ ID NO: 11545 - DNA, 25 bp, Mus musculus
caagccctgagttgattggatgtaa

SEQ ID NO: 11546 - DNA, 25 bp, Mus musculus
caagccctgtgcttggcaacattcc

SEQ ID NO: 11547 - DNA, 25 bp, Mus musculus
caagccctgtggtacttcggctcgg

SEQ ID NO: 11548 - DNA, 25 bp, Mus musculus
caagcccttagcactgacctcagta

SEQ ID NO: 11549 - DNA, 25 bp, Mus musculus
caagccgatggattcctctcataaa

SEQ ID NO: 11550 - DNA, 25 bp, Mus musculus
caagccgtacagagtatactgtgac

SEQ ID NO: 11551 - DNA, 25 bp, Mus musculus
caagccgttgaaaggtacatgaagc

SEQ ID NO: 11552 - DNA, 25 bp, Mus musculus
caagcctactaccatcatcgagaag

SEQ ID NO: 11553 - DNA, 25 bp, Mus musculus
caagcctagaaaagtggagctgtct

SEQ ID NO: 11554 - DNA, 25 bp, Mus musculus
caagcctcagctaaacaagcccatg

SEQ ID NO: 11555 - DNA, 25 bp, Mus musculus
caagcctcatgttgacagtgtcaag

SEQ ID NO: 11556 - DNA, 25 bp, Mus musculus
caagcctctagcagatgatatcatc

SEQ ID NO: 11557 - DNA, 25 bp, Mus musculus
caagcctgagcttgcagtgagagct

SEQ ID NO: 11558 - DNA, 25 bp, Mus musculus
caagcctgaggaaggcacaaatgca

SEQ ID NO: 11559 - DNA, 25 bp, Mus musculus
caagcctgcaatgctaagatgcaca

SEQ ID NO: 11560 - DNA, 25 bp, Mus musculus
caagcctgccttcagaaaggaagag

SEQ ID NO: 11561 - DNA, 25 bp, Mus musculus
caagcctgtgaaatacaaaaatgtt

SEQ ID NO: 11562 - DNA, 25 bp, Mus musculus
caagccttatgaagagggaatgaga

SEQ ID NO: 11563 - DNA, 25 bp, Mus musculus
caagccttggttgagtttgacacag

SEQ ID NO: 11564 - DNA, 25 bp, Mus musculus
caagcgaatcatatacacagctgga

SEQ ID NO: 11565 - DNA, 25 bp, Mus musculus
caagcgaccagcctctccgtatggg

SEQ ID NO: 11566 - DNA, 25 bp, Mus musculus
caagcgcaagatgaggagacgttcg

SEQ ID NO: 11567 - DNA, 25 bp, Mus musculus
caagcgcaatttcatggcgtccaca

SEQ ID NO: 11568 - DNA, 25 bp, Mus musculus
caagcgctggtcagataaggtcatc

SEQ ID NO: 11569 - DNA, 25 bp, Mus musculus
caagcgcttctttgaggctgcggcg

SEQ ID NO: 11570 - DNA, 25 bp, Mus musculus
caagcggcagcgattggacaggatt

SEQ ID NO: 11571 - DNA, 25 bp, Mus musculus
caagcggcggaatttcagcaagcag

SEQ ID NO: 11572 - DNA, 25 bp, Mus musculus
caagcggttaaatgaagtttctaag

SEQ ID NO: 11573 - DNA, 25 bp, Mus musculus
caagcgtgcacagctctggccttta

SEQ ID NO: 11574 - DNA, 25 bp, Mus musculus
caagcgttttggtgcctggtacaga

SEQ ID NO: 11575 - DNA, 25 bp, Mus musculus
caagctaaaagtggtgggagagaaa

SEQ ID NO: 11576 - DNA, 25 bp, Mus musculus
caagctaagattgatgaggacagaa

SEQ ID NO: 11577 - DNA, 25 bp, Mus musculus
caagctacggttcacagtggataaa

SEQ ID NO: 11578 - DNA, 25 bp, Mus musculus
caagctatgatgtagctaccctgca

SEQ ID NO: 11579 - DNA, 25 bp, Mus musculus
caagctatgattttctccaggaaaa

SEQ ID NO: 11580 - DNA, 25 bp, Mus musculus
caagctcagaatgaaaatgaatttc

SEQ ID NO: 11581 - DNA, 25 bp, Mus musculus
caagctcatccgtactttcgtcatg

SEQ ID NO: 11582 - DNA, 25 bp, Mus musculus
caagctccatgtgatgcaagaggag

SEQ ID NO: 11583 - DNA, 25 bp, Mus musculus
caagctcgggaagaaggtgatcctc

SEQ ID NO: 11584 - DNA, 25 bp, Mus musculus
caagctcgtgttttcaaagattcaa

SEQ ID NO: 11585 - DNA, 25 bp, Mus musculus
caagctctagaaatcccaggtcagg

SEQ ID NO: 11586 - DNA, 25 bp, Mus musculus
caagctctgaccatgaccaaagaag

SEQ ID NO: 11587 - DNA, 25 bp, Mus musculus
caagctcttaagcatcgtggcgctg

SEQ ID NO: 11588 - DNA, 25 bp, Mus musculus
caagctcttgcattagaatctcggg

SEQ ID NO: 11589 - DNA, 25 bp, Mus musculus
caagctgaagcatcttaccatcgtg

SEQ ID NO: 11590 - DNA, 25 bp, Mus musculus
caagctgacgaaccttgaaagggcg

SEQ ID NO: 11591 - DNA, 25 bp, Mus musculus
caagctgacttcaatgccgttgagt

SEQ ID NO: 11592 - DNA, 25 bp, Mus musculus
caagctgagatgagtttgtcctgtg

SEQ ID NO: 11593 - DNA, 25 bp, Mus musculus
caagctgagccttagcctcctcatg

SEQ ID NO: 11594 - DNA, 25 bp, Mus musculus
caagctgataagaaatgcctctgaa

SEQ ID NO: 11595 - DNA, 25 bp, Mus musculus
caagctgatcgagaagctggacatc

SEQ ID NO: 11596 - DNA, 25 bp, Mus musculus
caagctgatgctgacggtgatgacc

SEQ ID NO: 11597 - DNA, 25 bp, Mus musculus
caagctgcaggacagcggattctac

SEQ ID NO: 11598 - DNA, 25 bp, Mus musculus
caagctgcaggagagcggattctac

SEQ ID NO: 11599 - DNA, 25 bp, Mus musculus
caagctgcagggaacccacttctct

SEQ ID NO: 11600 - DNA, 25 bp, Mus musculus
caagctgctagaagctgagcggaga

SEQ ID NO: 11601 - DNA, 25 bp, Mus musculus
caagctgctgtcaggcttgttaggg

SEQ ID NO: 11602 - DNA, 25 bp, Mus musculus
caagctgcttcgaatccaggatgat

SEQ ID NO: 11603 - DNA, 25 bp, Mus musculus
caagctgcttcttggtgtctacaga

SEQ ID NO: 11604 - DNA, 25 bp, Mus musculus
caagctgcttggcatactcactgat

SEQ ID NO: 11605 - DNA, 25 bp, Mus musculus
caagctggacctgagctgctgccag

SEQ ID NO: 11606 - DNA, 25 bp, Mus musculus
caagctggatcaggcaagctccagc

SEQ ID NO: 11607 - DNA, 25 bp, Mus musculus
caagctggatgagctcaagcgacag

SEQ ID NO: 11608 - DNA, 25 bp, Mus musculus
caagctggcaaacggactgttgctt

SEQ ID NO: 11609 - DNA, 25 bp, Mus musculus
caagctggcggtgattcagtatagc

SEQ ID NO: 11610 - DNA, 25 bp, Mus musculus
caagctgggccaccttatcacaggg

SEQ ID NO: 11611 - DNA, 25 bp, Mus musculus
caagctggtgaagcggttgaacaca

SEQ ID NO: 11612 - DNA, 25 bp, Mus musculus
caagctgtcaggagctcagtatcag

SEQ ID NO: 11613 - DNA, 25 bp, Mus musculus
caagctgtgggagcttcttgtgagc

SEQ ID NO: 11614 - DNA, 25 bp, Mus musculus
caagctgtggtaatgcagtttatta

SEQ ID NO: 11615 - DNA, 25 bp, Mus musculus
caagctgttatgttgcctgagggag

SEQ ID NO: 11616 - DNA, 25 bp, Mus musculus
caagcttagccctaggactctgagc

SEQ ID NO: 11617 - DNA, 25 bp, Mus musculus
caagcttcggaacatgaaatgggag

SEQ ID NO: 11618 - DNA, 25 bp, Mus musculus
caagcttcggaagatgaaatgggag

SEQ ID NO: 11619 - DNA, 25 bp, Mus musculus
caagcttcgtgtctgacaagagacc

SEQ ID NO: 11620 - DNA, 25 bp, Mus musculus
caagcttctatttctggaggcctgg

SEQ ID NO: 11621 - DNA, 25 bp, Mus musculus
caagcttgataaacccgagttctat

SEQ ID NO: 11622 - DNA, 25 bp, Mus musculus
caagcttgcgctgcagacagtgtgg

SEQ ID NO: 11623 - DNA, 25 bp, Mus musculus
caagctttgcacaccggttggtcct

SEQ ID NO: 11624 - DNA, 25 bp, Mus musculus
caagctttggatgagttctagaagc

SEQ ID NO: 11625 - DNA, 25 bp, Mus musculus
caagctttgtgatggacggtggcac

SEQ ID NO: 11626 - DNA, 25 bp, Mus musculus
caaggaaaatcgcattctgctgtac

SEQ ID NO: 11627 - DNA, 25 bp, Mus musculus
caaggaaacaggagctaagtgggca

SEQ ID NO: 11628 - DNA, 25 bp, Mus musculus
caaggaaagggcatcatggaactac

SEQ ID NO: 11629 - DNA, 25 bp, Mus musculus
caaggaaagggcttcatggaactac

SEQ ID NO: 11630 - DNA, 25 bp, Mus musculus
caaggaacaccttaaacaggtcaag

SEQ ID NO: 11631 - DNA, 25 bp, Mus musculus
caaggaaccattcctcagaaggatt

SEQ ID NO: 11632 - DNA, 25 bp, Mus musculus
caaggaactgggaaagacctcgatc

SEQ ID NO: 11633 - DNA, 25 bp, Mus musculus
caaggaactgtcacaatttgaaaag

SEQ ID NO: 11634 - DNA, 25 bp, Mus musculus
caaggaagaatggttaaagggaatg

SEQ ID NO: 11635 - DNA, 25 bp, Mus musculus
caaggaagaggagtccatgagtagc

SEQ ID NO: 11636 - DNA, 25 bp, Mus musculus
caaggaagctatcaaattagcaata

SEQ ID NO: 11637 - DNA, 25 bp, Mus musculus
caaggaagctatcaacaaagctggg

SEQ ID NO: 11638 - DNA, 25 bp, Mus musculus
caaggaaggagattctataaaggca

SEQ ID NO: 11639 - DNA, 25 bp, Mus musculus
caaggaattcagattcaggaagctg

SEQ ID NO: 11640 - DNA, 25 bp, Mus musculus
caaggaatttcacgagtacctgacc

SEQ ID NO: 11641 - DNA, 25 bp, Mus musculus
caaggacaaactggtcatcgggcgc

SEQ ID NO: 11642 - DNA, 25 bp, Mus musculus
caaggacaacactggctggagaaga

SEQ ID NO: 11643 - DNA, 25 bp, Mus musculus
caaggacaaggacaaagcactgccc

SEQ ID NO: 11644 - DNA, 25 bp, Mus musculus
caaggacaagtatggcaaggatgcc

SEQ ID NO: 11645 - DNA, 25 bp, Mus musculus
caaggacaatagtggtgagaaaaca

SEQ ID NO: 11646 - DNA, 25 bp, Mus musculus
caaggacagaattctcatcaagtta

SEQ ID NO: 11647 - DNA, 25 bp, Mus musculus
caaggacaggctgacggtcacctct

SEQ ID NO: 11648 - DNA, 25 bp, Mus musculus
caaggacattcgtggttccatcacc

SEQ ID NO: 11649 - DNA, 25 bp, Mus musculus
caaggaccagccactttctgataga

SEQ ID NO: 11650 - DNA, 25 bp, Mus musculus
caaggaccaggcacctgcttttcca

SEQ ID NO: 11651 - DNA, 25 bp, Mus musculus
caaggaccaggctaaaaccagatta

SEQ ID NO: 11652 - DNA, 25 bp, Mus musculus
caaggaccagggtgtgaatgtgcgg

SEQ ID NO: 11653 - DNA, 25 bp, Mus musculus
caaggaccatggtggaagcacatct

SEQ ID NO: 11654 - DNA, 25 bp, Mus musculus
caaggaccattcaggagctggacag

SEQ ID NO: 11655 - DNA, 25 bp, Mus musculus
caaggaccgaaaagtcaaatttagg

SEQ ID NO: 11656 - DNA, 25 bp, Mus musculus
caaggaccgaaatgtcaaatttagg

SEQ ID NO: 11657 - DNA, 25 bp, Mus musculus
caaggaccgctgacagggtcataca

SEQ ID NO: 11658 - DNA, 25 bp, Mus musculus
caaggacctacgacatttcctcaac

SEQ ID NO: 11659 - DNA, 25 bp, Mus musculus
caaggacgacggtggtattgtcatc

SEQ ID NO: 11660 - DNA, 25 bp, Mus musculus
caaggacgcatctgccttcagaaag

SEQ ID NO: 11661 - DNA, 25 bp, Mus musculus
caaggactccatgaaagcgttttca

SEQ ID NO: 11662 - DNA, 25 bp, Mus musculus
caaggactggtggacatatgaattc

SEQ ID NO: 11663 - DNA, 25 bp, Mus musculus
caaggacttacaaaaattccagagt

SEQ ID NO: 11664 - DNA, 25 bp, Mus musculus
caaggacttctactcagaatttggg

SEQ ID NO: 11665 - DNA, 25 bp, Mus musculus
caaggagaagctggcacagactgcc

SEQ ID NO: 11666 - DNA, 25 bp, Mus musculus
caaggagaagtgtgcagagcaggcg

SEQ ID NO: 11667 - DNA, 25 bp, Mus musculus
caaggagaagttgactgttggcccc

SEQ ID NO: 11668 - DNA, 25 bp, Mus musculus
caaggagacagggatgtaccattgt

SEQ ID NO: 11669 - DNA, 25 bp, Mus musculus
caaggagacctctggcctgatgctg

SEQ ID NO: 11670 - DNA, 25 bp, Mus musculus
caaggagacgtaagccccaatcctt

SEQ ID NO: 11671 - DNA, 25 bp, Mus musculus
caaggagagcctgccagaactgagt

SEQ ID NO: 11672 - DNA, 25 bp, Mus musculus
caaggagatcaagatcgtgtctgcc

SEQ ID NO: 11673 - DNA, 25 bp, Mus musculus
caaggagcaaagcaaagagatgaac

SEQ ID NO: 11674 - DNA, 25 bp, Mus musculus
caaggagcaatacatggaagcatgt

SEQ ID NO: 11675 - DNA, 25 bp, Mus musculus
caaggagcagcgactcaactttggg

SEQ ID NO: 11676 - DNA, 25 bp, Mus musculus
caaggagcccttgaatagaagacag

SEQ ID NO: 11677 - DNA, 25 bp, Mus musculus
caaggagctcggagaagactctgct

SEQ ID NO: 11678 - DNA, 25 bp, Mus musculus
caaggagcttccctcagctgaaggc

SEQ ID NO: 11679 - DNA, 25 bp, Mus musculus
caaggaggaaacagggcgcaaagtc

SEQ ID NO: 11680 - DNA, 25 bp, Mus musculus
caaggaggaagatgcgtgccgcctc

SEQ ID NO: 11681 - DNA, 25 bp, Mus musculus
caaggaggacaaatgcattggctgc

SEQ ID NO: 11682 - DNA, 25 bp, Mus musculus
caaggaggacaaggaaaatcgcatt

SEQ ID NO: 11683 - DNA, 25 bp, Mus musculus
caaggaggcaattcagaagtgggat

SEQ ID NO: 11684 - DNA, 25 bp, Mus musculus
caaggaggcagatgtgtcactcaca

SEQ ID NO: 11685 - DNA, 25 bp, Mus musculus
caaggaggccatgcatatcttaagg

SEQ ID NO: 11686 - DNA, 25 bp, Mus musculus
caaggaggctctgttgcacaagcac

SEQ ID NO: 11687 - DNA, 25 bp, Mus musculus
caaggagtactggttcgtgctgaca

SEQ ID NO: 11688 - DNA, 25 bp, Mus musculus
caaggagtatcttgaaatgcatcca

SEQ ID NO: 11689 - DNA, 25 bp, Mus musculus
caaggagtcagagaagcagcttcta

SEQ ID NO: 11690 - DNA, 25 bp, Mus musculus
caaggagtcagtccagattctgcga

SEQ ID NO: 11691 - DNA, 25 bp, Mus musculus
caaggagtgatcctagagccacagc

SEQ ID NO: 11692 - DNA, 25 bp, Mus musculus
caaggagtgggaggtgtataacttc

SEQ ID NO: 11693 - DNA, 25 bp, Mus musculus
caaggatccagtttacactttttct

SEQ ID NO: 11694 - DNA, 25 bp, Mus musculus
caaggatccgtgctgaagttttcaa

SEQ ID NO: 11695 - DNA, 25 bp, Mus musculus
caaggatcgggcagctttcgaggcc

SEQ ID NO: 11696 - DNA, 25 bp, Mus musculus
caaggatgaagctaggaaaaggctc

SEQ ID NO: 11697 - DNA, 25 bp, Mus musculus
caaggatgagttcttcttcggcagc

SEQ ID NO: 11698 - DNA, 25 bp, Mus musculus
caaggatgcagtgaaagcactgaac

SEQ ID NO: 11699 - DNA, 25 bp, Mus musculus
caaggatgctgaggaatggttcttc

SEQ ID NO: 11700 - DNA, 25 bp, Mus musculus
caaggatggcctcagttcatgaacc

SEQ ID NO: 11701 - DNA, 25 bp, Mus musculus
caaggatgggaaacttaagtaccag

SEQ ID NO: 11702 - DNA, 25 bp, Mus musculus
caaggatgggaatcttaagtaccag

SEQ ID NO: 11703 - DNA, 25 bp, Mus musculus
caaggatgtggccatggactttacg

SEQ ID NO: 11704 - DNA, 25 bp, Mus musculus
caaggattcagtcaaactaagcagg

SEQ ID NO: 11705 - DNA, 25 bp, Mus musculus
caaggatttcaaagtgctttgcaag

SEQ ID NO: 11706 - DNA, 25 bp, Mus musculus
caaggcaccccaagataagaagaca

SEQ ID NO: 11707 - DNA, 25 bp, Mus musculus
caaggcaccccgataagaggaaaag

SEQ ID NO: 11708 - DNA, 25 bp, Mus musculus
caaggcactgactcggcctttcaca

SEQ ID NO: 11709 - DNA, 25 bp, Mus musculus
caaggcactgattgaaaatgcagac

SEQ ID NO: 11710 - DNA, 25 bp, Mus musculus
caaggcagaagacctatctgcattt

SEQ ID NO: 11711 - DNA, 25 bp, Mus musculus
caaggcagaagtctaaccgctggtc

SEQ ID NO: 11712 - DNA, 25 bp, Mus musculus
caaggcagtcttcagcctattatca

SEQ ID NO: 11713 - DNA, 25 bp, Mus musculus
caaggcagtgacatttgatagctga

SEQ ID NO: 11714 - DNA, 25 bp, Mus musculus
caaggcataatttcacaaagttcac

SEQ ID NO: 11715 - DNA, 25 bp, Mus musculus
caaggcataccaatacgaacaggag

SEQ ID NO: 11716 - DNA, 25 bp, Mus musculus
caaggcatgtcgatgagggagtctc

SEQ ID NO: 11717 - DNA, 25 bp, Mus musculus
caaggcattacgtcaccaagtgaga

SEQ ID NO: 11718 - DNA, 25 bp, Mus musculus
caaggcattatgtcattgctgagtc

SEQ ID NO: 11719 - DNA, 25 bp, Mus musculus
caaggccaagttcacgcagcctctg

SEQ ID NO: 11720 - DNA, 25 bp, Mus musculus
caaggccaccatgtcaaggtctaca

SEQ ID NO: 11721 - DNA, 25 bp, Mus musculus
caaggccagagagcaatttaagagg

SEQ ID NO: 11722 - DNA, 25 bp, Mus musculus
caaggccaggagtcaggcctggctt

SEQ ID NO: 11723 - DNA, 25 bp, Mus musculus
caaggccagtggtcttgtggagcca

SEQ ID NO: 11724 - DNA, 25 bp, Mus musculus
caaggccatggagaacagcgagtgc

SEQ ID NO: 11725 - DNA, 25 bp, Mus musculus
caaggcccaagcagaggtactggct

SEQ ID NO: 11726 - DNA, 25 bp, Mus musculus
caaggcccacagctagagcgtggca

SEQ ID NO: 11727 - DNA, 25 bp, Mus musculus
caaggcccaggagtggaatgtcaag

SEQ ID NO: 11728 - DNA, 25 bp, Mus musculus
caaggcccctgtggtgaaggctaaa

SEQ ID NO: 11729 - DNA, 25 bp, Mus musculus
caaggccctcagcaccattgtctag

SEQ ID NO: 11730 - DNA, 25 bp, Mus musculus
caaggccctcaggaccattgtctag

SEQ ID NO: 11731 - DNA, 25 bp, Mus musculus
caaggccgaggtggcctgcatcgct

SEQ ID NO: 11732 - DNA, 25 bp, Mus musculus
caaggccgtgcaccagtgtgacaat

SEQ ID NO: 11733 - DNA, 25 bp, Mus musculus
caaggcctagagtcagggcatgaca

SEQ ID NO: 11734 - DNA, 25 bp, Mus musculus
caaggcctcagatttgccgggttct

SEQ ID NO: 11735 - DNA, 25 bp, Mus musculus
caaggcctccagagatattgccagt

SEQ ID NO: 11736 - DNA, 25 bp, Mus musculus
caaggcgtgcagctcatcgacttct

SEQ ID NO: 11737 - DNA, 25 bp, Mus musculus
caaggcgtgtatggactacccagtg

SEQ ID NO: 11738 - DNA, 25 bp, Mus musculus
caaggctacggctactatcgcactg

SEQ ID NO: 11739 - DNA, 25 bp, Mus musculus
caaggctatggcaagctaagcagtg

SEQ ID NO: 11740 - DNA, 25 bp, Mus musculus
caaggctcagtatgatgacattgcc

SEQ ID NO: 11741 - DNA, 25 bp, Mus musculus
caaggctgacatcaatgcagtgaat

SEQ ID NO: 11742 - DNA, 25 bp, Mus musculus
caaggctgacatttttctctgttca

SEQ ID NO: 11743 - DNA, 25 bp, Mus musculus
caaggctgacttcgttttcatgttt

SEQ ID NO: 11744 - DNA, 25 bp, Mus musculus
caaggctgagaaactggttgagaac

SEQ ID NO: 11745 - DNA, 25 bp, Mus musculus
caaggctgagaatctggttgagaac

SEQ ID NO: 11746 - DNA, 25 bp, Mus musculus
caaggctgataatgctgtgaacaag

SEQ ID NO: 11747 - DNA, 25 bp, Mus musculus
caaggctgcagagcttgtcaacgac

SEQ ID NO: 11748 - DNA, 25 bp, Mus musculus
caaggctgccgttgtgtccgaggca

SEQ ID NO: 11749 - DNA, 25 bp, Mus musculus
caaggctggaggaatgcatcacgtc

SEQ ID NO: 11750 - DNA, 25 bp, Mus musculus
caaggctgttccgtgtgttcgtgca

SEQ ID NO: 11751 - DNA, 25 bp, Mus musculus
caaggcttgccctgctctggttcag

SEQ ID NO: 11752 - DNA, 25 bp, Mus musculus
caaggcttgccttccattggcccag

SEQ ID NO: 11753 - DNA, 25 bp, Mus musculus
caaggcttgtgagcccggagtcgac

SEQ ID NO: 11754 - DNA, 25 bp, Mus musculus
caaggctttgacatgcaagaggttg

SEQ ID NO: 11755 - DNA, 25 bp, Mus musculus
caaggctttgcagagaaaagacaca

SEQ ID NO: 11756 - DNA, 25 bp, Mus musculus
caaggctttttcagctttcccgtgg

SEQ ID NO: 11757 - DNA, 25 bp, Mus musculus
caagggaatcatgcacagggatgtg

SEQ ID NO: 11758 - DNA, 25 bp, Mus musculus
caagggacccctgagtttccagagg

SEQ ID NO: 11759 - DNA, 25 bp, Mus musculus
caagggactgatatgggacacaatg

SEQ ID NO: 11760 - DNA, 25 bp, Mus musculus
caagggagaactggaaattcagaga

SEQ ID NO: 11761 - DNA, 25 bp, Mus musculus
caagggagtcaaccatacatgtatg

SEQ ID NO: 11762 - DNA, 25 bp, Mus musculus
caagggagttgcagaaaagcctcat

SEQ ID NO: 11763 - DNA, 25 bp, Mus musculus
caagggatggacatggtcatttcct

SEQ ID NO: 11764 - DNA, 25 bp, Mus musculus
caagggatgtagaaagcaaagtgtc

SEQ ID NO: 11765 - DNA, 25 bp, Mus musculus
caagggatgtagtaagcaaagtgtc

SEQ ID NO: 11766 - DNA, 25 bp, Mus musculus
caagggcagaagttacagagcccgt

SEQ ID NO: 11767 - DNA, 25 bp, Mus musculus
caagggcatgtggaaccacttagga

SEQ ID NO: 11768 - DNA, 25 bp, Mus musculus
caagggccaggaagtacaaatgcgg

SEQ ID NO: 11769 - DNA, 25 bp, Mus musculus
caagggctggaacagttcataaaca

SEQ ID NO: 11770 - DNA, 25 bp, Mus musculus
caagggtcaagtggaagttactttg

SEQ ID NO: 11771 - DNA, 25 bp, Mus musculus
caagggtctgtatgctgagcagcaa

SEQ ID NO: 11772 - DNA, 25 bp, Mus musculus
caagggtgctctggacatgttgacc

SEQ ID NO: 11773 - DNA, 25 bp, Mus musculus
caagggttggataacgcactgtcac

SEQ ID NO: 11774 - DNA, 25 bp, Mus musculus
caagggttggctaacaagcaggaac

SEQ ID NO: 11775 - DNA, 25 bp, Mus musculus
caagggttggcttacaagcaggaac

SEQ ID NO: 11776 - DNA, 25 bp, Mus musculus
caagggttgtccaatgtgaaggctc

SEQ ID NO: 11777 - DNA, 25 bp, Mus musculus
caagggttgtccactgtgtccagcc

SEQ ID NO: 11778 - DNA, 25 bp, Mus musculus
caaggtaagaagaagacaatcggtc

SEQ ID NO: 11779 - DNA, 25 bp, Mus musculus
caaggtaattgatgataaggcgtat

SEQ ID NO: 11780 - DNA, 25 bp, Mus musculus
caaggtactcgttatatgtgacagg

SEQ ID NO: 11781 - DNA, 25 bp, Mus musculus
caaggtatccatctgtccccaaaac

SEQ ID NO: 11782 - DNA, 25 bp, Mus musculus
caaggtattgccattctaatccaga

SEQ ID NO: 11783 - DNA, 25 bp, Mus musculus
caaggtcacaaagttcattgaaggt

SEQ ID NO: 11784 - DNA, 25 bp, Mus musculus
caaggtcacccttaacacaggccta

SEQ ID NO: 11785 - DNA, 25 bp, Mus musculus
caaggtcaccggagagcctctctat

SEQ ID NO: 11786 - DNA, 25 bp, Mus musculus
caaggtcactcttcagtttccatca

SEQ ID NO: 11787 - DNA, 25 bp, Mus musculus
caaggtcagcactaagaggcctccc

SEQ ID NO: 11788 - DNA, 25 bp, Mus musculus
caaggtcagctttcacatggagtat

SEQ ID NO: 11789 - DNA, 25 bp, Mus musculus
caaggtcatgaccaagtcgtgtccc

SEQ ID NO: 11790 - DNA, 25 bp, Mus musculus
caaggtccagatggcggccaacgtg

SEQ ID NO: 11791 - DNA, 25 bp, Mus musculus
caaggtccagctacattgatatttg

SEQ ID NO: 11792 - DNA, 25 bp, Mus musculus
caaggtcctgaccttcctagacagt

SEQ ID NO: 11793 - DNA, 25 bp, Mus musculus
caaggtcgaccctggaagagtcggt

SEQ ID NO: 11794 - DNA, 25 bp, Mus musculus
caaggtcggtgaatatcacttccgt

SEQ ID NO: 11795 - DNA, 25 bp, Mus musculus
caaggtcggtgattatcacttccgt

SEQ ID NO: 11796 - DNA, 25 bp, Mus musculus
caaggtctacatagcccctcttagg

SEQ ID NO: 11797 - DNA, 25 bp, Mus musculus
caaggtctacatgtgcagctgtcaa

SEQ ID NO: 11798 - DNA, 25 bp, Mus musculus
caaggtctgggactctgttccagtc

SEQ ID NO: 11799 - DNA, 25 bp, Mus musculus
caaggtctttgtggctaggctgcgc

SEQ ID NO: 11800 - DNA, 25 bp, Mus musculus
caaggtgaacttttaagagaccctg

SEQ ID NO: 11801 - DNA, 25 bp, Mus musculus
caaggtgaatatagtgaggccatcc

SEQ ID NO: 11802 - DNA, 25 bp, Mus musculus
caaggtgaatggattctctaacaac

SEQ ID NO: 11803 - DNA, 25 bp, Mus musculus
caaggtgagacagtatctgatgtca

SEQ ID NO: 11804 - DNA, 25 bp, Mus musculus
caaggtgcatctcctagcactagct

SEQ ID NO: 11805 - DNA, 25 bp, Mus musculus
caaggtgctggctgtgaaccaggaa

SEQ ID NO: 11806 - DNA, 25 bp, Mus musculus
caaggtggaaggaaacagcaaaggc

SEQ ID NO: 11807 - DNA, 25 bp, Mus musculus
caaggtggaagtggccctcagtaac

SEQ ID NO: 11808 - DNA, 25 bp, Mus musculus
caaggtggcttacagcctcgacgga

SEQ ID NO: 11809 - DNA, 25 bp, Mus musculus
caaggtggtggccacgatgtaatca

SEQ ID NO: 11810 - DNA, 25 bp, Mus musculus
caaggtgtatttcctatcaggaaac

SEQ ID NO: 11811 - DNA, 25 bp, Mus musculus
caaggtgtgtgcttcatctaaaggc

SEQ ID NO: 11812 - DNA, 25 bp, Mus musculus
caaggtgttctgcaataaagcctcc

SEQ ID NO: 11813 - DNA, 25 bp, Mus musculus
caaggtgttggcaccctgggaaccg

SEQ ID NO: 11814 - DNA, 25 bp, Mus musculus
caaggttcagcatctacttacgtca

SEQ ID NO: 11815 - DNA, 25 bp, Mus musculus
caaggttcccttaggagagactctc

SEQ ID NO: 11816 - DNA, 25 bp, Mus musculus
caaggttcctactccatatggctga

SEQ ID NO: 11817 - DNA, 25 bp, Mus musculus
caaggttcggaggaccatgagcagc

SEQ ID NO: 11818 - DNA, 25 bp, Mus musculus
caaggttgaagagagcattgggaac

SEQ ID NO: 11819 - DNA, 25 bp, Mus musculus
caaggttgccacttcttatagagtc

SEQ ID NO: 11820 - DNA, 25 bp, Mus musculus
caaggtttaccaggagacgtcggag

SEQ ID NO: 11821 - DNA, 25 bp, Mus musculus
caagtaaaactttcgtaagctcagg

SEQ ID NO: 11822 - DNA, 25 bp, Mus musculus
caagtaacaccactatggaagcccc

SEQ ID NO: 11823 - DNA, 25 bp, Mus musculus
caagtaaccagttctgtttgcctgt

SEQ ID NO: 11824 - DNA, 25 bp, Mus musculus
caagtaactaagagatatgcccgga

SEQ ID NO: 11825 - DNA, 25 bp, Mus musculus
caagtaatgaacatggccgccttcc

SEQ ID NO: 11826 - DNA, 25 bp, Mus musculus
caagtaattacgtcacagggaagaa

SEQ ID NO: 11827 - DNA, 25 bp, Mus musculus
caagtacaaagtcagcagttgccgg

SEQ ID NO: 11828 - DNA, 25 bp, Mus musculus
caagtacacagataaagacaatgga

SEQ ID NO: 11829 - DNA, 25 bp, Mus musculus
caagtacactttgggatttgttgtg

SEQ ID NO: 11830 - DNA, 25 bp, Mus musculus
caagtacagcatctgcaagagcggt

SEQ ID NO: 11831 - DNA, 25 bp, Mus musculus
caagtacagggatcggccaacgatc

SEQ ID NO: 11832 - DNA, 25 bp, Mus musculus
caagtacagtgaagtgttcccacac

SEQ ID NO: 11833 - DNA, 25 bp, Mus musculus
caagtacagtgtcgtatagactaga

SEQ ID NO: 11834 - DNA, 25 bp, Mus musculus
caagtacatgttcaagtcactgcag

SEQ ID NO: 11835 - DNA, 25 bp, Mus musculus
caagtaccactaaatagtacagcta

SEQ ID NO: 11836 - DNA, 25 bp, Mus musculus
caagtaccagctggacaaagatggg

SEQ ID NO: 11837 - DNA, 25 bp, Mus musculus
caagtacctcatttgaagggataac

SEQ ID NO: 11838 - DNA, 25 bp, Mus musculus
caagtacgagagtggccctgacgga

SEQ ID NO: 11839 - DNA, 25 bp, Mus musculus
caagtacgagatgaacaaagccttc

SEQ ID NO: 11840 - DNA, 25 bp, Mus musculus
caagtactgccgtttcaaccaggac

SEQ ID NO: 11841 - DNA, 25 bp, Mus musculus
caagtactgttgctttacgtggcag

SEQ ID NO: 11842 - DNA, 25 bp, Mus musculus
caagtacttactaccaattgtggtc

SEQ ID NO: 11843 - DNA, 25 bp, Mus musculus
caagtacttccaaagaatgaccaca

SEQ ID NO: 11844 - DNA, 25 bp, Mus musculus
caagtagaatccgtacgatttcgtt

SEQ ID NO: 11845 - DNA, 25 bp, Mus musculus
caagtagacatgaaacagcccctga

SEQ ID NO: 11846 - DNA, 25 bp, Mus musculus
caagtagcatacaaaccctgggcct

SEQ ID NO: 11847 - DNA, 25 bp, Mus musculus
caagtagcctcacggctctgagctt

SEQ ID NO: 11848 - DNA, 25 bp, Mus musculus
caagtagcctcagggctctgagctt

SEQ ID NO: 11849 - DNA, 25 bp, Mus musculus
caagtagtctgaaaacacccctggg

SEQ ID NO: 11850 - DNA, 25 bp, Mus musculus
caagtagtggaatacaaaaccagtt

SEQ ID NO: 11851 - DNA, 25 bp, Mus musculus
caagtatcgccggaatgaactcttc

SEQ ID NO: 11852 - DNA, 25 bp, Mus musculus
caagtatcggattttgtgaggtacc

SEQ ID NO: 11853 - DNA, 25 bp, Mus musculus
caagtatgctgcaagtgagaacgta

SEQ ID NO: 11854 - DNA, 25 bp, Mus musculus
caagtattgggcctttcctagagaa

SEQ ID NO: 11855 - DNA, 25 bp, Mus musculus
caagtcaagcgataaagcagaggag

SEQ ID NO: 11856 - DNA, 25 bp, Mus musculus
caagtcaaggagaaatgaattctac

SEQ ID NO: 11857 - DNA, 25 bp, Mus musculus
caagtcaaggcctagagtcagggca

SEQ ID NO: 11858 - DNA, 25 bp, Mus musculus
caagtcaccgagactagacaggtca

SEQ ID NO: 11859 - DNA, 25 bp, Mus musculus
caagtcacctgtacagggcggtgct

SEQ ID NO: 11860 - DNA, 25 bp, Mus musculus
caagtcagacactgcattagagaaa

SEQ ID NO: 11861 - DNA, 25 bp, Mus musculus
caagtcagcaatgatgagcgcccag

SEQ ID NO: 11862 - DNA, 25 bp, Mus musculus
caagtcagtgtacgagaagatgttc

SEQ ID NO: 11863 - DNA, 25 bp, Mus musculus
caagtcatctgggatccactacggg

SEQ ID NO: 11864 - DNA, 25 bp, Mus musculus
caagtcattggacaggaggtccaca

SEQ ID NO: 11865 - DNA, 25 bp, Mus musculus
caagtccaagacctgtttaacaaga

SEQ ID NO: 11866 - DNA, 25 bp, Mus musculus
caagtccacatagcaagctgcacaa

SEQ ID NO: 11867 - DNA, 25 bp, Mus musculus
caagtccaggtcaatgccacaaata

SEQ ID NO: 11868 - DNA, 25 bp, Mus musculus
caagtccaggtctatgccacaaata

SEQ ID NO: 11869 - DNA, 25 bp, Mus musculus
caagtccagtgtgggctccaagcgt

SEQ ID NO: 11870 - DNA, 25 bp, Mus musculus
caagtccatgattgagaaggtgacc

SEQ ID NO: 11871 - DNA, 25 bp, Mus musculus
caagtccatgccagtgttgggttct

SEQ ID NO: 11872 - DNA, 25 bp, Mus musculus
caagtccccaggcataaagctttac

SEQ ID NO: 11873 - DNA, 25 bp, Mus musculus
caagtccgtggtcagctgatgaaac

SEQ ID NO: 11874 - DNA, 25 bp, Mus musculus
caagtcctgaactgtcaccttagtg

SEQ ID NO: 11875 - DNA, 25 bp, Mus musculus
caagtcctgcaagtgaacaagccgg

SEQ ID NO: 11876 - DNA, 25 bp, Mus musculus
caagtcctgggtcaacgctgtagcc

SEQ ID NO: 11877 - DNA, 25 bp, Mus musculus
caagtcctttgaggcaccaataaaa

SEQ ID NO: 11878 - DNA, 25 bp, Mus musculus
caagtcgctactatgtgggcatcga

SEQ ID NO: 11879 - DNA, 25 bp, Mus musculus
caagtcgctgatcgcctcagaggag

SEQ ID NO: 11880 - DNA, 25 bp, Mus musculus
caagtcgctgggacttaacacctcc

SEQ ID NO: 11881 - DNA, 25 bp, Mus musculus
caagtcggacaaagccaacttcaca

SEQ ID NO: 11882 - DNA, 25 bp, Mus musculus
caagtcgtccgtggagatggcacat

SEQ ID NO: 11883 - DNA, 25 bp, Mus musculus
caagtctcttgaggctcaggcggag

SEQ ID NO: 11884 - DNA, 25 bp, Mus musculus
caagtctgcagaggctgcagatgcg

SEQ ID NO: 11885 - DNA, 25 bp, Mus musculus
caagtctgctctacaagccataggg

SEQ ID NO: 11886 - DNA, 25 bp, Mus musculus
caagtctggtctccactcaatggct

SEQ ID NO: 11887 - DNA, 25 bp, Mus musculus
caagtcttcagccacattgttcctc

SEQ ID NO: 11888 - DNA, 25 bp, Mus musculus
caagtcttcttagtgacctgggacc

SEQ ID NO: 11889 - DNA, 25 bp, Mus musculus
caagtgaagatgctaactgtcttgc

SEQ ID NO: 11890 - DNA, 25 bp, Mus musculus
caagtgaaggaacacaggactgccg

SEQ ID NO: 11891 - DNA, 25 bp, Mus musculus
caagtgaaggcaagaaatggctcaa

SEQ ID NO: 11892 - DNA, 25 bp, Mus musculus
caagtgaattagcaataatccaaga

SEQ ID NO: 11893 - DNA, 25 bp, Mus musculus
caagtgacagatcacgagattcatc

SEQ ID NO: 11894 - DNA, 25 bp, Mus musculus
caagtgactgtttttctgcatggaa

SEQ ID NO: 11895 - DNA, 25 bp, Mus musculus
caagtgagaagccatgcctctatcc

SEQ ID NO: 11896 - DNA, 25 bp, Mus musculus
caagtgagcagagtgagttcgtcct

SEQ ID NO: 11897 - DNA, 25 bp, Mus musculus
caagtgcaaatgtcaccctggattt

SEQ ID NO: 11898 - DNA, 25 bp, Mus musculus
caagtgcacattggcttgccagcaa

SEQ ID NO: 11899 - DNA, 25 bp, Mus musculus
caagtgcagaattcacaagatccag

SEQ ID NO: 11900 - DNA, 25 bp, Mus musculus
caagtgcagagtgtcttaagggcat

SEQ ID NO: 11901 - DNA, 25 bp, Mus musculus
caagtgccaccgatgttacaagaca

SEQ ID NO: 11902 - DNA, 25 bp, Mus musculus
caagtgccagacacagactctgaga

SEQ ID NO: 11903 - DNA, 25 bp, Mus musculus
caagtgcccaagtttgtagtttcta

SEQ ID NO: 11904 - DNA, 25 bp, Mus musculus
caagtgccccatttgttccaagtct

SEQ ID NO: 11905 - DNA, 25 bp, Mus musculus
caagtgcctattgaaagagactcac

SEQ ID NO: 11906 - DNA, 25 bp, Mus musculus
caagtgcctggtcatcaagtatgcc

SEQ ID NO: 11907 - DNA, 25 bp, Mus musculus
caagtgcctttctgttgagcagccc

SEQ ID NO: 11908 - DNA, 25 bp, Mus musculus
caagtgctgcagcatcaagcccgac

SEQ ID NO: 11909 - DNA, 25 bp, Mus musculus
caagtgctgggacttagagacgcct

SEQ ID NO: 11910 - DNA, 25 bp, Mus musculus
caagtgctgttcttcaacatctggg

SEQ ID NO: 11911 - DNA, 25 bp, Mus musculus
caagtggaactttgcctacccagcc

SEQ ID NO: 11912 - DNA, 25 bp, Mus musculus
caagtggagactcgttcatgataag

SEQ ID NO: 11913 - DNA, 25 bp, Mus musculus
caagtggcagttctaccagaaccgc

SEQ ID NO: 11914 - DNA, 25 bp, Mus musculus
caagtggcagtttgtcatggaaagc

SEQ ID NO: 11915 - DNA, 25 bp, Mus musculus
caagtggccaaactgctcggctaca

SEQ ID NO: 11916 - DNA, 25 bp, Mus musculus
caagtggccaatgccatcataggcc

SEQ ID NO: 11917 - DNA, 25 bp, Mus musculus
caagtggctctacaagaggaaaggc

SEQ ID NO: 11918 - DNA, 25 bp, Mus musculus
caagtgggacctggctgccgtgatt

SEQ ID NO: 11919 - DNA, 25 bp, Mus musculus
caagtgggattacatgacaccagag

SEQ ID NO: 11920 - DNA, 25 bp, Mus musculus
caagtgggccgagcgactctgagac

SEQ ID NO: 11921 - DNA, 25 bp, Mus musculus
caagtgggtcaacaaacaccttatc

SEQ ID NO: 11922 - DNA, 25 bp, Mus musculus
caagtgggtctttgcctagatgcag

SEQ ID NO: 11923 - DNA, 25 bp, Mus musculus
caagtggtggaatagcctaagtgat

SEQ ID NO: 11924 - DNA, 25 bp, Mus musculus
caagtggtgtttgccactcaggaga

SEQ ID NO: 11925 - DNA, 25 bp, Mus musculus
caagtggttctcagcttgtggcgtt

SEQ ID NO: 11926 - DNA, 25 bp, Mus musculus
caagtggtttatgtaccatcccatc

SEQ ID NO: 11927 - DNA, 25 bp, Mus musculus
caagtgtaacagtgcatcgggatag

SEQ ID NO: 11928 - DNA, 25 bp, Mus musculus
caagtgtaccgccagctcagcaagc

SEQ ID NO: 11929 - DNA, 25 bp, Mus musculus
caagtgtatggaaacccacaacagt

SEQ ID NO: 11930 - DNA, 25 bp, Mus musculus
caagtgtccttggttataaactacg

SEQ ID NO: 11931 - DNA, 25 bp, Mus musculus
caagtgtctcagctgtcaccgtcta

SEQ ID NO: 11932 - DNA, 25 bp, Mus musculus
caagtgtctgcagaataaacccagg

SEQ ID NO: 11933 - DNA, 25 bp, Mus musculus
caagtgtgaatcttccccagctcct

SEQ ID NO: 11934 - DNA, 25 bp, Mus musculus
caagtgtgacctggaagacgaacgg

SEQ ID NO: 11935 - DNA, 25 bp, Mus musculus
caagtgtgccggaattggaatcagg

SEQ ID NO: 11936 - DNA, 25 bp, Mus musculus
caagtgtggctcgaaggataatatc

SEQ ID NO: 11937 - DNA, 25 bp, Mus musculus
caagtgtgtacttgcttctggccta

SEQ ID NO: 11938 - DNA, 25 bp, Mus musculus
caagtgttgcaggagaaacttcagt

SEQ ID NO: 11939 - DNA, 25 bp, Mus musculus
caagtgtttaactggactcactgga

SEQ ID NO: 11940 - DNA, 25 bp, Mus musculus
caagtgtttcaaagagattgggtca

SEQ ID NO: 11941 - DNA, 25 bp, Mus musculus
caagtgtttcccttggagcccctga

SEQ ID NO: 11942 - DNA, 25 bp, Mus musculus
caagtgtttccggaagtgcatcggg

SEQ ID NO: 11943 - DNA, 25 bp, Mus musculus
caagtgtttgaagaaacaggaatct

SEQ ID NO: 11944 - DNA, 25 bp, Mus musculus
caagttacacgtgggcaacatcagc

SEQ ID NO: 11945 - DNA, 25 bp, Mus musculus
caagttacctccgattatgagacca

SEQ ID NO: 11946 - DNA, 25 bp, Mus musculus
caagttacttaagagcagctcgggc

SEQ ID NO: 11947 - DNA, 25 bp, Mus musculus
caagttatcaagaatttagcgctgc

SEQ ID NO: 11948 - DNA, 25 bp, Mus musculus
caagttatcaagtatttagcgctgc

SEQ ID NO: 11949 - DNA, 25 bp, Mus musculus
caagttatcatctgatccgaggccc

SEQ ID NO: 11950 - DNA, 25 bp, Mus musculus
caagttattgcttctgaggatctgg

SEQ ID NO: 11951 - DNA, 25 bp, Mus musculus
caagttcacgatggactgcgcagcg

SEQ ID NO: 11952 - DNA, 25 bp, Mus musculus
caagttcagccagaatattgggcgc

SEQ ID NO: 11953 - DNA, 25 bp, Mus musculus
caagttcaggttcctttaggtgacg

SEQ ID NO: 11954 - DNA, 25 bp, Mus musculus
caagttcagtgccatccagaggcag

SEQ ID NO: 11955 - DNA, 25 bp, Mus musculus
caagttcagtggtgtcaactcagcc

SEQ ID NO: 11956 - DNA, 25 bp, Mus musculus
caagttcatgaaggagcgacacacg

SEQ ID NO: 11957 - DNA, 25 bp, Mus musculus
caagttccacagagcgtgagacgca

SEQ ID NO: 11958 - DNA, 25 bp, Mus musculus
caagttcgagaagaagaccgctcca

SEQ ID NO: 11959 - DNA, 25 bp, Mus musculus
caagttcgggaacaagacgttgtca

SEQ ID NO: 11960 - DNA, 25 bp, Mus musculus
caagttcgtcttggtgaagttcgac

SEQ ID NO: 11961 - DNA, 25 bp, Mus musculus
caagttctaatgtgcatgttccagc

SEQ ID NO: 11962 - DNA, 25 bp, Mus musculus
caagttctacagtcaggccatcgag

SEQ ID NO: 11963 - DNA, 25 bp, Mus musculus
caagttctacgtgggagtctgtgca

SEQ ID NO: 11964 - DNA, 25 bp, Mus musculus
caagttctgactcaagtgtaattat

SEQ ID NO: 11965 - DNA, 25 bp, Mus musculus
caagttgaaggcaatgtcttccctc

SEQ ID NO: 11966 - DNA, 25 bp, Mus musculus
caagttgagatttgccgatggaagt

SEQ ID NO: 11967 - DNA, 25 bp, Mus musculus
caagttgatctggagacaagtgcgg

SEQ ID NO: 11968 - DNA, 25 bp, Mus musculus
caagttgatgacttcttacctaaaa

SEQ ID NO: 11969 - DNA, 25 bp, Mus musculus
caagttgcaggccttgactgtggca

SEQ ID NO: 11970 - DNA, 25 bp, Mus musculus
caagttgccacctaccatagagcca

SEQ ID NO: 11971 - DNA, 25 bp, Mus musculus
caagttgcgtcgaacagccaagacc

SEQ ID NO: 11972 - DNA, 25 bp, Mus musculus
caagttgctgaagccacagaaagtg

SEQ ID NO: 11973 - DNA, 25 bp, Mus musculus
caagttggacccaccctctgatctg

SEQ ID NO: 11974 - DNA, 25 bp, Mus musculus
caagttgggtttcatagcccagagc

SEQ ID NO: 11975 - DNA, 25 bp, Mus musculus
caagttgtcagatgcagacctccgg

SEQ ID NO: 11976 - DNA, 25 bp, Mus musculus
caagtttcacatccatcaccgtttt

SEQ ID NO: 11977 - DNA, 25 bp, Mus musculus
caagtttgatgctctgttcacagac

SEQ ID NO: 11978 - DNA, 25 bp, Mus musculus
caagtttgcaataggagcttacacc

SEQ ID NO: 11979 - DNA, 25 bp, Mus musculus
caagtttggtttacacagcttagtg

SEQ ID NO: 11980 - DNA, 25 bp, Mus musculus
caagtttgtggctcagttgcagaca

SEQ ID NO: 11981 - DNA, 25 bp, Mus musculus
caagttttacagcagccacaggaag

SEQ ID NO: 11982 - DNA, 25 bp, Mus musculus
caagttttatgttcgagccccagga

SEQ ID NO: 11983 - DNA, 25 bp, Mus musculus
caagtttttcttcccttagatgatg

SEQ ID NO: 11984 - DNA, 25 bp, Mus musculus
caataaccagctacgacactgcagg

SEQ ID NO: 11985 - DNA, 25 bp, Mus musculus
caataacggataaggaccgcaccaa

SEQ ID NO: 11986 - DNA, 25 bp, Mus musculus
caataagcccacacgaggctggctg

SEQ ID NO: 11987 - DNA, 25 bp, Mus musculus
caataaggaagatccccagatatgt

SEQ ID NO: 11988 - DNA, 25 bp, Mus musculus
caataaggacatgaaagaagcagaa

SEQ ID NO: 11989 - DNA, 25 bp, Mus musculus
caataaggtggatggtactttgctg

SEQ ID NO: 11990 - DNA, 25 bp, Mus musculus
caataatcatttcttctacgagagc

SEQ ID NO: 11991 - DNA, 25 bp, Mus musculus
caatacaagcaagtgagtttgattc

SEQ ID NO: 11992 - DNA, 25 bp, Mus musculus
caatacaaggctgacatcaatgcag

SEQ ID NO: 11993 - DNA, 25 bp, Mus musculus
caatacaagtggtttatgtaccatc

SEQ ID NO: 11994 - DNA, 25 bp, Mus musculus
caatacagcaataaacttctatgaa

SEQ ID NO: 11995 - DNA, 25 bp, Mus musculus
caatacagtggatacagtttgctgt

SEQ ID NO: 11996 - DNA, 25 bp, Mus musculus
caatacatggaagcatgtctcagcc

SEQ ID NO: 11997 - DNA, 25 bp, Mus musculus
caatacccatccatgttgatacaaa

SEQ ID NO: 11998 - DNA, 25 bp, Mus musculus
caataccgttgcaatttgttgatgc

SEQ ID NO: 11999 - DNA, 25 bp, Mus musculus
caataccgttgctatttgttgatgc

SEQ ID NO: 12000 - DNA, 25 bp, Mus musculus
caatacgaggggttgagcacaggcc

SEQ ID NO: 12001 - DNA, 25 bp, Mus musculus
caatacggaatatcaatcccagcac

SEQ ID NO: 12002 - DNA, 25 bp, Mus musculus
caatactggagttaaggaaattctt

SEQ ID NO: 12003 - DNA, 25 bp, Mus musculus
caatacttgatcgactgtgtaagca

SEQ ID NO: 12004 - DNA, 25 bp, Mus musculus
caatagaaaatgtacctcagtgtca

SEQ ID NO: 12005 - DNA, 25 bp, Mus musculus
caatagacgtttcttatctgcccag

SEQ ID NO: 12006 - DNA, 25 bp, Mus musculus
caatagagaaatagtgcgaagaggg

SEQ ID NO: 12007 - DNA, 25 bp, Mus musculus
caatagcaatcctcctgagtacgag

SEQ ID NO: 12008 - DNA, 25 bp, Mus musculus
caatagccaccagtcttagcagaac

SEQ ID NO: 12009 - DNA, 25 bp, Mus musculus
caatagccattcagttagcccacca

SEQ ID NO: 12010 - DNA, 25 bp, Mus musculus
caatagcccagatgggaaaaaactt

SEQ ID NO: 12011 - DNA, 25 bp, Mus musculus
caataggagttcatgttttctacac

SEQ ID NO: 12012 - DNA, 25 bp, Mus musculus
caatagggcttagcgggtaaagcgc

SEQ ID NO: 12013 - DNA, 25 bp, Mus musculus
caatagtaattgtcgtcactgtggc

SEQ ID NO: 12014 - DNA, 25 bp, Mus musculus
caatagtctgaagctggatctggga

SEQ ID NO: 12015 - DNA, 25 bp, Mus musculus
caatagtggtgagaaaacagacccc

SEQ ID NO: 12016 - DNA, 25 bp, Mus musculus
caatataaatggtaaccaggcatgg

SEQ ID NO: 12017 - DNA, 25 bp, Mus musculus
caatatagtacaaagtttcatccag

SEQ ID NO: 12018 - DNA, 25 bp, Mus musculus
caatatatccaccacttagaagcag

SEQ ID NO: 12019 - DNA, 25 bp, Mus musculus
caatatattgagaggagagacggag

SEQ ID NO: 12020 - DNA, 25 bp, Mus musculus
caatatcaaccagcataccgaaaca

SEQ ID NO: 12021 - DNA, 25 bp, Mus musculus
caatatcctgaacttgagcgggaag

SEQ ID NO: 12022 - DNA, 25 bp, Mus musculus
caatatcctgtcttattttccagaa

SEQ ID NO: 12023 - DNA, 25 bp, Mus musculus
caatatcgtaaccttcttcagctcg

SEQ ID NO: 12024 - DNA, 25 bp, Mus musculus
caatatctggtgcagtaagccactc

SEQ ID NO: 12025 - DNA, 25 bp, Mus musculus
caatatgacaagttttacatccatg

SEQ ID NO: 12026 - DNA, 25 bp, Mus musculus
caatatggacaaacaggaactgatg

SEQ ID NO: 12027 - DNA, 25 bp, Mus musculus
caatatggacgtggtcaagtacgag

SEQ ID NO: 12028 - DNA, 25 bp, Mus musculus
caatatgggaaacactctaaaggag

SEQ ID NO: 12029 - DNA, 25 bp, Mus musculus
caatatgtgtactctgggctgtgtc

SEQ ID NO: 12030 - DNA, 25 bp, Mus musculus
caatattcggcccaaacctttcata

SEQ ID NO: 12031 - DNA, 25 bp, Mus musculus
caatatttaatcttgccaaccgaag

SEQ ID NO: 12032 - DNA, 25 bp, Mus musculus
caatatttccatggagacaacaccc

SEQ ID NO: 12033 - DNA, 25 bp, Mus musculus
caatatttccattaagtacatgtca

SEQ ID NO: 12034 - DNA, 25 bp, Mus musculus
caatcaaaattcgaaggctgcaaaa

SEQ ID NO: 12035 - DNA, 25 bp, Mus musculus
caatcaaagtatcgtgttatgaaca

SEQ ID NO: 12036 - DNA, 25 bp, Mus musculus
caatcacaactttggtggaccacct

SEQ ID NO: 12037 - DNA, 25 bp, Mus musculus
caatcacagatattgccactgagcg

SEQ ID NO: 12038 - DNA, 25 bp, Mus musculus
caatcactgagaaaacgtcttttgt

SEQ ID NO: 12039 - DNA, 25 bp, Mus musculus
caatcactgccctggttctgtcatg

SEQ ID NO: 12040 - DNA, 25 bp, Mus musculus
caatcactggctgtattagtacagg

SEQ ID NO: 12041 - DNA, 25 bp, Mus musculus
caatcagagacaagatgatctcaga

SEQ ID NO: 12042 - DNA, 25 bp, Mus musculus
caatcagatcgaggaactgcctacc

SEQ ID NO: 12043 - DNA, 25 bp, Mus musculus
caatcagatgctcttagttcagcca

SEQ ID NO: 12044 - DNA, 25 bp, Mus musculus
caatcagattggattaaataggtgg

SEQ ID NO: 12045 - DNA, 25 bp, Mus musculus
caatcagggtttcccttacagccct

SEQ ID NO: 12046 - DNA, 25 bp, Mus musculus
caatcagtatgtcctgtcccggaga

SEQ ID NO: 12047 - DNA, 25 bp, Mus musculus
caatcagtgtcaaggtggaaggaaa

SEQ ID NO: 12048 - DNA, 25 bp, Mus musculus
caatcatgagcattttggcactcca

SEQ ID NO: 12049 - DNA, 25 bp, Mus musculus
caatcatgcctacttttatcttcga

SEQ ID NO: 12050 - DNA, 25 bp, Mus musculus
caatccaagtgtggttccaaggaca

SEQ ID NO: 12051 - DNA, 25 bp, Mus musculus
caatccatagaagtcttggacaggc

SEQ ID NO: 12052 - DNA, 25 bp, Mus musculus
caatcccaaatttgttgtcaatgac

SEQ ID NO: 12053 - DNA, 25 bp, Mus musculus
caatcccaagacagaattatggtac

SEQ ID NO: 12054 - DNA, 25 bp, Mus musculus
caatccctaaaatagactcagttct

SEQ ID NO: 12055 - DNA, 25 bp, Mus musculus
caatccctgttgatactatccgtgc

SEQ ID NO: 12056 - DNA, 25 bp, Mus musculus
caatccctgttgttactatccgtgc

SEQ ID NO: 12057 - DNA, 25 bp, Mus musculus
caatccctttcttaaagtgcccacg

SEQ ID NO: 12058 - DNA, 25 bp, Mus musculus
caatccgcaacataactgtggccta

SEQ ID NO: 12059 - DNA, 25 bp, Mus musculus
caatcctagtaagaaatacctcctt

SEQ ID NO: 12060 - DNA, 25 bp, Mus musculus
caatcctccagaccacgatgttgtg

SEQ ID NO: 12061 - DNA, 25 bp, Mus musculus
caatcctccagactttactgccatg

SEQ ID NO: 12062 - DNA, 25 bp, Mus musculus
caatcctccagagtttactgccatg

SEQ ID NO: 12063 - DNA, 25 bp, Mus musculus
caatcctgcgcaatgggctggtcaa

SEQ ID NO: 12064 - DNA, 25 bp, Mus musculus
caatcctgggtgtctacacatgtga

SEQ ID NO: 12065 - DNA, 25 bp, Mus musculus
caatcctgtgccagcgtcttcagca

SEQ ID NO: 12066 - DNA, 25 bp, Mus musculus
caatcgaaataacaggccggtcgag

SEQ ID NO: 12067 - DNA, 25 bp, Mus musculus
caatcgaccgtccaagatccaggag

SEQ ID NO: 12068 - DNA, 25 bp, Mus musculus
caatcgacgcggagattcccttggt

SEQ ID NO: 12069 - DNA, 25 bp, Mus musculus
caatcgactctgaagtagtgggagc

SEQ ID NO: 12070 - DNA, 25 bp, Mus musculus
caatcggagggagtaagccaagagt

SEQ ID NO: 12071 - DNA, 25 bp, Mus musculus
caatcggtcagaagcctggtgacaa

SEQ ID NO: 12072 - DNA, 25 bp, Mus musculus
caatcgtcaccaagaatgggcagaa

SEQ ID NO: 12073 - DNA, 25 bp, Mus musculus
caatctacaagaacaaaggtttggc

SEQ ID NO: 12074 - DNA, 25 bp, Mus musculus
caatctacaagatcaaaggtttggc

SEQ ID NO: 12075 - DNA, 25 bp, Mus musculus
caatctccaggaagatctctttgac

SEQ ID NO: 12076 - DNA, 25 bp, Mus musculus
caatctccatgacatcatgttgctg

SEQ ID NO: 12077 - DNA, 25 bp, Mus musculus
caatctgcagcgaggtgggctgaca

SEQ ID NO: 12078 - DNA, 25 bp, Mus musculus
caatctgcatcctactctcaattag

SEQ ID NO: 12079 - DNA, 25 bp, Mus musculus
caatctgttccggaggaattttcag

SEQ ID NO: 12080 - DNA, 25 bp, Mus musculus
caatcttctgggagctggttaagcc

SEQ ID NO: 12081 - DNA, 25 bp, Mus musculus
caatcttgattcctgttgccggcct

SEQ ID NO: 12082 - DNA, 25 bp, Mus musculus
caatcttgcccacaggatggatata

SEQ ID NO: 12083 - DNA, 25 bp, Mus musculus
caatcttggcagtttaagaaaagcc

SEQ ID NO: 12084 - DNA, 25 bp, Mus musculus
caatgaaaacttctacctgctgagt

SEQ ID NO: 12085 - DNA, 25 bp, Mus musculus
caatgaaactgggaggaaagaagac

SEQ ID NO: 12086 - DNA, 25 bp, Mus musculus
caatgaaagtgagaacaagagaagt

SEQ ID NO: 12087 - DNA, 25 bp, Mus musculus
caatgaaagtgagcaagcacctgct

SEQ ID NO: 12088 - DNA, 25 bp, Mus musculus
caatgaacgggagctgttcaatgct

SEQ ID NO: 12089 - DNA, 25 bp, Mus musculus
caatgaagacatagtctcccgaaac

SEQ ID NO: 12090 - DNA, 25 bp, Mus musculus
caatgaagacattgtctcccgaaac

SEQ ID NO: 12091 - DNA, 25 bp, Mus musculus
caatgaagacgcgaagaagtactgt

SEQ ID NO: 12092 - DNA, 25 bp, Mus musculus
caatgaaggagaggtactctctgta

SEQ ID NO: 12093 - DNA, 25 bp, Mus musculus
caatgaaggcctatcttggaggtcg

SEQ ID NO: 12094 - DNA, 25 bp, Mus musculus
caatgaaggcttccaggcttacgat

SEQ ID NO: 12095 - DNA, 25 bp, Mus musculus
caatgaagtgttacctcagccgaac

SEQ ID NO: 12096 - DNA, 25 bp, Mus musculus
caatgaatcacccttctaatcctaa

SEQ ID NO: 12097 - DNA, 25 bp, Mus musculus
caatgaattctcgattgatgtggaa

SEQ ID NO: 12098 - DNA, 25 bp, Mus musculus
caatgaattggtggcctagcaacct

SEQ ID NO: 12099 - DNA, 25 bp, Mus musculus
caatgacaagaattggcctggcccc

SEQ ID NO: 12100 - DNA, 25 bp, Mus musculus
caatgacaagcgtaaaaagaacctc

SEQ ID NO: 12101 - DNA, 25 bp, Mus musculus
caatgacacccctgattgtgacaga

SEQ ID NO: 12102 - DNA, 25 bp, Mus musculus
caatgacagaggagatgtctgccgg

SEQ ID NO: 12103 - DNA, 25 bp, Mus musculus
caatgacattgccttggtccacctc

SEQ ID NO: 12104 - DNA, 25 bp, Mus musculus
caatgacctatgatgacattccaca

SEQ ID NO: 12105 - DNA, 25 bp, Mus musculus
caatgacctgatgttactacgcctc

SEQ ID NO: 12106 - DNA, 25 bp, Mus musculus
caatgaccttgttgacaaggttcaa

SEQ ID NO: 12107 - DNA, 25 bp, Mus musculus
caatgacgaacctgaggccttaggg

SEQ ID NO: 12108 - DNA, 25 bp, Mus musculus
caatgacgacaacttctgcaaggca

SEQ ID NO: 12109 - DNA, 25 bp, Mus musculus
caatgactccttcttcccacaaagg

SEQ ID NO: 12110 - DNA, 25 bp, Mus musculus
caatgacttagagagaagagcctca

SEQ ID NO: 12111 - DNA, 25 bp, Mus musculus
caatgagaaacggttcccgacgtgg

SEQ ID NO: 12112 - DNA, 25 bp, Mus musculus
caatgagaacaaggcgtgtatggac

SEQ ID NO: 12113 - DNA, 25 bp, Mus musculus
caatgagactgagcctgcgacgatg

SEQ ID NO: 12114 - DNA, 25 bp, Mus musculus
caatgagagccagaggcggttgcta

SEQ ID NO: 12115 - DNA, 25 bp, Mus musculus
caatgagatccctgattgttacacc

SEQ ID NO: 12116 - DNA, 25 bp, Mus musculus
caatgagatcttgcctaactgggaa

SEQ ID NO: 12117 - DNA, 25 bp, Mus musculus
caatgagatgtttggttacaatggc

SEQ ID NO: 12118 - DNA, 25 bp, Mus musculus
caatgagcagatagatgccccagca

SEQ ID NO: 12119 - DNA, 25 bp, Mus musculus
caatgagcattatgacgtcgcccga

SEQ ID NO: 12120 - DNA, 25 bp, Mus musculus
caatgagcctgcgaacatatttgag

SEQ ID NO: 12121 - DNA, 25 bp, Mus musculus
caatgagctctccatggctggaaac

SEQ ID NO: 12122 - DNA, 25 bp, Mus musculus
caatgagctgaacagaatgatccag

SEQ ID NO: 12123 - DNA, 25 bp, Mus musculus
caatgaggagatggcacccattgag

SEQ ID NO: 12124 - DNA, 25 bp, Mus musculus
caatgagtgtctcacccctgggata

SEQ ID NO: 12125 - DNA, 25 bp, Mus musculus
caatgagtgtctgacccctgggata

SEQ ID NO: 12126 - DNA, 25 bp, Mus musculus
caatgagttcctgaactttaagagg

SEQ ID NO: 12127 - DNA, 25 bp, Mus musculus
caatgagtttgtcactgtgctgcaa

SEQ ID NO: 12128 - DNA, 25 bp, Mus musculus
caatgatccacttgtgccgactgcc

SEQ ID NO: 12129 - DNA, 25 bp, Mus musculus
caatgatgatcattacgcagaagat

SEQ ID NO: 12130 - DNA, 25 bp, Mus musculus
caatgatggcaagatctcttttgca

SEQ ID NO: 12131 - DNA, 25 bp, Mus musculus
caatgatgggatgcccggaggcccc

SEQ ID NO: 12132 - DNA, 25 bp, Mus musculus
caatgatgggctagtcacagtggta

SEQ ID NO: 12133 - DNA, 25 bp, Mus musculus
caatgatgggcttgtcacagtggta

SEQ ID NO: 12134 - DNA, 25 bp, Mus musculus
caatgatgtcctggtcagcctagag

SEQ ID NO: 12135 - DNA, 25 bp, Mus musculus
caatgattaaaatggtcgtcccttc

SEQ ID NO: 12136 - DNA, 25 bp, Mus musculus
caatgcaaagaaatggagactgcag

SEQ ID NO: 12137 - DNA, 25 bp, Mus musculus
caatgcacatcgatgccaccttcaa

SEQ ID NO: 12138 - DNA, 25 bp, Mus musculus
caatgcaccgatggatatgaatggg

SEQ ID NO: 12139 - DNA, 25 bp, Mus musculus
caatgcagaagctgtcaagaacaag

SEQ ID NO: 12140 - DNA, 25 bp, Mus musculus
caatgcagaagtgctggctctgttc

SEQ ID NO: 12141 - DNA, 25 bp, Mus musculus
caatgcaggaaaggatcaccaccac

SEQ ID NO: 12142 - DNA, 25 bp, Mus musculus
caatgcagggagcttgatttctatg

SEQ ID NO: 12143 - DNA, 25 bp, Mus musculus
caatgcaggtttctccaggagggaa

SEQ ID NO: 12144 - DNA, 25 bp, Mus musculus
caatgcagtaccaagcagcctgggt

SEQ ID NO: 12145 - DNA, 25 bp, Mus musculus
caatgcagtacctagcagcctgggt

SEQ ID NO: 12146 - DNA, 25 bp, Mus musculus
caatgcatcctacaccaaactgcag

SEQ ID NO: 12147 - DNA, 25 bp, Mus musculus
caatgcatttgaagtggctgagaaa

SEQ ID NO: 12148 - DNA, 25 bp, Mus musculus
caatgccaaagtcaagacagatcag

SEQ ID NO: 12149 - DNA, 25 bp, Mus musculus
caatgccaagtgagttcacctctgc

SEQ ID NO: 12150 - DNA, 25 bp, Mus musculus
caatgcccctgagaaagggaacaag

SEQ ID NO: 12151 - DNA, 25 bp, Mus musculus
caatgccctggagatcgagctgcag

SEQ ID NO: 12152 - DNA, 25 bp, Mus musculus
caatgccctggatgatgatcgtgaa

SEQ ID NO: 12153 - DNA, 25 bp, Mus musculus
caatgccgttgagtatatcaatact

SEQ ID NO: 12154 - DNA, 25 bp, Mus musculus
caatgcctatactgagctgaatgac

SEQ ID NO: 12155 - DNA, 25 bp, Mus musculus
caatgccttagagaaggaggtagag

SEQ ID NO: 12156 - DNA, 25 bp, Mus musculus
caatgccttggcagatgataatgag

SEQ ID NO: 12157 - DNA, 25 bp, Mus musculus
caatgcgagcaagctggtgaaggtc

SEQ ID NO: 12158 - DNA, 25 bp, Mus musculus
caatgcggaaaaatctctggctcaa

SEQ ID NO: 12159 - DNA, 25 bp, Mus musculus
caatgcggaagtggtggccgcctac

SEQ ID NO: 12160 - DNA, 25 bp, Mus musculus
caatgctaacgtgtacatgagacct

SEQ ID NO: 12161 - DNA, 25 bp, Mus musculus
caatgctacccacattccagatgtt

SEQ ID NO: 12162 - DNA, 25 bp, Mus musculus
caatgctctccccattcatatcaag

SEQ ID NO: 12163 - DNA, 25 bp, Mus musculus
caatgctggaatgaagtaactcaag

SEQ ID NO: 12164 - DNA, 25 bp, Mus musculus
caatgctgtggcagcgattgcagga

SEQ ID NO: 12165 - DNA, 25 bp, Mus musculus
caatgctgttaccatggactcggat

SEQ ID NO: 12166 - DNA, 25 bp, Mus musculus
caatgctgttatcaaacaaaacccc

SEQ ID NO: 12167 - DNA, 25 bp, Mus musculus
caatgctgttatgaaacaaaacccc

SEQ ID NO: 12168 - DNA, 25 bp, Mus musculus
caatgctgtttctggcctgaacatc

SEQ ID NO: 12169 - DNA, 25 bp, Mus musculus
caatgcttcagcatcgactggatga

SEQ ID NO: 12170 - DNA, 25 bp, Mus musculus
caatgcttcagttacagcgtcccca

SEQ ID NO: 12171 - DNA, 25 bp, Mus musculus
caatgcttggaccttttaagtttgg

SEQ ID NO: 12172 - DNA, 25 bp, Mus musculus
caatggaaggtctgaccacatgcag

SEQ ID NO: 12173 - DNA, 25 bp, Mus musculus
caatggaattgccagttaacaagac

SEQ ID NO: 12174 - DNA, 25 bp, Mus musculus
caatggacctcttttcacggaatta

SEQ ID NO: 12175 - DNA, 25 bp, Mus musculus
caatggacggtcacagtgctattat

SEQ ID NO: 12176 - DNA, 25 bp, Mus musculus
caatggagactggacataccagaca

SEQ ID NO: 12177 - DNA, 25 bp, Mus musculus
caatggagattgctgccgatttata

SEQ ID NO: 12178 - DNA, 25 bp, Mus musculus
caatggagccatctttgagccttca

SEQ ID NO: 12179 - DNA, 25 bp, Mus musculus
caatggaggcattttggagcagagt

SEQ ID NO: 12180 - DNA, 25 bp, Mus musculus
caatggaggtagagcctgcagtgat

SEQ ID NO: 12181 - DNA, 25 bp, Mus musculus
caatggagtataagggtgaactagc

SEQ ID NO: 12182 - DNA, 25 bp, Mus musculus
caatggagtcagatccagatgcctt

SEQ ID NO: 12183 - DNA, 25 bp, Mus musculus
caatggagtcggagcaatgtcacag

SEQ ID NO: 12184 - DNA, 25 bp, Mus musculus
caatggatcccgagattttctggac

SEQ ID NO: 12185 - DNA, 25 bp, Mus musculus
caatggatccctgctgctccagaat

SEQ ID NO: 12186 - DNA, 25 bp, Mus musculus
caatggatgagaatgatggccctgg

SEQ ID NO: 12187 - DNA, 25 bp, Mus musculus
caatggattggtccactgggaaatc

SEQ ID NO: 12188 - DNA, 25 bp, Mus musculus
caatggcaacagtagtggcactagc

SEQ ID NO: 12189 - DNA, 25 bp, Mus musculus
caatggcaagttctacgtgggagtc

SEQ ID NO: 12190 - DNA, 25 bp, Mus musculus
caatggcaattacccgtcctggacg

SEQ ID NO: 12191 - DNA, 25 bp, Mus musculus
caatggcacagatgtgaatctgaag

SEQ ID NO: 12192 - DNA, 25 bp, Mus musculus
caatggcacatatgactacacacag

SEQ ID NO: 12193 - DNA, 25 bp, Mus musculus
caatggcagcgtgtgcagcgttcac

SEQ ID NO: 12194 - DNA, 25 bp, Mus musculus
caatggcccatctaggaacctcatg

SEQ ID NO: 12195 - DNA, 25 bp, Mus musculus
caatggccccattaagggaagagtt

SEQ ID NO: 12196 - DNA, 25 bp, Mus musculus
caatggccttttttggtgatcggat

SEQ ID NO: 12197 - DNA, 25 bp, Mus musculus
caatggctagattgctcagaaaact

SEQ ID NO: 12198 - DNA, 25 bp, Mus musculus
caatggctcagcacagagttctgag

SEQ ID NO: 12199 - DNA, 25 bp, Mus musculus
caatggctcttcagtctttaccacc

SEQ ID NO: 12200 - DNA, 25 bp, Mus musculus
caatggcttcatctggataggaaaa

SEQ ID NO: 12201 - DNA, 25 bp, Mus musculus
caatgggaagcatcagctggagact

SEQ ID NO: 12202 - DNA, 25 bp, Mus musculus
caatgggaatcaaccagtgtctatg

SEQ ID NO: 12203 - DNA, 25 bp, Mus musculus
caatgggacggacagctgaaattaa

SEQ ID NO: 12204 - DNA, 25 bp, Mus musculus
caatgggagcgtcttggaccctgca

SEQ ID NO: 12205 - DNA, 25 bp, Mus musculus
caatgggcatgcaccctatgggtca

SEQ ID NO: 12206 - DNA, 25 bp, Mus musculus
caatgggctggtcaatgcatcctac

SEQ ID NO: 12207 - DNA, 25 bp, Mus musculus
caatgggctttggagatcctctctc

SEQ ID NO: 12208 - DNA, 25 bp, Mus musculus
caatgggtagcttctgtggaagtac

SEQ ID NO: 12209 - DNA, 25 bp, Mus musculus
caatggtcgcatcaaaatctgggat

SEQ ID NO: 12210 - DNA, 25 bp, Mus musculus
caatggtgtcctcttctaaccagag

SEQ ID NO: 12211 - DNA, 25 bp, Mus musculus
caatggttcgaggactggcactacg

SEQ ID NO: 12212 - DNA, 25 bp, Mus musculus
caatgtagtcccctggatgctggca

SEQ ID NO: 12213 - DNA, 25 bp, Mus musculus
caatgtatctatgcctgcctacttc

SEQ ID NO: 12214 - DNA, 25 bp, Mus musculus
caatgtatttacctttatacctggg

SEQ ID NO: 12215 - DNA, 25 bp, Mus musculus
caatgtcaagttggcctggagggac

SEQ ID NO: 12216 - DNA, 25 bp, Mus musculus
caatgtcaccgtacagattgagaat

SEQ ID NO: 12217 - DNA, 25 bp, Mus musculus
caatgtcatcaatggcatcctcttc

SEQ ID NO: 12218 - DNA, 25 bp, Mus musculus
caatgtccactatcactgctcaggg

SEQ ID NO: 12219 - DNA, 25 bp, Mus musculus
caatgtcctcaaaattgcccctgag

SEQ ID NO: 12220 - DNA, 25 bp, Mus musculus
caatgtcctcaaagcctttaccgta

SEQ ID NO: 12221 - DNA, 25 bp, Mus musculus
caatgtctatgtttgaggatgtcac

SEQ ID NO: 12222 - DNA, 25 bp, Mus musculus
caatgtcttcaagcgccacagcatg

SEQ ID NO: 12223 - DNA, 25 bp, Mus musculus
caatgtgactgtttagtggaacaga

SEQ ID NO: 12224 - DNA, 25 bp, Mus musculus
caatgtgctgcaatagcagaacgct

SEQ ID NO: 12225 - DNA, 25 bp, Mus musculus
caatgtgctgccaactttgagaact

SEQ ID NO: 12226 - DNA, 25 bp, Mus musculus
caatgtgctgctagacacactgagc

SEQ ID NO: 12227 - DNA, 25 bp, Mus musculus
caatgtggcaagaacagatacttga

SEQ ID NO: 12228 - DNA, 25 bp, Mus musculus
caatgtggccacgttgctgttaaac

SEQ ID NO: 12229 - DNA, 25 bp, Mus musculus
caatgtgggcagtggcttatttatc

SEQ ID NO: 12230 - DNA, 25 bp, Mus musculus
caatgtgggtacttcgatcaccagc

SEQ ID NO: 12231 - DNA, 25 bp, Mus musculus
caatgtggtccatatctcaagggcc

SEQ ID NO: 12232 - DNA, 25 bp, Mus musculus
caatgttatccaagggactagagga

SEQ ID NO: 12233 - DNA, 25 bp, Mus musculus
caatgttatccatgggactagagga

SEQ ID NO: 12234 - DNA, 25 bp, Mus musculus
caatgttcacaaacagagagtggct

SEQ ID NO: 12235 - DNA, 25 bp, Mus musculus
caatgttccactctgcgtcgatatg

SEQ ID NO: 12236 - DNA, 25 bp, Mus musculus
caatgttcggactgtgcgggccttc

SEQ ID NO: 12237 - DNA, 25 bp, Mus musculus
caatgttggcattatgttcagaggc

SEQ ID NO: 12238 - DNA, 25 bp, Mus musculus
caatgttgtggccttctccgagatc

SEQ ID NO: 12239 - DNA, 25 bp, Mus musculus
caatgtttacagtacctttcagagt

SEQ ID NO: 12240 - DNA, 25 bp, Mus musculus
caattaatgatcacccaccgtgggc

SEQ ID NO: 12241 - DNA, 25 bp, Mus musculus
caattaccagccctactaaaggagg

SEQ ID NO: 12242 - DNA, 25 bp, Mus musculus
caattagaaggcattattcctggag

SEQ ID NO: 12243 - DNA, 25 bp, Mus musculus
caattagaaggctttattcctggag

SEQ ID NO: 12244 - DNA, 25 bp, Mus musculus
caattagacgccagcccacctggag

SEQ ID NO: 12245 - DNA, 25 bp, Mus musculus
caattaggcgagatcattttggctc

SEQ ID NO: 12246 - DNA, 25 bp, Mus musculus
caattaggcgagttcattttggctc

SEQ ID NO: 12247 - DNA, 25 bp, Mus musculus
caattatgaggtggagtacttgtgt

SEQ ID NO: 12248 - DNA, 25 bp, Mus musculus
caattatggatcagttgaacacctg

SEQ ID NO: 12249 - DNA, 25 bp, Mus musculus
caattatgggacacagcaggtcaag

SEQ ID NO: 12250 - DNA, 25 bp, Mus musculus
caattcaaagatgcaggcctcagta

SEQ ID NO: 12251 - DNA, 25 bp, Mus musculus
caattcaaagcaactatacgatggc

SEQ ID NO: 12252 - DNA, 25 bp, Mus musculus
caattcaagtaacactttcagggaa

SEQ ID NO: 12253 - DNA, 25 bp, Mus musculus
caattcacaggtactgcttagggca

SEQ ID NO: 12254 - DNA, 25 bp, Mus musculus
caattcagctttttgtgctaccagc

SEQ ID NO: 12255 - DNA, 25 bp, Mus musculus
caattcaggattttgatgcatgcag

SEQ ID NO: 12256 - DNA, 25 bp, Mus musculus
caattcaggcattagtttctcagtt

SEQ ID NO: 12257 - DNA, 25 bp, Mus musculus
caattccaactcattcaagtttggg

SEQ ID NO: 12258 - DNA, 25 bp, Mus musculus
caattccaaggaaggctttccgtgg

SEQ ID NO: 12259 - DNA, 25 bp, Mus musculus
caattccagtaaacaaacagttgga

SEQ ID NO: 12260 - DNA, 25 bp, Mus musculus
caattcgtggaagtttgggcctcac

SEQ ID NO: 12261 - DNA, 25 bp, Mus musculus
caattctcatctgggacttcctgaa

SEQ ID NO: 12262 - DNA, 25 bp, Mus musculus
caattctcccaggtgaactgcttaa

SEQ ID NO: 12263 - DNA, 25 bp, Mus musculus
caattcttccggcacgttcatcgtg

SEQ ID NO: 12264 - DNA, 25 bp, Mus musculus
caattcttggagaacacaaagaagt

SEQ ID NO: 12265 - DNA, 25 bp, Mus musculus
caattcttggccacacagttgatta

SEQ ID NO: 12266 - DNA, 25 bp, Mus musculus
caattgagaacagtcctgggtgtga

SEQ ID NO: 12267 - DNA, 25 bp, Mus musculus
caattgagacgcaaccaaactttgc

SEQ ID NO: 12268 - DNA, 25 bp, Mus musculus
caattgagcagttggccaagcagca

SEQ ID NO: 12269 - DNA, 25 bp, Mus musculus
caattgagctagaatcaggcctgag

SEQ ID NO: 12270 - DNA, 25 bp, Mus musculus
caattgcatatgtacgagtggatga

SEQ ID NO: 12271 - DNA, 25 bp, Mus musculus
caattgcctgttttgaagagggaga

SEQ ID NO: 12272 - DNA, 25 bp, Mus musculus
caattgctcctgataatggctcctc

SEQ ID NO: 12273 - DNA, 25 bp, Mus musculus
caattgctgatgaaggaacatggac

SEQ ID NO: 12274 - DNA, 25 bp, Mus musculus
caattggatttcatgatggagaccc

SEQ ID NO: 12275 - DNA, 25 bp, Mus musculus
caattggctcagtcattcttggtgg

SEQ ID NO: 12276 - DNA, 25 bp, Mus musculus
caattgggagacagatctcttgtga

SEQ ID NO: 12277 - DNA, 25 bp, Mus musculus
caattgggatctgccctaagtattc

SEQ ID NO: 12278 - DNA, 25 bp, Mus musculus
caattgggctgacttttcttatgct

SEQ ID NO: 12279 - DNA, 25 bp, Mus musculus
caattggtcaggtttaagaagccgc

SEQ ID NO: 12280 - DNA, 25 bp, Mus musculus
caattggtggtggatgctggcatct

SEQ ID NO: 12281 - DNA, 25 bp, Mus musculus
caattgtccccttttgcaatcagca

SEQ ID NO: 12282 - DNA, 25 bp, Mus musculus
caattgtcttattcatcaactggag

SEQ ID NO: 12283 - DNA, 25 bp, Mus musculus
caattgtgagcttcgctgtagggag

SEQ ID NO: 12284 - DNA, 25 bp, Mus musculus
caattgtggcattaatagtcaagtc

SEQ ID NO: 12285 - DNA, 25 bp, Mus musculus
caattgtggtcagatacctcgcaga

SEQ ID NO: 12286 - DNA, 25 bp, Mus musculus
caatttaagaggagtcagcttctcc

SEQ ID NO: 12287 - DNA, 25 bp, Mus musculus
caatttaagtataatgtggaagaga

SEQ ID NO: 12288 - DNA, 25 bp, Mus musculus
caatttaagtattatgtggaagaga

SEQ ID NO: 12289 - DNA, 25 bp, Mus musculus
caatttacagcgcaagatacatttt

SEQ ID NO: 12290 - DNA, 25 bp, Mus musculus
caatttaccaagtgtactgcaacag

SEQ ID NO: 12291 - DNA, 25 bp, Mus musculus
caatttaggaaatgtcttgaaagag

SEQ ID NO: 12292 - DNA, 25 bp, Mus musculus
caatttatggccgagggatagccta

SEQ ID NO: 12293 - DNA, 25 bp, Mus musculus
caatttattatggaccagcccagta

SEQ ID NO: 12294 - DNA, 25 bp, Mus musculus
caatttcaagggagtcaaccataca

SEQ ID NO: 12295 - DNA, 25 bp, Mus musculus
caatttcagggtaaggatgtcttcc

SEQ ID NO: 12296 - DNA, 25 bp, Mus musculus
caatttcatcgaggaaaggaagcaa

SEQ ID NO: 12297 - DNA, 25 bp, Mus musculus
caatttccagatgccttgttcaaca

SEQ ID NO: 12298 - DNA, 25 bp, Mus musculus
caatttccaggtattgaaccatggc

SEQ ID NO: 12299 - DNA, 25 bp, Mus musculus
caatttcttcactggctgccctaag

SEQ ID NO: 12300 - DNA, 25 bp, Mus musculus
caatttgcagctacatccacacgat

SEQ ID NO: 12301 - DNA, 25 bp, Mus musculus
caatttgtccaaagaaggtatcgag

SEQ ID NO: 12302 - DNA, 25 bp, Mus musculus
caatttgtgatgatggcctgagcca

SEQ ID NO: 12303 - DNA, 25 bp, Mus musculus
caatttgtgcactgggacaggatcg

SEQ ID NO: 12304 - DNA, 25 bp, Mus musculus
caattttcattcattactctccagc

SEQ ID NO: 12305 - DNA, 25 bp, Mus musculus
caattttcattctttactctccagc

SEQ ID NO: 12306 - DNA, 25 bp, Mus musculus
caattttctagacacatacaagctg

SEQ ID NO: 12307 - DNA, 25 bp, Mus musculus
caattttctagagacatacaagctg

SEQ ID NO: 12308 - DNA, 25 bp, Mus musculus
caattttgagacacaatctgcatcc

SEQ ID NO: 12309 - DNA, 25 bp, Mus musculus
caattttgcccatggtctagcttct

SEQ ID NO: 12310 - DNA, 25 bp, Mus musculus
caattttggagcaactcctttatgg

SEQ ID NO: 12311 - DNA, 25 bp, Mus musculus
cacaaaaagtagtggtgatgttcac

SEQ ID NO: 12312 - DNA, 25 bp, Mus musculus
cacaaaaattgctcgtcaggtctgc

SEQ ID NO: 12313 - DNA, 25 bp, Mus musculus
cacaaaacacagatcttaaagaacg

SEQ ID NO: 12314 - DNA, 25 bp, Mus musculus
cacaaaaccctctctcaagaacttg

SEQ ID NO: 12315 - DNA, 25 bp, Mus musculus
cacaaaacgtctatcagaaatgatt

SEQ ID NO: 12316 - DNA, 25 bp, Mus musculus
cacaaaactgccacctgattgaggg

SEQ ID NO: 12317 - DNA, 25 bp, Mus musculus
cacaaaaggacagctgtgaggacga

SEQ ID NO: 12318 - DNA, 25 bp, Mus musculus
cacaaaatcaagagcggagcggaag

SEQ ID NO: 12319 - DNA, 25 bp, Mus musculus
cacaaacacctgtaataagtatggg

SEQ ID NO: 12320 - DNA, 25 bp, Mus musculus
cacaaacgcggacgtggagtcaaag

SEQ ID NO: 12321 - DNA, 25 bp, Mus musculus
cacaaactaggtttgtgagagctgg

SEQ ID NO: 12322 - DNA, 25 bp, Mus musculus
cacaaacttagaggatgtgattgtt

SEQ ID NO: 12323 - DNA, 25 bp, Mus musculus
cacaaacttgacctaccgcgtgggc

SEQ ID NO: 12324 - DNA, 25 bp, Mus musculus
cacaaagacagtgagcatagcagtt

SEQ ID NO: 12325 - DNA, 25 bp, Mus musculus
cacaaagcaagcatctgtctggagg

SEQ ID NO: 12326 - DNA, 25 bp, Mus musculus
cacaaagcaagcttctgtctggagg

SEQ ID NO: 12327 - DNA, 25 bp, Mus musculus
cacaaagccctgctattgctggagg

SEQ ID NO: 12328 - DNA, 25 bp, Mus musculus
cacaaaggctccatattacacagta

SEQ ID NO: 12329 - DNA, 25 bp, Mus musculus
cacaaaggtgatgcaaaacagcagg

SEQ ID NO: 12330 - DNA, 25 bp, Mus musculus
cacaaagtaccaggccatgctgagt

SEQ ID NO: 12331 - DNA, 25 bp, Mus musculus
cacaaagtgtggtccaggttactcc

SEQ ID NO: 12332 - DNA, 25 bp, Mus musculus
cacaaagttcattgaaggtggcgat

SEQ ID NO: 12333 - DNA, 25 bp, Mus musculus
cacaaatactgctctgtggccagtg

SEQ ID NO: 12334 - DNA, 25 bp, Mus musculus
cacaaatagaggtgtggatctgggt

SEQ ID NO: 12335 - DNA, 25 bp, Mus musculus
cacaaatcagtacaatttgggtcct

SEQ ID NO: 12336 - DNA, 25 bp, Mus musculus
cacaaatctaaaaggcgcgagagaa

SEQ ID NO: 12337 - DNA, 25 bp, Mus musculus
cacaaatcttcgaaggactcctcga

SEQ ID NO: 12338 - DNA, 25 bp, Mus musculus
cacaaatgaggccatagaggagcag

SEQ ID NO: 12339 - DNA, 25 bp, Mus musculus
cacaaatgcatccacaaaaggcggc

SEQ ID NO: 12340 - DNA, 25 bp, Mus musculus
cacaaatgggaaaactgcatgacaa

SEQ ID NO: 12341 - DNA, 25 bp, Mus musculus
cacaaatgtgtgctggattcctgcc

SEQ ID NO: 12342 - DNA, 25 bp, Mus musculus
cacaacaaagcctttggtgttggct

SEQ ID NO: 12343 - DNA, 25 bp, Mus musculus
cacaacacagagagtctaggagact

SEQ ID NO: 12344 - DNA, 25 bp, Mus musculus
cacaacacattctgggtgccctggg

SEQ ID NO: 12345 - DNA, 25 bp, Mus musculus
cacaacagagttttgggacgcctcc

SEQ ID NO: 12346 - DNA, 25 bp, Mus musculus
cacaacagatctggtgcccatgcgg

SEQ ID NO: 12347 - DNA, 25 bp, Mus musculus
cacaacagctcatctcgatttgact

SEQ ID NO: 12348 - DNA, 25 bp, Mus musculus
cacaacattcaccacggcatggatg

SEQ ID NO: 12349 - DNA, 25 bp, Mus musculus
cacaaccacagaagctcagggaata

SEQ ID NO: 12350 - DNA, 25 bp, Mus musculus
cacaaccattgggatgatgaccagg

SEQ ID NO: 12351 - DNA, 25 bp, Mus musculus
cacaaccattgtttattgggtcaca

SEQ ID NO: 12352 - DNA, 25 bp, Mus musculus
cacaaccgcccttctggacaaggtg

SEQ ID NO: 12353 - DNA, 25 bp, Mus musculus
cacaaccttcgaagtgacaatctgt

SEQ ID NO: 12354 - DNA, 25 bp, Mus musculus
cacaacgaagaccaaatggccgtgg

SEQ ID NO: 12355 - DNA, 25 bp, Mus musculus
cacaactctgagatatgggctcctg

SEQ ID NO: 12356 - DNA, 25 bp, Mus musculus
cacaactgaaggtcccagcttacag

SEQ ID NO: 12357 - DNA, 25 bp, Mus musculus
cacaactgatgattagtaaagtctt

SEQ ID NO: 12358 - DNA, 25 bp, Mus musculus
cacaactgccccacttgggtggaag

SEQ ID NO: 12359 - DNA, 25 bp, Mus musculus
cacaactgtgggtggccacatgatg

SEQ ID NO: 12360 - DNA, 25 bp, Mus musculus
cacaacttgtagatggacacctttc

SEQ ID NO: 12361 - DNA, 25 bp, Mus musculus
cacaactttcctatcccagagagtt

SEQ ID NO: 12362 - DNA, 25 bp, Mus musculus
cacaagaagcaacgctgtctttctt

SEQ ID NO: 12363 - DNA, 25 bp, Mus musculus
cacaagacacaatggctgagtatgg

SEQ ID NO: 12364 - DNA, 25 bp, Mus musculus
cacaagacatattgcattttctgga

SEQ ID NO: 12365 - DNA, 25 bp, Mus musculus
cacaagacggtaagagggagaccaa

SEQ ID NO: 12366 - DNA, 25 bp, Mus musculus
cacaagactctcaggcgctcttact

SEQ ID NO: 12367 - DNA, 25 bp, Mus musculus
cacaagactcttgagatggtcagaa

SEQ ID NO: 12368 - DNA, 25 bp, Mus musculus
cacaagagggcctcatgggcattgg

SEQ ID NO: 12369 - DNA, 25 bp, Mus musculus
cacaagatcagagggccgatttcca

SEQ ID NO: 12370 - DNA, 25 bp, Mus musculus
cacaagatttgctcgaggaaggcga

SEQ ID NO: 12371 - DNA, 25 bp, Mus musculus
cacaagcacacagctgtcttggtcg

SEQ ID NO: 12372 - DNA, 25 bp, Mus musculus
cacaagcagtaggaattctaatgtc

SEQ ID NO: 12373 - DNA, 25 bp, Mus musculus
cacaagccagtgatggcactccgga

SEQ ID NO: 12374 - DNA, 25 bp, Mus musculus
cacaagccatgtggcaacctttcta

SEQ ID NO: 12375 - DNA, 25 bp, Mus musculus
cacaagcccattgaagtgaagggct

SEQ ID NO: 12376 - DNA, 25 bp, Mus musculus
cacaagcccgagtggaggtactgga

SEQ ID NO: 12377 - DNA, 25 bp, Mus musculus
cacaagccgcccaggtgcaggagaa

SEQ ID NO: 12378 - DNA, 25 bp, Mus musculus
cacaagctaaagacgggccattttc

SEQ ID NO: 12379 - DNA, 25 bp, Mus musculus
cacaagctaacttctgcacagaaaa

SEQ ID NO: 12380 - DNA, 25 bp, Mus musculus
cacaagctatgatgtagctaccctg

SEQ ID NO: 12381 - DNA, 25 bp, Mus musculus
cacaagctcgggacaagcgagacag

SEQ ID NO: 12382 - DNA, 25 bp, Mus musculus
cacaaggaaagagcatctctcggat

SEQ ID NO: 12383 - DNA, 25 bp, Mus musculus
cacaaggacaggctgacggtcacct

SEQ ID NO: 12384 - DNA, 25 bp, Mus musculus
cacaaggcatgagagtaggagagca

SEQ ID NO: 12385 - DNA, 25 bp, Mus musculus
cacaaggccatggagaacagcgagt

SEQ ID NO: 12386 - DNA, 25 bp, Mus musculus
cacaaggcggtgttgcatgatggtc

SEQ ID NO: 12387 - DNA, 25 bp, Mus musculus
cacaaggctccatggccaatagcac

SEQ ID NO: 12388 - DNA, 25 bp, Mus musculus
cacaaggctgataatgctgtgaaca

SEQ ID NO: 12389 - DNA, 25 bp, Mus musculus
cacaagggaactgctctgcacagct

SEQ ID NO: 12390 - DNA, 25 bp, Mus musculus
cacaaggtgtggtgatggctgcctc

SEQ ID NO: 12391 - DNA, 25 bp, Mus musculus
cacaaggttcaaacagagactccag

SEQ ID NO: 12392 - DNA, 25 bp, Mus musculus
cacaagtacctgatgcaaggcccat

SEQ ID NO: 12393 - DNA, 25 bp, Mus musculus
cacaagtcaagcgataaagcagagg

SEQ ID NO: 12394 - DNA, 25 bp, Mus musculus
cacaagtcatgtttgctatctctgg

SEQ ID NO: 12395 - DNA, 25 bp, Mus musculus
cacaagtccagtgtgggctccaagc

SEQ ID NO: 12396 - DNA, 25 bp, Mus musculus
cacaagtgttcccttcgctgcaaca

SEQ ID NO: 12397 - DNA, 25 bp, Mus musculus
cacaagttacattacccgatggtag

SEQ ID NO: 12398 - DNA, 25 bp, Mus musculus
cacaagtttaagcagttgcagaggg

SEQ ID NO: 12399 - DNA, 25 bp, Mus musculus
cacaataaactcctaatggtggagt

SEQ ID NO: 12400 - DNA, 25 bp, Mus musculus
cacaatcaaaagcatctctatggaa

SEQ ID NO: 12401 - DNA, 25 bp, Mus musculus
cacaatcaagcaacaacttgtcagg

SEQ ID NO: 12402 - DNA, 25 bp, Mus musculus
cacaatcagggtttcccttacagcc

SEQ ID NO: 12403 - DNA, 25 bp, Mus musculus
cacaatctttgctttggaaacttga

SEQ ID NO: 12404 - DNA, 25 bp, Mus musculus
cacaatgaggccattgatcacagct

SEQ ID NO: 12405 - DNA, 25 bp, Mus musculus
cacaatgctacccacattccagatg

SEQ ID NO: 12406 - DNA, 25 bp, Mus musculus
cacaatgcttaactgcatgcttcca

SEQ ID NO: 12407 - DNA, 25 bp, Mus musculus
cacaatgtcatgatagatcaccaac

SEQ ID NO: 12408 - DNA, 25 bp, Mus musculus
cacaatgtcctgctgaacctgccag

SEQ ID NO: 12409 - DNA, 25 bp, Mus musculus
cacaattacttgatagctcagggtc

SEQ ID NO: 12410 - DNA, 25 bp, Mus musculus
cacaattacttgttagctcagggtc

SEQ ID NO: 12411 - DNA, 25 bp, Mus musculus
cacaattcaggcattagtttctcag

SEQ ID NO: 12412 - DNA, 25 bp, Mus musculus
cacaattggctttggacagatcaag

SEQ ID NO: 12413 - DNA, 25 bp, Mus musculus
cacacaaatgttgccactgctgttt

SEQ ID NO: 12414 - DNA, 25 bp, Mus musculus
cacacaacgaactagaaaagcacag

SEQ ID NO: 12415 - DNA, 25 bp, Mus musculus
cacacaactttcctatcccagagag

SEQ ID NO: 12416 - DNA, 25 bp, Mus musculus
cacacaagctaaagacgggccattt

SEQ ID NO: 12417 - DNA, 25 bp, Mus musculus
cacacaaggccatggagaacagcga

SEQ ID NO: 12418 - DNA, 25 bp, Mus musculus
cacacaagttccacgtggacatctc

SEQ ID NO: 12419 - DNA, 25 bp, Mus musculus
cacacacattgttggagccccgtca

SEQ ID NO: 12420 - DNA, 25 bp, Mus musculus
cacacaccagtgatgctgtctgcgg

SEQ ID NO: 12421 - DNA, 25 bp, Mus musculus
cacacacctgcgcaagatgcgcaag

SEQ ID NO: 12422 - DNA, 25 bp, Mus musculus
cacacacgagctgttgtccttgagt

SEQ ID NO: 12423 - DNA, 25 bp, Mus musculus
cacacactaaagagcaacagaggca

SEQ ID NO: 12424 - DNA, 25 bp, Mus musculus
cacacactggctcagttcagcagga

SEQ ID NO: 12425 - DNA, 25 bp, Mus musculus
cacacactgggagggaatgccctct

SEQ ID NO: 12426 - DNA, 25 bp, Mus musculus
cacacagaactggagaaatatgaac

SEQ ID NO: 12427 - DNA, 25 bp, Mus musculus
cacacagaattctttaagggccaca

SEQ ID NO: 12428 - DNA, 25 bp, Mus musculus
cacacagcactaaggcaaagaagct

SEQ ID NO: 12429 - DNA, 25 bp, Mus musculus
cacacagcagagctgccgggttcaa

SEQ ID NO: 12430 - DNA, 25 bp, Mus musculus
cacacagcaggtggcagacttgacc

SEQ ID NO: 12431 - DNA, 25 bp, Mus musculus
cacacagccctgcttgacaaggctg

SEQ ID NO: 12432 - DNA, 25 bp, Mus musculus
cacacagctcctttacagctctggg

SEQ ID NO: 12433 - DNA, 25 bp, Mus musculus
cacacaggcatctcctggatgggat

SEQ ID NO: 12434 - DNA, 25 bp, Mus musculus
cacacaggctggaagatacactaca

SEQ ID NO: 12435 - DNA, 25 bp, Mus musculus
cacacagggccgtgatgctggagaa

SEQ ID NO: 12436 - DNA, 25 bp, Mus musculus
cacacaggtacatctggtccatcct

SEQ ID NO: 12437 - DNA, 25 bp, Mus musculus
cacacagtcgcagggaagccttgga

SEQ ID NO: 12438 - DNA, 25 bp, Mus musculus
cacacagtctcatcagtggtattcc

SEQ ID NO: 12439 - DNA, 25 bp, Mus musculus
cacacagttgtagtatgggatgcta

SEQ ID NO: 12440 - DNA, 25 bp, Mus musculus
cacacatagagaaggagaatgagcg

SEQ ID NO: 12441 - DNA, 25 bp, Mus musculus
cacacatatgtggacaatgcagtgg

SEQ ID NO: 12442 - DNA, 25 bp, Mus musculus
cacacatcacaaagatcctggaata

SEQ ID NO: 12443 - DNA, 25 bp, Mus musculus
cacacatcatgcctccttggattgt

SEQ ID NO: 12444 - DNA, 25 bp, Mus musculus
cacacatctggcagtttcacagcct

SEQ ID NO: 12445 - DNA, 25 bp, Mus musculus
cacacatgaggaggacctcaccaag

SEQ ID NO: 12446 - DNA, 25 bp, Mus musculus
cacacatgggttatgagcaggtcag

SEQ ID NO: 12447 - DNA, 25 bp, Mus musculus
cacacattagaaactgcagcttgga

SEQ ID NO: 12448 - DNA, 25 bp, Mus musculus
cacacattcgttcctggccagaagc

SEQ ID NO: 12449 - DNA, 25 bp, Mus musculus
cacacattctatgttactagttggc

SEQ ID NO: 12450 - DNA, 25 bp, Mus musculus
cacaccaagctgtggtaatgcagtt

SEQ ID NO: 12451 - DNA, 25 bp, Mus musculus
cacaccacgtgctccaggttggact

SEQ ID NO: 12452 - DNA, 25 bp, Mus musculus
cacaccactcccaaggatgttgaga

SEQ ID NO: 12453 - DNA, 25 bp, Mus musculus
cacaccagagtacctggcaccagag

SEQ ID NO: 12454 - DNA, 25 bp, Mus musculus
cacaccagggcattactagtctcta

SEQ ID NO: 12455 - DNA, 25 bp, Mus musculus
cacaccagtgggtcctatctaagga

SEQ ID NO: 12456 - DNA, 25 bp, Mus musculus
cacaccataaggctgagaaggaaac

SEQ ID NO: 12457 - DNA, 25 bp, Mus musculus
cacaccataagggtgagaaggaaac

SEQ ID NO: 12458 - DNA, 25 bp, Mus musculus
cacacccaagttttatgttcgagcc

SEQ ID NO: 12459 - DNA, 25 bp, Mus musculus
cacacccgagtatcgtttgagcaga

SEQ ID NO: 12460 - DNA, 25 bp, Mus musculus
cacaccggccagatctgggtgctgg

SEQ ID NO: 12461 - DNA, 25 bp, Mus musculus
cacacctgaaccaaatggaatggct

SEQ ID NO: 12462 - DNA, 25 bp, Mus musculus
cacacctgaagggaatgatgggcga

SEQ ID NO: 12463 - DNA, 25 bp, Mus musculus
cacacctgatgagtctctggacgac

SEQ ID NO: 12464 - DNA, 25 bp, Mus musculus
cacacctggcttatggatgcctgga

SEQ ID NO: 12465 - DNA, 25 bp, Mus musculus
cacacctggcttttggatgcctgga

SEQ ID NO: 12466 - DNA, 25 bp, Mus musculus
cacaccttggactgaggatcccaga

SEQ ID NO: 12467 - DNA, 25 bp, Mus musculus
cacaccttggccaccattttgggca

SEQ ID NO: 12468 - DNA, 25 bp, Mus musculus
cacacgaaacttccaggactttgac

SEQ ID NO: 12469 - DNA, 25 bp, Mus musculus
cacacgacgagtgcaggcttctcag

SEQ ID NO: 12470 - DNA, 25 bp, Mus musculus
cacacgagctgttgtccttgagtcg

SEQ ID NO: 12471 - DNA, 25 bp, Mus musculus
cacacgcagtgagcgctacgtttgc

SEQ ID NO: 12472 - DNA, 25 bp, Mus musculus
cacacgcgggtctgctgttaaaagg

SEQ ID NO: 12473 - DNA, 25 bp, Mus musculus
cacacgcggtttgtctgcatctcag

SEQ ID NO: 12474 - DNA, 25 bp, Mus musculus
cacacgctggctgactgatgaggat

SEQ ID NO: 12475 - DNA, 25 bp, Mus musculus
cacacggaatgtcaccgagcctgtg

SEQ ID NO: 12476 - DNA, 25 bp, Mus musculus
cacacggggcctcagaacagcacag

SEQ ID NO: 12477 - DNA, 25 bp, Mus musculus
cacacgtcccaatgagaagggagaa

SEQ ID NO: 12478 - DNA, 25 bp, Mus musculus
cacacgtgggcatggatgaatcaga

SEQ ID NO: 12479 - DNA, 25 bp, Mus musculus
cacacgttcctgtcggggaggatca

SEQ ID NO: 12480 - DNA, 25 bp, Mus musculus
cacactaaagagcaacagaggcaga

SEQ ID NO: 12481 - DNA, 25 bp, Mus musculus
cacactacaggtcctacggcctggg

SEQ ID NO: 12482 - DNA, 25 bp, Mus musculus
cacactattccgatgctaaagcaga

SEQ ID NO: 12483 - DNA, 25 bp, Mus musculus
cacactattccgttgctaaagcaga

SEQ ID NO: 12484 - DNA, 25 bp, Mus musculus
cacactattgtcctttttgcccaca

SEQ ID NO: 12485 - DNA, 25 bp, Mus musculus
cacactcacgacagccttgggatac

SEQ ID NO: 12486 - DNA, 25 bp, Mus musculus
cacactctaccaaaaccagagtttg

SEQ ID NO: 12487 - DNA, 25 bp, Mus musculus
cacactctgggcctttctggacatc

SEQ ID NO: 12488 - DNA, 25 bp, Mus musculus
cacactcttgacataagagacagac

SEQ ID NO: 12489 - DNA, 25 bp, Mus musculus
cacactgaaggtgttgcacagtcaa

SEQ ID NO: 12490 - DNA, 25 bp, Mus musculus
cacactgaccctcaatgtcaagagt

SEQ ID NO: 12491 - DNA, 25 bp, Mus musculus
cacactgagagctgtttaaaactac

SEQ ID NO: 12492 - DNA, 25 bp, Mus musculus
cacactggacagaagatgcctctga

SEQ ID NO: 12493 - DNA, 25 bp, Mus musculus
cacactggagctgtcgtcctgcgta

SEQ ID NO: 12494 - DNA, 25 bp, Mus musculus
cacactggagtccttccttatacag

SEQ ID NO: 12495 - DNA, 25 bp, Mus musculus
cacactggtcctgggccaagatggg

SEQ ID NO: 12496 - DNA, 25 bp, Mus musculus
cacactgtgctgctgaggacatagc

SEQ ID NO: 12497 - DNA, 25 bp, Mus musculus
cacactgtgctggtgaggacatagc

SEQ ID NO: 12498 - DNA, 25 bp, Mus musculus
cacactgtgggaactgccacgctag

SEQ ID NO: 12499 - DNA, 25 bp, Mus musculus
cacactgtgtgctgatgggagatgc

SEQ ID NO: 12500 - DNA, 25 bp, Mus musculus
cacactgttgatcggccatggccgg

SEQ ID NO: 12501 - DNA, 25 bp, Mus musculus
cacacttcaccgctgcatcatggga

SEQ ID NO: 12502 - DNA, 25 bp, Mus musculus
cacacttctggaggaccctgtgacg

SEQ ID NO: 12503 - DNA, 25 bp, Mus musculus
cacacttgaaggaccgaaggctgag

SEQ ID NO: 12504 - DNA, 25 bp, Mus musculus
cacacttgtgctgaccagtgatcag

SEQ ID NO: 12505 - DNA, 25 bp, Mus musculus
cacactttgagcacatattttaccc

SEQ ID NO: 12506 - DNA, 25 bp, Mus musculus
cacagaaagagcttcagaagttaag

SEQ ID NO: 12507 - DNA, 25 bp, Mus musculus
cacagaaagggcatctctcctccaa

SEQ ID NO: 12508 - DNA, 25 bp, Mus musculus
cacagaacagagcagtgcctcacgc

SEQ ID NO: 12509 - DNA, 25 bp, Mus musculus
cacagaactgagtatcccactagca

SEQ ID NO: 12510 - DNA, 25 bp, Mus musculus
cacagaagacctagaaaaggacact

SEQ ID NO: 12511 - DNA, 25 bp, Mus musculus
cacagaagcgatggtttagagagac

SEQ ID NO: 12512 - DNA, 25 bp, Mus musculus
cacagaagctcagggaataaatggg

SEQ ID NO: 12513 - DNA, 25 bp, Mus musculus
cacagaagctgtcctgcacatgcca

SEQ ID NO: 12514 - DNA, 25 bp, Mus musculus
cacagaaggatcgagtaggcggctt

SEQ ID NO: 12515 - DNA, 25 bp, Mus musculus
cacagaagggatgttgtcagagcca

SEQ ID NO: 12516 - DNA, 25 bp, Mus musculus
cacagaagggtgcttacttagtttt

SEQ ID NO: 12517 - DNA, 25 bp, Mus musculus
cacagaaggttaatgacactgaggg

SEQ ID NO: 12518 - DNA, 25 bp, Mus musculus
cacagaagtccctgaaaactatggt

SEQ ID NO: 12519 - DNA, 25 bp, Mus musculus
cacagaagtgaagcgggcacaccgc

SEQ ID NO: 12520 - DNA, 25 bp, Mus musculus
cacagaataatggaacctattttaa

SEQ ID NO: 12521 - DNA, 25 bp, Mus musculus
cacagaatagttggtaaatctggac

SEQ ID NO: 12522 - DNA, 25 bp, Mus musculus
cacagacaaacccacgggcaggtct

SEQ ID NO: 12523 - DNA, 25 bp, Mus musculus
cacagacaagactgtgctgagctca

SEQ ID NO: 12524 - DNA, 25 bp, Mus musculus
cacagacaagttttcgccgcttacc

SEQ ID NO: 12525 - DNA, 25 bp, Mus musculus
cacagacacagctgatcaggtcatc

SEQ ID NO: 12526 - DNA, 25 bp, Mus musculus
cacagacacccggaagaggaggaag

SEQ ID NO: 12527 - DNA, 25 bp, Mus musculus
cacagacaggaaatcttggcagttt

SEQ ID NO: 12528 - DNA, 25 bp, Mus musculus
cacagaccagctccacaggttttca

SEQ ID NO: 12529 - DNA, 25 bp, Mus musculus
cacagaccattcctggatgcgtcta

SEQ ID NO: 12530 - DNA, 25 bp, Mus musculus
cacagacgacgaagatgatgagacc

SEQ ID NO: 12531 - DNA, 25 bp, Mus musculus
cacagacgaggagaccgaggcccag

SEQ ID NO: 12532 - DNA, 25 bp, Mus musculus
cacagactacagtgactcggtggca

SEQ ID NO: 12533 - DNA, 25 bp, Mus musculus
cacagactgttttaactgcttgccg

SEQ ID NO: 12534 - DNA, 25 bp, Mus musculus
cacagacttagaggtggtactggag

SEQ ID NO: 12535 - DNA, 25 bp, Mus musculus
cacagactttggcagctggcagctg

SEQ ID NO: 12536 - DNA, 25 bp, Mus musculus
cacagagaaaatcccaggctcatat

SEQ ID NO: 12537 - DNA, 25 bp, Mus musculus
cacagagaaccccagtctagaactg

SEQ ID NO: 12538 - DNA, 25 bp, Mus musculus
cacagagacaaatgtccagagtgga

SEQ ID NO: 12539 - DNA, 25 bp, Mus musculus
cacagagacaagaaagcgcactgca

SEQ ID NO: 12540 - DNA, 25 bp, Mus musculus
cacagagagcaggatacaaagcagc

SEQ ID NO: 12541 - DNA, 25 bp, Mus musculus
cacagagagtcaagctggcatcctg

SEQ ID NO: 12542 - DNA, 25 bp, Mus musculus
cacagagatgcaggacagattgcgc

SEQ ID NO: 12543 - DNA, 25 bp, Mus musculus
cacagagatgcttcgacagttcaca

SEQ ID NO: 12544 - DNA, 25 bp, Mus musculus
cacagagattgactggaaggcctac

SEQ ID NO: 12545 - DNA, 25 bp, Mus musculus
cacagagattttctctgaagccagc

SEQ ID NO: 12546 - DNA, 25 bp, Mus musculus
cacagagcatactgccagatcaagg

SEQ ID NO: 12547 - DNA, 25 bp, Mus musculus
cacagagccaggtgctttgcggatg

SEQ ID NO: 12548 - DNA, 25 bp, Mus musculus
cacagagctggttgtggaccataga

SEQ ID NO: 12549 - DNA, 25 bp, Mus musculus
cacagaggaaccgaagccaagtacc

SEQ ID NO: 12550 - DNA, 25 bp, Mus musculus
cacagaggagcagcttctagcagtg

SEQ ID NO: 12551 - DNA, 25 bp, Mus musculus
cacagagggtctagtaaagagtccg

SEQ ID NO: 12552 - DNA, 25 bp, Mus musculus
cacagagtcagatactgccagatat

SEQ ID NO: 12553 - DNA, 25 bp, Mus musculus
cacagagtcagctgaggcacataga

SEQ ID NO: 12554 - DNA, 25 bp, Mus musculus
cacagagtcttctttattcaggcac

SEQ ID NO: 12555 - DNA, 25 bp, Mus musculus
cacagagtgttaagtgggaccctca

SEQ ID NO: 12556 - DNA, 25 bp, Mus musculus
cacagagttaatggagaggtgcccc

SEQ ID NO: 12557 - DNA, 25 bp, Mus musculus
cacagataaagacaatggaggcatg

SEQ ID NO: 12558 - DNA, 25 bp, Mus musculus
cacagatatgaggaagatgtccttc

SEQ ID NO: 12559 - DNA, 25 bp, Mus musculus
cacagatatgtagaactcttcttga

SEQ ID NO: 12560 - DNA, 25 bp, Mus musculus
cacagatcaattcctcaatgactag

SEQ ID NO: 12561 - DNA, 25 bp, Mus musculus
cacagatcatgagtcctttggccaa

SEQ ID NO: 12562 - DNA, 25 bp, Mus musculus
cacagatccgaccagttatgatggc

SEQ ID NO: 12563 - DNA, 25 bp, Mus musculus
cacagatcttctggtgtccatgagg

SEQ ID NO: 12564 - DNA, 25 bp, Mus musculus
cacagatgacatccttgtggcctcg

SEQ ID NO: 12565 - DNA, 25 bp, Mus musculus
cacagatgacgatgaccctttcaac

SEQ ID NO: 12566 - DNA, 25 bp, Mus musculus
cacagatgatacctttgatccagaa

SEQ ID NO: 12567 - DNA, 25 bp, Mus musculus
cacagatgctctcagctttttatga

SEQ ID NO: 12568 - DNA, 25 bp, Mus musculus
cacagatggtttttaatgggctaca

SEQ ID NO: 12569 - DNA, 25 bp, Mus musculus
cacagatgtgaatctgaagaacgga

SEQ ID NO: 12570 - DNA, 25 bp, Mus musculus
cacagattgaattgcgcattcttgc

SEQ ID NO: 12571 - DNA, 25 bp, Mus musculus
cacagattgactgggaaggtgatct

SEQ ID NO: 12572 - DNA, 25 bp, Mus musculus
cacagattggatggtatgggttgcc

SEQ ID NO: 12573 - DNA, 25 bp, Mus musculus
cacagattggctaaagtttgccaga

SEQ ID NO: 12574 - DNA, 25 bp, Mus musculus
cacagattggcttaagtttgccaga

SEQ ID NO: 12575 - DNA, 25 bp, Mus musculus
cacagattttgtggtagatcgagct

SEQ ID NO: 12576 - DNA, 25 bp, Mus musculus
cacagcaaatgctccaaaatgtcag

SEQ ID NO: 12577 - DNA, 25 bp, Mus musculus
cacagcaagcagacgcagtacgtgc

SEQ ID NO: 12578 - DNA, 25 bp, Mus musculus
cacagcaagctgagggtaaaaccgg

SEQ ID NO: 12579 - DNA, 25 bp, Mus musculus
cacagcaagggaatcatgcacaggg

SEQ ID NO: 12580 - DNA, 25 bp, Mus musculus
cacagcacaagctacatcatcatag

SEQ ID NO: 12581 - DNA, 25 bp, Mus musculus
cacagcacctacaaggagctccttg

SEQ ID NO: 12582 - DNA, 25 bp, Mus musculus
cacagcactcgctgtcagacatgca

SEQ ID NO: 12583 - DNA, 25 bp, Mus musculus
cacagcacttcactatgcagcaaag

SEQ ID NO: 12584 - DNA, 25 bp, Mus musculus
cacagcacttcttcctgtccatgga

SEQ ID NO: 12585 - DNA, 25 bp, Mus musculus
cacagcacttgaatatgacatagac

SEQ ID NO: 12586 - DNA, 25 bp, Mus musculus
cacagcacttgattatgacatagac

SEQ ID NO: 12587 - DNA, 25 bp, Mus musculus
cacagcagaaactggctggtgtcac

SEQ ID NO: 12588 - DNA, 25 bp, Mus musculus
cacagcagaacactggctttccacg

SEQ ID NO: 12589 - DNA, 25 bp, Mus musculus
cacagcagagaggatgccaagtccg

SEQ ID NO: 12590 - DNA, 25 bp, Mus musculus
cacagcagaggtaatcctgtaaggt

SEQ ID NO: 12591 - DNA, 25 bp, Mus musculus
cacagcagagtatggatatacagtt

SEQ ID NO: 12592 - DNA, 25 bp, Mus musculus
cacagcagcaaataaggactcccct

SEQ ID NO: 12593 - DNA, 25 bp, Mus musculus
cacagcagcagactaactttttcct

SEQ ID NO: 12594 - DNA, 25 bp, Mus musculus
cacagcaggagagttctcaggcagc

SEQ ID NO: 12595 - DNA, 25 bp, Mus musculus
cacagcaggcaacgaggctggaaag

SEQ ID NO: 12596 - DNA, 25 bp, Mus musculus
cacagcaggcagcaatgaacatagt

SEQ ID NO: 12597 - DNA, 25 bp, Mus musculus
cacagcaggtggcagacttgaccct

SEQ ID NO: 12598 - DNA, 25 bp, Mus musculus
cacagcagtaacaagaagccagggt

SEQ ID NO: 12599 - DNA, 25 bp, Mus musculus
cacagcagtgccctgctggattcct

SEQ ID NO: 12600 - DNA, 25 bp, Mus musculus
cacagcagtttagatggactaagct

SEQ ID NO: 12601 - DNA, 25 bp, Mus musculus
cacagcattttcgtatagatggtgc

SEQ ID NO: 12602 - DNA, 25 bp, Mus musculus
cacagccaaatacaatgttgggcag

SEQ ID NO: 12603 - DNA, 25 bp, Mus musculus
cacagccagcttgaaggagtctaca

SEQ ID NO: 12604 - DNA, 25 bp, Mus musculus
cacagccatcttgatttacctgagt

SEQ ID NO: 12605 - DNA, 25 bp, Mus musculus
cacagccccaggtacaaactgatgg

SEQ ID NO: 12606 - DNA, 25 bp, Mus musculus
cacagccctactgggcctgaaggag

SEQ ID NO: 12607 - DNA, 25 bp, Mus musculus
cacagcctcgtcgtggatatgctga

SEQ ID NO: 12608 - DNA, 25 bp, Mus musculus
cacagcctgaatgagaatgttctca

SEQ ID NO: 12609 - DNA, 25 bp, Mus musculus
cacagccttcgatgctttctcttga

SEQ ID NO: 12610 - DNA, 25 bp, Mus musculus
cacagccttcgtgtccagctttgag

SEQ ID NO: 12611 - DNA, 25 bp, Mus musculus
cacagcctttgacagaaatgttcac

SEQ ID NO: 12612 - DNA, 25 bp, Mus musculus
cacagcctttgagagcaggagcaca

SEQ ID NO: 12613 - DNA, 25 bp, Mus musculus
cacagcgacgaagagatggagcaac

SEQ ID NO: 12614 - DNA, 25 bp, Mus musculus
cacagcgagcagatcttgacttgtc

SEQ ID NO: 12615 - DNA, 25 bp, Mus musculus
cacagcgagccaagctgcagacaga

SEQ ID NO: 12616 - DNA, 25 bp, Mus musculus
cacagcgaggttaaacactcgggaa

SEQ ID NO: 12617 - DNA, 25 bp, Mus musculus
cacagcggacccgaaagacatgtat

SEQ ID NO: 12618 - DNA, 25 bp, Mus musculus
cacagcggagtgaaaagcattcctg

SEQ ID NO: 12619 - DNA, 25 bp, Mus musculus
cacagcggcagctttgacctgtcat

SEQ ID NO: 12620 - DNA, 25 bp, Mus musculus
cacagctaaggaacttctagataac

SEQ ID NO: 12621 - DNA, 25 bp, Mus musculus
cacagctcagacacaaacccataga

SEQ ID NO: 12622 - DNA, 25 bp, Mus musculus
cacagctcagggaaggatcgcattt

SEQ ID NO: 12623 - DNA, 25 bp, Mus musculus
cacagctccaggctttgtggcagaa

SEQ ID NO: 12624 - DNA, 25 bp, Mus musculus
cacagctcctctctcagatgcttgt

SEQ ID NO: 12625 - DNA, 25 bp, Mus musculus
cacagctgaaacagatcgaggggct

SEQ ID NO: 12626 - DNA, 25 bp, Mus musculus
cacagctgatgtcgtcgtcatgatg

SEQ ID NO: 12627 - DNA, 25 bp, Mus musculus
cacagctgggaagcctgaacctaat

SEQ ID NO: 12628 - DNA, 25 bp, Mus musculus
cacagctggtgtgggatcttagtct

SEQ ID NO: 12629 - DNA, 25 bp, Mus musculus
cacagcttccaatcgaggctacgga

SEQ ID NO: 12630 - DNA, 25 bp, Mus musculus
cacagcttccccaagggttcagaaa

SEQ ID NO: 12631 - DNA, 25 bp, Mus musculus
cacagcttggaagagtgagacctgg

SEQ ID NO: 12632 - DNA, 25 bp, Mus musculus
cacagcttgggtgctgtctgtcggc

SEQ ID NO: 12633 - DNA, 25 bp, Mus musculus
cacaggaaacttcgcagtgagccac

SEQ ID NO: 12634 - DNA, 25 bp, Mus musculus
cacaggaaatagctgaaaaggctct

SEQ ID NO: 12635 - DNA, 25 bp, Mus musculus
cacaggaaatcaaagcgtcagagct

SEQ ID NO: 12636 - DNA, 25 bp, Mus musculus
cacaggaagtgatccatgtctttca

SEQ ID NO: 12637 - DNA, 25 bp, Mus musculus
cacaggaatctgtgtatgccttgcg

SEQ ID NO: 12638 - DNA, 25 bp, Mus musculus
cacaggaatgctgccaaggtcctac

SEQ ID NO: 12639 - DNA, 25 bp, Mus musculus
cacaggaattgcttctctgctccag

SEQ ID NO: 12640 - DNA, 25 bp, Mus musculus
cacaggactgccgttttggatttcg

SEQ ID NO: 12641 - DNA, 25 bp, Mus musculus
cacaggactggcttatcccaaaaca

SEQ ID NO: 12642 - DNA, 25 bp, Mus musculus
cacaggagcaacgatggggagcctc

SEQ ID NO: 12643 - DNA, 25 bp, Mus musculus
cacaggaggcatggctacgtgagca

SEQ ID NO: 12644 - DNA, 25 bp, Mus musculus
cacaggaggccctgccgcagagagc

SEQ ID NO: 12645 - DNA, 25 bp, Mus musculus
cacaggaggcctgttgcacataaaa

SEQ ID NO: 12646 - DNA, 25 bp, Mus musculus
cacaggagttttcagccgcttaggg

SEQ ID NO: 12647 - DNA, 25 bp, Mus musculus
cacaggattaatgagaccaagcaca

SEQ ID NO: 12648 - DNA, 25 bp, Mus musculus
cacaggattacaagaagcggctttc

SEQ ID NO: 12649 - DNA, 25 bp, Mus musculus
cacaggcaaatactttgacaaagcc

SEQ ID NO: 12650 - DNA, 25 bp, Mus musculus
cacaggcaccggaagctgagaactc

SEQ ID NO: 12651 - DNA, 25 bp, Mus musculus
cacaggcactgaagccccggattat

SEQ ID NO: 12652 - DNA, 25 bp, Mus musculus
cacaggcatctcctggatgggatcc

SEQ ID NO: 12653 - DNA, 25 bp, Mus musculus
cacaggccattctttgtcacccagc

SEQ ID NO: 12654 - DNA, 25 bp, Mus musculus
cacaggcctacacacagagttcatg

SEQ ID NO: 12655 - DNA, 25 bp, Mus musculus
cacaggcgatttcaccgagctggga

SEQ ID NO: 12656 - DNA, 25 bp, Mus musculus
cacaggctaagtgctttttgcaaag

SEQ ID NO: 12657 - DNA, 25 bp, Mus musculus
cacaggctacacactggacactcaa

SEQ ID NO: 12658 - DNA, 25 bp, Mus musculus
cacaggctatgatgagccagcccaa

SEQ ID NO: 12659 - DNA, 25 bp, Mus musculus
cacaggctgagatattggaaaccca

SEQ ID NO: 12660 - DNA, 25 bp, Mus musculus
cacaggctttcttgtgtaacctgca

SEQ ID NO: 12661 - DNA, 25 bp, Mus musculus
cacagggaagaagtgccagtcctgg

SEQ ID NO: 12662 - DNA, 25 bp, Mus musculus
cacagggacatgaaggctgcgaatg

SEQ ID NO: 12663 - DNA, 25 bp, Mus musculus
cacagggactggcaatgtatccaag

SEQ ID NO: 12664 - DNA, 25 bp, Mus musculus
cacagggatcgattgcctctgattc

SEQ ID NO: 12665 - DNA, 25 bp, Mus musculus
cacagggccagctgctcgatgtggt

SEQ ID NO: 12666 - DNA, 25 bp, Mus musculus
cacagggcctgcagaaagagtgcca

SEQ ID NO: 12667 - DNA, 25 bp, Mus musculus
cacagggcgttttatcttgcgccaa

SEQ ID NO: 12668 - DNA, 25 bp, Mus musculus
cacagggtatgggactctggtacag

SEQ ID NO: 12669 - DNA, 25 bp, Mus musculus
cacagggtggaaaggcttgaaacag

SEQ ID NO: 12670 - DNA, 25 bp, Mus musculus
cacaggtgatgcttgttaccgggaa

SEQ ID NO: 12671 - DNA, 25 bp, Mus musculus
cacaggtgcgccttgaagagatgtc

SEQ ID NO: 12672 - DNA, 25 bp, Mus musculus
cacaggtgggtaagccaaaagtaat

SEQ ID NO: 12673 - DNA, 25 bp, Mus musculus
cacaggtttctgttacaagctgtga

SEQ ID NO: 12674 - DNA, 25 bp, Mus musculus
cacaggtttgaggagaccttccttt

SEQ ID NO: 12675 - DNA, 25 bp, Mus musculus
cacagtaacaagcttgcgctgcaga

SEQ ID NO: 12676 - DNA, 25 bp, Mus musculus
cacagtacagtaccccgtcttcaaa

SEQ ID NO: 12677 - DNA, 25 bp, Mus musculus
cacagtacagtagcccgtcttcaaa

SEQ ID NO: 12678 - DNA, 25 bp, Mus musculus
cacagtacagttggtgcccattcct

SEQ ID NO: 12679 - DNA, 25 bp, Mus musculus
cacagtacctacctcaaatggtgac

SEQ ID NO: 12680 - DNA, 25 bp, Mus musculus
cacagtagatctggcctaatggcag

SEQ ID NO: 12681 - DNA, 25 bp, Mus musculus
cacagtagatggtacagaactgtat

SEQ ID NO: 12682 - DNA, 25 bp, Mus musculus
cacagtcactatgggctgctcatag

SEQ ID NO: 12683 - DNA, 25 bp, Mus musculus
cacagtcagtagtgtaaagattcct

SEQ ID NO: 12684 - DNA, 25 bp, Mus musculus
cacagtcagtggcaactacaagaaa

SEQ ID NO: 12685 - DNA, 25 bp, Mus musculus
cacagtcagtgggaactacaagaaa

SEQ ID NO: 12686 - DNA, 25 bp, Mus musculus
cacagtcagtgtggttgccttgcac

SEQ ID NO: 12687 - DNA, 25 bp, Mus musculus
cacagtccagggtcacgatgtagct

SEQ ID NO: 12688 - DNA, 25 bp, Mus musculus
cacagtcccagtttcaagaatccag

SEQ ID NO: 12689 - DNA, 25 bp, Mus musculus
cacagtccggtgctgcagagcatca

SEQ ID NO: 12690 - DNA, 25 bp, Mus musculus
cacagtcctgaagtatgtgcaggaa

SEQ ID NO: 12691 - DNA, 25 bp, Mus musculus
cacagtcgtggcatataaggatgcc

SEQ ID NO: 12692 - DNA, 25 bp, Mus musculus
cacagtctagttgccaagtggaaca

SEQ ID NO: 12693 - DNA, 25 bp, Mus musculus
cacagtgaaactcaaagttacagac

SEQ ID NO: 12694 - DNA, 25 bp, Mus musculus
cacagtgacctctttgttatcgaca

SEQ ID NO: 12695 - DNA, 25 bp, Mus musculus
cacagtgagcctgataaaagggccg

SEQ ID NO: 12696 - DNA, 25 bp, Mus musculus
cacagtgagctgttccgggagctgc

SEQ ID NO: 12697 - DNA, 25 bp, Mus musculus
cacagtgagtcctgttttgaaataa

SEQ ID NO: 12698 - DNA, 25 bp, Mus musculus
cacagtgcaaacacggagagtgcgt

SEQ ID NO: 12699 - DNA, 25 bp, Mus musculus
cacagtgcaaaggaagacctggacc

SEQ ID NO: 12700 - DNA, 25 bp, Mus musculus
cacagtgcagcagaaatggagttcc

SEQ ID NO: 12701 - DNA, 25 bp, Mus musculus
cacagtgcgcttcagcatttggatc

SEQ ID NO: 12702 - DNA, 25 bp, Mus musculus
cacagtggagctctacaaaggcaga

SEQ ID NO: 12703 - DNA, 25 bp, Mus musculus
cacagtggagctgtacaaaggcaga

SEQ ID NO: 12704 - DNA, 25 bp, Mus musculus
cacagtggcaacagaggcgtccgga

SEQ ID NO: 12705 - DNA, 25 bp, Mus musculus
cacagtggccattgctgggtatgcc

SEQ ID NO: 12706 - DNA, 25 bp, Mus musculus
cacagtggctatgtacagatcgact

SEQ ID NO: 12707 - DNA, 25 bp, Mus musculus
cacagtggctttcatggaggaacaa

SEQ ID NO: 12708 - DNA, 25 bp, Mus musculus
cacagtggtctgtatcctggagatt

SEQ ID NO: 12709 - DNA, 25 bp, Mus musculus
cacagtgtatgaagaccaactagca

SEQ ID NO: 12710 - DNA, 25 bp, Mus musculus
cacagtgtcgtaactggctgaagac

SEQ ID NO: 12711 - DNA, 25 bp, Mus musculus
cacagtgtgaatcgagctttcccag

SEQ ID NO: 12712 - DNA, 25 bp, Mus musculus
cacagtgtgctcacctagaagacgc

SEQ ID NO: 12713 - DNA, 25 bp, Mus musculus
cacagtgtggcatctgctttattgg

SEQ ID NO: 12714 - DNA, 25 bp, Mus musculus
cacagtgtgggcgagcttcagcata

SEQ ID NO: 12715 - DNA, 25 bp, Mus musculus
cacagtgtgttcgttgtatttctgc

SEQ ID NO: 12716 - DNA, 25 bp, Mus musculus
cacagtgtttcctacagtgcctcga

SEQ ID NO: 12717 - DNA, 25 bp, Mus musculus
cacagttccaacacacagtcagtag

SEQ ID NO: 12718 - DNA, 25 bp, Mus musculus
cacagttgcctccttgctggaacgc

SEQ ID NO: 12719 - DNA, 25 bp, Mus musculus
cacagttggcaagtttgaggaagct

SEQ ID NO: 12720 - DNA, 25 bp, Mus musculus
cacagtttcctggacggcatcggag

SEQ ID NO: 12721 - DNA, 25 bp, Mus musculus
cacagtttcgtgtcagagcagagga

SEQ ID NO: 12722 - DNA, 25 bp, Mus musculus
cacagtttgggaggattcctggcca

SEQ ID NO: 12723 - DNA, 25 bp, Mus musculus
cacagtttgggctgataaactccca

SEQ ID NO: 12724 - DNA, 25 bp, Mus musculus
cacataaaagggagctccagaattt

SEQ ID NO: 12725 - DNA, 25 bp, Mus musculus
cacataaacccgtctcctgggaaga

SEQ ID NO: 12726 - DNA, 25 bp, Mus musculus
cacataagaatggacgatggagcag

SEQ ID NO: 12727 - DNA, 25 bp, Mus musculus
cacatacaagctcccaaagttaaaa

SEQ ID NO: 12728 - DNA, 25 bp, Mus musculus
cacatacaagctgccaaagttaaaa

SEQ ID NO: 12729 - DNA, 25 bp, Mus musculus
cacatacaatattcctttagacccc

SEQ ID NO: 12730 - DNA, 25 bp, Mus musculus
cacatacagcattggttcctctaga

SEQ ID NO: 12731 - DNA, 25 bp, Mus musculus
cacatacatgtttgctgtgaaacag

SEQ ID NO: 12732 - DNA, 25 bp, Mus musculus
cacatacctgaagtggattttctgt

SEQ ID NO: 12733 - DNA, 25 bp, Mus musculus
cacatactaaatgcacatgtgtagg

SEQ ID NO: 12734 - DNA, 25 bp, Mus musculus
cacatacttgctgcagtgggcccag

SEQ ID NO: 12735 - DNA, 25 bp, Mus musculus
cacatagaagcgctcctgggtggcc

SEQ ID NO: 12736 - DNA, 25 bp, Mus musculus
cacatagagtgtgtgcatgcaagca

SEQ ID NO: 12737 - DNA, 25 bp, Mus musculus
cacatagcatggtcatccactcaca

SEQ ID NO: 12738 - DNA, 25 bp, Mus musculus
cacatagctgcccactatgggaaca

SEQ ID NO: 12739 - DNA, 25 bp, Mus musculus
cacatatagcaaacatgaatgacgt

SEQ ID NO: 12740 - DNA, 25 bp, Mus musculus
cacatatgcatactttctggacaag

SEQ ID NO: 12741 - DNA, 25 bp, Mus musculus
cacatcaaggttggacagtttgtat

SEQ ID NO: 12742 - DNA, 25 bp, Mus musculus
cacatcaagtgcagaaacgccctga

SEQ ID NO: 12743 - DNA, 25 bp, Mus musculus
cacatcacatgtggtgtaactatct

SEQ ID NO: 12744 - DNA, 25 bp, Mus musculus
cacatcagacgccacagggcttgat

SEQ ID NO: 12745 - DNA, 25 bp, Mus musculus
cacatcagatataggaaacatacag

SEQ ID NO: 12746 - DNA, 25 bp, Mus musculus
cacatcagtctgaggggctccgctg

SEQ ID NO: 12747 - DNA, 25 bp, Mus musculus
cacatcatgattggagagtactgca

SEQ ID NO: 12748 - DNA, 25 bp, Mus musculus
cacatccagtcctctacagtgtctg

SEQ ID NO: 12749 - DNA, 25 bp, Mus musculus
cacatccatcggttattcaatcacc

SEQ ID NO: 12750 - DNA, 25 bp, Mus musculus
cacatccctaagcagaaactactgc

SEQ ID NO: 12751 - DNA, 25 bp, Mus musculus
cacatcccttaagcagcagaggagc

SEQ ID NO: 12752 - DNA, 25 bp, Mus musculus
cacatccgaaagcaggaagggtcct

SEQ ID NO: 12753 - DNA, 25 bp, Mus musculus
cacatccgaaaggaggaagggtcct

SEQ ID NO: 12754 - DNA, 25 bp, Mus musculus
cacatcctgtatgtgggatccacac

SEQ ID NO: 12755 - DNA, 25 bp, Mus musculus
cacatccttctgcaggccaagggac

SEQ ID NO: 12756 - DNA, 25 bp, Mus musculus
cacatccttgcctcagaatgtggga

SEQ ID NO: 12757 - DNA, 25 bp, Mus musculus
cacatccttgtgaatatgaatgggt

SEQ ID NO: 12758 - DNA, 25 bp, Mus musculus
cacatcgagaacttgagtggctttc

SEQ ID NO: 12759 - DNA, 25 bp, Mus musculus
cacatcgagaatatcaggcaggaga

SEQ ID NO: 12760 - DNA, 25 bp, Mus musculus
cacatcgctgcccagcagaaggcag

SEQ ID NO: 12761 - DNA, 25 bp, Mus musculus
cacatcggcagcagctctaggcaaa

SEQ ID NO: 12762 - DNA, 25 bp, Mus musculus
cacatcggcagctgtggcgacatga

SEQ ID NO: 12763 - DNA, 25 bp, Mus musculus
cacatctcctttatccacatttcat

SEQ ID NO: 12764 - DNA, 25 bp, Mus musculus
cacatctctcaagcagcaaagtttg

SEQ ID NO: 12765 - DNA, 25 bp, Mus musculus
cacatctgacatgtcatttgaggag

SEQ ID NO: 12766 - DNA, 25 bp, Mus musculus
cacatctgctggataacacggagag

SEQ ID NO: 12767 - DNA, 25 bp, Mus musculus
cacatctggagacattgtttatctt

SEQ ID NO: 12768 - DNA, 25 bp, Mus musculus
cacatctggagagattgtttatctt

SEQ ID NO: 12769 - DNA, 25 bp, Mus musculus
cacatctggtttgatctctgatgac

SEQ ID NO: 12770 - DNA, 25 bp, Mus musculus
cacatctgtcaaactacttgaaaga

SEQ ID NO: 12771 - DNA, 25 bp, Mus musculus
cacatcttttcgacgcaacttcagc

SEQ ID NO: 12772 - DNA, 25 bp, Mus musculus
cacatgaacctcctgaagcagtttg

SEQ ID NO: 12773 - DNA, 25 bp, Mus musculus
cacatgaagaactttgtgaccaggg

SEQ ID NO: 12774 - DNA, 25 bp, Mus musculus
cacatgaagcgatttgtcaaagagc

SEQ ID NO: 12775 - DNA, 25 bp, Mus musculus
cacatgacaatagccattctaacag

SEQ ID NO: 12776 - DNA, 25 bp, Mus musculus
cacatgacagtcctttaatagagaa

SEQ ID NO: 12777 - DNA, 25 bp, Mus musculus
cacatgacgtttccccaacggctgg

SEQ ID NO: 12778 - DNA, 25 bp, Mus musculus
cacatgatcctgtcatccttaccaa

SEQ ID NO: 12779 - DNA, 25 bp, Mus musculus
cacatgatcctgtgcgacctgcagc

SEQ ID NO: 12780 - DNA, 25 bp, Mus musculus
cacatgatgaagataagctatgatg

SEQ ID NO: 12781 - DNA, 25 bp, Mus musculus
cacatgcatgcttttgggatgtata

SEQ ID NO: 12782 - DNA, 25 bp, Mus musculus
cacatgcatggcgtctaatgagcag

SEQ ID NO: 12783 - DNA, 25 bp, Mus musculus
cacatgcatgtgtctgagtagagcc

SEQ ID NO: 12784 - DNA, 25 bp, Mus musculus
cacatgcctcatggagggagcccaa

SEQ ID NO: 12785 - DNA, 25 bp, Mus musculus
cacatgcgggcaacaggcggaaaga

SEQ ID NO: 12786 - DNA, 25 bp, Mus musculus
cacatgcgggttatggctggagccc

SEQ ID NO: 12787 - DNA, 25 bp, Mus musculus
cacatggaactagttcaggatctag

SEQ ID NO: 12788 - DNA, 25 bp, Mus musculus
cacatggatactcgctctgggaatt

SEQ ID NO: 12789 - DNA, 25 bp, Mus musculus
cacatggatactggctctgggaatt

SEQ ID NO: 12790 - DNA, 25 bp, Mus musculus
cacatggatgaagtgtgttcgtctc

SEQ ID NO: 12791 - DNA, 25 bp, Mus musculus
cacatggcgacctcacggagtttgg

SEQ ID NO: 12792 - DNA, 25 bp, Mus musculus
cacatggcgactgctgatgggctaa

SEQ ID NO: 12793 - DNA, 25 bp, Mus musculus
cacatgggagcaagcagcaggcaca

SEQ ID NO: 12794 - DNA, 25 bp, Mus musculus
cacatggtgcctgaggatggaaccc

SEQ ID NO: 12795 - DNA, 25 bp, Mus musculus
cacatggtgctttgcaaagtgtgcc

SEQ ID NO: 12796 - DNA, 25 bp, Mus musculus
cacatggtttgggacttgcacgttc

SEQ ID NO: 12797 - DNA, 25 bp, Mus musculus
cacatgtaaagcagtgtgttccgtt

SEQ ID NO: 12798 - DNA, 25 bp, Mus musculus
cacatgtaaatcgattggaatcacc

SEQ ID NO: 12799 - DNA, 25 bp, Mus musculus
cacatgtatgagtgtaagccagcgg

SEQ ID NO: 12800 - DNA, 25 bp, Mus musculus
cacatgtctcttcaatgaaagtcac

SEQ ID NO: 12801 - DNA, 25 bp, Mus musculus
cacatgtctcttgaatgaaagtcac

SEQ ID NO: 12802 - DNA, 25 bp, Mus musculus
cacatgtgctgaagctgaattcctt

SEQ ID NO: 12803 - DNA, 25 bp, Mus musculus
cacatgtggtaaagatagaccctcc

SEQ ID NO: 12804 - DNA, 25 bp, Mus musculus
cacatgtggtgtaactatctgtatt

SEQ ID NO: 12805 - DNA, 25 bp, Mus musculus
cacatgttcccaactgggccaagag

SEQ ID NO: 12806 - DNA, 25 bp, Mus musculus
cacatgttctgcagacctatcaatc

SEQ ID NO: 12807 - DNA, 25 bp, Mus musculus
cacatgtttgaagaagtgccgattg

SEQ ID NO: 12808 - DNA, 25 bp, Mus musculus
cacattatggaacaacagtctcggc

SEQ ID NO: 12809 - DNA, 25 bp, Mus musculus
cacattcaacttacagggcagagcc

SEQ ID NO: 12810 - DNA, 25 bp, Mus musculus
cacattcacaagaagggaagaatag

SEQ ID NO: 12811 - DNA, 25 bp, Mus musculus
cacattcctgaccattggctatggg

SEQ ID NO: 12812 - DNA, 25 bp, Mus musculus
cacattctaatgataacggagttgg

SEQ ID NO: 12813 - DNA, 25 bp, Mus musculus
cacattgagacgctgcattttccat

SEQ ID NO: 12814 - DNA, 25 bp, Mus musculus
cacattgccccgcagatgaggttcc

SEQ ID NO: 12815 - DNA, 25 bp, Mus musculus
cacattgctcagctagctgggaact

SEQ ID NO: 12816 - DNA, 25 bp, Mus musculus
cacattgggctaataggcctcattg

SEQ ID NO: 12817 - DNA, 25 bp, Mus musculus
cacatttactacgtcttgcatctag

SEQ ID NO: 12818 - DNA, 25 bp, Mus musculus
cacatttcccttcagcgtgctggat

SEQ ID NO: 12819 - DNA, 25 bp, Mus musculus
cacatttgaagatgctgagagcgca

SEQ ID NO: 12820 - DNA, 25 bp, Mus musculus
cacatttgaccaagagcagatcctt

SEQ ID NO: 12821 - DNA, 25 bp, Mus musculus
cacatttgagtgaagagagacatac

SEQ ID NO: 12822 - DNA, 25 bp, Mus musculus
caccaaaaacctgctatacattgaa

SEQ ID NO: 12823 - DNA, 25 bp, Mus musculus
caccaaaagcagatccttcacttca

SEQ ID NO: 12824 - DNA, 25 bp, Mus musculus
caccaaaatcggacgtcgctctttg

SEQ ID NO: 12825 - DNA, 25 bp, Mus musculus
caccaaacaaataacgccaggttct

SEQ ID NO: 12826 - DNA, 25 bp, Mus musculus
caccaaacaacccaagtcggattgg

SEQ ID NO: 12827 - DNA, 25 bp, Mus musculus
caccaaacatgaccaaacaaggaac

SEQ ID NO: 12828 - DNA, 25 bp, Mus musculus
caccaaatggagaatgagagcagaa

SEQ ID NO: 12829 - DNA, 25 bp, Mus musculus
caccaacagtgggtgagacagaaga

SEQ ID NO: 12830 - DNA, 25 bp, Mus musculus
caccaacagttacctctgcagcggg

SEQ ID NO: 12831 - DNA, 25 bp, Mus musculus
caccaactacgcgaggctttgaaga

SEQ ID NO: 12832 - DNA, 25 bp, Mus musculus
caccaactttgggttgctgagtgga

SEQ ID NO: 12833 - DNA, 25 bp, Mus musculus
caccaactttttggattctagctcg

SEQ ID NO: 12834 - DNA, 25 bp, Mus musculus
caccaagaccttaagtacatctcac

SEQ ID NO: 12835 - DNA, 25 bp, Mus musculus
caccaagcgcgcgatgcagtgtgtg

SEQ ID NO: 12836 - DNA, 25 bp, Mus musculus
caccaaggaactgtcacaatttgaa

SEQ ID NO: 12837 - DNA, 25 bp, Mus musculus
caccaaggctcaagaaattctggac

SEQ ID NO: 12838 - DNA, 25 bp, Mus musculus
caccaagtcaggaaatgatgccacc

SEQ ID NO: 12839 - DNA, 25 bp, Mus musculus
caccaagtccttttaatccacaagg

SEQ ID NO: 12840 - DNA, 25 bp, Mus musculus
caccaagtgagaagccatgcctcta

SEQ ID NO: 12841 - DNA, 25 bp, Mus musculus
caccaagtgggtcaacaaacacctt

SEQ ID NO: 12842 - DNA, 25 bp, Mus musculus
caccaatgtaagaaaactcacctcc

SEQ ID NO: 12843 - DNA, 25 bp, Mus musculus
caccaatgtgaccagcagtggagga

SEQ ID NO: 12844 - DNA, 25 bp, Mus musculus
caccacaaagatgaggtggctggcg

SEQ ID NO: 12845 - DNA, 25 bp, Mus musculus
caccacacgaggacgaagcctgtga

SEQ ID NO: 12846 - DNA, 25 bp, Mus musculus
caccacagaggagccaaggttatct

SEQ ID NO: 12847 - DNA, 25 bp, Mus musculus
caccacagccagcttgaaggagtct

SEQ ID NO: 12848 - DNA, 25 bp, Mus musculus
caccacatgtattcaagagctggag

SEQ ID NO: 12849 - DNA, 25 bp, Mus musculus
caccacatgttcgtgctggagcagg

SEQ ID NO: 12850 - DNA, 25 bp, Mus musculus
caccacatttggatcccttaagacc

SEQ ID NO: 12851 - DNA, 25 bp, Mus musculus
caccaccactagtggtatctcttgg

SEQ ID NO: 12852 - DNA, 25 bp, Mus musculus
caccaccgctttagaagggtctcca

SEQ ID NO: 12853 - DNA, 25 bp, Mus musculus
caccacctcctatctggatttaaag

SEQ ID NO: 12854 - DNA, 25 bp, Mus musculus
caccaccttgggtgtcaccacgaag

SEQ ID NO: 12855 - DNA, 25 bp, Mus musculus
caccacgacagcaggcggatatttg

SEQ ID NO: 12856 - DNA, 25 bp, Mus musculus
caccacgagatgaaagactactcag

SEQ ID NO: 12857 - DNA, 25 bp, Mus musculus
caccacgagatgaatggctccctca

SEQ ID NO: 12858 - DNA, 25 bp, Mus musculus
caccacgagcagtcctcagaggata

SEQ ID NO: 12859 - DNA, 25 bp, Mus musculus
caccacggcaagtagctgctcgtct

SEQ ID NO: 12860 - DNA, 25 bp, Mus musculus
caccactaaccaggaaagctggctg

SEQ ID NO: 12861 - DNA, 25 bp, Mus musculus
caccactaactgtatggaagtgatg

SEQ ID NO: 12862 - DNA, 25 bp, Mus musculus
caccactcaaaaatgcttttcgagg

SEQ ID NO: 12863 - DNA, 25 bp, Mus musculus
caccacttagaagcagaagtcaagt

SEQ ID NO: 12864 - DNA, 25 bp, Mus musculus
caccagaaaccagtcgctatgcagt

SEQ ID NO: 12865 - DNA, 25 bp, Mus musculus
caccagaagctggtggaccaggctc

SEQ ID NO: 12866 - DNA, 25 bp, Mus musculus
caccagaccaaggagactgcaacag

SEQ ID NO: 12867 - DNA, 25 bp, Mus musculus
caccagagaagatggagacagagtg

SEQ ID NO: 12868 - DNA, 25 bp, Mus musculus
caccagagaggagatcaatgagctg

SEQ ID NO: 12869 - DNA, 25 bp, Mus musculus
caccagagaggatgggctcaagtac

SEQ ID NO: 12870 - DNA, 25 bp, Mus musculus
caccagaggacggagaggattgacc

SEQ ID NO: 12871 - DNA, 25 bp, Mus musculus
caccagaggagtagtgtttctgaca

SEQ ID NO: 12872 - DNA, 25 bp, Mus musculus
caccagaggtcatcaatgcccatga

SEQ ID NO: 12873 - DNA, 25 bp, Mus musculus
caccagagtaggagacaaaggcact

SEQ ID NO: 12874 - DNA, 25 bp, Mus musculus
caccagagtatatgctgtgtctaca

SEQ ID NO: 12875 - DNA, 25 bp, Mus musculus
caccagataagctctggctgaggaa

SEQ ID NO: 12876 - DNA, 25 bp, Mus musculus
caccagatcgagacaggcctactga

SEQ ID NO: 12877 - DNA, 25 bp, Mus musculus
caccagatcttcaatctatggagca

SEQ ID NO: 12878 - DNA, 25 bp, Mus musculus
caccagcaaacataggctatgcaag

SEQ ID NO: 12879 - DNA, 25 bp, Mus musculus
caccagcagctccactttggacagt

SEQ ID NO: 12880 - DNA, 25 bp, Mus musculus
caccagcagctcgactttggacagt

SEQ ID NO: 12881 - DNA, 25 bp, Mus musculus
caccagcagggtagcagtgtccgta

SEQ ID NO: 12882 - DNA, 25 bp, Mus musculus
caccagcagtgcttggcagcattca

SEQ ID NO: 12883 - DNA, 25 bp, Mus musculus
caccagcatggatggctatcaagga

SEQ ID NO: 12884 - DNA, 25 bp, Mus musculus
caccagcatgtggttaagtgcacag

SEQ ID NO: 12885 - DNA, 25 bp, Mus musculus
caccagcatgttggctgatctggac

SEQ ID NO: 12886 - DNA, 25 bp, Mus musculus
caccagccacgtatgacggtgccag

SEQ ID NO: 12887 - DNA, 25 bp, Mus musculus
caccagctgaaggaacgccttcagg

SEQ ID NO: 12888 - DNA, 25 bp, Mus musculus
caccagctgcgatgcaatggcgtgc

SEQ ID NO: 12889 - DNA, 25 bp, Mus musculus
caccaggagctgattaaacaaaaga

SEQ ID NO: 12890 - DNA, 25 bp, Mus musculus
caccaggaggaagacctgactgaat

SEQ ID NO: 12891 - DNA, 25 bp, Mus musculus
caccaggcctggtgacctgactgag

SEQ ID NO: 12892 - DNA, 25 bp, Mus musculus
caccaggtatatggctgacatgatt

SEQ ID NO: 12893 - DNA, 25 bp, Mus musculus
caccaggtcagggtttaaggcagca

SEQ ID NO: 12894 - DNA, 25 bp, Mus musculus
caccaggtccatttgatagcctaga

SEQ ID NO: 12895 - DNA, 25 bp, Mus musculus
caccaggtcgctctggatatccagg

SEQ ID NO: 12896 - DNA, 25 bp, Mus musculus
caccaggtgcagagatccaagatgg

SEQ ID NO: 12897 - DNA, 25 bp, Mus musculus
caccagtagagaccgtaaggcttga

SEQ ID NO: 12898 - DNA, 25 bp, Mus musculus
caccagtgttctatcctgttgaatc

SEQ ID NO: 12899 - DNA, 25 bp, Mus musculus
caccagtgtttctgtctgtgcccat

SEQ ID NO: 12900 - DNA, 25 bp, Mus musculus
caccagtttgacttactggctgagc

SEQ ID NO: 12901 - DNA, 25 bp, Mus musculus
caccataaccgttggataatgtcac

SEQ ID NO: 12902 - DNA, 25 bp, Mus musculus
caccatatctgactcctctgatgag

SEQ ID NO: 12903 - DNA, 25 bp, Mus musculus
caccatatttgagtctttctccaag

SEQ ID NO: 12904 - DNA, 25 bp, Mus musculus
caccatcaaagcctccggcttgtgt

SEQ ID NO: 12905 - DNA, 25 bp, Mus musculus
caccatcagaaagtgtagtgaaaag

SEQ ID NO: 12906 - DNA, 25 bp, Mus musculus
caccatcaggctacttatgcatgga

SEQ ID NO: 12907 - DNA, 25 bp, Mus musculus
caccatccaaagtacttgtcaagac

SEQ ID NO: 12908 - DNA, 25 bp, Mus musculus
caccatcggtttgtagcggacagca

SEQ ID NO: 12909 - DNA, 25 bp, Mus musculus
caccatctatgtccacaaggttgtg

SEQ ID NO: 12910 - DNA, 25 bp, Mus musculus
caccatcttccccatcaaagttgag

SEQ ID NO: 12911 - DNA, 25 bp, Mus musculus
caccatgaagtacagttggccatat

SEQ ID NO: 12912 - DNA, 25 bp, Mus musculus
caccatgacaaaagaggtgtttgac

SEQ ID NO: 12913 - DNA, 25 bp, Mus musculus
caccatgatttatgactgtgaagga

SEQ ID NO: 12914 - DNA, 25 bp, Mus musculus
caccatgcagatcattctacagcca

SEQ ID NO: 12915 - DNA, 25 bp, Mus musculus
caccatgcccggcagtactgtacat

SEQ ID NO: 12916 - DNA, 25 bp, Mus musculus
caccatgcctacagctggtagcaag

SEQ ID NO: 12917 - DNA, 25 bp, Mus musculus
caccatgcctatacgtcgagccgtg

SEQ ID NO: 12918 - DNA, 25 bp, Mus musculus
caccatgcgcttgggaagggagaaa

SEQ ID NO: 12919 - DNA, 25 bp, Mus musculus
caccatgcttctgtgagcatatggc

SEQ ID NO: 12920 - DNA, 25 bp, Mus musculus
caccatggataagcacgctgatgcc

SEQ ID NO: 12921 - DNA, 25 bp, Mus musculus
caccatggcatgaaatggaggttcc

SEQ ID NO: 12922 - DNA, 25 bp, Mus musculus
caccatgggtaagagatctgaccta

SEQ ID NO: 12923 - DNA, 25 bp, Mus musculus
caccatggtagagcagcagatctcc

SEQ ID NO: 12924 - DNA, 25 bp, Mus musculus
caccatggttggctgattgcagttt

SEQ ID NO: 12925 - DNA, 25 bp, Mus musculus
caccatgtcagtggcaacagaacgg

SEQ ID NO: 12926 - DNA, 25 bp, Mus musculus
caccatgtctccttgtcctacaaag

SEQ ID NO: 12927 - DNA, 25 bp, Mus musculus
caccatgtgtggactggtcactcta

SEQ ID NO: 12928 - DNA, 25 bp, Mus musculus
caccatgtttgaagaaaattatcct

SEQ ID NO: 12929 - DNA, 25 bp, Mus musculus
caccattacaaaggtccctttcagg

SEQ ID NO: 12930 - DNA, 25 bp, Mus musculus
caccattaccctaagaagttataca

SEQ ID NO: 12931 - DNA, 25 bp, Mus musculus
caccattacccttagaagttataca

SEQ ID NO: 12932 - DNA, 25 bp, Mus musculus
caccattgaaggagagccggagtcc

SEQ ID NO: 12933 - DNA, 25 bp, Mus musculus
caccattgtgcttcgtggtgccact

SEQ ID NO: 12934 - DNA, 25 bp, Mus musculus
caccattgtggagcatgattctgga

SEQ ID NO: 12935 - DNA, 25 bp, Mus musculus
caccatttaaaacctggaggcactg

SEQ ID NO: 12936 - DNA, 25 bp, Mus musculus
caccatttctgaaatcaagaccctt

SEQ ID NO: 12937 - DNA, 25 bp, Mus musculus
caccatttgcttcaacttggacggg

SEQ ID NO: 12938 - DNA, 25 bp, Mus musculus
caccattttatctgggttctctgcc

SEQ ID NO: 12939 - DNA, 25 bp, Mus musculus
cacccaaagatagtagcttggcgtt

SEQ ID NO: 12940 - DNA, 25 bp, Mus musculus
cacccaaagctgttaaagtgtcatc

SEQ ID NO: 12941 - DNA, 25 bp, Mus musculus
cacccaagcctagaaaagtggagct

SEQ ID NO: 12942 - DNA, 25 bp, Mus musculus
cacccacagagttgaaaagagggtg

SEQ ID NO: 12943 - DNA, 25 bp, Mus musculus
cacccagacctgcaacaaagtgcga

SEQ ID NO: 12944 - DNA, 25 bp, Mus musculus
cacccagattggctgcttgttgcgc

SEQ ID NO: 12945 - DNA, 25 bp, Mus musculus
cacccagcctgatgagacccgagaa

SEQ ID NO: 12946 - DNA, 25 bp, Mus musculus
cacccagcggaacacactgtgggaa

SEQ ID NO: 12947 - DNA, 25 bp, Mus musculus
cacccaggaatggagctacctggtg

SEQ ID NO: 12948 - DNA, 25 bp, Mus musculus
cacccagggttttgtaggctgtgcc

SEQ ID NO: 12949 - DNA, 25 bp, Mus musculus
cacccagtgtaagcataattggcca

SEQ ID NO: 12950 - DNA, 25 bp, Mus musculus
cacccagttcttttgcaaagttcaa

SEQ ID NO: 12951 - DNA, 25 bp, Mus musculus
cacccataagcccaagaggagaaga

SEQ ID NO: 12952 - DNA, 25 bp, Mus musculus
cacccatagaatcaaagcaccgaag

SEQ ID NO: 12953 - DNA, 25 bp, Mus musculus
cacccatcccagatgaagattgtca

SEQ ID NO: 12954 - DNA, 25 bp, Mus musculus
cacccatcccagttgaagattgtca

SEQ ID NO: 12955 - DNA, 25 bp, Mus musculus
cacccatctaggattccagagagaa

SEQ ID NO: 12956 - DNA, 25 bp, Mus musculus
cacccatttggagccatgaatattg

SEQ ID NO: 12957 - DNA, 25 bp, Mus musculus
caccccacatgaggctgagaaacag

SEQ ID NO: 12958 - DNA, 25 bp, Mus musculus
caccccagaaggtgtcgtctttgac

SEQ ID NO: 12959 - DNA, 25 bp, Mus musculus
caccccaggaaagagggcactttgg

SEQ ID NO: 12960 - DNA, 25 bp, Mus musculus
caccccagtcccaaaggaggctatt

SEQ ID NO: 12961 - DNA, 25 bp, Mus musculus
cacccccgtctgtcatatgtagcag

SEQ ID NO: 12962 - DNA, 25 bp, Mus musculus
cacccctctggtgatggtacatggc

SEQ ID NO: 12963 - DNA, 25 bp, Mus musculus
cacccctgattgtgacagaattaga

SEQ ID NO: 12964 - DNA, 25 bp, Mus musculus
cacccctgtcagatgattctgaggc

SEQ ID NO: 12965 - DNA, 25 bp, Mus musculus
cacccctgttcacagtcagtgtgga

SEQ ID NO: 12966 - DNA, 25 bp, Mus musculus
cacccgaagaagttgcagctcgtct

SEQ ID NO: 12967 - DNA, 25 bp, Mus musculus
cacccgaagagactagaagatgcca

SEQ ID NO: 12968 - DNA, 25 bp, Mus musculus
cacccgagcccaagggttgtccaat

SEQ ID NO: 12969 - DNA, 25 bp, Mus musculus
cacccgagtccccatagacgagagg

SEQ ID NO: 12970 - DNA, 25 bp, Mus musculus
cacccgatgatgtcattgctcagaa

SEQ ID NO: 12971 - DNA, 25 bp, Mus musculus
cacccgcatcttaaggagacgaaag

SEQ ID NO: 12972 - DNA, 25 bp, Mus musculus
cacccgcgatagtattttcctcaag

SEQ ID NO: 12973 - DNA, 25 bp, Mus musculus
cacccgcgtttcaagagggagttca

SEQ ID NO: 12974 - DNA, 25 bp, Mus musculus
cacccgcttataaatgcctttgctc

SEQ ID NO: 12975 - DNA, 25 bp, Mus musculus
cacccggagaggacgccttgagaag

SEQ ID NO: 12976 - DNA, 25 bp, Mus musculus
cacccggctgttgacagatgtgcag

SEQ ID NO: 12977 - DNA, 25 bp, Mus musculus
caccctagtcattcattgctaacag

SEQ ID NO: 12978 - DNA, 25 bp, Mus musculus
caccctatgggtcagagagcaaaca

SEQ ID NO: 12979 - DNA, 25 bp, Mus musculus
caccctcactgcagggaggtctggg

SEQ ID NO: 12980 - DNA, 25 bp, Mus musculus
caccctcagaggcaggcaatgcact

SEQ ID NO: 12981 - DNA, 25 bp, Mus musculus
caccctcaggagacaagagtgtgga

SEQ ID NO: 12982 - DNA, 25 bp, Mus musculus
caccctctcatatgtggacatcaag

SEQ ID NO: 12983 - DNA, 25 bp, Mus musculus
caccctctcccaagcagaatgtgag

SEQ ID NO: 12984 - DNA, 25 bp, Mus musculus
caccctctgaccagctgagtacaag

SEQ ID NO: 12985 - DNA, 25 bp, Mus musculus
caccctctgagacagtgctctgcga

SEQ ID NO: 12986 - DNA, 25 bp, Mus musculus
caccctctgatctgcagagcaatgt

SEQ ID NO: 12987 - DNA, 25 bp, Mus musculus
caccctctgtggctgattaaggagc

SEQ ID NO: 12988 - DNA, 25 bp, Mus musculus
caccctgactggagttaccctgatc

SEQ ID NO: 12989 - DNA, 25 bp, Mus musculus
caccctgatgttattgggttcactc

SEQ ID NO: 12990 - DNA, 25 bp, Mus musculus
caccctgatgtttttgggttcactc

SEQ ID NO: 12991 - DNA, 25 bp, Mus musculus
caccctgatttaagaaggatcctga

SEQ ID NO: 12992 - DNA, 25 bp, Mus musculus
caccctgcccggctgggaagaattt

SEQ ID NO: 12993 - DNA, 25 bp, Mus musculus
caccctgcccgggtgggaagaattt

SEQ ID NO: 12994 - DNA, 25 bp, Mus musculus
caccctgctcttcagggaggtcagt

SEQ ID NO: 12995 - DNA, 25 bp, Mus musculus
caccctgctgatcatgaagctgaca

SEQ ID NO: 12996 - DNA, 25 bp, Mus musculus
caccctggagaacaattacctgacg

SEQ ID NO: 12997 - DNA, 25 bp, Mus musculus
caccctggaggaccagattatccag

SEQ ID NO: 12998 - DNA, 25 bp, Mus musculus
caccctggcagtggttaacagaatg

SEQ ID NO: 12999 - DNA, 25 bp, Mus musculus
caccctggccctgtggtgactggag

SEQ ID NO: 13000 - DNA, 25 bp, Mus musculus
caccctggtcaggattgtggtcact

SEQ ID NO: 13001 - DNA, 25 bp, Mus musculus
caccctggtcatggaggactgcaac

SEQ ID NO: 13002 - DNA, 25 bp, Mus musculus
cacccttcatggatacacttcagtt

SEQ ID NO: 13003 - DNA, 25 bp, Mus musculus
cacccttccggactcttaacatcaa

SEQ ID NO: 13004 - DNA, 25 bp, Mus musculus
cacccttgctctatgaaagcggcta

SEQ ID NO: 13005 - DNA, 25 bp, Mus musculus
cacccttgggaaaggagagtctaga

SEQ ID NO: 13006 - DNA, 25 bp, Mus musculus
caccctttatgagatgaaatcacag

SEQ ID NO: 13007 - DNA, 25 bp, Mus musculus
caccctttttggcaaattcagaaga

SEQ ID NO: 13008 - DNA, 25 bp, Mus musculus
caccgaaaccacctcgaaggcaggg

SEQ ID NO: 13009 - DNA, 25 bp, Mus musculus
caccgaagagcagcaggagcgtttc

SEQ ID NO: 13010 - DNA, 25 bp, Mus musculus
caccgaagagccaagtcattggaca

SEQ ID NO: 13011 - DNA, 25 bp, Mus musculus
caccgaatatggagccctcaacaga

SEQ ID NO: 13012 - DNA, 25 bp, Mus musculus
caccgagaaagtatgcgcaacatga

SEQ ID NO: 13013 - DNA, 25 bp, Mus musculus
caccgagaattatccgatctatcag

SEQ ID NO: 13014 - DNA, 25 bp, Mus musculus
caccgagtgctctttgaggtgcact

SEQ ID NO: 13015 - DNA, 25 bp, Mus musculus
caccgatggatatgaatgggacccc

SEQ ID NO: 13016 - DNA, 25 bp, Mus musculus
caccgatgttctacacgctgtgtgg

SEQ ID NO: 13017 - DNA, 25 bp, Mus musculus
caccgcagatttcttgtttaacaag

SEQ ID NO: 13018 - DNA, 25 bp, Mus musculus
caccgcagctgtcttctcgaggaga

SEQ ID NO: 13019 - DNA, 25 bp, Mus musculus
caccgcaggatcgatgctctaaata

SEQ ID NO: 13020 - DNA, 25 bp, Mus musculus
caccgcagtctttaacactggtatt

SEQ ID NO: 13021 - DNA, 25 bp, Mus musculus
caccgccacctgcattgaggctgag

SEQ ID NO: 13022 - DNA, 25 bp, Mus musculus
caccgccacctggattgaggctgag

SEQ ID NO: 13023 - DNA, 25 bp, Mus musculus
caccgcccagttacaaggcctggaa

SEQ ID NO: 13024 - DNA, 25 bp, Mus musculus
caccgccgggatggcaagtggctca

SEQ ID NO: 13025 - DNA, 25 bp, Mus musculus
caccgcctcataaagggagagaaat

SEQ ID NO: 13026 - DNA, 25 bp, Mus musculus
caccgctagaagagattgttgacaa

SEQ ID NO: 13027 - DNA, 25 bp, Mus musculus
caccgctctgaaagggatctgcaga

SEQ ID NO: 13028 - DNA, 25 bp, Mus musculus
caccgctctgaatgggatctgcaga

SEQ ID NO: 13029 - DNA, 25 bp, Mus musculus
caccgcttcttagagggcaagatca

SEQ ID NO: 13030 - DNA, 25 bp, Mus musculus
caccgctttagaagggtctccatct

SEQ ID NO: 13031 - DNA, 25 bp, Mus musculus
caccgcttttggtccaggagcttaa

SEQ ID NO: 13032 - DNA, 25 bp, Mus musculus
caccggaagctgagaactccacaga

SEQ ID NO: 13033 - DNA, 25 bp, Mus musculus
caccggaaggaatattcccagagta

SEQ ID NO: 13034 - DNA, 25 bp, Mus musculus
caccggagattatgctggcaaggca

SEQ ID NO: 13035 - DNA, 25 bp, Mus musculus
caccggatctggtttcagtgtgtcc

SEQ ID NO: 13036 - DNA, 25 bp, Mus musculus
caccgggaaagtctgggtcgcaaca

SEQ ID NO: 13037 - DNA, 25 bp, Mus musculus
caccggtgctgagtgtggtaccagc

SEQ ID NO: 13038 - DNA, 25 bp, Mus musculus
caccgtaacagatatgacagggaaa

SEQ ID NO: 13039 - DNA, 25 bp, Mus musculus
caccgtcctgctccagagcctgatg

SEQ ID NO: 13040 - DNA, 25 bp, Mus musculus
caccgtcgaggcttttgcgcttgtc

SEQ ID NO: 13041 - DNA, 25 bp, Mus musculus
caccgtctttcaacacttggcctgg

SEQ ID NO: 13042 - DNA, 25 bp, Mus musculus
caccgtgaaaaaagcaacatcacag

SEQ ID NO: 13043 - DNA, 25 bp, Mus musculus
caccgtgaatgtacggcggagtgtc

SEQ ID NO: 13044 - DNA, 25 bp, Mus musculus
caccgtgatgaactgtactctctga

SEQ ID NO: 13045 - DNA, 25 bp, Mus musculus
caccgtgcaaactgtgggaggcaca

SEQ ID NO: 13046 - DNA, 25 bp, Mus musculus
caccgtgcagagtcaggaccgtgtt

SEQ ID NO: 13047 - DNA, 25 bp, Mus musculus
caccgtgccaatagttctgctgagc

SEQ ID NO: 13048 - DNA, 25 bp, Mus musculus
caccgtggaaggttcttctgggact

SEQ ID NO: 13049 - DNA, 25 bp, Mus musculus
caccgtggacggagtaaaatacgct

SEQ ID NO: 13050 - DNA, 25 bp, Mus musculus
caccgtggcagtgaagatgttgaaa

SEQ ID NO: 13051 - DNA, 25 bp, Mus musculus
caccgtgggcttggggtgcacctca

SEQ ID NO: 13052 - DNA, 25 bp, Mus musculus
caccgtggtacctttgccctatgag

SEQ ID NO: 13053 - DNA, 25 bp, Mus musculus
caccgtggtcagaatgcagggcctg

SEQ ID NO: 13054 - DNA, 25 bp, Mus musculus
caccgtgtctcttctattgtggatg

SEQ ID NO: 13055 - DNA, 25 bp, Mus musculus
caccgtgtgctgcagttttgcctaa

SEQ ID NO: 13056 - DNA, 25 bp, Mus musculus
caccgtgtggattgcactgaagaca

SEQ ID NO: 13057 - DNA, 25 bp, Mus musculus
cacctaaaagtgctccatggagtca

SEQ ID NO: 13058 - DNA, 25 bp, Mus musculus
cacctaagctgtaataggaccatcc

SEQ ID NO: 13059 - DNA, 25 bp, Mus musculus
cacctactggtctgcgtctttggca

SEQ ID NO: 13060 - DNA, 25 bp, Mus musculus
cacctagagagaactgccagtgtcc

SEQ ID NO: 13061 - DNA, 25 bp, Mus musculus
cacctagccgggaatatgtcgactt

SEQ ID NO: 13062 - DNA, 25 bp, Mus musculus
cacctagcggctatggttaatgttc

SEQ ID NO: 13063 - DNA, 25 bp, Mus musculus
cacctagtcattgcccaggagctgg

SEQ ID NO: 13064 - DNA, 25 bp, Mus musculus
cacctagtgtgtacccagcaccatg

SEQ ID NO: 13065 - DNA, 25 bp, Mus musculus
cacctatacagaatgctgctgccaa

SEQ ID NO: 13066 - DNA, 25 bp, Mus musculus
cacctatacagattgctgctgccaa

SEQ ID NO: 13067 - DNA, 25 bp, Mus musculus
cacctatcaacaagctggccctgtt

SEQ ID NO: 13068 - DNA, 25 bp, Mus musculus
cacctatcccaatgaggagaagcag

SEQ ID NO: 13069 - DNA, 25 bp, Mus musculus
cacctatgaggaacgcagagtctgt

SEQ ID NO: 13070 - DNA, 25 bp, Mus musculus
cacctatggagcagaacaaagagac

SEQ ID NO: 13071 - DNA, 25 bp, Mus musculus
cacctatgggcgacgggccctgaaa

SEQ ID NO: 13072 - DNA, 25 bp, Mus musculus
cacctatgtgaagaacggcacgtcc

SEQ ID NO: 13073 - DNA, 25 bp, Mus musculus
cacctcacctcatcaaggagataat

SEQ ID NO: 13074 - DNA, 25 bp, Mus musculus
cacctcacgggcacagagttcagta

SEQ ID NO: 13075 - DNA, 25 bp, Mus musculus
cacctcagaatagtgctgcctaagg

SEQ ID NO: 13076 - DNA, 25 bp, Mus musculus
cacctcagacggaagatgggctact

SEQ ID NO: 13077 - DNA, 25 bp, Mus musculus
cacctcagcctttaccagacatgtt

SEQ ID NO: 13078 - DNA, 25 bp, Mus musculus
cacctcagctcgcaggtcctttgga

SEQ ID NO: 13079 - DNA, 25 bp, Mus musculus
cacctcaggcttggattctagtcac

SEQ ID NO: 13080 - DNA, 25 bp, Mus musculus
cacctcatcaaggagataatcctgg

SEQ ID NO: 13081 - DNA, 25 bp, Mus musculus
cacctcccaacctgtgctgagggag

SEQ ID NO: 13082 - DNA, 25 bp, Mus musculus
cacctcccgggatgtgactctgggc

SEQ ID NO: 13083 - DNA, 25 bp, Mus musculus
cacctccgatgtagaagaattggca

SEQ ID NO: 13084 - DNA, 25 bp, Mus musculus
cacctcctatctggatttaaagata

SEQ ID NO: 13085 - DNA, 25 bp, Mus musculus
cacctcctgggccatgagcgagctg

SEQ ID NO: 13086 - DNA, 25 bp, Mus musculus
cacctcctttgtggtcaaagatgag

SEQ ID NO: 13087 - DNA, 25 bp, Mus musculus
cacctcggaaagctctgttcaccta

SEQ ID NO: 13088 - DNA, 25 bp, Mus musculus
cacctcggctttatggttgctccaa

SEQ ID NO: 13089 - DNA, 25 bp, Mus musculus
cacctcgtggcgttaggctttacca

SEQ ID NO: 13090 - DNA, 25 bp, Mus musculus
cacctctaagttactgtcttgcaag

SEQ ID NO: 13091 - DNA, 25 bp, Mus musculus
cacctctccctgcattgacaaaaga

SEQ ID NO: 13092 - DNA, 25 bp, Mus musculus
cacctctgatgatgtgaccatatcc

SEQ ID NO: 13093 - DNA, 25 bp, Mus musculus
cacctctgccacctgatgaaaggca

SEQ ID NO: 13094 - DNA, 25 bp, Mus musculus
cacctctggtgctccgaggagatct

SEQ ID NO: 13095 - DNA, 25 bp, Mus musculus
cacctctggtttacagtgttgttgg

SEQ ID NO: 13096 - DNA, 25 bp, Mus musculus
cacctctggttttcagtgttgttgg

SEQ ID NO: 13097 - DNA, 25 bp, Mus musculus
cacctgaagcgctttgtctatgaga

SEQ ID NO: 13098 - DNA, 25 bp, Mus musculus
cacctgaagggaatgatgggcgatt

SEQ ID NO: 13099 - DNA, 25 bp, Mus musculus
cacctgacacatcagacgctgcgta

SEQ ID NO: 13100 - DNA, 25 bp, Mus musculus
cacctgactcaggagcacgatgctg

SEQ ID NO: 13101 - DNA, 25 bp, Mus musculus
cacctgactcttgaaaactgcttgc

SEQ ID NO: 13102 - DNA, 25 bp, Mus musculus
cacctgaggctaccttcttctaaag

SEQ ID NO: 13103 - DNA, 25 bp, Mus musculus
cacctgatgagtacattgagaaact

SEQ ID NO: 13104 - DNA, 25 bp, Mus musculus
cacctgatgagtctctggacgactt

SEQ ID NO: 13105 - DNA, 25 bp, Mus musculus
cacctgatggtgaagacgacactgc

SEQ ID NO: 13106 - DNA, 25 bp, Mus musculus
cacctgcaacaggtgtacattttgc

SEQ ID NO: 13107 - DNA, 25 bp, Mus musculus
cacctgcacctatcatgccattgga

SEQ ID NO: 13108 - DNA, 25 bp, Mus musculus
cacctgcagaagctatacctgaagg

SEQ ID NO: 13109 - DNA, 25 bp, Mus musculus
cacctgcaggagagccttgctggct

SEQ ID NO: 13110 - DNA, 25 bp, Mus musculus
cacctgcagtaccagccaaaaaggc

SEQ ID NO: 13111 - DNA, 25 bp, Mus musculus
cacctgcatagcaagctgtctgtga

SEQ ID NO: 13112 - DNA, 25 bp, Mus musculus
cacctgcattgtctgtgatgtcaag

SEQ ID NO: 13113 - DNA, 25 bp, Mus musculus
cacctgcctgccagactcaatgagg

SEQ ID NO: 13114 - DNA, 25 bp, Mus musculus
cacctgcctttgtggtgtctccaga

SEQ ID NO: 13115 - DNA, 25 bp, Mus musculus
cacctgctccaatgctcacagttag

SEQ ID NO: 13116 - DNA, 25 bp, Mus musculus
cacctgctccagataatgggacttc

SEQ ID NO: 13117 - DNA, 25 bp, Mus musculus
cacctgctgtccatgcggatggatt

SEQ ID NO: 13118 - DNA, 25 bp, Mus musculus
cacctgctttgtggacgctggcaat

SEQ ID NO: 13119 - DNA, 25 bp, Mus musculus
cacctggaatctacttggtgagtac

SEQ ID NO: 13120 - DNA, 25 bp, Mus musculus
cacctggaattttccaatttttgat

SEQ ID NO: 13121 - DNA, 25 bp, Mus musculus
cacctggacgggattgttcaagtcc

SEQ ID NO: 13122 - DNA, 25 bp, Mus musculus
cacctggagaagagtgccgtactcc

SEQ ID NO: 13123 - DNA, 25 bp, Mus musculus
cacctggagaaggagatcgagacct

SEQ ID NO: 13124 - DNA, 25 bp, Mus musculus
cacctggcaggaacccagcaaggcg

SEQ ID NO: 13125 - DNA, 25 bp, Mus musculus
cacctggcagtccttgatagaagca

SEQ ID NO: 13126 - DNA, 25 bp, Mus musculus
cacctggcgtccgagctgtggagct

SEQ ID NO: 13127 - DNA, 25 bp, Mus musculus
cacctgggacccttacaagtggatg

SEQ ID NO: 13128 - DNA, 25 bp, Mus musculus
cacctgggagattctggcagtgagc

SEQ ID NO: 13129 - DNA, 25 bp, Mus musculus
cacctgggagctccaagctggataa

SEQ ID NO: 13130 - DNA, 25 bp, Mus musculus
cacctgggcaatgacagcagccggg

SEQ ID NO: 13131 - DNA, 25 bp, Mus musculus
cacctgggctctttggtacctcttc

SEQ ID NO: 13132 - DNA, 25 bp, Mus musculus
cacctgggtgacagtaattcctggg

SEQ ID NO: 13133 - DNA, 25 bp, Mus musculus
cacctgggtgagttattcggcagaa

SEQ ID NO: 13134 - DNA, 25 bp, Mus musculus
cacctggtggacgacggtgacatca

SEQ ID NO: 13135 - DNA, 25 bp, Mus musculus
cacctggttcactggaatccaaagt

SEQ ID NO: 13136 - DNA, 25 bp, Mus musculus
cacctgtaacccaatttcaagggag

SEQ ID NO: 13137 - DNA, 25 bp, Mus musculus
cacctgtacggttgatggaaaggtc

SEQ ID NO: 13138 - DNA, 25 bp, Mus musculus
cacctgtacttcctgcactacgagt

SEQ ID NO: 13139 - DNA, 25 bp, Mus musculus
cacctgtacttcgtgcactacgagt

SEQ ID NO: 13140 - DNA, 25 bp, Mus musculus
cacctgtagcagaagggaggagaca

SEQ ID NO: 13141 - DNA, 25 bp, Mus musculus
cacctgtatcagaagatgaagacaa

SEQ ID NO: 13142 - DNA, 25 bp, Mus musculus
cacctgtcctgcagagggtggaccg

SEQ ID NO: 13143 - DNA, 25 bp, Mus musculus
cacctgtggaattatgactaagcca

SEQ ID NO: 13144 - DNA, 25 bp, Mus musculus
cacctgtgggtctcggattgggcta

SEQ ID NO: 13145 - DNA, 25 bp, Mus musculus
cacctgtggtccaggaatgctacca

SEQ ID NO: 13146 - DNA, 25 bp, Mus musculus
cacctgtggtggacaccacacaagg

SEQ ID NO: 13147 - DNA, 25 bp, Mus musculus
cacctgtgtggcgactggtttccca

SEQ ID NO: 13148 - DNA, 25 bp, Mus musculus
cacctgttcatcactatcctagatg

SEQ ID NO: 13149 - DNA, 25 bp, Mus musculus
cacctgttgtgaagattttctggac

SEQ ID NO: 13150 - DNA, 25 bp, Mus musculus
caccttaactgagaaaattagagcc

SEQ ID NO: 13151 - DNA, 25 bp, Mus musculus
caccttaagtaaaataggagatgag

SEQ ID NO: 13152 - DNA, 25 bp, Mus musculus
caccttacatatgcggagttcactc

SEQ ID NO: 13153 - DNA, 25 bp, Mus musculus
caccttaccaggatgagtgggaggc

SEQ ID NO: 13154 - DNA, 25 bp, Mus musculus
caccttaccaggttgagtgggaggc

SEQ ID NO: 13155 - DNA, 25 bp, Mus musculus
caccttagctctggcttactggaac

SEQ ID NO: 13156 - DNA, 25 bp, Mus musculus
caccttattaggtcacagcagagtg

SEQ ID NO: 13157 - DNA, 25 bp, Mus musculus
caccttatttcgagctgtgaatccc

SEQ ID NO: 13158 - DNA, 25 bp, Mus musculus
caccttcaaggccaagttcacgcag

SEQ ID NO: 13159 - DNA, 25 bp, Mus musculus
caccttcagagggagtgttctggag

SEQ ID NO: 13160 - DNA, 25 bp, Mus musculus
caccttcagtgcttaggagtcataa

SEQ ID NO: 13161 - DNA, 25 bp, Mus musculus
caccttcatgagtggattgatctga

SEQ ID NO: 13162 - DNA, 25 bp, Mus musculus
caccttcccttacatgtgagttttc

SEQ ID NO: 13163 - DNA, 25 bp, Mus musculus
caccttccgtggaacaggcgtccgt

SEQ ID NO: 13164 - DNA, 25 bp, Mus musculus
caccttccgtgggtttactcagctg

SEQ ID NO: 13165 - DNA, 25 bp, Mus musculus
caccttccgtggtacaggcgtccgt

SEQ ID NO: 13166 - DNA, 25 bp, Mus musculus
caccttcctgactacgctcattatt

SEQ ID NO: 13167 - DNA, 25 bp, Mus musculus
caccttcgcctgcatcaggattgag

SEQ ID NO: 13168 - DNA, 25 bp, Mus musculus
caccttctgaccatgaagaaagacg

SEQ ID NO: 13169 - DNA, 25 bp, Mus musculus
caccttgagggccttcgcttgagct

SEQ ID NO: 13170 - DNA, 25 bp, Mus musculus
caccttgatgacaccttgatgataa

SEQ ID NO: 13171 - DNA, 25 bp, Mus musculus
caccttggcacatcgaccttttgta

SEQ ID NO: 13172 - DNA, 25 bp, Mus musculus
caccttgggtccgaaatccagaact

SEQ ID NO: 13173 - DNA, 25 bp, Mus musculus
cacctttactctgtgtgatgtgtca

SEQ ID NO: 13174 - DNA, 25 bp, Mus musculus
cacctttatgggaatggcagtggaa

SEQ ID NO: 13175 - DNA, 25 bp, Mus musculus
cacctttgaagaacttggagctctt

SEQ ID NO: 13176 - DNA, 25 bp, Mus musculus
cacctttgacacatacattgggcag

SEQ ID NO: 13177 - DNA, 25 bp, Mus musculus
cacctttgagtgcaacatatgcctg

SEQ ID NO: 13178 - DNA, 25 bp, Mus musculus
cacctttgcctgagtctcccttggg

SEQ ID NO: 13179 - DNA, 25 bp, Mus musculus
cacctttggagaggctctgaagcag

SEQ ID NO: 13180 - DNA, 25 bp, Mus musculus
cacctttggattcatctcggagcac

SEQ ID NO: 13181 - DNA, 25 bp, Mus musculus
caccttttcagaacagactctgatg

SEQ ID NO: 13182 - DNA, 25 bp, Mus musculus
cacgaaaaatattgtaggcatgccg

SEQ ID NO: 13183 - DNA, 25 bp, Mus musculus
cacgaaaagtgcttcggcacaacgc

SEQ ID NO: 13184 - DNA, 25 bp, Mus musculus
cacgaaacaatgaatcagaaaagcc

SEQ ID NO: 13185 - DNA, 25 bp, Mus musculus
cacgaaacttccaggactttgactg

SEQ ID NO: 13186 - DNA, 25 bp, Mus musculus
cacgaaaggcttgtggcaggctcct

SEQ ID NO: 13187 - DNA, 25 bp, Mus musculus
cacgaaatgctagtggctatcagaa

SEQ ID NO: 13188 - DNA, 25 bp, Mus musculus
cacgaacgagctggagggaatctgc

SEQ ID NO: 13189 - DNA, 25 bp, Mus musculus
cacgaactgtctaacacggactggt

SEQ ID NO: 13190 - DNA, 25 bp, Mus musculus
cacgaagactatcctggccaacggt

SEQ ID NO: 13191 - DNA, 25 bp, Mus musculus
cacgaagactggtttattaacaaga

SEQ ID NO: 13192 - DNA, 25 bp, Mus musculus
cacgaagggaaaagtgcgcctccca

SEQ ID NO: 13193 - DNA, 25 bp, Mus musculus
cacgaagtaggttttggatgcaagg

SEQ ID NO: 13194 - DNA, 25 bp, Mus musculus
cacgaagtcggctatgtgattcctt

SEQ ID NO: 13195 - DNA, 25 bp, Mus musculus
cacgaatatctggatggagacaagc

SEQ ID NO: 13196 - DNA, 25 bp, Mus musculus
cacgaatgtcactgtgacaaggcca

SEQ ID NO: 13197 - DNA, 25 bp, Mus musculus
cacgacacactgaagcagcggcggc

SEQ ID NO: 13198 - DNA, 25 bp, Mus musculus
cacgacaggcgactgcagtacactg

SEQ ID NO: 13199 - DNA, 25 bp, Mus musculus
cacgacattggcactgagatgatca

SEQ ID NO: 13200 - DNA, 25 bp, Mus musculus
cacgacccaccgtgatgaactgtac

SEQ ID NO: 13201 - DNA, 25 bp, Mus musculus
cacgaccctccgaggatgggacaca

SEQ ID NO: 13202 - DNA, 25 bp, Mus musculus
cacgacctggtggttatctgcatat

SEQ ID NO: 13203 - DNA, 25 bp, Mus musculus
cacgactctggctgcttccagatgc

SEQ ID NO: 13204 - DNA, 25 bp, Mus musculus
cacgagaacgaagttcttcgtcacc

SEQ ID NO: 13205 - DNA, 25 bp, Mus musculus
cacgagccctacctcaagaactggg

SEQ ID NO: 13206 - DNA, 25 bp, Mus musculus
cacgaggatgcccatagaagcctgg

SEQ ID NO: 13207 - DNA, 25 bp, Mus musculus
cacgagggtcatgaagatgatggcc

SEQ ID NO: 13208 - DNA, 25 bp, Mus musculus
cacgagtctatgagctgacaagcaa

SEQ ID NO: 13209 - DNA, 25 bp, Mus musculus
cacgagtgtggatctgaagaagagt

SEQ ID NO: 13210 - DNA, 25 bp, Mus musculus
cacgatatggtcatgggtgtgcccg

SEQ ID NO: 13211 - DNA, 25 bp, Mus musculus
cacgatccaaatctcggtctcggac

SEQ ID NO: 13212 - DNA, 25 bp, Mus musculus
cacgatccacactagttatgggaat

SEQ ID NO: 13213 - DNA, 25 bp, Mus musculus
cacgatgccagcctccagaagaggg

SEQ ID NO: 13214 - DNA, 25 bp, Mus musculus
cacgatggagcttcgagagtatcac

SEQ ID NO: 13215 - DNA, 25 bp, Mus musculus
cacgatgggcagtttacagtcattc

SEQ ID NO: 13216 - DNA, 25 bp, Mus musculus
cacgattcgtcattccattcgagga

SEQ ID NO: 13217 - DNA, 25 bp, Mus musculus
cacgatttcacctttggatgggaaa

SEQ ID NO: 13218 - DNA, 25 bp, Mus musculus
cacgcaaagagcctaaagctgaagc

SEQ ID NO: 13219 - DNA, 25 bp, Mus musculus
cacgcaacgggaagaggtcaacaag

SEQ ID NO: 13220 - DNA, 25 bp, Mus musculus
cacgcaagaccaacttgcagttctg

SEQ ID NO: 13221 - DNA, 25 bp, Mus musculus
cacgcacacgtgaggaagcttctgt

SEQ ID NO: 13222 - DNA, 25 bp, Mus musculus
cacgcagactgtatacaggagctta

SEQ ID NO: 13223 - DNA, 25 bp, Mus musculus
cacgcagaggaaggcggtggtcctc

SEQ ID NO: 13224 - DNA, 25 bp, Mus musculus
cacgcagatcttcttctcactgggc

SEQ ID NO: 13225 - DNA, 25 bp, Mus musculus
cacgcagctcacacagaagctgctg

SEQ ID NO: 13226 - DNA, 25 bp, Mus musculus
cacgcagctctgtgactggtggagc

SEQ ID NO: 13227 - DNA, 25 bp, Mus musculus
cacgcagggattggacacgctatgg

SEQ ID NO: 13228 - DNA, 25 bp, Mus musculus
cacgccaaggtattaccctggcggt

SEQ ID NO: 13229 - DNA, 25 bp, Mus musculus
cacgccatcacagtgtctgttgcaa

SEQ ID NO: 13230 - DNA, 25 bp, Mus musculus
cacgccatgactatatcttggcaac

SEQ ID NO: 13231 - DNA, 25 bp, Mus musculus
cacgccattgtctctgtgaacggca

SEQ ID NO: 13232 - DNA, 25 bp, Mus musculus
cacgcctacggcaaggccgggaaga

SEQ ID NO: 13233 - DNA, 25 bp, Mus musculus
cacgcctcattgctcatgctggcag

SEQ ID NO: 13234 - DNA, 25 bp, Mus musculus
cacgcctctggctgtagtcactctg

SEQ ID NO: 13235 - DNA, 25 bp, Mus musculus
cacgcctggagcaggcccttggaga

SEQ ID NO: 13236 - DNA, 25 bp, Mus musculus
cacgcctggagctggcccttggaga

SEQ ID NO: 13237 - DNA, 25 bp, Mus musculus
cacgcctggtgtttcatactctgac

SEQ ID NO: 13238 - DNA, 25 bp, Mus musculus
cacgccttggactcaggcgatgctt

SEQ ID NO: 13239 - DNA, 25 bp, Mus musculus
cacgcctttgttggcgattactcgg

SEQ ID NO: 13240 - DNA, 25 bp, Mus musculus
cacgcgctcccttgatgatcttgag

SEQ ID NO: 13241 - DNA, 25 bp, Mus musculus
cacgcggacaccagagacctcaggg

SEQ ID NO: 13242 - DNA, 25 bp, Mus musculus
cacgcgggtctgctgttaaaaggtt

SEQ ID NO: 13243 - DNA, 25 bp, Mus musculus
cacgctacactctgtggttctgcat

SEQ ID NO: 13244 - DNA, 25 bp, Mus musculus
cacgctatggtaaacaaactgcatt

SEQ ID NO: 13245 - DNA, 25 bp, Mus musculus
cacgctattgcagttatttgggctt

SEQ ID NO: 13246 - DNA, 25 bp, Mus musculus
cacgctcacggtggaatatccatgg

SEQ ID NO: 13247 - DNA, 25 bp, Mus musculus
cacgctcagcttgtgagggatctgc

SEQ ID NO: 13248 - DNA, 25 bp, Mus musculus
cacgctcatcagtatgtggccagag

SEQ ID NO: 13249 - DNA, 25 bp, Mus musculus
cacgctcatggaggaagtggcttat

SEQ ID NO: 13250 - DNA, 25 bp, Mus musculus
cacgctgaacaaacaggtgaacttc

SEQ ID NO: 13251 - DNA, 25 bp, Mus musculus
cacgctgaacgaaagggacacggag

SEQ ID NO: 13252 - DNA, 25 bp, Mus musculus
cacgctgaggccaaccagcagcaga

SEQ ID NO: 13253 - DNA, 25 bp, Mus musculus
cacgctgctcacacagagacattgt

SEQ ID NO: 13254 - DNA, 25 bp, Mus musculus
cacgctggatcctgacgaggttcca

SEQ ID NO: 13255 - DNA, 25 bp, Mus musculus
cacgctgggtacagaagccatcatc

SEQ ID NO: 13256 - DNA, 25 bp, Mus musculus
cacgctgtggatagtcctcatcctg

SEQ ID NO: 13257 - DNA, 25 bp, Mus musculus
cacgcttccgagtctggttcaactt

SEQ ID NO: 13258 - DNA, 25 bp, Mus musculus
cacggaaacttcctagggtgcaggc

SEQ ID NO: 13259 - DNA, 25 bp, Mus musculus
cacggaaagagaaaattaggccctg

SEQ ID NO: 13260 - DNA, 25 bp, Mus musculus
cacggaaagcctgaactggtttgga

SEQ ID NO: 13261 - DNA, 25 bp, Mus musculus
cacggaaatgacacagcaggacaca

SEQ ID NO: 13262 - DNA, 25 bp, Mus musculus
cacggaagccatccagtgcagctgt

SEQ ID NO: 13263 - DNA, 25 bp, Mus musculus
cacggaagtgctgttctttggccaa

SEQ ID NO: 13264 - DNA, 25 bp, Mus musculus
cacggaccaggcagacattgagaac

SEQ ID NO: 13265 - DNA, 25 bp, Mus musculus
cacggactatttgaaatggctcttc

SEQ ID NO: 13266 - DNA, 25 bp, Mus musculus
cacggacttctactcttctcggcag

SEQ ID NO: 13267 - DNA, 25 bp, Mus musculus
cacggagaaggaagccctgctaagg

SEQ ID NO: 13268 - DNA, 25 bp, Mus musculus
cacggagaccgactccttggtgtct

SEQ ID NO: 13269 - DNA, 25 bp, Mus musculus
cacggagacggcttggcaatctggt

SEQ ID NO: 13270 - DNA, 25 bp, Mus musculus
cacggagagcttttgacgtcagggc

SEQ ID NO: 13271 - DNA, 25 bp, Mus musculus
cacggagatcccagaaggaattaca

SEQ ID NO: 13272 - DNA, 25 bp, Mus musculus
cacggagcaatacagtgacatcggg

SEQ ID NO: 13273 - DNA, 25 bp, Mus musculus
cacggaggacgatcgcccggcagac

SEQ ID NO: 13274 - DNA, 25 bp, Mus musculus
cacggaggctcaggtgcccttttta

SEQ ID NO: 13275 - DNA, 25 bp, Mus musculus
cacggagggtcgattgtcaatatca

SEQ ID NO: 13276 - DNA, 25 bp, Mus musculus
cacggaggtatagctaccatttttc

SEQ ID NO: 13277 - DNA, 25 bp, Mus musculus
cacggagtatcagagcattctggct

SEQ ID NO: 13278 - DNA, 25 bp, Mus musculus
cacggatcagctggatggagagaca

SEQ ID NO: 13279 - DNA, 25 bp, Mus musculus
cacggatcattgagcgtctcttaaa

SEQ ID NO: 13280 - DNA, 25 bp, Mus musculus
cacggatccggccactgtgtacagt

SEQ ID NO: 13281 - DNA, 25 bp, Mus musculus
cacggatgagttttctaaacttggg

SEQ ID NO: 13282 - DNA, 25 bp, Mus musculus
cacggatgctctctatattgtgtcg

SEQ ID NO: 13283 - DNA, 25 bp, Mus musculus
cacggatggtgagaaatatggataa

SEQ ID NO: 13284 - DNA, 25 bp, Mus musculus
cacggattagtcaaccttaggaagt

SEQ ID NO: 13285 - DNA, 25 bp, Mus musculus
cacggattccaaagatggtcatcaa

SEQ ID NO: 13286 - DNA, 25 bp, Mus musculus
cacggcaactcacgcacagtcaaat

SEQ ID NO: 13287 - DNA, 25 bp, Mus musculus
cacggcaagtagctgctcgtctcca

SEQ ID NO: 13288 - DNA, 25 bp, Mus musculus
cacggcacatccaacagaaactggc

SEQ ID NO: 13289 - DNA, 25 bp, Mus musculus
cacggcatacaggtgctccctgagt

SEQ ID NO: 13290 - DNA, 25 bp, Mus musculus
cacggcatggatgacctcattggag

SEQ ID NO: 13291 - DNA, 25 bp, Mus musculus
cacggccaagggaagaagaatctgc

SEQ ID NO: 13292 - DNA, 25 bp, Mus musculus
cacggccttcgggaagccccttgtg

SEQ ID NO: 13293 - DNA, 25 bp, Mus musculus
cacggcggccactgggtttagtgct

SEQ ID NO: 13294 - DNA, 25 bp, Mus musculus
cacggctctgagcttattctctcca

SEQ ID NO: 13295 - DNA, 25 bp, Mus musculus
cacggctctgaggttattctctcca

SEQ ID NO: 13296 - DNA, 25 bp, Mus musculus
cacggcttccccagattatctggag

SEQ ID NO: 13297 - DNA, 25 bp, Mus musculus
cacggcttggagtgttccgcgcaga

SEQ ID NO: 13298 - DNA, 25 bp, Mus musculus
cacgggaaaagcttgccccatgcct

SEQ ID NO: 13299 - DNA, 25 bp, Mus musculus
cacgggaatcctggagcagtgtagc

SEQ ID NO: 13300 - DNA, 25 bp, Mus musculus
cacgggaccttgctaatcatggaag

SEQ ID NO: 13301 - DNA, 25 bp, Mus musculus
cacgggagattttgctctggtgaaa

SEQ ID NO: 13302 - DNA, 25 bp, Mus musculus
cacgggagctttgtcaataagccca

SEQ ID NO: 13303 - DNA, 25 bp, Mus musculus
cacgggatgacctgttcaacaccaa

SEQ ID NO: 13304 - DNA, 25 bp, Mus musculus
cacgggccctctggaattcgagaga

SEQ ID NO: 13305 - DNA, 25 bp, Mus musculus
cacgggctgggatcgatgacatatc

SEQ ID NO: 13306 - DNA, 25 bp, Mus musculus
cacgggtggattcaggcaaccctac

SEQ ID NO: 13307 - DNA, 25 bp, Mus musculus
cacgggtttctcacaggattcctct

SEQ ID NO: 13308 - DNA, 25 bp, Mus musculus
cacggtacctgcagacaattgtcca

SEQ ID NO: 13309 - DNA, 25 bp, Mus musculus
cacggtagtgggtgacctgttctct

SEQ ID NO: 13310 - DNA, 25 bp, Mus musculus
cacggtatcttccagtcaattggct

SEQ ID NO: 13311 - DNA, 25 bp, Mus musculus
cacggtcaccaccaaggttcggagg

SEQ ID NO: 13312 - DNA, 25 bp, Mus musculus
cacggtcaccactgaagacgtgaag

SEQ ID NO: 13313 - DNA, 25 bp, Mus musculus
cacggtcagaactattgctatggat

SEQ ID NO: 13314 - DNA, 25 bp, Mus musculus
cacggtcgagaaggacaaggtgacc

SEQ ID NO: 13315 - DNA, 25 bp, Mus musculus
cacggtctggaagcaacccgggaag

SEQ ID NO: 13316 - DNA, 25 bp, Mus musculus
cacggtctttgacaacgggcagaac

SEQ ID NO: 13317 - DNA, 25 bp, Mus musculus
cacggtgcgcttttggcaggctcac

SEQ ID NO: 13318 - DNA, 25 bp, Mus musculus
cacggtggaatatccatggaggtac

SEQ ID NO: 13319 - DNA, 25 bp, Mus musculus
cacggtggatcagtatggagaagtc

SEQ ID NO: 13320 - DNA, 25 bp, Mus musculus
cacggtggcttctgtcccaaggaag

SEQ ID NO: 13321 - DNA, 25 bp, Mus musculus
cacggtgtatgcagtgagaagcttc

SEQ ID NO: 13322 - DNA, 25 bp, Mus musculus
cacggtgtatgctgtgagaagcttc

SEQ ID NO: 13323 - DNA, 25 bp, Mus musculus
cacggtgtgcgttttgctcttccac

SEQ ID NO: 13324 - DNA, 25 bp, Mus musculus
cacggttgccccagctgggcactgt

SEQ ID NO: 13325 - DNA, 25 bp, Mus musculus
cacggttgtagctatggatcggtac

SEQ ID NO: 13326 - DNA, 25 bp, Mus musculus
cacgtaacaccttttgaccacaaca

SEQ ID NO: 13327 - DNA, 25 bp, Mus musculus
cacgtaatatgcaccagtgtgtcca

SEQ ID NO: 13328 - DNA, 25 bp, Mus musculus
cacgtacagctagtcaatgagaaac

SEQ ID NO: 13329 - DNA, 25 bp, Mus musculus
cacgtaccaaatgaaatgctctatg

SEQ ID NO: 13330 - DNA, 25 bp, Mus musculus
cacgtagctgctgatcttggaaatg

SEQ ID NO: 13331 - DNA, 25 bp, Mus musculus
cacgtcaacacaaagtggctaggct

SEQ ID NO: 13332 - DNA, 25 bp, Mus musculus
cacgtcaatgtgaaccccaacttct

SEQ ID NO: 13333 - DNA, 25 bp, Mus musculus
cacgtcagccgaacagagacttcag

SEQ ID NO: 13334 - DNA, 25 bp, Mus musculus
cacgtccaacagtggtgtgttctcc

SEQ ID NO: 13335 - DNA, 25 bp, Mus musculus
cacgtccatggtgcttcgtctggag

SEQ ID NO: 13336 - DNA, 25 bp, Mus musculus
cacgtcccagcagtttgaagcagaa

SEQ ID NO: 13337 - DNA, 25 bp, Mus musculus
cacgtcccagggagaacgtatgcag

SEQ ID NO: 13338 - DNA, 25 bp, Mus musculus
cacgtcggctgggatgctctagcag

SEQ ID NO: 13339 - DNA, 25 bp, Mus musculus
cacgtctgactctacatttgtagta

SEQ ID NO: 13340 - DNA, 25 bp, Mus musculus
cacgtctgtccgtagcctgctgagg

SEQ ID NO: 13341 - DNA, 25 bp, Mus musculus
cacgtgacaaaagtgcagactcttc

SEQ ID NO: 13342 - DNA, 25 bp, Mus musculus
cacgtgactcgttgtttctggagaa

SEQ ID NO: 13343 - DNA, 25 bp, Mus musculus
cacgtgcaagctgataagaaatgcc

SEQ ID NO: 13344 - DNA, 25 bp, Mus musculus
cacgtgcggagtaaatgttgagtgt

SEQ ID NO: 13345 - DNA, 25 bp, Mus musculus
cacgtgctaacagcagcataggaca

SEQ ID NO: 13346 - DNA, 25 bp, Mus musculus
cacgtgctcaagaagaaaggctacc

SEQ ID NO: 13347 - DNA, 25 bp, Mus musculus
cacgtgctgtctctagggctcctca

SEQ ID NO: 13348 - DNA, 25 bp, Mus musculus
cacgtggaaggcagtcaggaaatgc

SEQ ID NO: 13349 - DNA, 25 bp, Mus musculus
cacgtggacatctcactcactcagt

SEQ ID NO: 13350 - DNA, 25 bp, Mus musculus
cacgtggacatggtgtcgctgctcc

SEQ ID NO: 13351 - DNA, 25 bp, Mus musculus
cacgtggagatatggaagaggacca

SEQ ID NO: 13352 - DNA, 25 bp, Mus musculus
cacgtggagcccttggtgattagct

SEQ ID NO: 13353 - DNA, 25 bp, Mus musculus
cacgtggccaagatccagagtgaca

SEQ ID NO: 13354 - DNA, 25 bp, Mus musculus
cacgtggccattgcagtagagggac

SEQ ID NO: 13355 - DNA, 25 bp, Mus musculus
cacgtggcccaggagggcaagcata

SEQ ID NO: 13356 - DNA, 25 bp, Mus musculus
cacgtggctcggtggttcaggcaca

SEQ ID NO: 13357 - DNA, 25 bp, Mus musculus
cacgtgggataagcatgtttatggg

SEQ ID NO: 13358 - DNA, 25 bp, Mus musculus
cacgtgggtgacctaccccaagctt

SEQ ID NO: 13359 - DNA, 25 bp, Mus musculus
cacgtggtactgaccgatttcggcc

SEQ ID NO: 13360 - DNA, 25 bp, Mus musculus
cacgtggttgacacaaaaactgctc

SEQ ID NO: 13361 - DNA, 25 bp, Mus musculus
cacgtgtatttcctgcagcagtggc

SEQ ID NO: 13362 - DNA, 25 bp, Mus musculus
cacgtgtccatgtggcctgcacatc

SEQ ID NO: 13363 - DNA, 25 bp, Mus musculus
cacgtgtgaggctgtgatgactcta

SEQ ID NO: 13364 - DNA, 25 bp, Mus musculus
cacgtgtgcgcagaagcattggcag

SEQ ID NO: 13365 - DNA, 25 bp, Mus musculus
cacgtgttctctggttgtcttggat

SEQ ID NO: 13366 - DNA, 25 bp, Mus musculus
cacgttacaacaaaccactgcaaag

SEQ ID NO: 13367 - DNA, 25 bp, Mus musculus
cacgttcaatatttgatggtttccg

SEQ ID NO: 13368 - DNA, 25 bp, Mus musculus
cacgttcatcgtgctgattagaaga

SEQ ID NO: 13369 - DNA, 25 bp, Mus musculus
cacgttcttgaactccggcagcacg

SEQ ID NO: 13370 - DNA, 25 bp, Mus musculus
cacgttgccttgtggaggaacttag

SEQ ID NO: 13371 - DNA, 25 bp, Mus musculus
cacgttgctgttaaaccgagcggct

SEQ ID NO: 13372 - DNA, 25 bp, Mus musculus
cacgttgtcataataaacacaagac

SEQ ID NO: 13373 - DNA, 25 bp, Mus musculus
cacgtttccgaagatgatgggctca

SEQ ID NO: 13374 - DNA, 25 bp, Mus musculus
cacgtttgcatagcgtaagctcttc

SEQ ID NO: 13375 - DNA, 25 bp, Mus musculus
cacgtttgttgtggaaaagaagcac

SEQ ID NO: 13376 - DNA, 25 bp, Mus musculus
cacgttttagccattcaagggaaga

SEQ ID NO: 13377 - DNA, 25 bp, Mus musculus
cactaaaaacttatctcctgacaaa

SEQ ID NO: 13378 - DNA, 25 bp, Mus musculus
cactaaagagcaacagaggcagaga

SEQ ID NO: 13379 - DNA, 25 bp, Mus musculus
cactaaagtttgcagctcaatggat

SEQ ID NO: 13380 - DNA, 25 bp, Mus musculus
cactaaatagtacagctacgtcctc

SEQ ID NO: 13381 - DNA, 25 bp, Mus musculus
cactaacaatgtagtacgctgtgac

SEQ ID NO: 13382 - DNA, 25 bp, Mus musculus
cactaacaatgttgtacgctgtgac

SEQ ID NO: 13383 - DNA, 25 bp, Mus musculus
cactaaccagatatgtacctccaag

SEQ ID NO: 13384 - DNA, 25 bp, Mus musculus
cactaaccagatttgtacctccaag

SEQ ID NO: 13385 - DNA, 25 bp, Mus musculus
cactaacctcttattcagaatgtcc

SEQ ID NO: 13386 - DNA, 25 bp, Mus musculus
cactaactacgagagccggaaggga

SEQ ID NO: 13387 - DNA, 25 bp, Mus musculus
cactaactgtatggaagtgatgacg

SEQ ID NO: 13388 - DNA, 25 bp, Mus musculus
cactaacttggtacgatacagacag

SEQ ID NO: 13389 - DNA, 25 bp, Mus musculus
cactaagcagatgatgagtagcttc

SEQ ID NO: 13390 - DNA, 25 bp, Mus musculus
cactaagcagtatggcctgggaaca

SEQ ID NO: 13391 - DNA, 25 bp, Mus musculus
cactaaggagctgttgttaactagc

SEQ ID NO: 13392 - DNA, 25 bp, Mus musculus
cactaatacagatattcatggtaga

SEQ ID NO: 13393 - DNA, 25 bp, Mus musculus
cactaatagtgtagtcactgaggaa

SEQ ID NO: 13394 - DNA, 25 bp, Mus musculus
cactaatccaggaggcttgttttgt

SEQ ID NO: 13395 - DNA, 25 bp, Mus musculus
cactaatccaggtggcttgttttgt

SEQ ID NO: 13396 - DNA, 25 bp, Mus musculus
cactaatgaaggaaaatctacgtct

SEQ ID NO: 13397 - DNA, 25 bp, Mus musculus
cactacaatggattgaagcagtcaa

SEQ ID NO: 13398 - DNA, 25 bp, Mus musculus
cactacagaggagagaccgtgaaag

SEQ ID NO: 13399 - DNA, 25 bp, Mus musculus
cactacagccagtggaatttcctgg

SEQ ID NO: 13400 - DNA, 25 bp, Mus musculus
cactacagtattgcttccatcctga

SEQ ID NO: 13401 - DNA, 25 bp, Mus musculus
cactaccaacacagttatagcaaag

SEQ ID NO: 13402 - DNA, 25 bp, Mus musculus
cactaccaacactgttatagcaaag

SEQ ID NO: 13403 - DNA, 25 bp, Mus musculus
cactaccgctgctgatgtccagagg

SEQ ID NO: 13404 - DNA, 25 bp, Mus musculus
cactacctcaccaagcaggatgtgg

SEQ ID NO: 13405 - DNA, 25 bp, Mus musculus
cactacgaaggtttcctctggatgc

SEQ ID NO: 13406 - DNA, 25 bp, Mus musculus
cactacggagtatgtgtagcctcag

SEQ ID NO: 13407 - DNA, 25 bp, Mus musculus
cactacgtaggccaggctggcatca

SEQ ID NO: 13408 - DNA, 25 bp, Mus musculus
cactacgtgcaaaaggtatataaag

SEQ ID NO: 13409 - DNA, 25 bp, Mus musculus
cactactactctacagtcagcacaa

SEQ ID NO: 13410 - DNA, 25 bp, Mus musculus
cactactcaggcctacgagggcagt

SEQ ID NO: 13411 - DNA, 25 bp, Mus musculus
cactacttgtggatgttgaacctaa

SEQ ID NO: 13412 - DNA, 25 bp, Mus musculus
cactagaaacatatcttcgaaagca

SEQ ID NO: 13413 - DNA, 25 bp, Mus musculus
cactagaacaagaacggcgccatgt

SEQ ID NO: 13414 - DNA, 25 bp, Mus musculus
cactagaagacgatggagtctggta

SEQ ID NO: 13415 - DNA, 25 bp, Mus musculus
cactagacaccctagaagtcaggag

SEQ ID NO: 13416 - DNA, 25 bp, Mus musculus
cactagactcttcaccagtgatggc

SEQ ID NO: 13417 - DNA, 25 bp, Mus musculus
cactagagggcagcactgtgagtta

SEQ ID NO: 13418 - DNA, 25 bp, Mus musculus
cactagagtatgattttggaagcca

SEQ ID NO: 13419 - DNA, 25 bp, Mus musculus
cactagagtgtaatgaccctgccaa

SEQ ID NO: 13420 - DNA, 25 bp, Mus musculus
cactagggaacagagaagagtgaga

SEQ ID NO: 13421 - DNA, 25 bp, Mus musculus
cactagttaagatttgagatggata

SEQ ID NO: 13422 - DNA, 25 bp, Mus musculus
cactagtttggcttacgaaattcac

SEQ ID NO: 13423 - DNA, 25 bp, Mus musculus
cactatatcgaagagagtactggcg

SEQ ID NO: 13424 - DNA, 25 bp, Mus musculus
cactatcagtgacccctgaggagtg

SEQ ID NO: 13425 - DNA, 25 bp, Mus musculus
cactatcgtgataactttggaggag

SEQ ID NO: 13426 - DNA, 25 bp, Mus musculus
cactatcgttgttcacatggccagt

SEQ ID NO: 13427 - DNA, 25 bp, Mus musculus
cactatctaacagcagcccattggg

SEQ ID NO: 13428 - DNA, 25 bp, Mus musculus
cactatcttcggtaactctgctgga

SEQ ID NO: 13429 - DNA, 25 bp, Mus musculus
cactatgagagacatctggaggcga

SEQ ID NO: 13430 - DNA, 25 bp, Mus musculus
cactatgagtctcttcaaaccgcca

SEQ ID NO: 13431 - DNA, 25 bp, Mus musculus
cactatggatgattttgaacgtcgc

SEQ ID NO: 13432 - DNA, 25 bp, Mus musculus
cactatggcaggaaaagtaattacc

SEQ ID NO: 13433 - DNA, 25 bp, Mus musculus
cactatgtacgacatgcaggcactg

SEQ ID NO: 13434 - DNA, 25 bp, Mus musculus
cactatgttgacaggctatttgacc

SEQ ID NO: 13435 - DNA, 25 bp, Mus musculus
cactattaaatggatggtagatgcc

SEQ ID NO: 13436 - DNA, 25 bp, Mus musculus
cactattctcttgctcgatggctac

SEQ ID NO: 13437 - DNA, 25 bp, Mus musculus
cactcaagaatagagcaatacgcta

SEQ ID NO: 13438 - DNA, 25 bp, Mus musculus
cactcaagcaaaactagctctttta

SEQ ID NO: 13439 - DNA, 25 bp, Mus musculus
cactcaagggcaagtcagaggccaa

SEQ ID NO: 13440 - DNA, 25 bp, Mus musculus
cactcaatactttcagagcatgact

SEQ ID NO: 13441 - DNA, 25 bp, Mus musculus
cactcacactgagagctgtttaaaa

SEQ ID NO: 13442 - DNA, 25 bp, Mus musculus
cactcacagggatagcagatccttc

SEQ ID NO: 13443 - DNA, 25 bp, Mus musculus
cactcacaggtatttctatgtcggc

SEQ ID NO: 13444 - DNA, 25 bp, Mus musculus
cactcaccaatcatgagcattttgg

SEQ ID NO: 13445 - DNA, 25 bp, Mus musculus
cactcaccacagaccctgttgatgt

SEQ ID NO: 13446 - DNA, 25 bp, Mus musculus
cactcactcttaccacctgtggtgg

SEQ ID NO: 13447 - DNA, 25 bp, Mus musculus
cactcactctttggagatgtgaaga

SEQ ID NO: 13448 - DNA, 25 bp, Mus musculus
cactcagaagatcacgacgttggct

SEQ ID NO: 13449 - DNA, 25 bp, Mus musculus
cactcagagcccctgacagtgatgg

SEQ ID NO: 13450 - DNA, 25 bp, Mus musculus
cactcagaggacatgctgcatagag

SEQ ID NO: 13451 - DNA, 25 bp, Mus musculus
cactcagcatcatcgtgctctgcta

SEQ ID NO: 13452 - DNA, 25 bp, Mus musculus
cactcagcggagtccaagacaaggg

SEQ ID NO: 13453 - DNA, 25 bp, Mus musculus
cactcagctgttcttatcaatggag

SEQ ID NO: 13454 - DNA, 25 bp, Mus musculus
cactcaggaagtctcagacagcact

SEQ ID NO: 13455 - DNA, 25 bp, Mus musculus
cactcaggccttcgaggctgtctga

SEQ ID NO: 13456 - DNA, 25 bp, Mus musculus
cactcaggccttggaggctgtctga

SEQ ID NO: 13457 - DNA, 25 bp, Mus musculus
cactcagttgcgtgatgcaaagaac

SEQ ID NO: 13458 - DNA, 25 bp, Mus musculus
cactcatcaactatgtgtccttcat

SEQ ID NO: 13459 - DNA, 25 bp, Mus musculus
cactcatcagcttggaacctgggca

SEQ ID NO: 13460 - DNA, 25 bp, Mus musculus
cactcatctttgtgggcggcgtgcc

SEQ ID NO: 13461 - DNA, 25 bp, Mus musculus
cactcatgatggatttggagaagcc

SEQ ID NO: 13462 - DNA, 25 bp, Mus musculus
cactcatggccaagttggtggtcct

SEQ ID NO: 13463 - DNA, 25 bp, Mus musculus
cactcatggccatattggagcacag

SEQ ID NO: 13464 - DNA, 25 bp, Mus musculus
cactcatttctatggtggcaggaag

SEQ ID NO: 13465 - DNA, 25 bp, Mus musculus
cactcatttgagctcccaggtgaac

SEQ ID NO: 13466 - DNA, 25 bp, Mus musculus
cactcatttgaggtcccaggtgaac

SEQ ID NO: 13467 - DNA, 25 bp, Mus musculus
cactccaaggttgacttgaaaggtg

SEQ ID NO: 13468 - DNA, 25 bp, Mus musculus
cactccactgaggtgacagtcggac

SEQ ID NO: 13469 - DNA, 25 bp, Mus musculus
cactccagagattgagagagtcaaa

SEQ ID NO: 13470 - DNA, 25 bp, Mus musculus
cactccagggagcactgatgatata

SEQ ID NO: 13471 - DNA, 25 bp, Mus musculus
cactcccgaattctggacatcagca

SEQ ID NO: 13472 - DNA, 25 bp, Mus musculus
cactccgaaaggaaggagatggaaa

SEQ ID NO: 13473 - DNA, 25 bp, Mus musculus
cactccgttgttccccaggatagca

SEQ ID NO: 13474 - DNA, 25 bp, Mus musculus
cactcctaccatggcttggatagaa

SEQ ID NO: 13475 - DNA, 25 bp, Mus musculus
cactcctgaggtttggctctggcac

SEQ ID NO: 13476 - DNA, 25 bp, Mus musculus
cactcctgtgccgattataataatc

SEQ ID NO: 13477 - DNA, 25 bp, Mus musculus
cactccttcctgacagaggtgacag

SEQ ID NO: 13478 - DNA, 25 bp, Mus musculus
cactcgataagtatgcctgtcatga

SEQ ID NO: 13479 - DNA, 25 bp, Mus musculus
cactcgctggagatgactctggagc

SEQ ID NO: 13480 - DNA, 25 bp, Mus musculus
cactcgctttatcccagggttacag

SEQ ID NO: 13481 - DNA, 25 bp, Mus musculus
cactcggcaccatgggttggtggaa

SEQ ID NO: 13482 - DNA, 25 bp, Mus musculus
cactcggtttatcctgatagttcct

SEQ ID NO: 13483 - DNA, 25 bp, Mus musculus
cactcgttccagtcagaggtgctta

SEQ ID NO: 13484 - DNA, 25 bp, Mus musculus
cactctacaggtgatcagcttctag

SEQ ID NO: 13485 - DNA, 25 bp, Mus musculus
cactctatgctaaccggtgccacta

SEQ ID NO: 13486 - DNA, 25 bp, Mus musculus
cactctcaccatcaggctacttatg

SEQ ID NO: 13487 - DNA, 25 bp, Mus musculus
cactctcagacgacgctgcatctgt

SEQ ID NO: 13488 - DNA, 25 bp, Mus musculus
cactctccaagctttatctcatgtt

SEQ ID NO: 13489 - DNA, 25 bp, Mus musculus
cactctcgagcgcactctcgtggag

SEQ ID NO: 13490 - DNA, 25 bp, Mus musculus
cactctctggagtgctccctgacgg

SEQ ID NO: 13491 - DNA, 25 bp, Mus musculus
cactctcttcccagatatacttaga

SEQ ID NO: 13492 - DNA, 25 bp, Mus musculus
cactctcttctgattctcctcaagg

SEQ ID NO: 13493 - DNA, 25 bp, Mus musculus
cactctgactgtagccaagtgctgg

SEQ ID NO: 13494 - DNA, 25 bp, Mus musculus
cactctgagctagagaagtatgaac

SEQ ID NO: 13495 - DNA, 25 bp, Mus musculus
cactctgaggccagatgagaaggcc

SEQ ID NO: 13496 - DNA, 25 bp, Mus musculus
cactctgatatctgcacacttccag

SEQ ID NO: 13497 - DNA, 25 bp, Mus musculus
cactctgatttggttcgtggcaggg

SEQ ID NO: 13498 - DNA, 25 bp, Mus musculus
cactctgctgaagacgcaacttaca

SEQ ID NO: 13499 - DNA, 25 bp, Mus musculus
cactctggtatatggagggatcttt

SEQ ID NO: 13500 - DNA, 25 bp, Mus musculus
cactctggtgaccatggccaaaaaa

SEQ ID NO: 13501 - DNA, 25 bp, Mus musculus
cactctggtggagtttctgcttgat

SEQ ID NO: 13502 - DNA, 25 bp, Mus musculus
cactctggtttccaggtgacagaca

SEQ ID NO: 13503 - DNA, 25 bp, Mus musculus
cactctgtgggcaagcactattgtt

SEQ ID NO: 13504 - DNA, 25 bp, Mus musculus
cactctgtggttaagaaggaagcca

SEQ ID NO: 13505 - DNA, 25 bp, Mus musculus
cactctgtggtttagaaggaagcca

SEQ ID NO: 13506 - DNA, 25 bp, Mus musculus
cactcttcagtttccatcatctaga

SEQ ID NO: 13507 - DNA, 25 bp, Mus musculus
cactcttccctagaattggagctga

SEQ ID NO: 13508 - DNA, 25 bp, Mus musculus
cactcttctggcatcggtggcttta

SEQ ID NO: 13509 - DNA, 25 bp, Mus musculus
cactcttgcaagatgtcagaactat

SEQ ID NO: 13510 - DNA, 25 bp, Mus musculus
cactctttgaagtctctcatgacca

SEQ ID NO: 13511 - DNA, 25 bp, Mus musculus
cactctttgggtctgaagctgggca

SEQ ID NO: 13512 - DNA, 25 bp, Mus musculus
cactgaaaatcgtgccgatgcctgg

SEQ ID NO: 13513 - DNA, 25 bp, Mus musculus
cactgaaagacgaagctgatgcgga

SEQ ID NO: 13514 - DNA, 25 bp, Mus musculus
cactgaaatttggtccagcacgtaa

SEQ ID NO: 13515 - DNA, 25 bp, Mus musculus
cactgaacaccaaatggagaatgag

SEQ ID NO: 13516 - DNA, 25 bp, Mus musculus
cactgaacagcaaccacacaggcta

SEQ ID NO: 13517 - DNA, 25 bp, Mus musculus
cactgaacccgttgatgacacatgc

SEQ ID NO: 13518 - DNA, 25 bp, Mus musculus
cactgaagacaatccgtcagtcgga

SEQ ID NO: 13519 - DNA, 25 bp, Mus musculus
cactgaagacgtgaagctcttagcc

SEQ ID NO: 13520 - DNA, 25 bp, Mus musculus
cactgaagactgatctagaatctga

SEQ ID NO: 13521 - DNA, 25 bp, Mus musculus
cactgaagcagagaaggactgagca

SEQ ID NO: 13522 - DNA, 25 bp, Mus musculus
cactgaagcgtctgtttgttgttaa

SEQ ID NO: 13523 - DNA, 25 bp, Mus musculus
cactgaaggtcgtgacggaggaaat

SEQ ID NO: 13524 - DNA, 25 bp, Mus musculus
cactgaagtcatccagggtatcaga

SEQ ID NO: 13525 - DNA, 25 bp, Mus musculus
cactgaagttttccctgagagcact

SEQ ID NO: 13526 - DNA, 25 bp, Mus musculus
cactgaatagtaatcacacaggcta

SEQ ID NO: 13527 - DNA, 25 bp, Mus musculus
cactgaattatttccaatgagaaag

SEQ ID NO: 13528 - DNA, 25 bp, Mus musculus
cactgacactgtgccgagagtgttt

SEQ ID NO: 13529 - DNA, 25 bp, Mus musculus
cactgacatgtatgatgctcatctc

SEQ ID NO: 13530 - DNA, 25 bp, Mus musculus
cactgaccagtggagtgaggcagct

SEQ ID NO: 13531 - DNA, 25 bp, Mus musculus
cactgaccctcaatgtcaagagtga

SEQ ID NO: 13532 - DNA, 25 bp, Mus musculus
cactgacgaggcctttgagttttac

SEQ ID NO: 13533 - DNA, 25 bp, Mus musculus
cactgactggaatttgatggcttcc

SEQ ID NO: 13534 - DNA, 25 bp, Mus musculus
cactgactggcgagaacgtcgaaga

SEQ ID NO: 13535 - DNA, 25 bp, Mus musculus
cactgactggcgtgaacgtcgaaga

SEQ ID NO: 13536 - DNA, 25 bp, Mus musculus
cactgacttctacaccggtggtgaa

SEQ ID NO: 13537 - DNA, 25 bp, Mus musculus
cactgactttgaattcaaggagctg

SEQ ID NO: 13538 - DNA, 25 bp, Mus musculus
cactgacttttactacgcccaggag

SEQ ID NO: 13539 - DNA, 25 bp, Mus musculus
cactgagaaaacgtcttttgtggaa

SEQ ID NO: 13540 - DNA, 25 bp, Mus musculus
cactgagactcaggggtcaggtatc

SEQ ID NO: 13541 - DNA, 25 bp, Mus musculus
cactgagactcattttaatcctgaa

SEQ ID NO: 13542 - DNA, 25 bp, Mus musculus
cactgagagctgtttaaaactacag

SEQ ID NO: 13543 - DNA, 25 bp, Mus musculus
cactgagataaagtctacttggtcg

SEQ ID NO: 13544 - DNA, 25 bp, Mus musculus
cactgagatcttgacgctggttgga

SEQ ID NO: 13545 - DNA, 25 bp, Mus musculus
cactgagcaaagaaatggtgacata

SEQ ID NO: 13546 - DNA, 25 bp, Mus musculus
cactgagcagaatgcaacacttgtg

SEQ ID NO: 13547 - DNA, 25 bp, Mus musculus
cactgagcttggaatctgaagtcac

SEQ ID NO: 13548 - DNA, 25 bp, Mus musculus
cactgaggaaaccagacgtgagtca

SEQ ID NO: 13549 - DNA, 25 bp, Mus musculus
cactgaggaaggtggaaagactcca

SEQ ID NO: 13550 - DNA, 25 bp, Mus musculus
cactgaggcaagctgcccagtcatg

SEQ ID NO: 13551 - DNA, 25 bp, Mus musculus
cactgaggccaaaaaacattgctgg

SEQ ID NO: 13552 - DNA, 25 bp, Mus musculus
cactgaggctgacgatgaagataat

SEQ ID NO: 13553 - DNA, 25 bp, Mus musculus
cactgagtacgtgtctccggcagac

SEQ ID NO: 13554 - DNA, 25 bp, Mus musculus
cactgagtgggttcagattgcccaa

SEQ ID NO: 13555 - DNA, 25 bp, Mus musculus
cactgatagaatagagaatttgaga

SEQ ID NO: 13556 - DNA, 25 bp, Mus musculus
cactgatccatcatctggccatttc

SEQ ID NO: 13557 - DNA, 25 bp, Mus musculus
cactgatccatcttctggccatttc

SEQ ID NO: 13558 - DNA, 25 bp, Mus musculus
cactgatgagaattggctgagcccc

SEQ ID NO: 13559 - DNA, 25 bp, Mus musculus
cactgatgagatcccagccaaaagg

SEQ ID NO: 13560 - DNA, 25 bp, Mus musculus
cactgatgatgtcaatgccataatc

SEQ ID NO: 13561 - DNA, 25 bp, Mus musculus
cactgatggaaagggcttacaaagc

SEQ ID NO: 13562 - DNA, 25 bp, Mus musculus
cactgatggaattggaaaagcatat

SEQ ID NO: 13563 - DNA, 25 bp, Mus musculus
cactgatggacatatagggatcttg

SEQ ID NO: 13564 - DNA, 25 bp, Mus musculus
cactgatggaggacactatgacgga

SEQ ID NO: 13565 - DNA, 25 bp, Mus musculus
cactgatgggacatgacgatgctgt

SEQ ID NO: 13566 - DNA, 25 bp, Mus musculus
cactgatgtacacagacactgtgca

SEQ ID NO: 13567 - DNA, 25 bp, Mus musculus
cactgcaaagaagcagctccagttt

SEQ ID NO: 13568 - DNA, 25 bp, Mus musculus
cactgcaaagactgattctgtgaat

SEQ ID NO: 13569 - DNA, 25 bp, Mus musculus
cactgcaaagagcacaagccatgtg

SEQ ID NO: 13570 - DNA, 25 bp, Mus musculus
cactgcaacatgacactgcttttct

SEQ ID NO: 13571 - DNA, 25 bp, Mus musculus
cactgcaatcatcccggcatgactg

SEQ ID NO: 13572 - DNA, 25 bp, Mus musculus
cactgcaatcattcaggcctaagga

SEQ ID NO: 13573 - DNA, 25 bp, Mus musculus
cactgcacaaagaaccttctctgac

SEQ ID NO: 13574 - DNA, 25 bp, Mus musculus
cactgcacacccgagtatcgtttga

SEQ ID NO: 13575 - DNA, 25 bp, Mus musculus
cactgcacacttccgtggccattga

SEQ ID NO: 13576 - DNA, 25 bp, Mus musculus
cactgcagcatgttccgattcctag

SEQ ID NO: 13577 - DNA, 25 bp, Mus musculus
cactgcagctgggtgacaaggtgtt

SEQ ID NO: 13578 - DNA, 25 bp, Mus musculus
cactgcaggctcgaggagctttccg

SEQ ID NO: 13579 - DNA, 25 bp, Mus musculus
cactgcaggctgagttcacgctgcc

SEQ ID NO: 13580 - DNA, 25 bp, Mus musculus
cactgcaggctgtgttcacgctgcc

SEQ ID NO: 13581 - DNA, 25 bp, Mus musculus
cactgcagtcctggctattccagag

SEQ ID NO: 13582 - DNA, 25 bp, Mus musculus
cactgcagtctggaggctactggtt

SEQ ID NO: 13583 - DNA, 25 bp, Mus musculus
cactgcatgaaagaggatgttcttg

SEQ ID NO: 13584 - DNA, 25 bp, Mus musculus
cactgcatgcagctctggagacaag

SEQ ID NO: 13585 - DNA, 25 bp, Mus musculus
cactgcatgtagcagcgcattacga

SEQ ID NO: 13586 - DNA, 25 bp, Mus musculus
cactgcattagagaaatttaaggga

SEQ ID NO: 13587 - DNA, 25 bp, Mus musculus
cactgcattcgggagcctctctgag

SEQ ID NO: 13588 - DNA, 25 bp, Mus musculus
cactgcattggacaatattcctgta

SEQ ID NO: 13589 - DNA, 25 bp, Mus musculus
cactgccaggagcagattgtcgccc

SEQ ID NO: 13590 - DNA, 25 bp, Mus musculus
cactgccattgaagcggatgatcca

SEQ ID NO: 13591 - DNA, 25 bp, Mus musculus
cactgccattgatgcggatgatcca

SEQ ID NO: 13592 - DNA, 25 bp, Mus musculus
cactgcccagtgtcatgcgtttctg

SEQ ID NO: 13593 - DNA, 25 bp, Mus musculus
cactgccccagcaatcaacaggaga

SEQ ID NO: 13594 - DNA, 25 bp, Mus musculus
cactgcctctatccgggtattctga

SEQ ID NO: 13595 - DNA, 25 bp, Mus musculus
cactgcctgataatcagttttccca

SEQ ID NO: 13596 - DNA, 25 bp, Mus musculus
cactgcctgtccatcttactggtgg

SEQ ID NO: 13597 - DNA, 25 bp, Mus musculus
cactgccttctgttcagttggagaa

SEQ ID NO: 13598 - DNA, 25 bp, Mus musculus
cactgcgagtgtaacgagcgatggc

SEQ ID NO: 13599 - DNA, 25 bp, Mus musculus
cactgcgcaatgagaagtacttagc

SEQ ID NO: 13600 - DNA, 25 bp, Mus musculus
cactgcggatcaaagctgcgaagag

SEQ ID NO: 13601 - DNA, 25 bp, Mus musculus
cactgcgtacattcaccaggtgacg

SEQ ID NO: 13602 - DNA, 25 bp, Mus musculus
cactgctaaagtgtgtagaagccga

SEQ ID NO: 13603 - DNA, 25 bp, Mus musculus
cactgctcttaagacaggtggacca

SEQ ID NO: 13604 - DNA, 25 bp, Mus musculus
cactgctgaaggctggctgcaacct

SEQ ID NO: 13605 - DNA, 25 bp, Mus musculus
cactgctgaggtctgtcctctgtga

SEQ ID NO: 13606 - DNA, 25 bp, Mus musculus
cactgctggacgacatgaccaagaa

SEQ ID NO: 13607 - DNA, 25 bp, Mus musculus
cactgctggtcgtgggcaacaagtc

SEQ ID NO: 13608 - DNA, 25 bp, Mus musculus
cactgctgtggtgagtgaacaaccc

SEQ ID NO: 13609 - DNA, 25 bp, Mus musculus
cactgcttaagcttctgtagttgga

SEQ ID NO: 13610 - DNA, 25 bp, Mus musculus
cactggaaagctccgaatgaggtcc

SEQ ID NO: 13611 - DNA, 25 bp, Mus musculus
cactggaaccattagtcactcctga

SEQ ID NO: 13612 - DNA, 25 bp, Mus musculus
cactggaatccaaagtataacacct

SEQ ID NO: 13613 - DNA, 25 bp, Mus musculus
cactggaatgcagatgggagcgcta

SEQ ID NO: 13614 - DNA, 25 bp, Mus musculus
cactggaatgtggagcagcttgtga

SEQ ID NO: 13615 - DNA, 25 bp, Mus musculus
cactggacacagttgaggtccctta

SEQ ID NO: 13616 - DNA, 25 bp, Mus musculus
cactggacagaagatgcctctgatt

SEQ ID NO: 13617 - DNA, 25 bp, Mus musculus
cactggacatggaagacctatcttc

SEQ ID NO: 13618 - DNA, 25 bp, Mus musculus
cactggacccagagaagctcggtca

SEQ ID NO: 13619 - DNA, 25 bp, Mus musculus
cactggaggaagcacaccctctcat

SEQ ID NO: 13620 - DNA, 25 bp, Mus musculus
cactggaggcagagacgttaatgaa

SEQ ID NO: 13621 - DNA, 25 bp, Mus musculus
cactggaggctcagaagtggagaat

SEQ ID NO: 13622 - DNA, 25 bp, Mus musculus
cactggatacgaactggagacaatg

SEQ ID NO: 13623 - DNA, 25 bp, Mus musculus
cactggatcaggtgctaggccgctt

SEQ ID NO: 13624 - DNA, 25 bp, Mus musculus
cactggatcttctgatggaaaatgg

SEQ ID NO: 13625 - DNA, 25 bp, Mus musculus
cactggatggcttcaggcgatcttc

SEQ ID NO: 13626 - DNA, 25 bp, Mus musculus
cactggattgccaacaacctgtttg

SEQ ID NO: 13627 - DNA, 25 bp, Mus musculus
cactggatttacacaaggcaagatc

SEQ ID NO: 13628 - DNA, 25 bp, Mus musculus
cactggatttactcaaggcaagatc

SEQ ID NO: 13629 - DNA, 25 bp, Mus musculus
cactggatttattcagaagctctcc

SEQ ID NO: 13630 - DNA, 25 bp, Mus musculus
cactggcacactgattgaggacctc

SEQ ID NO: 13631 - DNA, 25 bp, Mus musculus
cactggcagactatgtggtcaacac

SEQ ID NO: 13632 - DNA, 25 bp, Mus musculus
cactggcagcatatttaacattgcg

SEQ ID NO: 13633 - DNA, 25 bp, Mus musculus
cactggcatagttggagacaaagga

SEQ ID NO: 13634 - DNA, 25 bp, Mus musculus
cactggccaccatggataagcacgc

SEQ ID NO: 13635 - DNA, 25 bp, Mus musculus
cactggccacgacaagtgtgtgagc

SEQ ID NO: 13636 - DNA, 25 bp, Mus musculus
cactggcctagggtaggactacagc

SEQ ID NO: 13637 - DNA, 25 bp, Mus musculus
cactggcgacagagataagcctcga

SEQ ID NO: 13638 - DNA, 25 bp, Mus musculus
cactggctaatcaagagtgaaaaac

SEQ ID NO: 13639 - DNA, 25 bp, Mus musculus
cactggctacccacagacggaaggc

SEQ ID NO: 13640 - DNA, 25 bp, Mus musculus
cactggctgctggatctcatcacag

SEQ ID NO: 13641 - DNA, 25 bp, Mus musculus
cactggctggatccctgttccaaga

SEQ ID NO: 13642 - DNA, 25 bp, Mus musculus
cactggctggctgagcagcatcaca

SEQ ID NO: 13643 - DNA, 25 bp, Mus musculus
cactggctgtatcctgctcggagga

SEQ ID NO: 13644 - DNA, 25 bp, Mus musculus
cactggcttggcatggcctgttagt

SEQ ID NO: 13645 - DNA, 25 bp, Mus musculus
cactggcttggctgacaccatacct

SEQ ID NO: 13646 - DNA, 25 bp, Mus musculus
cactgggaaatgatccaacagggca

SEQ ID NO: 13647 - DNA, 25 bp, Mus musculus
cactgggaaatggtgggcccactaa

SEQ ID NO: 13648 - DNA, 25 bp, Mus musculus
cactgggagggaatgccctctcctt

SEQ ID NO: 13649 - DNA, 25 bp, Mus musculus
cactgggagtgacatctttaataag

SEQ ID NO: 13650 - DNA, 25 bp, Mus musculus
cactgggcagatggcactaatatta

SEQ ID NO: 13651 - DNA, 25 bp, Mus musculus
cactgggcaggcttgtggagaccct

SEQ ID NO: 13652 - DNA, 25 bp, Mus musculus
cactgggccacacaaagccttgctg

SEQ ID NO: 13653 - DNA, 25 bp, Mus musculus
cactgggccagtgtgtctatgtgca

SEQ ID NO: 13654 - DNA, 25 bp, Mus musculus
cactgggccttgtttgtctttgcac

SEQ ID NO: 13655 - DNA, 25 bp, Mus musculus
cactgggctgaatggtaacctatcc

SEQ ID NO: 13656 - DNA, 25 bp, Mus musculus
cactgggcttgggttttggcagcct

SEQ ID NO: 13657 - DNA, 25 bp, Mus musculus
cactgggtggcgatgctgaaagcct

SEQ ID NO: 13658 - DNA, 25 bp, Mus musculus
cactggtactgaagatcttgcccga

SEQ ID NO: 13659 - DNA, 25 bp, Mus musculus
cactggtagcagtatttgaggagta

SEQ ID NO: 13660 - DNA, 25 bp, Mus musculus
cactggtagtaacccagccctgact

SEQ ID NO: 13661 - DNA, 25 bp, Mus musculus
cactggtagtaagccagccctgact

SEQ ID NO: 13662 - DNA, 25 bp, Mus musculus
cactggtcctgtaaacaagattcaa

SEQ ID NO: 13663 - DNA, 25 bp, Mus musculus
cactggtgcttggtcttttgctcca

SEQ ID NO: 13664 - DNA, 25 bp, Mus musculus
cactggtgtgactgtggacttccag

SEQ ID NO: 13665 - DNA, 25 bp, Mus musculus
cactggtttgcactcagtggtcagg

SEQ ID NO: 13666 - DNA, 25 bp, Mus musculus
cactgtagtttatcaagtgagtccc

SEQ ID NO: 13667 - DNA, 25 bp, Mus musculus
cactgtatccagaactcccagaata

SEQ ID NO: 13668 - DNA, 25 bp, Mus musculus
cactgtcaaacctgcatgtggacgt

SEQ ID NO: 13669 - DNA, 25 bp, Mus musculus
cactgtcaacagtgaagcctttcat

SEQ ID NO: 13670 - DNA, 25 bp, Mus musculus
cactgtcaatgagatctataaaaca

SEQ ID NO: 13671 - DNA, 25 bp, Mus musculus
cactgtcaccagacctgtggcaaaa

SEQ ID NO: 13672 - DNA, 25 bp, Mus musculus
cactgtcactccagagattgagaga

SEQ ID NO: 13673 - DNA, 25 bp, Mus musculus
cactgtcatcagatgagtgggagag

SEQ ID NO: 13674 - DNA, 25 bp, Mus musculus
cactgtccagcctgcaggttgcaga

SEQ ID NO: 13675 - DNA, 25 bp, Mus musculus
cactgtcctactataagagccaaga

SEQ ID NO: 13676 - DNA, 25 bp, Mus musculus
cactgtctatgtatgggaacattcg

SEQ ID NO: 13677 - DNA, 25 bp, Mus musculus
cactgtgaagcacctgtgtggcgac

SEQ ID NO: 13678 - DNA, 25 bp, Mus musculus
cactgtgaagttccgctgtccggct

SEQ ID NO: 13679 - DNA, 25 bp, Mus musculus
cactgtgacgtttctggctggcaac

SEQ ID NO: 13680 - DNA, 25 bp, Mus musculus
cactgtgactgtcggtgtagttcct

SEQ ID NO: 13681 - DNA, 25 bp, Mus musculus
cactgtgagttatgcaggctgggct

SEQ ID NO: 13682 - DNA, 25 bp, Mus musculus
cactgtgcaggaatttatggaggtc

SEQ ID NO: 13683 - DNA, 25 bp, Mus musculus
cactgtgcatagaagatgggtccat

SEQ ID NO: 13684 - DNA, 25 bp, Mus musculus
cactgtgcatgaggccataccctgt

SEQ ID NO: 13685 - DNA, 25 bp, Mus musculus
cactgtgccagtgagctttgttgcc

SEQ ID NO: 13686 - DNA, 25 bp, Mus musculus
cactgtgccccgattagaagctctc

SEQ ID NO: 13687 - DNA, 25 bp, Mus musculus
cactgtgcgggcctgtttagcacct

SEQ ID NO: 13688 - DNA, 25 bp, Mus musculus
cactgtgcttaagcaggtagtgcca

SEQ ID NO: 13689 - DNA, 25 bp, Mus musculus
cactgtggaactgttaacagatcgg

SEQ ID NO: 13690 - DNA, 25 bp, Mus musculus
cactgtggaagatatctgcatgttg

SEQ ID NO: 13691 - DNA, 25 bp, Mus musculus
cactgtggcaagtgcagtctctggc

SEQ ID NO: 13692 - DNA, 25 bp, Mus musculus
cactgtggcagcaggtctggatcga

SEQ ID NO: 13693 - DNA, 25 bp, Mus musculus
cactgtggcagctggtctggatcga

SEQ ID NO: 13694 - DNA, 25 bp, Mus musculus
cactgtggcagttgttgtttatgat

SEQ ID NO: 13695 - DNA, 25 bp, Mus musculus
cactgtgggaactgccacgctaggc

SEQ ID NO: 13696 - DNA, 25 bp, Mus musculus
cactgtgtaggcctgttgcccatgg

SEQ ID NO: 13697 - DNA, 25 bp, Mus musculus
cactgtgtccgcagcaacaacatct

SEQ ID NO: 13698 - DNA, 25 bp, Mus musculus
cactgtgtgaacacccggctgattc

SEQ ID NO: 13699 - DNA, 25 bp, Mus musculus
cactgtgtgtcgactgctactcaac

SEQ ID NO: 13700 - DNA, 25 bp, Mus musculus
cactgtgtgtggcaaccatggcttc

SEQ ID NO: 13701 - DNA, 25 bp, Mus musculus
cactgtgtgtgggaaccatggcttc

SEQ ID NO: 13702 - DNA, 25 bp, Mus musculus
cactgtgtttggtctttggcctctg

SEQ ID NO: 13703 - DNA, 25 bp, Mus musculus
cactgttcttcaccggcaggagagt

SEQ ID NO: 13704 - DNA, 25 bp, Mus musculus
cactgttgaatatgaccttcatgaa

SEQ ID NO: 13705 - DNA, 25 bp, Mus musculus
cactgttgacaaacgcatggacttt

SEQ ID NO: 13706 - DNA, 25 bp, Mus musculus
cactgttgccctgacgacttcgtgg

SEQ ID NO: 13707 - DNA, 25 bp, Mus musculus
cactgttgcctcttcagattctgag

SEQ ID NO: 13708 - DNA, 25 bp, Mus musculus
cactgttggagagggctacggttac

SEQ ID NO: 13709 - DNA, 25 bp, Mus musculus
cactgtttacgtcagtatgatcgcc

SEQ ID NO: 13710 - DNA, 25 bp, Mus musculus
cactgtttccgaggtcagggagaga

SEQ ID NO: 13711 - DNA, 25 bp, Mus musculus
cactgtttgcctagaaagccagaag

SEQ ID NO: 13712 - DNA, 25 bp, Mus musculus
cactgtttttaggtgctgaagattc

SEQ ID NO: 13713 - DNA, 25 bp, Mus musculus
cacttaaggagggtgtgtgtacttc

SEQ ID NO: 13714 - DNA, 25 bp, Mus musculus
cacttaatttggaataacatggaac

SEQ ID NO: 13715 - DNA, 25 bp, Mus musculus
cacttacaatcccaaaatgagtttg

SEQ ID NO: 13716 - DNA, 25 bp, Mus musculus
cacttacactggtgtctgcccagat

SEQ ID NO: 13717 - DNA, 25 bp, Mus musculus
cacttacagggagcggcctctgtgc

SEQ ID NO: 13718 - DNA, 25 bp, Mus musculus
cacttacgatggatatactgctgga

SEQ ID NO: 13719 - DNA, 25 bp, Mus musculus
cacttactggtgaacacaatagcat

SEQ ID NO: 13720 - DNA, 25 bp, Mus musculus
cacttactggtgtacacaatagcat

SEQ ID NO: 13721 - DNA, 25 bp, Mus musculus
cacttagaccactcactggaccgtg

SEQ ID NO: 13722 - DNA, 25 bp, Mus musculus
cacttagcttcatgagcctgagcct

SEQ ID NO: 13723 - DNA, 25 bp, Mus musculus
cacttaggtgatgtcagttccaata

SEQ ID NO: 13724 - DNA, 25 bp, Mus musculus
cacttagttctgaggtgaagacaga

SEQ ID NO: 13725 - DNA, 25 bp, Mus musculus
cacttataccgtccacctgctggag

SEQ ID NO: 13726 - DNA, 25 bp, Mus musculus
cacttatcccgaaagcctatcagca

SEQ ID NO: 13727 - DNA, 25 bp, Mus musculus
cacttatgacatcaaggtccgtgca

SEQ ID NO: 13728 - DNA, 25 bp, Mus musculus
cacttatggacttccagctggagga

SEQ ID NO: 13729 - DNA, 25 bp, Mus musculus
cacttattacgattttctctgcccc

SEQ ID NO: 13730 - DNA, 25 bp, Mus musculus
cacttcaactactagagagtagtac

SEQ ID NO: 13731 - DNA, 25 bp, Mus musculus
cacttcaagattcacggccaaggga

SEQ ID NO: 13732 - DNA, 25 bp, Mus musculus
cacttcaagctctacaaatatgtct

SEQ ID NO: 13733 - DNA, 25 bp, Mus musculus
cacttcagagccttgttggacagca

SEQ ID NO: 13734 - DNA, 25 bp, Mus musculus
cacttccaagcagtgcagttcggga

SEQ ID NO: 13735 - DNA, 25 bp, Mus musculus
cacttccacatgatttgtatccgag

SEQ ID NO: 13736 - DNA, 25 bp, Mus musculus
cacttccagtgtcgaaggctggaca

SEQ ID NO: 13737 - DNA, 25 bp, Mus musculus
cacttccatgtctcaactgaagaat

SEQ ID NO: 13738 - DNA, 25 bp, Mus musculus
cacttccgctatgaggaggcatcca

SEQ ID NO: 13739 - DNA, 25 bp, Mus musculus
cacttccggccacgctatgagtatg

SEQ ID NO: 13740 - DNA, 25 bp, Mus musculus
cacttccggccaggctatgagtatg

SEQ ID NO: 13741 - DNA, 25 bp, Mus musculus
cacttcctgtcatgagtcagccctt

SEQ ID NO: 13742 - DNA, 25 bp, Mus musculus
cacttcctttataggatggagtgtg

SEQ ID NO: 13743 - DNA, 25 bp, Mus musculus
cacttcgaggaaaactgctttgagc

SEQ ID NO: 13744 - DNA, 25 bp, Mus musculus
cacttcgattgtgcttacttatacc

SEQ ID NO: 13745 - DNA, 25 bp, Mus musculus
cacttcgattttctagctgccctaa

SEQ ID NO: 13746 - DNA, 25 bp, Mus musculus
cacttcgctgctcttcccggagagt

SEQ ID NO: 13747 - DNA, 25 bp, Mus musculus
cacttcggaagtgtcctgccaaagc

SEQ ID NO: 13748 - DNA, 25 bp, Mus musculus
cacttcgtaggccagactggacttg

SEQ ID NO: 13749 - DNA, 25 bp, Mus musculus
cacttctaaaaacaggatcccgaat

SEQ ID NO: 13750 - DNA, 25 bp, Mus musculus
cacttctacagtcatcatcaacgag

SEQ ID NO: 13751 - DNA, 25 bp, Mus musculus
cacttctatgctcgtggactatggg

SEQ ID NO: 13752 - DNA, 25 bp, Mus musculus
cacttctatgctggtggactatggg

SEQ ID NO: 13753 - DNA, 25 bp, Mus musculus
cacttctgctgatgacaagaatcgg

SEQ ID NO: 13754 - DNA, 25 bp, Mus musculus
cacttctgggaaatcaagatgacct

SEQ ID NO: 13755 - DNA, 25 bp, Mus musculus
cacttctggtgacgtcttctttctg

SEQ ID NO: 13756 - DNA, 25 bp, Mus musculus
cacttctgtctgaggtacacaaagg

SEQ ID NO: 13757 - DNA, 25 bp, Mus musculus
cacttctgtgatgcaggtgacagcc

SEQ ID NO: 13758 - DNA, 25 bp, Mus musculus
cacttctttttagatgaatggcgga

SEQ ID NO: 13759 - DNA, 25 bp, Mus musculus
cacttgaacctgctcagtgtatcca

SEQ ID NO: 13760 - DNA, 25 bp, Mus musculus
cacttgaagaatgatcccagggaac

SEQ ID NO: 13761 - DNA, 25 bp, Mus musculus
cacttgagccatcctaccgggaatc

SEQ ID NO: 13762 - DNA, 25 bp, Mus musculus
cacttgattgaacgcctgtacagag

SEQ ID NO: 13763 - DNA, 25 bp, Mus musculus
cacttgatttggatctcaggacgga

SEQ ID NO: 13764 - DNA, 25 bp, Mus musculus
cacttgcacaaacaagagggtcctg

SEQ ID NO: 13765 - DNA, 25 bp, Mus musculus
cacttgcacaagaggttcttcagcc

SEQ ID NO: 13766 - DNA, 25 bp, Mus musculus
cacttgcagacattgtaaaagaccc

SEQ ID NO: 13767 - DNA, 25 bp, Mus musculus
cacttgcagtcggtgtcagaagcaa

SEQ ID NO: 13768 - DNA, 25 bp, Mus musculus
cacttgccccaactgttgctggttt

SEQ ID NO: 13769 - DNA, 25 bp, Mus musculus
cacttgccgcacttcattaaatggg

SEQ ID NO: 13770 - DNA, 25 bp, Mus musculus
cacttgcgaccaggagagcatttct

SEQ ID NO: 13771 - DNA, 25 bp, Mus musculus
cacttgcgactgctttgagggcttc

SEQ ID NO: 13772 - DNA, 25 bp, Mus musculus
cacttgcgactggtttgagggcttc

SEQ ID NO: 13773 - DNA, 25 bp, Mus musculus
cacttgcggtggcttgggcttcaca

SEQ ID NO: 13774 - DNA, 25 bp, Mus musculus
cacttgcggtgggttgggcttcaca

SEQ ID NO: 13775 - DNA, 25 bp, Mus musculus
cacttgctagtagctactgaaaggc

SEQ ID NO: 13776 - DNA, 25 bp, Mus musculus
cacttgctgccaagggctatagaag

SEQ ID NO: 13777 - DNA, 25 bp, Mus musculus
cacttgcttttccagagcagaaaag

SEQ ID NO: 13778 - DNA, 25 bp, Mus musculus
cacttgcttttttccagtcttctgg

SEQ ID NO: 13779 - DNA, 25 bp, Mus musculus
cacttggagctgcttctgcaacaac

SEQ ID NO: 13780 - DNA, 25 bp, Mus musculus
cacttggctggtttagtttttagct

SEQ ID NO: 13781 - DNA, 25 bp, Mus musculus
cacttgggaatcagtaaaccatggc

SEQ ID NO: 13782 - DNA, 25 bp, Mus musculus
cacttgggctagtgggccttcagga

SEQ ID NO: 13783 - DNA, 25 bp, Mus musculus
cacttgtccgtctgtccagtaagca

SEQ ID NO: 13784 - DNA, 25 bp, Mus musculus
cacttgtgaattttcattgaaaaac

SEQ ID NO: 13785 - DNA, 25 bp, Mus musculus
cacttgtgctgaccagtgatcagtc

SEQ ID NO: 13786 - DNA, 25 bp, Mus musculus
cacttgtgctgagtacactcatttc

SEQ ID NO: 13787 - DNA, 25 bp, Mus musculus
cacttgtggaatctgctctcacgag

SEQ ID NO: 13788 - DNA, 25 bp, Mus musculus
cacttgtgtgcctttgatcagcgct

SEQ ID NO: 13789 - DNA, 25 bp, Mus musculus
cacttgtttttgtgtcactggcagg

SEQ ID NO: 13790 - DNA, 25 bp, Mus musculus
cactttaactgtgctgttcatcctc

SEQ ID NO: 13791 - DNA, 25 bp, Mus musculus
cactttaagaacctaggctatgcca

SEQ ID NO: 13792 - DNA, 25 bp, Mus musculus
cactttacttggcagaagaagtatg

SEQ ID NO: 13793 - DNA, 25 bp, Mus musculus
cactttacttgggagaagaagtatg

SEQ ID NO: 13794 - DNA, 25 bp, Mus musculus
cactttagtaggacttgaggacaaa

SEQ ID NO: 13795 - DNA, 25 bp, Mus musculus
cactttatatgcagattcctcagga

SEQ ID NO: 13796 - DNA, 25 bp, Mus musculus
cactttccgtgctttgacgaactct

SEQ ID NO: 13797 - DNA, 25 bp, Mus musculus
cactttcctctgacaggtcgtggtg

SEQ ID NO: 13798 - DNA, 25 bp, Mus musculus
cactttccttgtggtactctggact

SEQ ID NO: 13799 - DNA, 25 bp, Mus musculus
cactttctccactgaacccttggag

SEQ ID NO: 13800 - DNA, 25 bp, Mus musculus
cactttgcgctaacccagagagtag

SEQ ID NO: 13801 - DNA, 25 bp, Mus musculus
cactttggccgtgtttatgggtaca

SEQ ID NO: 13802 - DNA, 25 bp, Mus musculus
cactttgggatttgttgtgatctgc

SEQ ID NO: 13803 - DNA, 25 bp, Mus musculus
cactttggtgttggcggtgtcatct

SEQ ID NO: 13804 - DNA, 25 bp, Mus musculus
cactttgtcgggaaagggcctcagc

SEQ ID NO: 13805 - DNA, 25 bp, Mus musculus
cactttgtctgtgatgccatgagta

SEQ ID NO: 13806 - DNA, 25 bp, Mus musculus
cactttgtggagaaagtcgtcttcc

SEQ ID NO: 13807 - DNA, 25 bp, Mus musculus
cactttgtggccctcaagagtgtga

SEQ ID NO: 13808 - DNA, 25 bp, Mus musculus
cacttttcatggatgcctgccctcg

SEQ ID NO: 13809 - DNA, 25 bp, Mus musculus
cacttttcctacttgcctttagcac

SEQ ID NO: 13810 - DNA, 25 bp, Mus musculus
cacttttgagacagaagtctggacc

SEQ ID NO: 13811 - DNA, 25 bp, Mus musculus
cacttttgtattgagttgcagccag

SEQ ID NO: 13812 - DNA, 25 bp, Mus musculus
cacttttgtcctaaaactgccacga

SEQ ID NO: 13813 - DNA, 25 bp, Mus musculus
cactttttaattcgagcctctgcag

SEQ ID NO: 13814 - DNA, 25 bp, Mus musculus
cagaaaaaagtgagctaagtattgg

SEQ ID NO: 13815 - DNA, 25 bp, Mus musculus
cagaaaaaattggtacttcaagagg

SEQ ID NO: 13816 - DNA, 25 bp, Mus musculus
cagaaaaaccctttgatatgaagtc

SEQ ID NO: 13817 - DNA, 25 bp, Mus musculus
cagaaaaagaccagtcctcaagcga

SEQ ID NO: 13818 - DNA, 25 bp, Mus musculus
cagaaaaagcttcaggagcggagac

SEQ ID NO: 13819 - DNA, 25 bp, Mus musculus
cagaaaaaggcaaagaaggtgaaga

SEQ ID NO: 13820 - DNA, 25 bp, Mus musculus
cagaaaaattcaacgccaagattca

SEQ ID NO: 13821 - DNA, 25 bp, Mus musculus
cagaaaacacacacctgaagggaat

SEQ ID NO: 13822 - DNA, 25 bp, Mus musculus
cagaaaaccaggcacagaatagatc

SEQ ID NO: 13823 - DNA, 25 bp, Mus musculus
cagaaaaccttgctcagaagcttcc

SEQ ID NO: 13824 - DNA, 25 bp, Mus musculus
cagaaaactgtcttcagcttcctca

SEQ ID NO: 13825 - DNA, 25 bp, Mus musculus
cagaaaagaatttgacggacctagg

SEQ ID NO: 13826 - DNA, 25 bp, Mus musculus
cagaaaagacataggcacatttgga

SEQ ID NO: 13827 - DNA, 25 bp, Mus musculus
cagaaaagccaagggactcagcaag

SEQ ID NO: 13828 - DNA, 25 bp, Mus musculus
cagaaaagccggatgaaataaccaa

SEQ ID NO: 13829 - DNA, 25 bp, Mus musculus
cagaaaagcctcatgttcatcgagc

SEQ ID NO: 13830 - DNA, 25 bp, Mus musculus
cagaaaagctgaagccaggagacct

SEQ ID NO: 13831 - DNA, 25 bp, Mus musculus
cagaaaaggacaggttccaggaact

SEQ ID NO: 13832 - DNA, 25 bp, Mus musculus
cagaaaagtcttgagtaatgtcatg

SEQ ID NO: 13833 - DNA, 25 bp, Mus musculus
cagaaaataattacttggaatgcca

SEQ ID NO: 13834 - DNA, 25 bp, Mus musculus
cagaaaataatttcttggaatgcca

SEQ ID NO: 13835 - DNA, 25 bp, Mus musculus
cagaaaatactcctccatgccagca

SEQ ID NO: 13836 - DNA, 25 bp, Mus musculus
cagaaaatattaacaatgcagcctc

SEQ ID NO: 13837 - DNA, 25 bp, Mus musculus
cagaaaatctggttctcttgcacta

SEQ ID NO: 13838 - DNA, 25 bp, Mus musculus
cagaaaatgagtaagcgagaggcta

SEQ ID NO: 13839 - DNA, 25 bp, Mus musculus
cagaaaatgcgaccaaatgtgaagc

SEQ ID NO: 13840 - DNA, 25 bp, Mus musculus
cagaaaatggttgctttgctcaaca

SEQ ID NO: 13841 - DNA, 25 bp, Mus musculus
cagaaaattaatgcccgttggacca

SEQ ID NO: 13842 - DNA, 25 bp, Mus musculus
cagaaacaaagcgatgagcttgccc

SEQ ID NO: 13843 - DNA, 25 bp, Mus musculus
cagaaacatcagtcaaggagaacaa

SEQ ID NO: 13844 - DNA, 25 bp, Mus musculus
cagaaacatctggtgatgggtgaca

SEQ ID NO: 13845 - DNA, 25 bp, Mus musculus
cagaaaccaaatttgactctggttc

SEQ ID NO: 13846 - DNA, 25 bp, Mus musculus
cagaaacctgagctttaattgtgcc

SEQ ID NO: 13847 - DNA, 25 bp, Mus musculus
cagaaaccttgagatctcaggaccc

SEQ ID NO: 13848 - DNA, 25 bp, Mus musculus
cagaaacggcgttgacgtaatttag

SEQ ID NO: 13849 - DNA, 25 bp, Mus musculus
cagaaacgtttacaagaaccacaag

SEQ ID NO: 13850 - DNA, 25 bp, Mus musculus
cagaaacgtttcaacgatgggaccg

SEQ ID NO: 13851 - DNA, 25 bp, Mus musculus
cagaaactacactggaacccggagg

SEQ ID NO: 13852 - DNA, 25 bp, Mus musculus
cagaaactaggcctcttgccacctc

SEQ ID NO: 13853 - DNA, 25 bp, Mus musculus
cagaaactccttttcttgacccagg

SEQ ID NO: 13854 - DNA, 25 bp, Mus musculus
cagaaactggctggtgtcactgcac

SEQ ID NO: 13855 - DNA, 25 bp, Mus musculus
cagaaacttcaaagtgccagggcgg

SEQ ID NO: 13856 - DNA, 25 bp, Mus musculus
cagaaacttgcatctgaagatacaa

SEQ ID NO: 13857 - DNA, 25 bp, Mus musculus
cagaaagaacccctctgaagcccag

SEQ ID NO: 13858 - DNA, 25 bp, Mus musculus
cagaaagaacctaaagaagcaacca

SEQ ID NO: 13859 - DNA, 25 bp, Mus musculus
cagaaagaagatggctcctgagcaa

SEQ ID NO: 13860 - DNA, 25 bp, Mus musculus
cagaaagacccacaggtgacctcag

SEQ ID NO: 13861 - DNA, 25 bp, Mus musculus
cagaaagagaagaattcccctgctg

SEQ ID NO: 13862 - DNA, 25 bp, Mus musculus
cagaaagagcaggtgcatgccgatg

SEQ ID NO: 13863 - DNA, 25 bp, Mus musculus
cagaaagataattgaagcccagcga

SEQ ID NO: 13864 - DNA, 25 bp, Mus musculus
cagaaagatggatcttgggaccggc

SEQ ID NO: 13865 - DNA, 25 bp, Mus musculus
cagaaagcagtcactgtgtcataaa

SEQ ID NO: 13866 - DNA, 25 bp, Mus musculus
cagaaagcatccttgctgagcacta

SEQ ID NO: 13867 - DNA, 25 bp, Mus musculus
cagaaagcatgcaggctgtgatcct

SEQ ID NO: 13868 - DNA, 25 bp, Mus musculus
cagaaaggcggctccaggatgttat

SEQ ID NO: 13869 - DNA, 25 bp, Mus musculus
cagaaaggcttttggtgtcagctac

SEQ ID NO: 13870 - DNA, 25 bp, Mus musculus
cagaaagggcatctctcctccaagc

SEQ ID NO: 13871 - DNA, 25 bp, Mus musculus
cagaaaggtgctcctgtcaaacaaa

SEQ ID NO: 13872 - DNA, 25 bp, Mus musculus
cagaaataggaaagacactggcaga

SEQ ID NO: 13873 - DNA, 25 bp, Mus musculus
cagaaatcaggaggctacctctgcc

SEQ ID NO: 13874 - DNA, 25 bp, Mus musculus
cagaaatcatatttgtcgactggaa

SEQ ID NO: 13875 - DNA, 25 bp, Mus musculus
cagaaatccatgtctgcctccgtac

SEQ ID NO: 13876 - DNA, 25 bp, Mus musculus
cagaaatcctgggaatcaaattaaa

SEQ ID NO: 13877 - DNA, 25 bp, Mus musculus
cagaaatgagaccaaggagcgccaa

SEQ ID NO: 13878 - DNA, 25 bp, Mus musculus
cagaaatgagacgaaggagcgccaa

SEQ ID NO: 13879 - DNA, 25 bp, Mus musculus
cagaaatgtgtgcagactatatggc

SEQ ID NO: 13880 - DNA, 25 bp, Mus musculus
cagaaatgttccaagaacagttacc

SEQ ID NO: 13881 - DNA, 25 bp, Mus musculus
cagaaattacaacagaagatatcaa

SEQ ID NO: 13882 - DNA, 25 bp, Mus musculus
cagaaattgggagaacagaacactg

SEQ ID NO: 13883 - DNA, 25 bp, Mus musculus
cagaaattgtttactccatatacag

SEQ ID NO: 13884 - DNA, 25 bp, Mus musculus
cagaaattttgaagaatctaagcca

SEQ ID NO: 13885 - DNA, 25 bp, Mus musculus
cagaaattttgggagttgcagctac

SEQ ID NO: 13886 - DNA, 25 bp, Mus musculus
cagaacaaagatcttgccaatcaag

SEQ ID NO: 13887 - DNA, 25 bp, Mus musculus
cagaacaagttgaaggcaatgtctt

SEQ ID NO: 13888 - DNA, 25 bp, Mus musculus
cagaacaatccctggaccctagtag

SEQ ID NO: 13889 - DNA, 25 bp, Mus musculus
cagaacaattaccagccctactaaa

SEQ ID NO: 13890 - DNA, 25 bp, Mus musculus
cagaacactggtagtaagccagccc

SEQ ID NO: 13891 - DNA, 25 bp, Mus musculus
cagaacactggttgtaagccagccc

SEQ ID NO: 13892 - DNA, 25 bp, Mus musculus
cagaacagactctgatgagcacaga

SEQ ID NO: 13893 - DNA, 25 bp, Mus musculus
cagaacagactggaaagtttgcaaa

SEQ ID NO: 13894 - DNA, 25 bp, Mus musculus
cagaacagattatgcaagaaaaaca

SEQ ID NO: 13895 - DNA, 25 bp, Mus musculus
cagaacagcctatttgccgcatgag

SEQ ID NO: 13896 - DNA, 25 bp, Mus musculus
cagaacaggacagcaccaggttcca

SEQ ID NO: 13897 - DNA, 25 bp, Mus musculus
cagaacataatggacacctgcctgt

SEQ ID NO: 13898 - DNA, 25 bp, Mus musculus
cagaacattcccagaggtgctgttc

SEQ ID NO: 13899 - DNA, 25 bp, Mus musculus
cagaaccacagaaaacggagggaag

SEQ ID NO: 13900 - DNA, 25 bp, Mus musculus
cagaaccagagagagattatcttga

SEQ ID NO: 13901 - DNA, 25 bp, Mus musculus
cagaaccagggtctctgtgtccgct

SEQ ID NO: 13902 - DNA, 25 bp, Mus musculus
cagaaccagggtgtctgtgtccgct

SEQ ID NO: 13903 - DNA, 25 bp, Mus musculus
cagaaccatgctgacctgctgcgga

SEQ ID NO: 13904 - DNA, 25 bp, Mus musculus
cagaaccgcgtgtctgctatcatct

SEQ ID NO: 13905 - DNA, 25 bp, Mus musculus
cagaacctatagcagagtggcagaa

SEQ ID NO: 13906 - DNA, 25 bp, Mus musculus
cagaacctgctggatgaccttgtca

SEQ ID NO: 13907 - DNA, 25 bp, Mus musculus
cagaacctgtctgaggaagtggccc

SEQ ID NO: 13908 - DNA, 25 bp, Mus musculus
cagaacgcttccatttctacaaaag

SEQ ID NO: 13909 - DNA, 25 bp, Mus musculus
cagaacggttgaacctttcccagag

SEQ ID NO: 13910 - DNA, 25 bp, Mus musculus
cagaactagaggaaatggacttaat

SEQ ID NO: 13911 - DNA, 25 bp, Mus musculus
cagaactgagtcttcctttggagta

SEQ ID NO: 13912 - DNA, 25 bp, Mus musculus
cagaactgatacagccccgctgatc

SEQ ID NO: 13913 - DNA, 25 bp, Mus musculus
cagaactgggctacagctacggtgg

SEQ ID NO: 13914 - DNA, 25 bp, Mus musculus
cagaactgtgtgtctcgctgcagca

SEQ ID NO: 13915 - DNA, 25 bp, Mus musculus
cagaacttaatcaggaaatttccta

SEQ ID NO: 13916 - DNA, 25 bp, Mus musculus
cagaacttcaggaggtgcagatcac

SEQ ID NO: 13917 - DNA, 25 bp, Mus musculus
cagaacttcgggagttcaggccgga

SEQ ID NO: 13918 - DNA, 25 bp, Mus musculus
cagaacttgctgaattggctagact

SEQ ID NO: 13919 - DNA, 25 bp, Mus musculus
cagaactttttcatttgctgtctcc

SEQ ID NO: 13920 - DNA, 25 bp, Mus musculus
cagaagaaactgaccccggaacagt

SEQ ID NO: 13921 - DNA, 25 bp, Mus musculus
cagaagaaagacaggacgaagcatc

SEQ ID NO: 13922 - DNA, 25 bp, Mus musculus
cagaagaaagctgggtagttttccg

SEQ ID NO: 13923 - DNA, 25 bp, Mus musculus
cagaagaaagggaagtttgcttggt

SEQ ID NO: 13924 - DNA, 25 bp, Mus musculus
cagaagaaccagaggacctagccct

SEQ ID NO: 13925 - DNA, 25 bp, Mus musculus
cagaagaagcaactcgcaagcggga

SEQ ID NO: 13926 - DNA, 25 bp, Mus musculus
cagaagaatatgtgagcaggccatg

SEQ ID NO: 13927 - DNA, 25 bp, Mus musculus
cagaagacagcacttacacgtatgt

SEQ ID NO: 13928 - DNA, 25 bp, Mus musculus
cagaagaccagaaagccctgtcaga

SEQ ID NO: 13929 - DNA, 25 bp, Mus musculus
cagaagaccagatagccctgtcaga

SEQ ID NO: 13930 - DNA, 25 bp, Mus musculus
cagaagaccatagctggacagagca

SEQ ID NO: 13931 - DNA, 25 bp, Mus musculus
cagaagacctatctgcatttgagtc

SEQ ID NO: 13932 - DNA, 25 bp, Mus musculus
cagaagacggcaccacgactaagta

SEQ ID NO: 13933 - DNA, 25 bp, Mus musculus
cagaagacgtggtccagactggagc

SEQ ID NO: 13934 - DNA, 25 bp, Mus musculus
cagaagactaaaatagggcacagtg

SEQ ID NO: 13935 - DNA, 25 bp, Mus musculus
cagaagactgagctgctgatgtcag

SEQ ID NO: 13936 - DNA, 25 bp, Mus musculus
cagaagacttgtaaatggatgctgc

SEQ ID NO: 13937 - DNA, 25 bp, Mus musculus
cagaagagaacaagacaactcagga

SEQ ID NO: 13938 - DNA, 25 bp, Mus musculus
cagaagagacagtggctgctgcaga

SEQ ID NO: 13939 - DNA, 25 bp, Mus musculus
cagaagagactagtccctgtgacgg

SEQ ID NO: 13940 - DNA, 25 bp, Mus musculus
cagaagaggccaagattggaagagc

SEQ ID NO: 13941 - DNA, 25 bp, Mus musculus
cagaagaggctcgacaagcatgtga

SEQ ID NO: 13942 - DNA, 25 bp, Mus musculus
cagaagagtttaagaggcgacttgc

SEQ ID NO: 13943 - DNA, 25 bp, Mus musculus
cagaagataccaccatgcctatacg

SEQ ID NO: 13944 - DNA, 25 bp, Mus musculus
cagaagatatcatcaagttttccaa

SEQ ID NO: 13945 - DNA, 25 bp, Mus musculus
cagaagatatccacattccaaagat

SEQ ID NO: 13946 - DNA, 25 bp, Mus musculus
cagaagatcgtagagctagctcaca

SEQ ID NO: 13947 - DNA, 25 bp, Mus musculus
cagaagatctgcgaccagtgggata

SEQ ID NO: 13948 - DNA, 25 bp, Mus musculus
cagaagatgggatcacggaacagca

SEQ ID NO: 13949 - DNA, 25 bp, Mus musculus
cagaagatgtcggagacgcaggcta

SEQ ID NO: 13950 - DNA, 25 bp, Mus musculus
cagaagattttgattggagtcctgg

SEQ ID NO: 13951 - DNA, 25 bp, Mus musculus
cagaagcagagctatggaatcccaa

SEQ ID NO: 13952 - DNA, 25 bp, Mus musculus
cagaagcagatgaactgttgaataa

SEQ ID NO: 13953 - DNA, 25 bp, Mus musculus
cagaagcagatgtttcggaacctca

SEQ ID NO: 13954 - DNA, 25 bp, Mus musculus
cagaagcaggacaccctaaaaaggt

SEQ ID NO: 13955 - DNA, 25 bp, Mus musculus
cagaagcatttctcaggacacctgg

SEQ ID NO: 13956 - DNA, 25 bp, Mus musculus
cagaagccatcaacctgtcgggagg

SEQ ID NO: 13957 - DNA, 25 bp, Mus musculus
cagaagcccaagaccatgaagctca

SEQ ID NO: 13958 - DNA, 25 bp, Mus musculus
cagaagcctaaaggaaccattgaat

SEQ ID NO: 13959 - DNA, 25 bp, Mus musculus
cagaagcggccaatggccagtacac

SEQ ID NO: 13960 - DNA, 25 bp, Mus musculus
cagaagcgtctatgattccttcaga

SEQ ID NO: 13961 - DNA, 25 bp, Mus musculus
cagaagctaaactcctgcggcagca

SEQ ID NO: 13962 - DNA, 25 bp, Mus musculus
cagaagctatgcactggcaggctct

SEQ ID NO: 13963 - DNA, 25 bp, Mus musculus
cagaagctcacagctgagtttgagg

SEQ ID NO: 13964 - DNA, 25 bp, Mus musculus
cagaagctcccgtccgtgttcaaga

SEQ ID NO: 13965 - DNA, 25 bp, Mus musculus
cagaagctcctagcaaacaagcaat

SEQ ID NO: 13966 - DNA, 25 bp, Mus musculus
cagaagctctcttctcaacagccat

SEQ ID NO: 13967 - DNA, 25 bp, Mus musculus
cagaagctgtcctgcacatgccagg

SEQ ID NO: 13968 - DNA, 25 bp, Mus musculus
cagaagcttgcccaggttggcacga

SEQ ID NO: 13969 - DNA, 25 bp, Mus musculus
cagaaggaaacattcgaagcgggat

SEQ ID NO: 13970 - DNA, 25 bp, Mus musculus
cagaaggaagtgcatcttcatacac

SEQ ID NO: 13971 - DNA, 25 bp, Mus musculus
cagaaggaccctgtaatatgcctaa

SEQ ID NO: 13972 - DNA, 25 bp, Mus musculus
cagaaggactggacccggagctact

SEQ ID NO: 13973 - DNA, 25 bp, Mus musculus
cagaaggagcttgcagaaatcacgc

SEQ ID NO: 13974 - DNA, 25 bp, Mus musculus
cagaaggaggtgtatttcatgggcc

SEQ ID NO: 13975 - DNA, 25 bp, Mus musculus
cagaaggcagccttggtgaacggcc

SEQ ID NO: 13976 - DNA, 25 bp, Mus musculus
cagaaggcatcatactgattggtga

SEQ ID NO: 13977 - DNA, 25 bp, Mus musculus
cagaaggcctaggagaagtgctgta

SEQ ID NO: 13978 - DNA, 25 bp, Mus musculus
cagaaggcgaaggtctccttctcca

SEQ ID NO: 13979 - DNA, 25 bp, Mus musculus
cagaaggctggagcaagaaagaact

SEQ ID NO: 13980 - DNA, 25 bp, Mus musculus
cagaaggctgtcgaacccttgtata

SEQ ID NO: 13981 - DNA, 25 bp, Mus musculus
cagaagggacagatgacaggtcaat

SEQ ID NO: 13982 - DNA, 25 bp, Mus musculus
cagaagggacagttgacaggtcaat

SEQ ID NO: 13983 - DNA, 25 bp, Mus musculus
cagaagggcagctgaacggtctcca

SEQ ID NO: 13984 - DNA, 25 bp, Mus musculus
cagaagggtattcatgtagaaaaca

SEQ ID NO: 13985 - DNA, 25 bp, Mus musculus
cagaagggtattgatgtagaaaaca

SEQ ID NO: 13986 - DNA, 25 bp, Mus musculus
cagaagggtgagatcctctccgaag

SEQ ID NO: 13987 - DNA, 25 bp, Mus musculus
cagaaggtaccgaagttggcttcca

SEQ ID NO: 13988 - DNA, 25 bp, Mus musculus
cagaaggtacttgactttagttatg

SEQ ID NO: 13989 - DNA, 25 bp, Mus musculus
cagaaggtcctttccaaggtgggca

SEQ ID NO: 13990 - DNA, 25 bp, Mus musculus
cagaaggtggacagatcctaagggt

SEQ ID NO: 13991 - DNA, 25 bp, Mus musculus
cagaaggtgtcgtctttgacttgct

SEQ ID NO: 13992 - DNA, 25 bp, Mus musculus
cagaaggttatgagacaagaagatg

SEQ ID NO: 13993 - DNA, 25 bp, Mus musculus
cagaagtattatctccttaagggaa

SEQ ID NO: 13994 - DNA, 25 bp, Mus musculus
cagaagtattgggaagccctaaact

SEQ ID NO: 13995 - DNA, 25 bp, Mus musculus
cagaagtcaaggagaactgaaagtg

SEQ ID NO: 13996 - DNA, 25 bp, Mus musculus
cagaagtccaagatacactgaagct

SEQ ID NO: 13997 - DNA, 25 bp, Mus musculus
cagaagtccaagttacactgaagct

SEQ ID NO: 13998 - DNA, 25 bp, Mus musculus
cagaagtccctgaaaactatggtgg

SEQ ID NO: 13999 - DNA, 25 bp, Mus musculus
cagaagtcgaggaaaggccaacaat

SEQ ID NO: 14000 - DNA, 25 bp, Mus musculus
cagaagtgaggatgcaagcaactcc

SEQ ID NO: 14001 - DNA, 25 bp, Mus musculus
cagaagtgccatagcgttgctgttt

SEQ ID NO: 14002 - DNA, 25 bp, Mus musculus
cagaagtggttgctccaaaatcaca

SEQ ID NO: 14003 - DNA, 25 bp, Mus musculus
cagaagtgtctaaatgttggcatga

SEQ ID NO: 14004 - DNA, 25 bp, Mus musculus
cagaagttacagagcccgtgaggca

SEQ ID NO: 14005 - DNA, 25 bp, Mus musculus
cagaagtttccactgttacttgtca

SEQ ID NO: 14006 - DNA, 25 bp, Mus musculus
cagaagtttggcaaggtgaagcagt

SEQ ID NO: 14007 - DNA, 25 bp, Mus musculus
cagaagtttgtcacacagtgctgtc

SEQ ID NO: 14008 - DNA, 25 bp, Mus musculus
cagaagtttttggacattgcaagac

SEQ ID NO: 14009 - DNA, 25 bp, Mus musculus
cagaatacagagaaagctctgactt

SEQ ID NO: 14010 - DNA, 25 bp, Mus musculus
cagaataccagagtccttccgtggg

SEQ ID NO: 14011 - DNA, 25 bp, Mus musculus
cagaatactgtttgacatgacggca

SEQ ID NO: 14012 - DNA, 25 bp, Mus musculus
cagaatagtgctgcctaaggacctg

SEQ ID NO: 14013 - DNA, 25 bp, Mus musculus
cagaatcaagtgtgtggagattgtc

SEQ ID NO: 14014 - DNA, 25 bp, Mus musculus
cagaatcaccgcacacctggttcat

SEQ ID NO: 14015 - DNA, 25 bp, Mus musculus
cagaatccacagaaggagagcaggc

SEQ ID NO: 14016 - DNA, 25 bp, Mus musculus
cagaatccatgccaccgatgttcta

SEQ ID NO: 14017 - DNA, 25 bp, Mus musculus
cagaatcccctgaagtaaccatcaa

SEQ ID NO: 14018 - DNA, 25 bp, Mus musculus
cagaatcctgagtatggcacacaca

SEQ ID NO: 14019 - DNA, 25 bp, Mus musculus
cagaatcgggatgctgcctggtacc

SEQ ID NO: 14020 - DNA, 25 bp, Mus musculus
cagaatctaagagggatggaggctt

SEQ ID NO: 14021 - DNA, 25 bp, Mus musculus
cagaatctagatgatggttcacaac

SEQ ID NO: 14022 - DNA, 25 bp, Mus musculus
cagaatctgagcttgacggaagaat

SEQ ID NO: 14023 - DNA, 25 bp, Mus musculus
cagaatctgatattagcttcatgtg

SEQ ID NO: 14024 - DNA, 25 bp, Mus musculus
cagaatctgatgctgtgcgcactgc

SEQ ID NO: 14025 - DNA, 25 bp, Mus musculus
cagaatgaagaggaagctgagtgcc

SEQ ID NO: 14026 - DNA, 25 bp, Mus musculus
cagaatgaagcaattcgtggaagag

SEQ ID NO: 14027 - DNA, 25 bp, Mus musculus
cagaatgacagctactcgtggccga

SEQ ID NO: 14028 - DNA, 25 bp, Mus musculus
cagaatgcacaggtggatgttcaat

SEQ ID NO: 14029 - DNA, 25 bp, Mus musculus
cagaatgcaggtccagccacattgg

SEQ ID NO: 14030 - DNA, 25 bp, Mus musculus
cagaatggagaggaagtggtcactc

SEQ ID NO: 14031 - DNA, 25 bp, Mus musculus
cagaatgggacttaagagacattga

SEQ ID NO: 14032 - DNA, 25 bp, Mus musculus
cagaatgggatacgacacgggtctt

SEQ ID NO: 14033 - DNA, 25 bp, Mus musculus
cagaatgtcaccgagtacgtcgtcc

SEQ ID NO: 14034 - DNA, 25 bp, Mus musculus
cagaatgtgtttgtggatacccatg

SEQ ID NO: 14035 - DNA, 25 bp, Mus musculus
cagaatgttaccaaaagagccttag

SEQ ID NO: 14036 - DNA, 25 bp, Mus musculus
cagaattagaggctttctggaagcc

SEQ ID NO: 14037 - DNA, 25 bp, Mus musculus
cagaattagagtctcgagtcatggc

SEQ ID NO: 14038 - DNA, 25 bp, Mus musculus
cagaattatgccaaggaggtggcag

SEQ ID NO: 14039 - DNA, 25 bp, Mus musculus
cagaattatggtacttcaccagctg

SEQ ID NO: 14040 - DNA, 25 bp, Mus musculus
cagaattcagcaaaccacagcagag

SEQ ID NO: 14041 - DNA, 25 bp, Mus musculus
cagaattcccgtgacatcaccgagg

SEQ ID NO: 14042 - DNA, 25 bp, Mus musculus
cagaattccgcggttgctgtgagcg

SEQ ID NO: 14043 - DNA, 25 bp, Mus musculus
cagaattctcttgaactcatggagg

SEQ ID NO: 14044 - DNA, 25 bp, Mus musculus
cagaattcttgctgcctgctttttg

SEQ ID NO: 14045 - DNA, 25 bp, Mus musculus
cagaattctttaagggccacagtcc

SEQ ID NO: 14046 - DNA, 25 bp, Mus musculus
cagaattgtcggatgagcagttaag

SEQ ID NO: 14047 - DNA, 25 bp, Mus musculus
cagaatttaacacaccaacatgcat

SEQ ID NO: 14048 - DNA, 25 bp, Mus musculus
cagaatttcttcgtggaaagcaagg

SEQ ID NO: 14049 - DNA, 25 bp, Mus musculus
cagaattttagcagttgtcttccca

SEQ ID NO: 14050 - DNA, 25 bp, Mus musculus
cagacaaaagagtatccagaagaca

SEQ ID NO: 14051 - DNA, 25 bp, Mus musculus
cagacaaattttcactccacttaaa

SEQ ID NO: 14052 - DNA, 25 bp, Mus musculus
cagacaacagtagaaattggcgctt

SEQ ID NO: 14053 - DNA, 25 bp, Mus musculus
cagacaaccagcagagtggagatgc

SEQ ID NO: 14054 - DNA, 25 bp, Mus musculus
cagacaagagcacaaacagtccacc

SEQ ID NO: 14055 - DNA, 25 bp, Mus musculus
cagacaagagcactgaatctcctgg

SEQ ID NO: 14056 - DNA, 25 bp, Mus musculus
cagacaagagccatgaagatcctca

SEQ ID NO: 14057 - DNA, 25 bp, Mus musculus
cagacaagcccaagtcaaatgctaa

SEQ ID NO: 14058 - DNA, 25 bp, Mus musculus
cagacaaggtagcttcactctctca

SEQ ID NO: 14059 - DNA, 25 bp, Mus musculus
cagacaagttttcgccgcttacctt

SEQ ID NO: 14060 - DNA, 25 bp, Mus musculus
cagacacacaagagattaatttgaa

SEQ ID NO: 14061 - DNA, 25 bp, Mus musculus
cagacacagggctgcgagtcttcgg

SEQ ID NO: 14062 - DNA, 25 bp, Mus musculus
cagacacctcagtcctcggatgagt

SEQ ID NO: 14063 - DNA, 25 bp, Mus musculus
cagacaccttctgagagcagagagg

SEQ ID NO: 14064 - DNA, 25 bp, Mus musculus
cagacacgatcagacctactgctgt

SEQ ID NO: 14065 - DNA, 25 bp, Mus musculus
cagacacggcttggataatgaacat

SEQ ID NO: 14066 - DNA, 25 bp, Mus musculus
cagacactacaagaaaaaaggaggg

SEQ ID NO: 14067 - DNA, 25 bp, Mus musculus
cagacactgctcattgtgttcacag

SEQ ID NO: 14068 - DNA, 25 bp, Mus musculus
cagacactggtcaagctgcctggac

SEQ ID NO: 14069 - DNA, 25 bp, Mus musculus
cagacagaagtgaaccgacagaagg

SEQ ID NO: 14070 - DNA, 25 bp, Mus musculus
cagacagaatgttttttcctacaaa

SEQ ID NO: 14071 - DNA, 25 bp, Mus musculus
cagacagacctttggagctacaggt

SEQ ID NO: 14072 - DNA, 25 bp, Mus musculus
cagacagccctgaagtggatagaga

SEQ ID NO: 14073 - DNA, 25 bp, Mus musculus
cagacagccctgatggaaatcctcg

SEQ ID NO: 14074 - DNA, 25 bp, Mus musculus
cagacagctgtttgacaccatctcc

SEQ ID NO: 14075 - DNA, 25 bp, Mus musculus
cagacagctttctgggtggattgaa

SEQ ID NO: 14076 - DNA, 25 bp, Mus musculus
cagacaggaaatcttggcagtttcc

SEQ ID NO: 14077 - DNA, 25 bp, Mus musculus
cagacaggagctctccagcttcttg

SEQ ID NO: 14078 - DNA, 25 bp, Mus musculus
cagacaggaggatacagtgacggac

SEQ ID NO: 14079 - DNA, 25 bp, Mus musculus
cagacagtaacagcggccaaatcca

SEQ ID NO: 14080 - DNA, 25 bp, Mus musculus
cagacagtgagatgacaggatatgt

SEQ ID NO: 14081 - DNA, 25 bp, Mus musculus
cagacagtgtctgtgatggacacgc

SEQ ID NO: 14082 - DNA, 25 bp, Mus musculus
cagacataaccagaagaacaccaaa

SEQ ID NO: 14083 - DNA, 25 bp, Mus musculus
cagacatagaaacagaagaaataga

SEQ ID NO: 14084 - DNA, 25 bp, Mus musculus
cagacatcagtatcggttgtgatac

SEQ ID NO: 14085 - DNA, 25 bp, Mus musculus
cagacatctggagagctgcggttca

SEQ ID NO: 14086 - DNA, 25 bp, Mus musculus
cagacatctggattcctctcaacca

SEQ ID NO: 14087 - DNA, 25 bp, Mus musculus
cagacatcttctgggtgtccgtgct

SEQ ID NO: 14088 - DNA, 25 bp, Mus musculus
cagacatgaaccgactcatcatgaa

SEQ ID NO: 14089 - DNA, 25 bp, Mus musculus
cagacatgaagctaatttgctgccg

SEQ ID NO: 14090 - DNA, 25 bp, Mus musculus
cagacatggatggagagggctctac

SEQ ID NO: 14091 - DNA, 25 bp, Mus musculus
cagacatggcagcaaaaatatttgc

SEQ ID NO: 14092 - DNA, 25 bp, Mus musculus
cagacatggcaggaaaaatatttgc

SEQ ID NO: 14093 - DNA, 25 bp, Mus musculus
cagacatggcctttgaaaccattgt

SEQ ID NO: 14094 - DNA, 25 bp, Mus musculus
cagacatgtactctctgatagacga

SEQ ID NO: 14095 - DNA, 25 bp, Mus musculus
cagacatgttccagctggaccctca

SEQ ID NO: 14096 - DNA, 25 bp, Mus musculus
cagacattatctgacgaatctgatg

SEQ ID NO: 14097 - DNA, 25 bp, Mus musculus
cagacattatgttacatcaccagaa

SEQ ID NO: 14098 - DNA, 25 bp, Mus musculus
cagacattcagcagccaagctgaca

SEQ ID NO: 14099 - DNA, 25 bp, Mus musculus
cagaccaaagaagagagttggacag

SEQ ID NO: 14100 - DNA, 25 bp, Mus musculus
cagaccaaagagtgcaacaaacgaa

SEQ ID NO: 14101 - DNA, 25 bp, Mus musculus
cagaccaagatgactgagcgagcgc

SEQ ID NO: 14102 - DNA, 25 bp, Mus musculus
cagaccaagtggatgagccagtgcc

SEQ ID NO: 14103 - DNA, 25 bp, Mus musculus
cagaccaatgccagaggagcaacag

SEQ ID NO: 14104 - DNA, 25 bp, Mus musculus
cagaccagactgataatatacatgt

SEQ ID NO: 14105 - DNA, 25 bp, Mus musculus
cagaccagcaaattattcacgacag

SEQ ID NO: 14106 - DNA, 25 bp, Mus musculus
cagaccagcagttggtaaagaaagg

SEQ ID NO: 14107 - DNA, 25 bp, Mus musculus
cagaccaggaggcttataaacaaca

SEQ ID NO: 14108 - DNA, 25 bp, Mus musculus
cagaccagtgtattctaaaaaggga

SEQ ID NO: 14109 - DNA, 25 bp, Mus musculus
cagaccagttctatcgctacaagat

SEQ ID NO: 14110 - DNA, 25 bp, Mus musculus
cagacccaagcctgagcttgcagtg

SEQ ID NO: 14111 - DNA, 25 bp, Mus musculus
cagacccagcaagttttccttaaca

SEQ ID NO: 14112 - DNA, 25 bp, Mus musculus
cagacccattgtgaagtcagcgtgg

SEQ ID NO: 14113 - DNA, 25 bp, Mus musculus
cagacccatttaggaggcatgatag

SEQ ID NO: 14114 - DNA, 25 bp, Mus musculus
cagaccccacttctagaaggttctt

SEQ ID NO: 14115 - DNA, 25 bp, Mus musculus
cagacccggcgcatcagaagccggg

SEQ ID NO: 14116 - DNA, 25 bp, Mus musculus
cagaccctgcaaatgacagatgggc

SEQ ID NO: 14117 - DNA, 25 bp, Mus musculus
cagaccctgttgatgttgtaccgca

SEQ ID NO: 14118 - DNA, 25 bp, Mus musculus
cagaccgccatgaccgagacttacg

SEQ ID NO: 14119 - DNA, 25 bp, Mus musculus
cagaccgccatgtccgagacttacg

SEQ ID NO: 14120 - DNA, 25 bp, Mus musculus
cagaccggcacggatgaaaacccag

SEQ ID NO: 14121 - DNA, 25 bp, Mus musculus
cagaccgggcccaggtcttcctgaa

SEQ ID NO: 14122 - DNA, 25 bp, Mus musculus
cagaccgtgctggaaggggacaact

SEQ ID NO: 14123 - DNA, 25 bp, Mus musculus
cagaccgtggatggcaaacaccaag

SEQ ID NO: 14124 - DNA, 25 bp, Mus musculus
cagaccgttgccatctgcttcctgg

SEQ ID NO: 14125 - DNA, 25 bp, Mus musculus
cagacctaccgagtgctgctgggcg

SEQ ID NO: 14126 - DNA, 25 bp, Mus musculus
cagacctacggcaacgggtccaaat

SEQ ID NO: 14127 - DNA, 25 bp, Mus musculus
cagacctcatccatggctgttctgg

SEQ ID NO: 14128 - DNA, 25 bp, Mus musculus
cagacctcgggctgcctttgtttga

SEQ ID NO: 14129 - DNA, 25 bp, Mus musculus
cagacctctatgacgtgtttgtgaa

SEQ ID NO: 14130 - DNA, 25 bp, Mus musculus
cagacctgatagtcttgaagatgca

SEQ ID NO: 14131 - DNA, 25 bp, Mus musculus
cagacctgatgaaggaggctacagt

SEQ ID NO: 14132 - DNA, 25 bp, Mus musculus
cagacctgcagactgaggtcagctg

SEQ ID NO: 14133 - DNA, 25 bp, Mus musculus
cagacctgcagagaaactcagcaca

SEQ ID NO: 14134 - DNA, 25 bp, Mus musculus
cagacctgcataagatccctgttgc

SEQ ID NO: 14135 - DNA, 25 bp, Mus musculus
cagacctggcttcaatgtgctcaag

SEQ ID NO: 14136 - DNA, 25 bp, Mus musculus
cagacctgggcaaagtgatagaaag

SEQ ID NO: 14137 - DNA, 25 bp, Mus musculus
cagacctggtggagaccctggagct

SEQ ID NO: 14138 - DNA, 25 bp, Mus musculus
cagacctgtcgccaaagcaaggtat

SEQ ID NO: 14139 - DNA, 25 bp, Mus musculus
cagaccttcagtcagacctcttctt

SEQ ID NO: 14140 - DNA, 25 bp, Mus musculus
cagacgatatgtttgcggttggata

SEQ ID NO: 14141 - DNA, 25 bp, Mus musculus
cagacgatctctggacccgttttgt

SEQ ID NO: 14142 - DNA, 25 bp, Mus musculus
cagacgcagagcgagcccttgctgt

SEQ ID NO: 14143 - DNA, 25 bp, Mus musculus
cagacgccacggtgcacccgtgtgg

SEQ ID NO: 14144 - DNA, 25 bp, Mus musculus
cagacgcttcatatatgtgaaagag

SEQ ID NO: 14145 - DNA, 25 bp, Mus musculus
cagacggaccggatatgcagagcct

SEQ ID NO: 14146 - DNA, 25 bp, Mus musculus
cagacgggactgctatgccattcgg

SEQ ID NO: 14147 - DNA, 25 bp, Mus musculus
cagacgggtcacactgctggaagcc

SEQ ID NO: 14148 - DNA, 25 bp, Mus musculus
cagacgtcactgttgcctctattca

SEQ ID NO: 14149 - DNA, 25 bp, Mus musculus
cagacgtctctcaactggaaggaca

SEQ ID NO: 14150 - DNA, 25 bp, Mus musculus
cagacgtggagctggtcgtgttcct

SEQ ID NO: 14151 - DNA, 25 bp, Mus musculus
cagacgtggcagtatttgaagcagt

SEQ ID NO: 14152 - DNA, 25 bp, Mus musculus
cagacgttacccatgttgctcagct

SEQ ID NO: 14153 - DNA, 25 bp, Mus musculus
cagacgttacccttgttgctcagct

SEQ ID NO: 14154 - DNA, 25 bp, Mus musculus
cagacgttggcaccatctgtgaccc

SEQ ID NO: 14155 - DNA, 25 bp, Mus musculus
cagactacagtgactcggtggcacg

SEQ ID NO: 14156 - DNA, 25 bp, Mus musculus
cagactacggtgactgttgggtaca

SEQ ID NO: 14157 - DNA, 25 bp, Mus musculus
cagactagagacagaatgtgtgagt

SEQ ID NO: 14158 - DNA, 25 bp, Mus musculus
cagactatggagcttttatcaaaat

SEQ ID NO: 14159 - DNA, 25 bp, Mus musculus
cagactcagataatagctgggtgct

SEQ ID NO: 14160 - DNA, 25 bp, Mus musculus
cagactccaaactatcatgtcacac

SEQ ID NO: 14161 - DNA, 25 bp, Mus musculus
cagactccactctgcagataaagaa

SEQ ID NO: 14162 - DNA, 25 bp, Mus musculus
cagactcctgcccatggaggctttg

SEQ ID NO: 14163 - DNA, 25 bp, Mus musculus
cagactctgacaatagtgctggtga

SEQ ID NO: 14164 - DNA, 25 bp, Mus musculus
cagactctgtggttgatgtgggaaa

SEQ ID NO: 14165 - DNA, 25 bp, Mus musculus
cagactgagctgtggccaaccgttt

SEQ ID NO: 14166 - DNA, 25 bp, Mus musculus
cagactgaggcaaggtcatgctgaa

SEQ ID NO: 14167 - DNA, 25 bp, Mus musculus
cagactgatcttgcttccttggcct

SEQ ID NO: 14168 - DNA, 25 bp, Mus musculus
cagactgcacgggtgtccagggata

SEQ ID NO: 14169 - DNA, 25 bp, Mus musculus
cagactgctggctgatagctgtgct

SEQ ID NO: 14170 - DNA, 25 bp, Mus musculus
cagactggaagtgcgtgtacacgta

SEQ ID NO: 14171 - DNA, 25 bp, Mus musculus
cagactggagctgggtcccacttca

SEQ ID NO: 14172 - DNA, 25 bp, Mus musculus
cagactggccttcagatcctcttat

SEQ ID NO: 14173 - DNA, 25 bp, Mus musculus
cagactggcttcagcttcctgcagg

SEQ ID NO: 14174 - DNA, 25 bp, Mus musculus
cagactgtatcaagcgagactatca

SEQ ID NO: 14175 - DNA, 25 bp, Mus musculus
cagactgttgctctgtgtcaggaga

SEQ ID NO: 14176 - DNA, 25 bp, Mus musculus
cagactgttgctgtgtgtcaggaga

SEQ ID NO: 14177 - DNA, 25 bp, Mus musculus
cagactgttttaactgcttgccgat

SEQ ID NO: 14178 - DNA, 25 bp, Mus musculus
cagacttcaccacagatgaatgcga

SEQ ID NO: 14179 - DNA, 25 bp, Mus musculus
cagacttcattctggaggactccat

SEQ ID NO: 14180 - DNA, 25 bp, Mus musculus
cagacttctcgtagagacctggaga

SEQ ID NO: 14181 - DNA, 25 bp, Mus musculus
cagacttctgaagatgacaatttgt

SEQ ID NO: 14182 - DNA, 25 bp, Mus musculus
cagacttctgcggttcaaattgcaa

SEQ ID NO: 14183 - DNA, 25 bp, Mus musculus
cagacttcttatcatggaaggcaac

SEQ ID NO: 14184 - DNA, 25 bp, Mus musculus
cagacttctttcaatcatcacagta

SEQ ID NO: 14185 - DNA, 25 bp, Mus musculus
cagacttctttctatcatcacagta

SEQ ID NO: 14186 - DNA, 25 bp, Mus musculus
cagacttggagacatagtccctcca

SEQ ID NO: 14187 - DNA, 25 bp, Mus musculus
cagacttggtctatacactggcttt

SEQ ID NO: 14188 - DNA, 25 bp, Mus musculus
cagactttccgagacctggtctggt

SEQ ID NO: 14189 - DNA, 25 bp, Mus musculus
cagagaaaacacaggaagtactgga

SEQ ID NO: 14190 - DNA, 25 bp, Mus musculus
cagagaaaagcatgtggcacagttg

SEQ ID NO: 14191 - DNA, 25 bp, Mus musculus
cagagaaaatcccaggctcatatag

SEQ ID NO: 14192 - DNA, 25 bp, Mus musculus
cagagaaaatgttcaagggcaaacg

SEQ ID NO: 14193 - DNA, 25 bp, Mus musculus
cagagaaactcagcacagctcagtc

SEQ ID NO: 14194 - DNA, 25 bp, Mus musculus
cagagaaagtttcttccaactactt

SEQ ID NO: 14195 - DNA, 25 bp, Mus musculus
cagagaaataatgaggacgtttcta

SEQ ID NO: 14196 - DNA, 25 bp, Mus musculus
cagagaaatccatgatgaccttacg

SEQ ID NO: 14197 - DNA, 25 bp, Mus musculus
cagagaacctgtacagttggaaaca

SEQ ID NO: 14198 - DNA, 25 bp, Mus musculus
cagagaactcaggagacaaaagagg

SEQ ID NO: 14199 - DNA, 25 bp, Mus musculus
cagagaactgcggagtgtcatgaat

SEQ ID NO: 14200 - DNA, 25 bp, Mus musculus
cagagaactgggaaacatcattcag

SEQ ID NO: 14201 - DNA, 25 bp, Mus musculus
cagagaagagcaagcccctggacca

SEQ ID NO: 14202 - DNA, 25 bp, Mus musculus
cagagaagaggatcccagggtgaca

SEQ ID NO: 14203 - DNA, 25 bp, Mus musculus
cagagaagagtgagataagatgtca

SEQ ID NO: 14204 - DNA, 25 bp, Mus musculus
cagagaagcattgctaccaaagccc

SEQ ID NO: 14205 - DNA, 25 bp, Mus musculus
cagagaagcctgaaaaagaaaaatc

SEQ ID NO: 14206 - DNA, 25 bp, Mus musculus
cagagaagggctattcgtttgtcag

SEQ ID NO: 14207 - DNA, 25 bp, Mus musculus
cagagaagttaagtacagataagag

SEQ ID NO: 14208 - DNA, 25 bp, Mus musculus
cagagaagtttttcatggctaccta

SEQ ID NO: 14209 - DNA, 25 bp, Mus musculus
cagagaatgaccacatcaacctgaa

SEQ ID NO: 14210 - DNA, 25 bp, Mus musculus
cagagaatgcaattgtgcatatggg

SEQ ID NO: 14211 - DNA, 25 bp, Mus musculus
cagagaatgctcatgttgcttggta

SEQ ID NO: 14212 - DNA, 25 bp, Mus musculus
cagagaatgtccagtggtttgtgct

SEQ ID NO: 14213 - DNA, 25 bp, Mus musculus
cagagacaaaagtttcactcagtca

SEQ ID NO: 14214 - DNA, 25 bp, Mus musculus
cagagacaacccctgattctaccta

SEQ ID NO: 14215 - DNA, 25 bp, Mus musculus
cagagacaccacattgaaattagag

SEQ ID NO: 14216 - DNA, 25 bp, Mus musculus
cagagacaccactttgaaattagag

SEQ ID NO: 14217 - DNA, 25 bp, Mus musculus
cagagacacctagagatttaactgt

SEQ ID NO: 14218 - DNA, 25 bp, Mus musculus
cagagacacctgttaatccacaaca

SEQ ID NO: 14219 - DNA, 25 bp, Mus musculus
cagagacactcaggtctgagccggc

SEQ ID NO: 14220 - DNA, 25 bp, Mus musculus
cagagacagctaagctaggcagacc

SEQ ID NO: 14221 - DNA, 25 bp, Mus musculus
cagagacagtttaagtacaaccaac

SEQ ID NO: 14222 - DNA, 25 bp, Mus musculus
cagagacccaagtgtttgtggccac

SEQ ID NO: 14223 - DNA, 25 bp, Mus musculus
cagagaccttcagtttcggtggctg

SEQ ID NO: 14224 - DNA, 25 bp, Mus musculus
cagagacggaagctaccattttgcc

SEQ ID NO: 14225 - DNA, 25 bp, Mus musculus
cagagacggctaccatgacaatggg

SEQ ID NO: 14226 - DNA, 25 bp, Mus musculus
cagagacgtgatgcgggaaaactac

SEQ ID NO: 14227 - DNA, 25 bp, Mus musculus
cagagacgtggagtatcatggagtt

SEQ ID NO: 14228 - DNA, 25 bp, Mus musculus
cagagactagaagaattcttcacca

SEQ ID NO: 14229 - DNA, 25 bp, Mus musculus
cagagactagcaaggataaggtgcc

SEQ ID NO: 14230 - DNA, 25 bp, Mus musculus
cagagactctggactctcaggctgt

SEQ ID NO: 14231 - DNA, 25 bp, Mus musculus
cagagactgacacccatagatgctt

SEQ ID NO: 14232 - DNA, 25 bp, Mus musculus
cagagacttgcaaatgcctatttcc

SEQ ID NO: 14233 - DNA, 25 bp, Mus musculus
cagagacttttggaataacaatgaa

SEQ ID NO: 14234 - DNA, 25 bp, Mus musculus
cagagagaaattaaagccccagcta

SEQ ID NO: 14235 - DNA, 25 bp, Mus musculus
cagagagaatctgaagttgagaaca

SEQ ID NO: 14236 - DNA, 25 bp, Mus musculus
cagagagatacctgaattaaaggcc

SEQ ID NO: 14237 - DNA, 25 bp, Mus musculus
cagagagatgtcttggaacagatcc

SEQ ID NO: 14238 - DNA, 25 bp, Mus musculus
cagagagcagctaccagctcaggag

SEQ ID NO: 14239 - DNA, 25 bp, Mus musculus
cagagagcagtgatgaggatctgcc

SEQ ID NO: 14240 - DNA, 25 bp, Mus musculus
cagagagccaaagagggcaagagac

SEQ ID NO: 14241 - DNA, 25 bp, Mus musculus
cagagagctggcagaggatgagccc

SEQ ID NO: 14242 - DNA, 25 bp, Mus musculus
cagagaggaagacacatgtactatt

SEQ ID NO: 14243 - DNA, 25 bp, Mus musculus
cagagaggaatgcagtgtccctgtc

SEQ ID NO: 14244 - DNA, 25 bp, Mus musculus
cagagaggatagctgacggcaccat

SEQ ID NO: 14245 - DNA, 25 bp, Mus musculus
cagagaggctggagggtcctttcaa

SEQ ID NO: 14246 - DNA, 25 bp, Mus musculus
cagagaggctggtgggtcctttcaa

SEQ ID NO: 14247 - DNA, 25 bp, Mus musculus
cagagaggtcacatggcttgctcga

SEQ ID NO: 14248 - DNA, 25 bp, Mus musculus
cagagaggtgacagaacttattaaa

SEQ ID NO: 14249 - DNA, 25 bp, Mus musculus
cagagagtagccattgatggaatac

SEQ ID NO: 14250 - DNA, 25 bp, Mus musculus
cagagagtgacttttgacctgtacc

SEQ ID NO: 14251 - DNA, 25 bp, Mus musculus
cagagataagcctcgaagcagcctt

SEQ ID NO: 14252 - DNA, 25 bp, Mus musculus
cagagatacaattcccacatggtgc

SEQ ID NO: 14253 - DNA, 25 bp, Mus musculus
cagagatacctgcacctttgtccta

SEQ ID NO: 14254 - DNA, 25 bp, Mus musculus
cagagatacgtgcagctcaagcagg

SEQ ID NO: 14255 - DNA, 25 bp, Mus musculus
cagagatccaagatggcagattcaa

SEQ ID NO: 14256 - DNA, 25 bp, Mus musculus
cagagatcgatacgtacttcaccgg

SEQ ID NO: 14257 - DNA, 25 bp, Mus musculus
cagagatctaaagctggaaaacata

SEQ ID NO: 14258 - DNA, 25 bp, Mus musculus
cagagatgaactggcagacttggag

SEQ ID NO: 14259 - DNA, 25 bp, Mus musculus
cagagatgacctccatcttgcgaag

SEQ ID NO: 14260 - DNA, 25 bp, Mus musculus
cagagatgagcgtgtgaacctgctg

SEQ ID NO: 14261 - DNA, 25 bp, Mus musculus
cagagatgatcagagctctggagca

SEQ ID NO: 14262 - DNA, 25 bp, Mus musculus
cagagatgcctacttttactgaaga

SEQ ID NO: 14263 - DNA, 25 bp, Mus musculus
cagagatgctgagccgattatcggg

SEQ ID NO: 14264 - DNA, 25 bp, Mus musculus
cagagatggtgtacatagatgaaat

SEQ ID NO: 14265 - DNA, 25 bp, Mus musculus
cagagatgtgtgaccagcggcagct

SEQ ID NO: 14266 - DNA, 25 bp, Mus musculus
cagagatgttgtgagcagtgtacct

SEQ ID NO: 14267 - DNA, 25 bp, Mus musculus
cagagattgagagagtcaaacgcaa

SEQ ID NO: 14268 - DNA, 25 bp, Mus musculus
cagagcaacgttgcccttgggcaga

SEQ ID NO: 14269 - DNA, 25 bp, Mus musculus
cagagcaagcagcaatccaatgagc

SEQ ID NO: 14270 - DNA, 25 bp, Mus musculus
cagagcaaggatggctcgggcttcc

SEQ ID NO: 14271 - DNA, 25 bp, Mus musculus
cagagcaagttcagtgccatccaga

SEQ ID NO: 14272 - DNA, 25 bp, Mus musculus
cagagcacacagacctgatgttttc

SEQ ID NO: 14273 - DNA, 25 bp, Mus musculus
cagagcacagagacttgccggagtc

SEQ ID NO: 14274 - DNA, 25 bp, Mus musculus
cagagcacccgactcaaagcattgg

SEQ ID NO: 14275 - DNA, 25 bp, Mus musculus
cagagcaccggcatgatgagctgca

SEQ ID NO: 14276 - DNA, 25 bp, Mus musculus
cagagcacctttgtggcatcaattt

SEQ ID NO: 14277 - DNA, 25 bp, Mus musculus
cagagcagaacatcactggctccag

SEQ ID NO: 14278 - DNA, 25 bp, Mus musculus
cagagcagcagcacttgggccggca

SEQ ID NO: 14279 - DNA, 25 bp, Mus musculus
cagagcagctgcgagaagcgtgccc

SEQ ID NO: 14280 - DNA, 25 bp, Mus musculus
cagagcagctttgccaccggcttat

SEQ ID NO: 14281 - DNA, 25 bp, Mus musculus
cagagcaggcgctcaccattaggga

SEQ ID NO: 14282 - DNA, 25 bp, Mus musculus
cagagcagggaagatgattaagttc

SEQ ID NO: 14283 - DNA, 25 bp, Mus musculus
cagagcaggtatctgtgttctacca

SEQ ID NO: 14284 - DNA, 25 bp, Mus musculus
cagagcagtctgaagtcggtggatt

SEQ ID NO: 14285 - DNA, 25 bp, Mus musculus
cagagcataaatacggagaggcaga

SEQ ID NO: 14286 - DNA, 25 bp, Mus musculus
cagagcatagctctgctcatatgca

SEQ ID NO: 14287 - DNA, 25 bp, Mus musculus
cagagcatctgtacttggagaccac

SEQ ID NO: 14288 - DNA, 25 bp, Mus musculus
cagagcatgactgattatggcaaag

SEQ ID NO: 14289 - DNA, 25 bp, Mus musculus
cagagccaatctctgcgtgacagag

SEQ ID NO: 14290 - DNA, 25 bp, Mus musculus
cagagccacgacagtcggaaatcta

SEQ ID NO: 14291 - DNA, 25 bp, Mus musculus
cagagccagggagataccccttgct

SEQ ID NO: 14292 - DNA, 25 bp, Mus musculus
cagagccagtacagcagctacggca

SEQ ID NO: 14293 - DNA, 25 bp, Mus musculus
cagagccagttcctgagctgttgtc

SEQ ID NO: 14294 - DNA, 25 bp, Mus musculus
cagagccatttctgagagtggtgtg

SEQ ID NO: 14295 - DNA, 25 bp, Mus musculus
cagagcccacctgtgctgtacagag

SEQ ID NO: 14296 - DNA, 25 bp, Mus musculus
cagagcccagaaattcacgtgagta

SEQ ID NO: 14297 - DNA, 25 bp, Mus musculus
cagagcccagaccatgtttacaggg

SEQ ID NO: 14298 - DNA, 25 bp, Mus musculus
cagagccccgtttacaggtccttgg

SEQ ID NO: 14299 - DNA, 25 bp, Mus musculus
cagagcccgttaaatgccagtgata

SEQ ID NO: 14300 - DNA, 25 bp, Mus musculus
cagagcccgttatatgccagtgata

SEQ ID NO: 14301 - DNA, 25 bp, Mus musculus
cagagccctgccttgtctcaaagag

SEQ ID NO: 14302 - DNA, 25 bp, Mus musculus
cagagccctttggtcacctggtgga

SEQ ID NO: 14303 - DNA, 25 bp, Mus musculus
cagagccgggataagcagatagaag

SEQ ID NO: 14304 - DNA, 25 bp, Mus musculus
cagagccggtgtcacatgacagaac

SEQ ID NO: 14305 - DNA, 25 bp, Mus musculus
cagagccggtgtgacatgacagaac

SEQ ID NO: 14306 - DNA, 25 bp, Mus musculus
cagagcctctttgtgtggaaaacga

SEQ ID NO: 14307 - DNA, 25 bp, Mus musculus
cagagcctgaaagggtgggactaca

SEQ ID NO: 14308 - DNA, 25 bp, Mus musculus
cagagcctgatgatgcccagctcca

SEQ ID NO: 14309 - DNA, 25 bp, Mus musculus
cagagcctgctatccccagtacatg

SEQ ID NO: 14310 - DNA, 25 bp, Mus musculus
cagagcctgctattggagaaggcgc

SEQ ID NO: 14311 - DNA, 25 bp, Mus musculus
cagagcctgctctttgaaaagacca

SEQ ID NO: 14312 - DNA, 25 bp, Mus musculus
cagagcctggtaccactgcgaccag

SEQ ID NO: 14313 - DNA, 25 bp, Mus musculus
cagagcctgtgggttgagaatcaag

SEQ ID NO: 14314 - DNA, 25 bp, Mus musculus
cagagcctttgacagcgacccggga

SEQ ID NO: 14315 - DNA, 25 bp, Mus musculus
cagagcctttgagagcgacccggga

SEQ ID NO: 14316 - DNA, 25 bp, Mus musculus
cagagcgaactctgctcagccattc

SEQ ID NO: 14317 - DNA, 25 bp, Mus musculus
cagagcgagcccttgctgtggccag

SEQ ID NO: 14318 - DNA, 25 bp, Mus musculus
cagagcgcaaggcatacaccagaaa

SEQ ID NO: 14319 - DNA, 25 bp, Mus musculus
cagagcggcacgattcggctcgact

SEQ ID NO: 14320 - DNA, 25 bp, Mus musculus
cagagcgggctgtagcggaactcaa

SEQ ID NO: 14321 - DNA, 25 bp, Mus musculus
cagagcggtgatgagagaaaccatc

SEQ ID NO: 14322 - DNA, 25 bp, Mus musculus
cagagctagaaagccggctccatca

SEQ ID NO: 14323 - DNA, 25 bp, Mus musculus
cagagctagcagagcagcagcactt

SEQ ID NO: 14324 - DNA, 25 bp, Mus musculus
cagagctcagaactccaagatacac

SEQ ID NO: 14325 - DNA, 25 bp, Mus musculus
cagagctcagaagtccaagatacac

SEQ ID NO: 14326 - DNA, 25 bp, Mus musculus
cagagctccgaggaatgggacccag

SEQ ID NO: 14327 - DNA, 25 bp, Mus musculus
cagagctcctagacacaaaccggta

SEQ ID NO: 14328 - DNA, 25 bp, Mus musculus
cagagctctgcggataaagagagac

SEQ ID NO: 14329 - DNA, 25 bp, Mus musculus
cagagctgccaccttcgatggaacg

SEQ ID NO: 14330 - DNA, 25 bp, Mus musculus
cagagctgcctcgttattccaaaga

SEQ ID NO: 14331 - DNA, 25 bp, Mus musculus
cagagctggcagagtacacggccaa

SEQ ID NO: 14332 - DNA, 25 bp, Mus musculus
cagagctggttgtggaccatagaag

SEQ ID NO: 14333 - DNA, 25 bp, Mus musculus
cagagctgtcttaaatcttttgagt

SEQ ID NO: 14334 - DNA, 25 bp, Mus musculus
cagagctgtggaactggagggagat

SEQ ID NO: 14335 - DNA, 25 bp, Mus musculus
cagagcttccgactataaatcggct

SEQ ID NO: 14336 - DNA, 25 bp, Mus musculus
cagagcttggccattgccacctgtg

SEQ ID NO: 14337 - DNA, 25 bp, Mus musculus
cagagcttgtcaacgactatggcaa

SEQ ID NO: 14338 - DNA, 25 bp, Mus musculus
cagagctttgggatgccgggatcaa

SEQ ID NO: 14339 - DNA, 25 bp, Mus musculus
cagaggaaaattcaagaaatgctgg

SEQ ID NO: 14340 - DNA, 25 bp, Mus musculus
cagaggaaccgaagccaagtaccac

SEQ ID NO: 14341 - DNA, 25 bp, Mus musculus
cagaggaagccattacccactgctg

SEQ ID NO: 14342 - DNA, 25 bp, Mus musculus
cagaggaagctcttttaataaacct

SEQ ID NO: 14343 - DNA, 25 bp, Mus musculus
cagaggaaggaaaactcagggtctt

SEQ ID NO: 14344 - DNA, 25 bp, Mus musculus
cagaggacacggagcgtggacaaca

SEQ ID NO: 14345 - DNA, 25 bp, Mus musculus
cagaggacaggctgcaagagaagat

SEQ ID NO: 14346 - DNA, 25 bp, Mus musculus
cagaggacatgataaactgtttacc

SEQ ID NO: 14347 - DNA, 25 bp, Mus musculus
cagaggacatgcctactgatatgaa

SEQ ID NO: 14348 - DNA, 25 bp, Mus musculus
cagaggacatttaagctcgactaca

SEQ ID NO: 14349 - DNA, 25 bp, Mus musculus
cagaggacctgtgtgcttaaagtct

SEQ ID NO: 14350 - DNA, 25 bp, Mus musculus
cagaggacgacagcttctgtggtgt

SEQ ID NO: 14351 - DNA, 25 bp, Mus musculus
cagaggacgattcttttctccagtg

SEQ ID NO: 14352 - DNA, 25 bp, Mus musculus
cagaggacggagaggattgaccaca

SEQ ID NO: 14353 - DNA, 25 bp, Mus musculus
cagaggagcacgcagctgaacaaga

SEQ ID NO: 14354 - DNA, 25 bp, Mus musculus
cagaggagccaaggttatctcaaca

SEQ ID NO: 14355 - DNA, 25 bp, Mus musculus
cagaggagctggaacaacagaaaag

SEQ ID NO: 14356 - DNA, 25 bp, Mus musculus
cagaggagctggatgtccccttgga

SEQ ID NO: 14357 - DNA, 25 bp, Mus musculus
cagaggagttcctgcggctgtctaa

SEQ ID NO: 14358 - DNA, 25 bp, Mus musculus
cagaggatccgcctatttccttcct

SEQ ID NO: 14359 - DNA, 25 bp, Mus musculus
cagaggatctgtggtgtcacaccct

SEQ ID NO: 14360 - DNA, 25 bp, Mus musculus
cagaggatggacagcgaaccgagta

SEQ ID NO: 14361 - DNA, 25 bp, Mus musculus
cagaggatggtctgggccaattccc

SEQ ID NO: 14362 - DNA, 25 bp, Mus musculus
cagaggatgtccgaagaatgaaatg

SEQ ID NO: 14363 - DNA, 25 bp, Mus musculus
cagaggcacatcagtgacctgtacg

SEQ ID NO: 14364 - DNA, 25 bp, Mus musculus
cagaggcagaacgatcattacagat

SEQ ID NO: 14365 - DNA, 25 bp, Mus musculus
cagaggcagaatacagagaaagctc

SEQ ID NO: 14366 - DNA, 25 bp, Mus musculus
cagaggcagagagatacctgaatta

SEQ ID NO: 14367 - DNA, 25 bp, Mus musculus
cagaggcagtggatgtacaaaaaca

SEQ ID NO: 14368 - DNA, 25 bp, Mus musculus
cagaggccatctgaaaagacttggg

SEQ ID NO: 14369 - DNA, 25 bp, Mus musculus
cagaggccgggattttgaaaagcaa

SEQ ID NO: 14370 - DNA, 25 bp, Mus musculus
cagaggcgactctcggaagtggcaa

SEQ ID NO: 14371 - DNA, 25 bp, Mus musculus
cagaggcgaggctgagtgtcaactt

SEQ ID NO: 14372 - DNA, 25 bp, Mus musculus
cagaggcgattcaaggagttcctga

SEQ ID NO: 14373 - DNA, 25 bp, Mus musculus
cagaggcgccccagaggacactgag

SEQ ID NO: 14374 - DNA, 25 bp, Mus musculus
cagaggcggctcaagttctaattct

SEQ ID NO: 14375 - DNA, 25 bp, Mus musculus
cagaggctatagacctgggtgtgaa

SEQ ID NO: 14376 - DNA, 25 bp, Mus musculus
cagaggctcttcatgatcctttggc

SEQ ID NO: 14377 - DNA, 25 bp, Mus musculus
cagaggcttacatcaaggaaccaga

SEQ ID NO: 14378 - DNA, 25 bp, Mus musculus
cagagggaacacagatggctgtatt

SEQ ID NO: 14379 - DNA, 25 bp, Mus musculus
cagagggatgtgtatctgtctcaca

SEQ ID NO: 14380 - DNA, 25 bp, Mus musculus
cagagggccctgttgtgaacgctaa

SEQ ID NO: 14381 - DNA, 25 bp, Mus musculus
cagagggctaccctatccccttgga

SEQ ID NO: 14382 - DNA, 25 bp, Mus musculus
cagagggctatatcctcaacgcaca

SEQ ID NO: 14383 - DNA, 25 bp, Mus musculus
cagagggcttcggtgatgccgcact

SEQ ID NO: 14384 - DNA, 25 bp, Mus musculus
cagagggtcctaacatggaagatcc

SEQ ID NO: 14385 - DNA, 25 bp, Mus musculus
cagagggtctcggatagtggctttc

SEQ ID NO: 14386 - DNA, 25 bp, Mus musculus
cagagggtgaatgggtatctttccc

SEQ ID NO: 14387 - DNA, 25 bp, Mus musculus
cagagggtgtgacaaccatcctccc

SEQ ID NO: 14388 - DNA, 25 bp, Mus musculus
cagagggttagatcactgcccagcg

SEQ ID NO: 14389 - DNA, 25 bp, Mus musculus
cagaggtaatcctgtaaggtgtgat

SEQ ID NO: 14390 - DNA, 25 bp, Mus musculus
cagaggtatagcaagttaaaagaga

SEQ ID NO: 14391 - DNA, 25 bp, Mus musculus
cagaggtcatcaatgcccatgacta

SEQ ID NO: 14392 - DNA, 25 bp, Mus musculus
cagaggtccaactccagagtgcaga

SEQ ID NO: 14393 - DNA, 25 bp, Mus musculus
cagaggtcctacaggaacaccaggg

SEQ ID NO: 14394 - DNA, 25 bp, Mus musculus
cagaggtctgtggtttcttgaaaca

SEQ ID NO: 14395 - DNA, 25 bp, Mus musculus
cagaggtgacagatgtttatgagat

SEQ ID NO: 14396 - DNA, 25 bp, Mus musculus
cagaggtgccatccagtttgtcaca

SEQ ID NO: 14397 - DNA, 25 bp, Mus musculus
cagaggtgcttagcctttgtggatg

SEQ ID NO: 14398 - DNA, 25 bp, Mus musculus
cagaggtggaactcccaaaacgtcg

SEQ ID NO: 14399 - DNA, 25 bp, Mus musculus
cagaggtggcactggcctatgccaa

SEQ ID NO: 14400 - DNA, 25 bp, Mus musculus
cagaggtggctgacctcaagaagca

SEQ ID NO: 14401 - DNA, 25 bp, Mus musculus
cagaggtgggctaaaggctgtccaa

SEQ ID NO: 14402 - DNA, 25 bp, Mus musculus
cagaggttcaggagagctacaggca

SEQ ID NO: 14403 - DNA, 25 bp, Mus musculus
cagaggttccgcaagggactgtcct

SEQ ID NO: 14404 - DNA, 25 bp, Mus musculus
cagaggttgaagatgtcgagtgcac

SEQ ID NO: 14405 - DNA, 25 bp, Mus musculus
cagaggttgcggaaggagactccac

SEQ ID NO: 14406 - DNA, 25 bp, Mus musculus
cagagtaagaacctgggctgagcct

SEQ ID NO: 14407 - DNA, 25 bp, Mus musculus
cagagtaagccctgcaggcacagga

SEQ ID NO: 14408 - DNA, 25 bp, Mus musculus
cagagtaatcaattggcccagaagt

SEQ ID NO: 14409 - DNA, 25 bp, Mus musculus
cagagtaatgcggagcagcacgcag

SEQ ID NO: 14410 - DNA, 25 bp, Mus musculus
cagagtacattagcagccgcatggc

SEQ ID NO: 14411 - DNA, 25 bp, Mus musculus
cagagtaccgtgctagcggcgctct

SEQ ID NO: 14412 - DNA, 25 bp, Mus musculus
cagagtaccgtggtagcggcgctct

SEQ ID NO: 14413 - DNA, 25 bp, Mus musculus
cagagtacctctgtcagataggtga

SEQ ID NO: 14414 - DNA, 25 bp, Mus musculus
cagagtaccttggtaatagctgagc

SEQ ID NO: 14415 - DNA, 25 bp, Mus musculus
cagagtactttagtcctgaggactc

SEQ ID NO: 14416 - DNA, 25 bp, Mus musculus
cagagtagccaatcctgtgccagcg

SEQ ID NO: 14417 - DNA, 25 bp, Mus musculus
cagagtataaagcagctgtcacact

SEQ ID NO: 14418 - DNA, 25 bp, Mus musculus
cagagtatatgctgtgtctacaaaa

SEQ ID NO: 14419 - DNA, 25 bp, Mus musculus
cagagtatgaaactggacagtgagc

SEQ ID NO: 14420 - DNA, 25 bp, Mus musculus
cagagtcacattctccactgttctc

SEQ ID NO: 14421 - DNA, 25 bp, Mus musculus
cagagtcatcctgtccaacatggta

SEQ ID NO: 14422 - DNA, 25 bp, Mus musculus
cagagtccaagtccatgccagtgtt

SEQ ID NO: 14423 - DNA, 25 bp, Mus musculus
cagagtccagcgattgtccaagaat

SEQ ID NO: 14424 - DNA, 25 bp, Mus musculus
cagagtcccagatcctaattatatt

SEQ ID NO: 14425 - DNA, 25 bp, Mus musculus
cagagtcctatgtacaatgtcacgc

SEQ ID NO: 14426 - DNA, 25 bp, Mus musculus
cagagtccttcagtatgtgggtggt

SEQ ID NO: 14427 - DNA, 25 bp, Mus musculus
cagagtccttccgtgggtcaaagta

SEQ ID NO: 14428 - DNA, 25 bp, Mus musculus
cagagtctacctgggcaaaatcagt

SEQ ID NO: 14429 - DNA, 25 bp, Mus musculus
cagagtctgaaatattggaggccca

SEQ ID NO: 14430 - DNA, 25 bp, Mus musculus
cagagtctgaactagaatggagaaa

SEQ ID NO: 14431 - DNA, 25 bp, Mus musculus
cagagtgaacttcatcgggacagga

SEQ ID NO: 14432 - DNA, 25 bp, Mus musculus
cagagtgaacttgatcgggacagga

SEQ ID NO: 14433 - DNA, 25 bp, Mus musculus
cagagtgaatgaatgcaggacgcct

SEQ ID NO: 14434 - DNA, 25 bp, Mus musculus
cagagtgacctctgaggacaaggag

SEQ ID NO: 14435 - DNA, 25 bp, Mus musculus
cagagtgactctgctaaggcagcgg

SEQ ID NO: 14436 - DNA, 25 bp, Mus musculus
cagagtgactggaatcttggaaatc

SEQ ID NO: 14437 - DNA, 25 bp, Mus musculus
cagagtgactggtatcttggaaatc

SEQ ID NO: 14438 - DNA, 25 bp, Mus musculus
cagagtgagcattcggtggatttac

SEQ ID NO: 14439 - DNA, 25 bp, Mus musculus
cagagtgagttcgtcctaggtacgc

SEQ ID NO: 14440 - DNA, 25 bp, Mus musculus
cagagtgatatacctgggccttcag

SEQ ID NO: 14441 - DNA, 25 bp, Mus musculus
cagagtgatatagctgggccttcag

SEQ ID NO: 14442 - DNA, 25 bp, Mus musculus
cagagtgatcattctgcctcagatc

SEQ ID NO: 14443 - DNA, 25 bp, Mus musculus
cagagtgatccaaagcaaatatgaa

SEQ ID NO: 14444 - DNA, 25 bp, Mus musculus
cagagtgatccatagcaaatatgaa

SEQ ID NO: 14445 - DNA, 25 bp, Mus musculus
cagagtgattccctggaaaggatag

SEQ ID NO: 14446 - DNA, 25 bp, Mus musculus
cagagtgatttggtatgctgtttgc

SEQ ID NO: 14447 - DNA, 25 bp, Mus musculus
cagagtgcaaggtgttctccaagac

SEQ ID NO: 14448 - DNA, 25 bp, Mus musculus
cagagtgcagagatcagtaaggaac

SEQ ID NO: 14449 - DNA, 25 bp, Mus musculus
cagagtgccttggaggctgagctac

SEQ ID NO: 14450 - DNA, 25 bp, Mus musculus
cagagtgctaaagtccagagtactt

SEQ ID NO: 14451 - DNA, 25 bp, Mus musculus
cagagtggttatgggaaagtatcca

SEQ ID NO: 14452 - DNA, 25 bp, Mus musculus
cagagtggttgcctttgaaagtgaa

SEQ ID NO: 14453 - DNA, 25 bp, Mus musculus
cagagtgtatgtggctctcatcacc

SEQ ID NO: 14454 - DNA, 25 bp, Mus musculus
cagagtgtcccagtgacgatgagga

SEQ ID NO: 14455 - DNA, 25 bp, Mus musculus
cagagtgtccctgagagattagaag

SEQ ID NO: 14456 - DNA, 25 bp, Mus musculus
cagagtgtcttaagggcattatcta

SEQ ID NO: 14457 - DNA, 25 bp, Mus musculus
cagagtgtcttttggcgctttctta

SEQ ID NO: 14458 - DNA, 25 bp, Mus musculus
cagagtgtgtacacaccaccggcca

SEQ ID NO: 14459 - DNA, 25 bp, Mus musculus
cagagttacattggattctagaaga

SEQ ID NO: 14460 - DNA, 25 bp, Mus musculus
cagagttactcaaaaactacctgga

SEQ ID NO: 14461 - DNA, 25 bp, Mus musculus
cagagttaggctatgtgttccaagc

SEQ ID NO: 14462 - DNA, 25 bp, Mus musculus
cagagttcaatcagaacaacggaaa

SEQ ID NO: 14463 - DNA, 25 bp, Mus musculus
cagagttcatgtagccatgggcact

SEQ ID NO: 14464 - DNA, 25 bp, Mus musculus
cagagttcgtggcagatatgaccaa

SEQ ID NO: 14465 - DNA, 25 bp, Mus musculus
cagagttctgagatgtgacacaagt

SEQ ID NO: 14466 - DNA, 25 bp, Mus musculus
cagagttctggttgccagaccggca

SEQ ID NO: 14467 - DNA, 25 bp, Mus musculus
cagagttctgtggatcctctcaatg

SEQ ID NO: 14468 - DNA, 25 bp, Mus musculus
cagagttgaagttcccctaattgct

SEQ ID NO: 14469 - DNA, 25 bp, Mus musculus
cagagtttcttagttggccgcaggc

SEQ ID NO: 14470 - DNA, 25 bp, Mus musculus
cagagtttgctgctgcacattccaa

SEQ ID NO: 14471 - DNA, 25 bp, Mus musculus
cagagttttgggacgcctcctcctt

SEQ ID NO: 14472 - DNA, 25 bp, Mus musculus
cagataaaccaaaggcgaaggaaca

SEQ ID NO: 14473 - DNA, 25 bp, Mus musculus
cagataaacctgcaagtcccaagtt

SEQ ID NO: 14474 - DNA, 25 bp, Mus musculus
cagataaagacaatggaggcatgct

SEQ ID NO: 14475 - DNA, 25 bp, Mus musculus
cagataacctattcgggtagaaaca

SEQ ID NO: 14476 - DNA, 25 bp, Mus musculus
cagataactaccagaacacctcaac

SEQ ID NO: 14477 - DNA, 25 bp, Mus musculus
cagataacttcatacagtggagact

SEQ ID NO: 14478 - DNA, 25 bp, Mus musculus
cagataagagaagtagtgaagacca

SEQ ID NO: 14479 - DNA, 25 bp, Mus musculus
cagataagctcccagaagagatggc

SEQ ID NO: 14480 - DNA, 25 bp, Mus musculus
cagataagtatgagcttgtttaccc

SEQ ID NO: 14481 - DNA, 25 bp, Mus musculus
cagataatagctgggtgctcgctgg

SEQ ID NO: 14482 - DNA, 25 bp, Mus musculus
cagataattaataagaagctggatc

SEQ ID NO: 14483 - DNA, 25 bp, Mus musculus
cagatacaaatgaatgtataccagg

SEQ ID NO: 14484 - DNA, 25 bp, Mus musculus
cagataccagatgcatagtagcaag

SEQ ID NO: 14485 - DNA, 25 bp, Mus musculus
cagatacggactggatgggaggaag

SEQ ID NO: 14486 - DNA, 25 bp, Mus musculus
cagatacttgaaaacgaagaagcta

SEQ ID NO: 14487 - DNA, 25 bp, Mus musculus
cagatacttgtgaagtcattgggag

SEQ ID NO: 14488 - DNA, 25 bp, Mus musculus
cagatagaaacgtctgggcaagggt

SEQ ID NO: 14489 - DNA, 25 bp, Mus musculus
cagatagagatgaataagaagcgcg

SEQ ID NO: 14490 - DNA, 25 bp, Mus musculus
cagatagctccgaagacgttgtcag

SEQ ID NO: 14491 - DNA, 25 bp, Mus musculus
cagatagtagatgattggctaaacc

SEQ ID NO: 14492 - DNA, 25 bp, Mus musculus
cagatagtctatcttctgtggagac

SEQ ID NO: 14493 - DNA, 25 bp, Mus musculus
cagatagtgacgacactacgtgcaa

SEQ ID NO: 14494 - DNA, 25 bp, Mus musculus
cagatagtttactggatgttctaac

SEQ ID NO: 14495 - DNA, 25 bp, Mus musculus
cagatatactgagggaggtgaaact

SEQ ID NO: 14496 - DNA, 25 bp, Mus musculus
cagatatcaaggaaaagctaaacga

SEQ ID NO: 14497 - DNA, 25 bp, Mus musculus
cagatatgaatgtaattatggcttc

SEQ ID NO: 14498 - DNA, 25 bp, Mus musculus
cagatatgcaaagtaaacagggtgc

SEQ ID NO: 14499 - DNA, 25 bp, Mus musculus
cagatatgggaaaagtcaatcgaac

SEQ ID NO: 14500 - DNA, 25 bp, Mus musculus
cagatatggtatttcttagaacttc

SEQ ID NO: 14501 - DNA, 25 bp, Mus musculus
cagatatgtaccaccaagaaaagct

SEQ ID NO: 14502 - DNA, 25 bp, Mus musculus
cagatatgtacctccaagaaaagct

SEQ ID NO: 14503 - DNA, 25 bp, Mus musculus
cagatattggacctacaaattggag

SEQ ID NO: 14504 - DNA, 25 bp, Mus musculus
cagatcaacatgttgtatggaacca

SEQ ID NO: 14505 - DNA, 25 bp, Mus musculus
cagatcaagaggaggagatgtgctt

SEQ ID NO: 14506 - DNA, 25 bp, Mus musculus
cagatcaattcctcaatgactagaa

SEQ ID NO: 14507 - DNA, 25 bp, Mus musculus
cagatcaccgaggacgtgggtgcca

SEQ ID NO: 14508 - DNA, 25 bp, Mus musculus
cagatcactactattgccgttttgg

SEQ ID NO: 14509 - DNA, 25 bp, Mus musculus
cagatcactactggaacagcactgg

SEQ ID NO: 14510 - DNA, 25 bp, Mus musculus
cagatcactacttttgccgttttgg

SEQ ID NO: 14511 - DNA, 25 bp, Mus musculus
cagatcaggtggaatttgtggagca

SEQ ID NO: 14512 - DNA, 25 bp, Mus musculus
cagatcagttcggatggttgtggat

SEQ ID NO: 14513 - DNA, 25 bp, Mus musculus
cagatcatccctgtggcaaaagcca

SEQ ID NO: 14514 - DNA, 25 bp, Mus musculus
cagatcattgaaaactctataacta

SEQ ID NO: 14515 - DNA, 25 bp, Mus musculus
cagatccagagcactgtggactgga

SEQ ID NO: 14516 - DNA, 25 bp, Mus musculus
cagatccatcagttcttcagcttca

SEQ ID NO: 14517 - DNA, 25 bp, Mus musculus
cagatcccatccacgcagtttgacg

SEQ ID NO: 14518 - DNA, 25 bp, Mus musculus
cagatccctctcacaggcttcgtgg

SEQ ID NO: 14519 - DNA, 25 bp, Mus musculus
cagatccgcttgaagaaactgaagc

SEQ ID NO: 14520 - DNA, 25 bp, Mus musculus
cagatcctcaggacaagcactggct

SEQ ID NO: 14521 - DNA, 25 bp, Mus musculus
cagatcctccatgagtgccttaaaa

SEQ ID NO: 14522 - DNA, 25 bp, Mus musculus
cagatcctgaaggagcgaggcctgc

SEQ ID NO: 14523 - DNA, 25 bp, Mus musculus
cagatcctgtccaacaagaagccgg

SEQ ID NO: 14524 - DNA, 25 bp, Mus musculus
cagatccttgtaagataaaagcacg

SEQ ID NO: 14525 - DNA, 25 bp, Mus musculus
cagatcgaccagttcagtaaagaga

SEQ ID NO: 14526 - DNA, 25 bp, Mus musculus
cagatcgagaaaagatagaagcctc

SEQ ID NO: 14527 - DNA, 25 bp, Mus musculus
cagatcgcagtggtacaggaacagt

SEQ ID NO: 14528 - DNA, 25 bp, Mus musculus
cagatctagactccgacccctttgg

SEQ ID NO: 14529 - DNA, 25 bp, Mus musculus
cagatctagcactcttggccatcaa

SEQ ID NO: 14530 - DNA, 25 bp, Mus musculus
cagatctatagatcctggattacac

SEQ ID NO: 14531 - DNA, 25 bp, Mus musculus
cagatctggagctgtagttgcagat

SEQ ID NO: 14532 - DNA, 25 bp, Mus musculus
cagatctgggcggtcttgaccccgt

SEQ ID NO: 14533 - DNA, 25 bp, Mus musculus
cagatcttaaagaacgcttacgcag

SEQ ID NO: 14534 - DNA, 25 bp, Mus musculus
cagatcttacttctttgacaacccc

SEQ ID NO: 14535 - DNA, 25 bp, Mus musculus
cagatcttatagcagtcggtttaaa

SEQ ID NO: 14536 - DNA, 25 bp, Mus musculus
cagatctttagtgccagtcctcgtt

SEQ ID NO: 14537 - DNA, 25 bp, Mus musculus
cagatgaacgatgtcatggcagagt

SEQ ID NO: 14538 - DNA, 25 bp, Mus musculus
cagatgaagtcctcatcaccggcat

SEQ ID NO: 14539 - DNA, 25 bp, Mus musculus
cagatgacaggtcaatcagaagtgt

SEQ ID NO: 14540 - DNA, 25 bp, Mus musculus
cagatgacaggtgaatcagaagtgt

SEQ ID NO: 14541 - DNA, 25 bp, Mus musculus
cagatgacccctagttcttcctatg

SEQ ID NO: 14542 - DNA, 25 bp, Mus musculus
cagatgacgacctgtgttccgacat

SEQ ID NO: 14543 - DNA, 25 bp, Mus musculus
cagatgacgatgaccctttcaaccc

SEQ ID NO: 14544 - DNA, 25 bp, Mus musculus
cagatgagatcattcaggaagtccg

SEQ ID NO: 14545 - DNA, 25 bp, Mus musculus
cagatgagttgagtggagatgcttc

SEQ ID NO: 14546 - DNA, 25 bp, Mus musculus
cagatgataacggaaggacgcatga

SEQ ID NO: 14547 - DNA, 25 bp, Mus musculus
cagatgatctcattggccctgatga

SEQ ID NO: 14548 - DNA, 25 bp, Mus musculus
cagatgatgataccagactactgca

SEQ ID NO: 14549 - DNA, 25 bp, Mus musculus
cagatgatggacaggcaagtgagaa

SEQ ID NO: 14550 - DNA, 25 bp, Mus musculus
cagatgattctctgttgccagcgcc

SEQ ID NO: 14551 - DNA, 25 bp, Mus musculus
cagatgattctgaggctgatttgcc

SEQ ID NO: 14552 - DNA, 25 bp, Mus musculus
cagatgcagccacagattctgttgt

SEQ ID NO: 14553 - DNA, 25 bp, Mus musculus
cagatgcagcttcttcatatccggg

SEQ ID NO: 14554 - DNA, 25 bp, Mus musculus
cagatgcagcttgttcatatccggg

SEQ ID NO: 14555 - DNA, 25 bp, Mus musculus
cagatgcaggagttccgggcatcct

SEQ ID NO: 14556 - DNA, 25 bp, Mus musculus
cagatgccacattggctgcttctca

SEQ ID NO: 14557 - DNA, 25 bp, Mus musculus
cagatgccctcaaggtctcagtttc

SEQ ID NO: 14558 - DNA, 25 bp, Mus musculus
cagatgcggcagctgtgcattgcca

SEQ ID NO: 14559 - DNA, 25 bp, Mus musculus
cagatgctaatggacgctggcctcc

SEQ ID NO: 14560 - DNA, 25 bp, Mus musculus
cagatgctctcagctttttatgagg

SEQ ID NO: 14561 - DNA, 25 bp, Mus musculus
cagatgctgggtcccttcaccatca

SEQ ID NO: 14562 - DNA, 25 bp, Mus musculus
cagatggaaaggacaaacgggtcct

SEQ ID NO: 14563 - DNA, 25 bp, Mus musculus
cagatggaactttgaaggctgagtc

SEQ ID NO: 14564 - DNA, 25 bp, Mus musculus
cagatggaagacagcgtccttcagc

SEQ ID NO: 14565 - DNA, 25 bp, Mus musculus
cagatggaattacaggactatgtgc

SEQ ID NO: 14566 - DNA, 25 bp, Mus musculus
cagatggaggctccctttggatgcc

SEQ ID NO: 14567 - DNA, 25 bp, Mus musculus
cagatggatcagtactaaaacccga

SEQ ID NO: 14568 - DNA, 25 bp, Mus musculus
cagatggcgcggaatggacagctaa

SEQ ID NO: 14569 - DNA, 25 bp, Mus musculus
cagatggcgcggtatggacagctaa

SEQ ID NO: 14570 - DNA, 25 bp, Mus musculus
cagatgggactgtttatcggagcca

SEQ ID NO: 14571 - DNA, 25 bp, Mus musculus
cagatgggcaagtttcacccagaat

SEQ ID NO: 14572 - DNA, 25 bp, Mus musculus
cagatgggccggaaggccaagccta

SEQ ID NO: 14573 - DNA, 25 bp, Mus musculus
cagatgggcgtagtccatcgggacc

SEQ ID NO: 14574 - DNA, 25 bp, Mus musculus
cagatgggtagatcataagcctgcc

SEQ ID NO: 14575 - DNA, 25 bp, Mus musculus
cagatgggtccagcttcaacatgac

SEQ ID NO: 14576 - DNA, 25 bp, Mus musculus
cagatgggtccttacagagatcaga

SEQ ID NO: 14577 - DNA, 25 bp, Mus musculus
cagatggtaagcagggcagtcaaca

SEQ ID NO: 14578 - DNA, 25 bp, Mus musculus
cagatggtgtctgccattgtacgca

SEQ ID NO: 14579 - DNA, 25 bp, Mus musculus
cagatggtgttagcaggactggcct

SEQ ID NO: 14580 - DNA, 25 bp, Mus musculus
cagatggttgatgacgtggaccttc

SEQ ID NO: 14581 - DNA, 25 bp, Mus musculus
cagatgtacaacctggaaactacat

SEQ ID NO: 14582 - DNA, 25 bp, Mus musculus
cagatgtacaacgtggaaactacat

SEQ ID NO: 14583 - DNA, 25 bp, Mus musculus
cagatgtacagtccgcagggcatca

SEQ ID NO: 14584 - DNA, 25 bp, Mus musculus
cagatgtatacccttcctgggtgat

SEQ ID NO: 14585 - DNA, 25 bp, Mus musculus
cagatgtctctgttgctccgccgac

SEQ ID NO: 14586 - DNA, 25 bp, Mus musculus
cagatgtctttctgcttgactgaac

SEQ ID NO: 14587 - DNA, 25 bp, Mus musculus
cagatgtgaagagccaggatgttgc

SEQ ID NO: 14588 - DNA, 25 bp, Mus musculus
cagatgtgcagtctgaggcttcaga

SEQ ID NO: 14589 - DNA, 25 bp, Mus musculus
cagatgtgccagctggaaccatgga

SEQ ID NO: 14590 - DNA, 25 bp, Mus musculus
cagatgtggaaagcccacttacaaa

SEQ ID NO: 14591 - DNA, 25 bp, Mus musculus
cagatgtggacgtgttcaggcagct

SEQ ID NO: 14592 - DNA, 25 bp, Mus musculus
cagatgttaccattacaggcagatg

SEQ ID NO: 14593 - DNA, 25 bp, Mus musculus
cagatgttagtcaggagggactgaa

SEQ ID NO: 14594 - DNA, 25 bp, Mus musculus
cagatgttcctgagcctagagagag

SEQ ID NO: 14595 - DNA, 25 bp, Mus musculus
cagatgttcttaggctacctaactt

SEQ ID NO: 14596 - DNA, 25 bp, Mus musculus
cagatgttggctgcacacctgggtg

SEQ ID NO: 14597 - DNA, 25 bp, Mus musculus
cagatgtttcggaacctcagaattc

SEQ ID NO: 14598 - DNA, 25 bp, Mus musculus
cagattaccctgcagatgacgggtc

SEQ ID NO: 14599 - DNA, 25 bp, Mus musculus
cagattaccctggagatgacgggtc

SEQ ID NO: 14600 - DNA, 25 bp, Mus musculus
cagattatcgcccttatgaaatagt

SEQ ID NO: 14601 - DNA, 25 bp, Mus musculus
cagattatctgatgctcccagagca

SEQ ID NO: 14602 - DNA, 25 bp, Mus musculus
cagattcacaaacgtcacggtgaga

SEQ ID NO: 14603 - DNA, 25 bp, Mus musculus
cagattcaggatgtagaaggcaaat

SEQ ID NO: 14604 - DNA, 25 bp, Mus musculus
cagattcagttggtctgggatggaa

SEQ ID NO: 14605 - DNA, 25 bp, Mus musculus
cagattcgatgtgatccttcaggct

SEQ ID NO: 14606 - DNA, 25 bp, Mus musculus
cagattctgagcaacaagttcctca

SEQ ID NO: 14607 - DNA, 25 bp, Mus musculus
cagattctgataaaaattaccccaa

SEQ ID NO: 14608 - DNA, 25 bp, Mus musculus
cagattctgtcacagacgagggaga

SEQ ID NO: 14609 - DNA, 25 bp, Mus musculus
cagattcttcgaacgccagctcaga

SEQ ID NO: 14610 - DNA, 25 bp, Mus musculus
cagattgagaaatttcaggagaagg

SEQ ID NO: 14611 - DNA, 25 bp, Mus musculus
cagattgagaataccgttctgtatg

SEQ ID NO: 14612 - DNA, 25 bp, Mus musculus
cagattgagattaataaaatgcaca

SEQ ID NO: 14613 - DNA, 25 bp, Mus musculus
cagattgataactgtcgaacccctg

SEQ ID NO: 14614 - DNA, 25 bp, Mus musculus
cagattgccatcgtgacggagagcc

SEQ ID NO: 14615 - DNA, 25 bp, Mus musculus
cagattgcctgtgacaacgctgtgt

SEQ ID NO: 14616 - DNA, 25 bp, Mus musculus
cagattggaagaaggtcatcttctc

SEQ ID NO: 14617 - DNA, 25 bp, Mus musculus
cagattggaggatcggaaagaatcc

SEQ ID NO: 14618 - DNA, 25 bp, Mus musculus
cagattggagtcaagtctgagttcc

SEQ ID NO: 14619 - DNA, 25 bp, Mus musculus
cagattggcatctcggtggaattgt

SEQ ID NO: 14620 - DNA, 25 bp, Mus musculus
cagattggcttaagtttgccagaat

SEQ ID NO: 14621 - DNA, 25 bp, Mus musculus
cagattggcttatgtttgccagaat

SEQ ID NO: 14622 - DNA, 25 bp, Mus musculus
cagatttcaagatggttgagctgga

SEQ ID NO: 14623 - DNA, 25 bp, Mus musculus
cagatttctcctcccaaaagggtgt

SEQ ID NO: 14624 - DNA, 25 bp, Mus musculus
cagatttctgttacgaatgtgttgg

SEQ ID NO: 14625 - DNA, 25 bp, Mus musculus
cagatttgtcctccgaggcacacag

SEQ ID NO: 14626 - DNA, 25 bp, Mus musculus
cagatttgtggctcaggtcggccct

SEQ ID NO: 14627 - DNA, 25 bp, Mus musculus
cagattttgagctgcccctgactag

SEQ ID NO: 14628 - DNA, 25 bp, Mus musculus
cagattttgggctggcccgtgcctt

SEQ ID NO: 14629 - DNA, 25 bp, Mus musculus
cagatttttctgttgcttggttaga

SEQ ID NO: 14630 - DNA, 25 bp, Mus musculus
cagcaaaagcgactcagtagtcttt

SEQ ID NO: 14631 - DNA, 25 bp, Mus musculus
cagcaaaagtatctactggcggaga

SEQ ID NO: 14632 - DNA, 25 bp, Mus musculus
cagcaaacaagtaccctatcttctt

SEQ ID NO: 14633 - DNA, 25 bp, Mus musculus
cagcaaacaagtcttctgggtccga

SEQ ID NO: 14634 - DNA, 25 bp, Mus musculus
cagcaaacattgatgacaaaagaca

SEQ ID NO: 14635 - DNA, 25 bp, Mus musculus
cagcaaacgtctggcaacctgagtt

SEQ ID NO: 14636 - DNA, 25 bp, Mus musculus
cagcaaagcagccatcctgttggag

SEQ ID NO: 14637 - DNA, 25 bp, Mus musculus
cagcaaagggccacaagttacatta

SEQ ID NO: 14638 - DNA, 25 bp, Mus musculus
cagcaaagtgatgagcatggtttcc

SEQ ID NO: 14639 - DNA, 25 bp, Mus musculus
cagcaaagtggtacccggcaattca

SEQ ID NO: 14640 - DNA, 25 bp, Mus musculus
cagcaaatcaacagtgcagtggaga

SEQ ID NO: 14641 - DNA, 25 bp, Mus musculus
cagcaaatcatgactattgtagatg

SEQ ID NO: 14642 - DNA, 25 bp, Mus musculus
cagcaaatgatgagatagtagaagt

SEQ ID NO: 14643 - DNA, 25 bp, Mus musculus
cagcaaatgctggaagacaagaaac

SEQ ID NO: 14644 - DNA, 25 bp, Mus musculus
cagcaaattcaagagcacgaagagg

SEQ ID NO: 14645 - DNA, 25 bp, Mus musculus
cagcaacaacatctgccacaagtgt

SEQ ID NO: 14646 - DNA, 25 bp, Mus musculus
cagcaacaactcctgcaacaagtgt

SEQ ID NO: 14647 - DNA, 25 bp, Mus musculus
cagcaacagtatttacaggatcgac

SEQ ID NO: 14648 - DNA, 25 bp, Mus musculus
cagcaacagtgtaacaggcgctcct

SEQ ID NO: 14649 - DNA, 25 bp, Mus musculus
cagcaacagttactggaggatacgg

SEQ ID NO: 14650 - DNA, 25 bp, Mus musculus
cagcaacatcgtggagaaatttgtc

SEQ ID NO: 14651 - DNA, 25 bp, Mus musculus
cagcaacgcaatacaagtttggcca

SEQ ID NO: 14652 - DNA, 25 bp, Mus musculus
cagcaacggttatgcgggagcatga

SEQ ID NO: 14653 - DNA, 25 bp, Mus musculus
cagcaacgtagtagtcctgggtatc

SEQ ID NO: 14654 - DNA, 25 bp, Mus musculus
cagcaactctgggaaagagtctgct

SEQ ID NO: 14655 - DNA, 25 bp, Mus musculus
cagcaagattctcctgcccatggtg

SEQ ID NO: 14656 - DNA, 25 bp, Mus musculus
cagcaagcaagggtccgtccctttg

SEQ ID NO: 14657 - DNA, 25 bp, Mus musculus
cagcaagcactgttagggttgaaac

SEQ ID NO: 14658 - DNA, 25 bp, Mus musculus
cagcaagcgccttggtcttatgcag

SEQ ID NO: 14659 - DNA, 25 bp, Mus musculus
cagcaagcggactttgccagcagac

SEQ ID NO: 14660 - DNA, 25 bp, Mus musculus
cagcaaggaataaggccgagtgtac

SEQ ID NO: 14661 - DNA, 25 bp, Mus musculus
cagcaaggcccaagcagaggtactg

SEQ ID NO: 14662 - DNA, 25 bp, Mus musculus
cagcaagtcttcagccacattgttc

SEQ ID NO: 14663 - DNA, 25 bp, Mus musculus
cagcaagtggcagaggataaatttg

SEQ ID NO: 14664 - DNA, 25 bp, Mus musculus
cagcaagttgcccatcgagggagct

SEQ ID NO: 14665 - DNA, 25 bp, Mus musculus
cagcaagtttagcaagctcacacag

SEQ ID NO: 14666 - DNA, 25 bp, Mus musculus
cagcaagttttccttaacacctgca

SEQ ID NO: 14667 - DNA, 25 bp, Mus musculus
cagcaatctggcctccattcacaag

SEQ ID NO: 14668 - DNA, 25 bp, Mus musculus
cagcaatcttgtttgtaaagtgtca

SEQ ID NO: 14669 - DNA, 25 bp, Mus musculus
cagcaatgaattggtggcctagcaa

SEQ ID NO: 14670 - DNA, 25 bp, Mus musculus
cagcaatgactggagcctcagtgat

SEQ ID NO: 14671 - DNA, 25 bp, Mus musculus
cagcaatgatgagcgcccagagggt

SEQ ID NO: 14672 - DNA, 25 bp, Mus musculus
cagcaatgtcccagtgccctattct

SEQ ID NO: 14673 - DNA, 25 bp, Mus musculus
cagcaatgtccctgtgccctattct

SEQ ID NO: 14674 - DNA, 25 bp, Mus musculus
cagcaattgtgagcttcgctgtagg

SEQ ID NO: 14675 - DNA, 25 bp, Mus musculus
cagcacaatcagtgtcaaggtggaa

SEQ ID NO: 14676 - DNA, 25 bp, Mus musculus
cagcacacacctgcactttgaggga

SEQ ID NO: 14677 - DNA, 25 bp, Mus musculus
cagcacactgtttgaataaagagcg

SEQ ID NO: 14678 - DNA, 25 bp, Mus musculus
cagcacagcaaatgctccaaaatgt

SEQ ID NO: 14679 - DNA, 25 bp, Mus musculus
cagcacaggctacacactggacact

SEQ ID NO: 14680 - DNA, 25 bp, Mus musculus
cagcacagtacagagtatctaagag

SEQ ID NO: 14681 - DNA, 25 bp, Mus musculus
cagcacattttctttggtgccacca

SEQ ID NO: 14682 - DNA, 25 bp, Mus musculus
cagcaccaaggaggaaatcctggcc

SEQ ID NO: 14683 - DNA, 25 bp, Mus musculus
cagcaccaggactggatgagtggca

SEQ ID NO: 14684 - DNA, 25 bp, Mus musculus
cagcaccaggcccaatggacattgt

SEQ ID NO: 14685 - DNA, 25 bp, Mus musculus
cagcaccaggttccaaatcatcagt

SEQ ID NO: 14686 - DNA, 25 bp, Mus musculus
cagcacccaagcctagaaaagtgga

SEQ ID NO: 14687 - DNA, 25 bp, Mus musculus
cagcacccagttctggtctgcacag

SEQ ID NO: 14688 - DNA, 25 bp, Mus musculus
cagcacccatttggagccatgaata

SEQ ID NO: 14689 - DNA, 25 bp, Mus musculus
cagcacccttgggaaaggagagtct

SEQ ID NO: 14690 - DNA, 25 bp, Mus musculus
cagcaccgaaaaggagatcctgcct

SEQ ID NO: 14691 - DNA, 25 bp, Mus musculus
cagcaccggcttcagcaggatgagt

SEQ ID NO: 14692 - DNA, 25 bp, Mus musculus
cagcaccgtgaacatgaccctggag

SEQ ID NO: 14693 - DNA, 25 bp, Mus musculus
cagcacctcgagagaaggacacccg

SEQ ID NO: 14694 - DNA, 25 bp, Mus musculus
cagcacctcgagtgaaggacacccg

SEQ ID NO: 14695 - DNA, 25 bp, Mus musculus
cagcacgcctctgggagaggtgtcc

SEQ ID NO: 14696 - DNA, 25 bp, Mus musculus
cagcacgtgggacagagataacgac

SEQ ID NO: 14697 - DNA, 25 bp, Mus musculus
cagcacgtgggagcccgaagaaaat

SEQ ID NO: 14698 - DNA, 25 bp, Mus musculus
cagcactaccaggttaactttaaag

SEQ ID NO: 14699 - DNA, 25 bp, Mus musculus
cagcactatttattaacttgatcag

SEQ ID NO: 14700 - DNA, 25 bp, Mus musculus
cagcactctcctgaagaagagaatg

SEQ ID NO: 14701 - DNA, 25 bp, Mus musculus
cagcactgataacactgtcatggct

SEQ ID NO: 14702 - DNA, 25 bp, Mus musculus
cagcactgccaggagcagattgtcg

SEQ ID NO: 14703 - DNA, 25 bp, Mus musculus
cagcactggaaggatttgggagcaa

SEQ ID NO: 14704 - DNA, 25 bp, Mus musculus
cagcactggccctgtcatgatttgc

SEQ ID NO: 14705 - DNA, 25 bp, Mus musculus
cagcactgggacctggaaggattca

SEQ ID NO: 14706 - DNA, 25 bp, Mus musculus
cagcactgggacgtggaaggattca

SEQ ID NO: 14707 - DNA, 25 bp, Mus musculus
cagcactggtcagcatgctcagcag

SEQ ID NO: 14708 - DNA, 25 bp, Mus musculus
cagcactgtgggagaagcacagccc

SEQ ID NO: 14709 - DNA, 25 bp, Mus musculus
cagcacttaatttggaataacatgg

SEQ ID NO: 14710 - DNA, 25 bp, Mus musculus
cagcacttcagtcacaacaaatggg

SEQ ID NO: 14711 - DNA, 25 bp, Mus musculus
cagcacttcattttggaggaagcca

SEQ ID NO: 14712 - DNA, 25 bp, Mus musculus
cagcacttctatgctgtggagaggc

SEQ ID NO: 14713 - DNA, 25 bp, Mus musculus
cagcacttgagtcgctatttcctgc

SEQ ID NO: 14714 - DNA, 25 bp, Mus musculus
cagcacttgagtggctatttcctgc

SEQ ID NO: 14715 - DNA, 25 bp, Mus musculus
cagcacttgcagactgccctcagga

SEQ ID NO: 14716 - DNA, 25 bp, Mus musculus
cagcacttgcttggactatacgaca

SEQ ID NO: 14717 - DNA, 25 bp, Mus musculus
cagcagaaagtgaacgatgcttcaa

SEQ ID NO: 14718 - DNA, 25 bp, Mus musculus
cagcagaaatcctgggaatcaaatt

SEQ ID NO: 14719 - DNA, 25 bp, Mus musculus
cagcagaagttggaataattgagag

SEQ ID NO: 14720 - DNA, 25 bp, Mus musculus
cagcagaagttttcaagaagcacgg

SEQ ID NO: 14721 - DNA, 25 bp, Mus musculus
cagcagaatgatgagagcaaagagt

SEQ ID NO: 14722 - DNA, 25 bp, Mus musculus
cagcagaatggcagagccagccccg

SEQ ID NO: 14723 - DNA, 25 bp, Mus musculus
cagcagacatggatattcattataa

SEQ ID NO: 14724 - DNA, 25 bp, Mus musculus
cagcagactgtcctgcctgaaggtc

SEQ ID NO: 14725 - DNA, 25 bp, Mus musculus
cagcagagactctggactctcaggc

SEQ ID NO: 14726 - DNA, 25 bp, Mus musculus
cagcagagcagtgtgaaccagtggc

SEQ ID NO: 14727 - DNA, 25 bp, Mus musculus
cagcagagccttcagagtttcacca

SEQ ID NO: 14728 - DNA, 25 bp, Mus musculus
cagcagaggaatgaagttcacaata

SEQ ID NO: 14729 - DNA, 25 bp, Mus musculus
cagcagaggagcacgcagctgaaca

SEQ ID NO: 14730 - DNA, 25 bp, Mus musculus
cagcagaggctattgatgacatacc

SEQ ID NO: 14731 - DNA, 25 bp, Mus musculus
cagcagaggtaatcctgtaaggtgt

SEQ ID NO: 14732 - DNA, 25 bp, Mus musculus
cagcagaggttgtacaagatcacca

SEQ ID NO: 14733 - DNA, 25 bp, Mus musculus
cagcagagtatggatatacagtttc

SEQ ID NO: 14734 - DNA, 25 bp, Mus musculus
cagcagagtgctgggcttgggcttc

SEQ ID NO: 14735 - DNA, 25 bp, Mus musculus
cagcagatatgggaaaagtcaatcg

SEQ ID NO: 14736 - DNA, 25 bp, Mus musculus
cagcagatcttattcatccttccca

SEQ ID NO: 14737 - DNA, 25 bp, Mus musculus
cagcagattctgagcaacaagttcc

SEQ ID NO: 14738 - DNA, 25 bp, Mus musculus
cagcagatttagtgctcctgcggaa

SEQ ID NO: 14739 - DNA, 25 bp, Mus musculus
cagcagcaaaatcaaggttaaacaa

SEQ ID NO: 14740 - DNA, 25 bp, Mus musculus
cagcagcaaataaggactccccttc

SEQ ID NO: 14741 - DNA, 25 bp, Mus musculus
cagcagcaaatcctattgagtctca

SEQ ID NO: 14742 - DNA, 25 bp, Mus musculus
cagcagcaagcaagggtccgtccct

SEQ ID NO: 14743 - DNA, 25 bp, Mus musculus
cagcagcagataccagccagggctg

SEQ ID NO: 14744 - DNA, 25 bp, Mus musculus
cagcagcagatagcagccagggctg

SEQ ID NO: 14745 - DNA, 25 bp, Mus musculus
cagcagcagatcaccgaggacgtgg

SEQ ID NO: 14746 - DNA, 25 bp, Mus musculus
cagcagcaggccaatcaagctcctt

SEQ ID NO: 14747 - DNA, 25 bp, Mus musculus
cagcagcagtactgatgaggaccca

SEQ ID NO: 14748 - DNA, 25 bp, Mus musculus
cagcagcagtgggaaacattatggc

SEQ ID NO: 14749 - DNA, 25 bp, Mus musculus
cagcagccacaggaagaagagtttg

SEQ ID NO: 14750 - DNA, 25 bp, Mus musculus
cagcagcctagaagacgctagcact

SEQ ID NO: 14751 - DNA, 25 bp, Mus musculus
cagcagcctgcgtgagatcacactg

SEQ ID NO: 14752 - DNA, 25 bp, Mus musculus
cagcagcggcatgcccatacggatt

SEQ ID NO: 14753 - DNA, 25 bp, Mus musculus
cagcagcgtcctctggaatttcgac

SEQ ID NO: 14754 - DNA, 25 bp, Mus musculus
cagcagctactgaaggacccaatat

SEQ ID NO: 14755 - DNA, 25 bp, Mus musculus
cagcagctatatcactgggactgtg

SEQ ID NO: 14756 - DNA, 25 bp, Mus musculus
cagcagctcatcaccatttgccgtg

SEQ ID NO: 14757 - DNA, 25 bp, Mus musculus
cagcagctcctacagcaatgagccg

SEQ ID NO: 14758 - DNA, 25 bp, Mus musculus
cagcagctcctggtgtttggtacca

SEQ ID NO: 14759 - DNA, 25 bp, Mus musculus
cagcagctctgctcctgcagaatga

SEQ ID NO: 14760 - DNA, 25 bp, Mus musculus
cagcagctctttcttcaaggcagtt

SEQ ID NO: 14761 - DNA, 25 bp, Mus musculus
cagcagctgattagagataatgacc

SEQ ID NO: 14762 - DNA, 25 bp, Mus musculus
cagcagctggcaatcatccagattc

SEQ ID NO: 14763 - DNA, 25 bp, Mus musculus
cagcagctggtcgagaagcttcagg

SEQ ID NO: 14764 - DNA, 25 bp, Mus musculus
cagcaggacttggaactggaagaat

SEQ ID NO: 14765 - DNA, 25 bp, Mus musculus
cagcaggatcgaagtgtaacacgtt

SEQ ID NO: 14766 - DNA, 25 bp, Mus musculus
cagcaggatgagtgagcggcaactc

SEQ ID NO: 14767 - DNA, 25 bp, Mus musculus
cagcaggcagcaatgaacatagtca

SEQ ID NO: 14768 - DNA, 25 bp, Mus musculus
cagcaggcgcctgtggatctttggc

SEQ ID NO: 14769 - DNA, 25 bp, Mus musculus
cagcagggactgagccctgcaggct

SEQ ID NO: 14770 - DNA, 25 bp, Mus musculus
cagcagggtcacagcagcctggtgt

SEQ ID NO: 14771 - DNA, 25 bp, Mus musculus
cagcagggtctgcagcccatagtga

SEQ ID NO: 14772 - DNA, 25 bp, Mus musculus
cagcaggtggcagacttgaccctga

SEQ ID NO: 14773 - DNA, 25 bp, Mus musculus
cagcaggttaaccaggaaaagcagg

SEQ ID NO: 14774 - DNA, 25 bp, Mus musculus
cagcagtacgggttgggcagcttca

SEQ ID NO: 14775 - DNA, 25 bp, Mus musculus
cagcagtatattctttacacaagtc

SEQ ID NO: 14776 - DNA, 25 bp, Mus musculus
cagcagtatcctgcctccggagaga

SEQ ID NO: 14777 - DNA, 25 bp, Mus musculus
cagcagtcagctcagatctccaaag

SEQ ID NO: 14778 - DNA, 25 bp, Mus musculus
cagcagtcagtgtgatcactgtgac

SEQ ID NO: 14779 - DNA, 25 bp, Mus musculus
cagcagtcccgcaaacaacttatca

SEQ ID NO: 14780 - DNA, 25 bp, Mus musculus
cagcagtgaagttcctacagaattc

SEQ ID NO: 14781 - DNA, 25 bp, Mus musculus
cagcagtgcagcaagactctggtac

SEQ ID NO: 14782 - DNA, 25 bp, Mus musculus
cagcagtggacatgttggctttatc

SEQ ID NO: 14783 - DNA, 25 bp, Mus musculus
cagcagtggctacttcagcagcagc

SEQ ID NO: 14784 - DNA, 25 bp, Mus musculus
cagcagtgggaaacattatggcatc

SEQ ID NO: 14785 - DNA, 25 bp, Mus musculus
cagcagttgcgatgcactgaggcaa

SEQ ID NO: 14786 - DNA, 25 bp, Mus musculus
cagcagtttagatggactaagctga

SEQ ID NO: 14787 - DNA, 25 bp, Mus musculus
cagcagttttagtatcagcaggaaa

SEQ ID NO: 14788 - DNA, 25 bp, Mus musculus
cagcagttttccttgactccaggag

SEQ ID NO: 14789 - DNA, 25 bp, Mus musculus
cagcatacaaagttcgagttggtgc

SEQ ID NO: 14790 - DNA, 25 bp, Mus musculus
cagcatacggccacaaaaggaagga

SEQ ID NO: 14791 - DNA, 25 bp, Mus musculus
cagcatacggtggtgtgtttggaaa

SEQ ID NO: 14792 - DNA, 25 bp, Mus musculus
cagcatagagaacactctgtgggca

SEQ ID NO: 14793 - DNA, 25 bp, Mus musculus
cagcatatccagacccattgtgaag

SEQ ID NO: 14794 - DNA, 25 bp, Mus musculus
cagcatcaatccgtgccttaatggg

SEQ ID NO: 14795 - DNA, 25 bp, Mus musculus
cagcatcacaattggctttggacag

SEQ ID NO: 14796 - DNA, 25 bp, Mus musculus
cagcatcacggcctgccggattgat

SEQ ID NO: 14797 - DNA, 25 bp, Mus musculus
cagcatcccacggacacaagtagaa

SEQ ID NO: 14798 - DNA, 25 bp, Mus musculus
cagcatccctgacaatgaaactggg

SEQ ID NO: 14799 - DNA, 25 bp, Mus musculus
cagcatcctgccagcttagcaggca

SEQ ID NO: 14800 - DNA, 25 bp, Mus musculus
cagcatcgcagacaagaagcgcaga

SEQ ID NO: 14801 - DNA, 25 bp, Mus musculus
cagcatctccagaggaggacagatt

SEQ ID NO: 14802 - DNA, 25 bp, Mus musculus
cagcatctgaggtggagactaatcc

SEQ ID NO: 14803 - DNA, 25 bp, Mus musculus
cagcatctgatgtcagcatgcttgg

SEQ ID NO: 14804 - DNA, 25 bp, Mus musculus
cagcatctggactggcatagaaaag

SEQ ID NO: 14805 - DNA, 25 bp, Mus musculus
cagcatctggcatctatttatgaga

SEQ ID NO: 14806 - DNA, 25 bp, Mus musculus
cagcatcttatatattagcttgacc

SEQ ID NO: 14807 - DNA, 25 bp, Mus musculus
cagcatcttcgcaaagaattggtgg

SEQ ID NO: 14808 - DNA, 25 bp, Mus musculus
cagcatgaaggagcctgtgagagac

SEQ ID NO: 14809 - DNA, 25 bp, Mus musculus
cagcatgaatgatcatgaagataca

SEQ ID NO: 14810 - DNA, 25 bp, Mus musculus
cagcatgacatgtgccgcttccatt

SEQ ID NO: 14811 - DNA, 25 bp, Mus musculus
cagcatgagagcttttgtggaaaac

SEQ ID NO: 14812 - DNA, 25 bp, Mus musculus
cagcatgagggtcagcactacagca

SEQ ID NO: 14813 - DNA, 25 bp, Mus musculus
cagcatgagtaccacagagactaag

SEQ ID NO: 14814 - DNA, 25 bp, Mus musculus
cagcatggatgctgtctgctctgcc

SEQ ID NO: 14815 - DNA, 25 bp, Mus musculus
cagcatgggtgtgtggagctccatc

SEQ ID NO: 14816 - DNA, 25 bp, Mus musculus
cagcatggtctagatgggaaaaagg

SEQ ID NO: 14817 - DNA, 25 bp, Mus musculus
cagcatggttgcctggctacctgct

SEQ ID NO: 14818 - DNA, 25 bp, Mus musculus
cagcatgtacctgttaccaagacaa

SEQ ID NO: 14819 - DNA, 25 bp, Mus musculus
cagcatgtatttttagaagacagtc

SEQ ID NO: 14820 - DNA, 25 bp, Mus musculus
cagcatgtccaagcacaaacttatt

SEQ ID NO: 14821 - DNA, 25 bp, Mus musculus
cagcatgtttctgtacactgggaaa

SEQ ID NO: 14822 - DNA, 25 bp, Mus musculus
cagcattagattgactgtctcgtaa

SEQ ID NO: 14823 - DNA, 25 bp, Mus musculus
cagcattcagcagagtgaagttcac

SEQ ID NO: 14824 - DNA, 25 bp, Mus musculus
cagcattccagttgtcctgaggtgc

SEQ ID NO: 14825 - DNA, 25 bp, Mus musculus
cagcattcgattagcatgcctgcta

SEQ ID NO: 14826 - DNA, 25 bp, Mus musculus
cagcattctgcattgagctactcac

SEQ ID NO: 14827 - DNA, 25 bp, Mus musculus
cagcattgaacactcgggcgagtat

SEQ ID NO: 14828 - DNA, 25 bp, Mus musculus
cagcattgaacagtcgggcgagtat

SEQ ID NO: 14829 - DNA, 25 bp, Mus musculus
cagcattgcttcagggattgttgca

SEQ ID NO: 14830 - DNA, 25 bp, Mus musculus
cagcatttcgagcaacagatcatgg

SEQ ID NO: 14831 - DNA, 25 bp, Mus musculus
cagcatttgggattggaacaagaca

SEQ ID NO: 14832 - DNA, 25 bp, Mus musculus
cagcattttcattggagggagtttc

SEQ ID NO: 14833 - DNA, 25 bp, Mus musculus
cagcattttcctagtatctattacg

SEQ ID NO: 14834 - DNA, 25 bp, Mus musculus
cagccaaaggaaaaggccgaggcac

SEQ ID NO: 14835 - DNA, 25 bp, Mus musculus
cagccaaattatgggacattcagaa

SEQ ID NO: 14836 - DNA, 25 bp, Mus musculus
cagccaacctccttctaaggctgga

SEQ ID NO: 14837 - DNA, 25 bp, Mus musculus
cagccaagcacttgaggaatatctc

SEQ ID NO: 14838 - DNA, 25 bp, Mus musculus
cagccaagccagctgaagaagctca

SEQ ID NO: 14839 - DNA, 25 bp, Mus musculus
cagccaagctggctgccttgtggtt

SEQ ID NO: 14840 - DNA, 25 bp, Mus musculus
cagccaagcttgcacatgagtgcag

SEQ ID NO: 14841 - DNA, 25 bp, Mus musculus
cagccaaggaggtttccagtggaag

SEQ ID NO: 14842 - DNA, 25 bp, Mus musculus
cagccaaggatgctgtcatcagcct

SEQ ID NO: 14843 - DNA, 25 bp, Mus musculus
cagccaatagcccagatgggaaaaa

SEQ ID NO: 14844 - DNA, 25 bp, Mus musculus
cagccaatgccgtgcggcggctgca

SEQ ID NO: 14845 - DNA, 25 bp, Mus musculus
cagccacacttccagggcgtgacgg

SEQ ID NO: 14846 - DNA, 25 bp, Mus musculus
cagccacaggaagaagagtttggtt

SEQ ID NO: 14847 - DNA, 25 bp, Mus musculus
cagccacagtcactgcctttgtgtt

SEQ ID NO: 14848 - DNA, 25 bp, Mus musculus
cagccacatactggaatccgagtct

SEQ ID NO: 14849 - DNA, 25 bp, Mus musculus
cagccacatgcctcatggagggagc

SEQ ID NO: 14850 - DNA, 25 bp, Mus musculus
cagccacattggtctatcctcaagc

SEQ ID NO: 14851 - DNA, 25 bp, Mus musculus
cagccacattgttcctctagaaggg

SEQ ID NO: 14852 - DNA, 25 bp, Mus musculus
cagccaccatttttcgaaaggaagg

SEQ ID NO: 14853 - DNA, 25 bp, Mus musculus
cagccacccaggctttggtctacat

SEQ ID NO: 14854 - DNA, 25 bp, Mus musculus
cagccaccttgctgagctgtgataa

SEQ ID NO: 14855 - DNA, 25 bp, Mus musculus
cagccacggaaaatagggaagaagt

SEQ ID NO: 14856 - DNA, 25 bp, Mus musculus
cagccactaagaagagaaggagcgc

SEQ ID NO: 14857 - DNA, 25 bp, Mus musculus
cagccactaagatgagaaggagcgc

SEQ ID NO: 14858 - DNA, 25 bp, Mus musculus
cagccactgtatcgagttgaaagcc

SEQ ID NO: 14859 - DNA, 25 bp, Mus musculus
cagccactgtatggagttgaaagcc

SEQ ID NO: 14860 - DNA, 25 bp, Mus musculus
cagccactgttgctttggaaggacc

SEQ ID NO: 14861 - DNA, 25 bp, Mus musculus
cagccagaatgtcaccgagtacgtc

SEQ ID NO: 14862 - DNA, 25 bp, Mus musculus
cagccagagagtgctcaggtgctca

SEQ ID NO: 14863 - DNA, 25 bp, Mus musculus
cagccagcaggcactcagttcttac

SEQ ID NO: 14864 - DNA, 25 bp, Mus musculus
cagccagcatgtcatccacaaatac

SEQ ID NO: 14865 - DNA, 25 bp, Mus musculus
cagccagcggagaactacaagaaca

SEQ ID NO: 14866 - DNA, 25 bp, Mus musculus
cagccagcgggagttgaaacctttt

SEQ ID NO: 14867 - DNA, 25 bp, Mus musculus
cagccagctagctgtggatccggag

SEQ ID NO: 14868 - DNA, 25 bp, Mus musculus
cagccagctccgaaagcaaaagagg

SEQ ID NO: 14869 - DNA, 25 bp, Mus musculus
cagccagcttgaaggagtctacaga

SEQ ID NO: 14870 - DNA, 25 bp, Mus musculus
cagccaggaggaggacttccgtttg

SEQ ID NO: 14871 - DNA, 25 bp, Mus musculus
cagccaggccagctgtggtagctcc

SEQ ID NO: 14872 - DNA, 25 bp, Mus musculus
cagccagggcctcgtttgtcagcct

SEQ ID NO: 14873 - DNA, 25 bp, Mus musculus
cagccagggcctggtttgtcagcct

SEQ ID NO: 14874 - DNA, 25 bp, Mus musculus
cagccaggtccacaggattaatgag

SEQ ID NO: 14875 - DNA, 25 bp, Mus musculus
cagccagtatgcctcctaaggaaga

SEQ ID NO: 14876 - DNA, 25 bp, Mus musculus
cagccagtcagatgtacagtccgca

SEQ ID NO: 14877 - DNA, 25 bp, Mus musculus
cagccagtcagtgccatagcaacaa

SEQ ID NO: 14878 - DNA, 25 bp, Mus musculus
cagccagtctggtgctgtgctcaca

SEQ ID NO: 14879 - DNA, 25 bp, Mus musculus
cagccagtcttctatgttcccacat

SEQ ID NO: 14880 - DNA, 25 bp, Mus musculus
cagccagtgctgatggagatcccag

SEQ ID NO: 14881 - DNA, 25 bp, Mus musculus
cagccagtggaggaagatctttgat

SEQ ID NO: 14882 - DNA, 25 bp, Mus musculus
cagccagtgtgtctccctgctgcgg

SEQ ID NO: 14883 - DNA, 25 bp, Mus musculus
cagccatatcctcatttctggtgat

SEQ ID NO: 14884 - DNA, 25 bp, Mus musculus
cagccatattcaatccaagtgtggt

SEQ ID NO: 14885 - DNA, 25 bp, Mus musculus
cagccatcacctcgatttacttgtt

SEQ ID NO: 14886 - DNA, 25 bp, Mus musculus
cagccatcacctggatttacttgtt

SEQ ID NO: 14887 - DNA, 25 bp, Mus musculus
cagccatcgcatatcttcataacaa

SEQ ID NO: 14888 - DNA, 25 bp, Mus musculus
cagccatctcagtggactgggagga

SEQ ID NO: 14889 - DNA, 25 bp, Mus musculus
cagccatctctaccaacatcaagga

SEQ ID NO: 14890 - DNA, 25 bp, Mus musculus
cagccatctggagcgcctggagatt

SEQ ID NO: 14891 - DNA, 25 bp, Mus musculus
cagccatctgggaggccttcaaggg

SEQ ID NO: 14892 - DNA, 25 bp, Mus musculus
cagccatctttttaattggattagg

SEQ ID NO: 14893 - DNA, 25 bp, Mus musculus
cagccatgaagcagacactggtcaa

SEQ ID NO: 14894 - DNA, 25 bp, Mus musculus
cagccatgctgaaaccaaacagaac

SEQ ID NO: 14895 - DNA, 25 bp, Mus musculus
cagccatgctggtttgctgcagaca

SEQ ID NO: 14896 - DNA, 25 bp, Mus musculus
cagccatggcaagtaaagggccttc

SEQ ID NO: 14897 - DNA, 25 bp, Mus musculus
cagccattcattcatatatttcacc

SEQ ID NO: 14898 - DNA, 25 bp, Mus musculus
cagccattcattgatatatttcacc

SEQ ID NO: 14899 - DNA, 25 bp, Mus musculus
cagcccaaacggaggcagtcatcat

SEQ ID NO: 14900 - DNA, 25 bp, Mus musculus
cagcccaaacggtggcagtcatcat

SEQ ID NO: 14901 - DNA, 25 bp, Mus musculus
cagcccaagaaccaggaaagttctt

SEQ ID NO: 14902 - DNA, 25 bp, Mus musculus
cagcccaagggtgtatccaagaaag

SEQ ID NO: 14903 - DNA, 25 bp, Mus musculus
cagcccacagaggtgacgatgaagt

SEQ ID NO: 14904 - DNA, 25 bp, Mus musculus
cagcccagactgaagagcctgttca

SEQ ID NO: 14905 - DNA, 25 bp, Mus musculus
cagcccagcctccttgtgtgcgaga

SEQ ID NO: 14906 - DNA, 25 bp, Mus musculus
cagcccaggaaactgggctcacctg

SEQ ID NO: 14907 - DNA, 25 bp, Mus musculus
cagcccaggcaagggatcagtggaa

SEQ ID NO: 14908 - DNA, 25 bp, Mus musculus
cagcccagtaagtctacgtgggaac

SEQ ID NO: 14909 - DNA, 25 bp, Mus musculus
cagcccagttctggataaactcaac

SEQ ID NO: 14910 - DNA, 25 bp, Mus musculus
cagcccatcactttgaggcctggat

SEQ ID NO: 14911 - DNA, 25 bp, Mus musculus
cagccccagaaaagtccaggatgca

SEQ ID NO: 14912 - DNA, 25 bp, Mus musculus
cagccccatataaaaacgtcaacgt

SEQ ID NO: 14913 - DNA, 25 bp, Mus musculus
cagccccgtctgaggtaatagttgt

SEQ ID NO: 14914 - DNA, 25 bp, Mus musculus
cagcccctgggagagcagcgttgtt

SEQ ID NO: 14915 - DNA, 25 bp, Mus musculus
cagcccctggtgatactgttgacaa

SEQ ID NO: 14916 - DNA, 25 bp, Mus musculus
cagcccgactcaatggaaccacaaa

SEQ ID NO: 14917 - DNA, 25 bp, Mus musculus
cagcccgactttctttacacaacag

SEQ ID NO: 14918 - DNA, 25 bp, Mus musculus
cagcccgcatcatttgttggcagta

SEQ ID NO: 14919 - DNA, 25 bp, Mus musculus
cagcccgcgttttgggttttctgct

SEQ ID NO: 14920 - DNA, 25 bp, Mus musculus
cagcccgggccacattaagtaactt

SEQ ID NO: 14921 - DNA, 25 bp, Mus musculus
cagcccgggccagattaagtaactt

SEQ ID NO: 14922 - DNA, 25 bp, Mus musculus
cagcccgggtcggtcaaggtctact

SEQ ID NO: 14923 - DNA, 25 bp, Mus musculus
cagcccggtcactgtggttgaggct

SEQ ID NO: 14924 - DNA, 25 bp, Mus musculus
cagcccgtcttgcaataaggagtga

SEQ ID NO: 14925 - DNA, 25 bp, Mus musculus
cagcccgtcttggaataaggagtga

SEQ ID NO: 14926 - DNA, 25 bp, Mus musculus
cagccctacctctgtgagactggtc

SEQ ID NO: 14927 - DNA, 25 bp, Mus musculus
cagccctacgtgagcaagctggatt

SEQ ID NO: 14928 - DNA, 25 bp, Mus musculus
cagccctactaaaggaggacgctgg

SEQ ID NO: 14929 - DNA, 25 bp, Mus musculus
cagccctatgacgtttacgaccagg

SEQ ID NO: 14930 - DNA, 25 bp, Mus musculus
cagccctgccagagaccttcagttt

SEQ ID NO: 14931 - DNA, 25 bp, Mus musculus
cagccctggtcccagaactgaggag

SEQ ID NO: 14932 - DNA, 25 bp, Mus musculus
cagccctgtaatatcacagccccag

SEQ ID NO: 14933 - DNA, 25 bp, Mus musculus
cagccctgtaatttcacagccccag

SEQ ID NO: 14934 - DNA, 25 bp, Mus musculus
cagccctgttgatgactgaaaatga

SEQ ID NO: 14935 - DNA, 25 bp, Mus musculus
cagccgaactgaacaaaccgatgga

SEQ ID NO: 14936 - DNA, 25 bp, Mus musculus
cagccgaagttagaagacttgaatc

SEQ ID NO: 14937 - DNA, 25 bp, Mus musculus
cagccgcatttacatcttccactat

SEQ ID NO: 14938 - DNA, 25 bp, Mus musculus
cagccgccaacgcacaagagtggtt

SEQ ID NO: 14939 - DNA, 25 bp, Mus musculus
cagccgcccgctatcggaacgtgtt

SEQ ID NO: 14940 - DNA, 25 bp, Mus musculus
cagccgcctaactgaggccgtgagg

SEQ ID NO: 14941 - DNA, 25 bp, Mus musculus
cagccgcctggtggtgtacgtctct

SEQ ID NO: 14942 - DNA, 25 bp, Mus musculus
cagccgcttaagagggattatggag

SEQ ID NO: 14943 - DNA, 25 bp, Mus musculus
cagccggacaacatcaaggcactgt

SEQ ID NO: 14944 - DNA, 25 bp, Mus musculus
cagccggagttgtaccacccaatga

SEQ ID NO: 14945 - DNA, 25 bp, Mus musculus
cagccggatccgagaagttgtccca

SEQ ID NO: 14946 - DNA, 25 bp, Mus musculus
cagccgggaccgcttcctcaaggat

SEQ ID NO: 14947 - DNA, 25 bp, Mus musculus
cagccgggactttggctgggatccc

SEQ ID NO: 14948 - DNA, 25 bp, Mus musculus
cagccgtaccatgtaatgccattgg

SEQ ID NO: 14949 - DNA, 25 bp, Mus musculus
cagccgtagctcagaaccggatcta

SEQ ID NO: 14950 - DNA, 25 bp, Mus musculus
cagccgtagctctgcaaccacgttt

SEQ ID NO: 14951 - DNA, 25 bp, Mus musculus
cagccgtaggcaagacggccctggt

SEQ ID NO: 14952 - DNA, 25 bp, Mus musculus
cagccgtagttaccgagtggaacag

SEQ ID NO: 14953 - DNA, 25 bp, Mus musculus
cagccgtgatgatgaatgcaggaag

SEQ ID NO: 14954 - DNA, 25 bp, Mus musculus
cagccgtggtggatcgatacagcac

SEQ ID NO: 14955 - DNA, 25 bp, Mus musculus
cagccgtgtcggacttggaactctc

SEQ ID NO: 14956 - DNA, 25 bp, Mus musculus
cagccgtgtcttgcatgtgttaagc

SEQ ID NO: 14957 - DNA, 25 bp, Mus musculus
cagccgttggcaatgcacatccatc

SEQ ID NO: 14958 - DNA, 25 bp, Mus musculus
cagccgttggcattgcacatccatc

SEQ ID NO: 14959 - DNA, 25 bp, Mus musculus
cagcctaccgagaagagactctgag

SEQ ID NO: 14960 - DNA, 25 bp, Mus musculus
cagcctacgtggtcaaggtcttctc

SEQ ID NO: 14961 - DNA, 25 bp, Mus musculus
cagcctagaagacgctagcactaac

SEQ ID NO: 14962 - DNA, 25 bp, Mus musculus
cagcctattagctattgatgcaaga

SEQ ID NO: 14963 - DNA, 25 bp, Mus musculus
cagcctccagagacagtccagaact

SEQ ID NO: 14964 - DNA, 25 bp, Mus musculus
cagcctccagaggaattcggtttca

SEQ ID NO: 14965 - DNA, 25 bp, Mus musculus
cagcctccaggcatgcaataagcga

SEQ ID NO: 14966 - DNA, 25 bp, Mus musculus
cagcctccatagatcaaacagtgaa

SEQ ID NO: 14967 - DNA, 25 bp, Mus musculus
cagcctccgcagctcagtaatctga

SEQ ID NO: 14968 - DNA, 25 bp, Mus musculus
cagcctccgcaggtcagtaatctga

SEQ ID NO: 14969 - DNA, 25 bp, Mus musculus
cagcctcctgctagactcatcagtg

SEQ ID NO: 14970 - DNA, 25 bp, Mus musculus
cagcctccttgtgtgcgagaactgg

SEQ ID NO: 14971 - DNA, 25 bp, Mus musculus
cagcctcgccctggatgagaattgt

SEQ ID NO: 14972 - DNA, 25 bp, Mus musculus
cagcctcggcctcgagcagctttga

SEQ ID NO: 14973 - DNA, 25 bp, Mus musculus
cagcctctgtactatgtggccgaga

SEQ ID NO: 14974 - DNA, 25 bp, Mus musculus
cagcctcttccaaatgaccaatgag

SEQ ID NO: 14975 - DNA, 25 bp, Mus musculus
cagcctgaaatgaagcccttcacag

SEQ ID NO: 14976 - DNA, 25 bp, Mus musculus
cagcctgaacccacagacgtaaaag

SEQ ID NO: 14977 - DNA, 25 bp, Mus musculus
cagcctgaagaagtttttgatgtac

SEQ ID NO: 14978 - DNA, 25 bp, Mus musculus
cagcctgaaggacacagttgaaccc

SEQ ID NO: 14979 - DNA, 25 bp, Mus musculus
cagcctgaaggagacagttgaaccc

SEQ ID NO: 14980 - DNA, 25 bp, Mus musculus
cagcctgaaggttaacatgttcaac

SEQ ID NO: 14981 - DNA, 25 bp, Mus musculus
cagcctgataattgagccgacccag

SEQ ID NO: 14982 - DNA, 25 bp, Mus musculus
cagcctgatggcatcgctgtggttg

SEQ ID NO: 14983 - DNA, 25 bp, Mus musculus
cagcctgcaaagaaaagatgatttc

SEQ ID NO: 14984 - DNA, 25 bp, Mus musculus
cagcctgcaaagtaaagatgatttc

SEQ ID NO: 14985 - DNA, 25 bp, Mus musculus
cagcctgccagaaaacagatcactt

SEQ ID NO: 14986 - DNA, 25 bp, Mus musculus
cagcctgcttgttgtgagctgtgac

SEQ ID NO: 14987 - DNA, 25 bp, Mus musculus
cagcctggaggctctaagtgtgcat

SEQ ID NO: 14988 - DNA, 25 bp, Mus musculus
cagcctggcaaaatctgagggccca

SEQ ID NO: 14989 - DNA, 25 bp, Mus musculus
cagcctggccctccggtacatgaag

SEQ ID NO: 14990 - DNA, 25 bp, Mus musculus
cagcctgggccatacacttgtggaa

SEQ ID NO: 14991 - DNA, 25 bp, Mus musculus
cagcctgggcttcaccatctcagtg

SEQ ID NO: 14992 - DNA, 25 bp, Mus musculus
cagcctggggtgagccaaatgaaag

SEQ ID NO: 14993 - DNA, 25 bp, Mus musculus
cagcctggtagattgccagaggact

SEQ ID NO: 14994 - DNA, 25 bp, Mus musculus
cagcctggtgtccacgctgcagcag

SEQ ID NO: 14995 - DNA, 25 bp, Mus musculus
cagcctgtgaccagatcttccagaa

SEQ ID NO: 14996 - DNA, 25 bp, Mus musculus
cagcctgtttatcccatcacgggtg

SEQ ID NO: 14997 - DNA, 25 bp, Mus musculus
cagccttaagctgtgtgttttactg

SEQ ID NO: 14998 - DNA, 25 bp, Mus musculus
cagccttatgtgcagatggtcctca

SEQ ID NO: 14999 - DNA, 25 bp, Mus musculus
cagccttggccgatgtaaacacacc

SEQ ID NO: 15000 - DNA, 25 bp, Mus musculus
cagccttggtagcagcaggtgacat

SEQ ID NO: 15001 - DNA, 25 bp, Mus musculus
cagccttggtgtccgctgggtctca

SEQ ID NO: 15002 - DNA, 25 bp, Mus musculus
cagccttgtcctgaagagcacctga

SEQ ID NO: 15003 - DNA, 25 bp, Mus musculus
cagccttgttttatcatgtcttcaa

SEQ ID NO: 15004 - DNA, 25 bp, Mus musculus
cagcctttctatgccgtggagaaga

SEQ ID NO: 15005 - DNA, 25 bp, Mus musculus
cagcctttcttgacccctgggtgtt

SEQ ID NO: 15006 - DNA, 25 bp, Mus musculus
cagcctttgagagcaggagcacatt

SEQ ID NO: 15007 - DNA, 25 bp, Mus musculus
cagcctttgcccattacaaatcaag

SEQ ID NO: 15008 - DNA, 25 bp, Mus musculus
cagcctttggaggatcggctcttcc

SEQ ID NO: 15009 - DNA, 25 bp, Mus musculus
cagcctttggatcctgtggtacccc

SEQ ID NO: 15010 - DNA, 25 bp, Mus musculus
cagccttttcgaacatgaactaggg

SEQ ID NO: 15011 - DNA, 25 bp, Mus musculus
cagcgaacatttcgagaaataaaag

SEQ ID NO: 15012 - DNA, 25 bp, Mus musculus
cagcgaagacagagtcggtgcagta

SEQ ID NO: 15013 - DNA, 25 bp, Mus musculus
cagcgaatcgggaggcttggtacaa

SEQ ID NO: 15014 - DNA, 25 bp, Mus musculus
cagcgaatcgggtggcttggtacaa

SEQ ID NO: 15015 - DNA, 25 bp, Mus musculus
cagcgaatgggcagccaagtacatc

SEQ ID NO: 15016 - DNA, 25 bp, Mus musculus
cagcgacacatagtctttctaacag

SEQ ID NO: 15017 - DNA, 25 bp, Mus musculus
cagcgacacgccgactatacgaaaa

SEQ ID NO: 15018 - DNA, 25 bp, Mus musculus
cagcgacgaagagatggagcaaccg

SEQ ID NO: 15019 - DNA, 25 bp, Mus musculus
cagcgagaaggatggaaaggaatat

SEQ ID NO: 15020 - DNA, 25 bp, Mus musculus
cagcgagcgctactctcgtagattc

SEQ ID NO: 15021 - DNA, 25 bp, Mus musculus
cagcgaggacatctggaagaaattc

SEQ ID NO: 15022 - DNA, 25 bp, Mus musculus
cagcgaggagaacatcaagaacaat

SEQ ID NO: 15023 - DNA, 25 bp, Mus musculus
cagcgaggcctgcagaactacctta

SEQ ID NO: 15024 - DNA, 25 bp, Mus musculus
cagcgagggccaggtattcatggaa

SEQ ID NO: 15025 - DNA, 25 bp, Mus musculus
cagcgagtgatctcagaagggatgc

SEQ ID NO: 15026 - DNA, 25 bp, Mus musculus
cagcgagtggatgggttactgcctc

SEQ ID NO: 15027 - DNA, 25 bp, Mus musculus
cagcgatgagtcattcgccatgatt

SEQ ID NO: 15028 - DNA, 25 bp, Mus musculus
cagcgattgtccaagaattcctcac

SEQ ID NO: 15029 - DNA, 25 bp, Mus musculus
cagcgcaaaaatctccggtgtttct

SEQ ID NO: 15030 - DNA, 25 bp, Mus musculus
cagcgcaaaaatgtccggtgtttct

SEQ ID NO: 15031 - DNA, 25 bp, Mus musculus
cagcgcaagatacatttttgtagaa

SEQ ID NO: 15032 - DNA, 25 bp, Mus musculus
cagcgcagcctgactgagatagaaa

SEQ ID NO: 15033 - DNA, 25 bp, Mus musculus
cagcgcagctgctgagaattactta

SEQ ID NO: 15034 - DNA, 25 bp, Mus musculus
cagcgcaggctgttgaagatgtttt

SEQ ID NO: 15035 - DNA, 25 bp, Mus musculus
cagcgcagtataagaaggccctaga

SEQ ID NO: 15036 - DNA, 25 bp, Mus musculus
cagcgccaggctggagagcctcgaa

SEQ ID NO: 15037 - DNA, 25 bp, Mus musculus
cagcgcccagactgaggcttgttac

SEQ ID NO: 15038 - DNA, 25 bp, Mus musculus
cagcgcccgaggaactgacagtggt

SEQ ID NO: 15039 - DNA, 25 bp, Mus musculus
cagcgcctaaagtggagcaacagga

SEQ ID NO: 15040 - DNA, 25 bp, Mus musculus
cagcgcggtgattggtcgattgtaa

SEQ ID NO: 15041 - DNA, 25 bp, Mus musculus
cagcgcggtgtctgcctgcacgctg

SEQ ID NO: 15042 - DNA, 25 bp, Mus musculus
cagcgctcctgttcggtttccagca

SEQ ID NO: 15043 - DNA, 25 bp, Mus musculus
cagcgctctgtttttggagagagaa

SEQ ID NO: 15044 - DNA, 25 bp, Mus musculus
cagcgctctttatgctggagggagt

SEQ ID NO: 15045 - DNA, 25 bp, Mus musculus
cagcgctgctgtcacactcttcaag

SEQ ID NO: 15046 - DNA, 25 bp, Mus musculus
cagcgctgggagtggaaaaattttc

SEQ ID NO: 15047 - DNA, 25 bp, Mus musculus
cagcgctgtgtgaacagcaccagca

SEQ ID NO: 15048 - DNA, 25 bp, Mus musculus
cagcgctgtgtgtacagcaccagca

SEQ ID NO: 15049 - DNA, 25 bp, Mus musculus
cagcgcttccgggacaagaagctgt

SEQ ID NO: 15050 - DNA, 25 bp, Mus musculus
cagcgcttggctgaaccatcacaga

SEQ ID NO: 15051 - DNA, 25 bp, Mus musculus
cagcggaacacactgtgggaactgc

SEQ ID NO: 15052 - DNA, 25 bp, Mus musculus
cagcggagcaactgcggtggttcag

SEQ ID NO: 15053 - DNA, 25 bp, Mus musculus
cagcggagcctctgatcctggcggc

SEQ ID NO: 15054 - DNA, 25 bp, Mus musculus
cagcggagtgaaaagcattcctggc

SEQ ID NO: 15055 - DNA, 25 bp, Mus musculus
cagcggcaaaatatggtatctgcga

SEQ ID NO: 15056 - DNA, 25 bp, Mus musculus
cagcggcaaaatttggtatctgcga

SEQ ID NO: 15057 - DNA, 25 bp, Mus musculus
cagcggcagagactatgtgtcccag

SEQ ID NO: 15058 - DNA, 25 bp, Mus musculus
cagcggcctcaaaacggagggcaat

SEQ ID NO: 15059 - DNA, 25 bp, Mus musculus
cagcggctggtggagttcatgacaa

SEQ ID NO: 15060 - DNA, 25 bp, Mus musculus
cagcgggaaccactgcttaccttgg

SEQ ID NO: 15061 - DNA, 25 bp, Mus musculus
cagcgggcgtcaaccccgacttgga

SEQ ID NO: 15062 - DNA, 25 bp, Mus musculus
cagcgggcttgcatgatcagaagaa

SEQ ID NO: 15063 - DNA, 25 bp, Mus musculus
cagcgggtccctgctgacatgatct

SEQ ID NO: 15064 - DNA, 25 bp, Mus musculus
cagcggtataccacttgcagagcaa

SEQ ID NO: 15065 - DNA, 25 bp, Mus musculus
cagcggtatacctcttgcagagcaa

SEQ ID NO: 15066 - DNA, 25 bp, Mus musculus
cagcggtatttccagctgtaccccg

SEQ ID NO: 15067 - DNA, 25 bp, Mus musculus
cagcggtcagcagtgtttgtgatcc

SEQ ID NO: 15068 - DNA, 25 bp, Mus musculus
cagcggtggagatggcgacatcctc

SEQ ID NO: 15069 - DNA, 25 bp, Mus musculus
cagcggtggcatttccagaagagga

SEQ ID NO: 15070 - DNA, 25 bp, Mus musculus
cagcggtgttgctgttgaaacagga

SEQ ID NO: 15071 - DNA, 25 bp, Mus musculus
cagcggtttcttactgtttgtgcaa

SEQ ID NO: 15072 - DNA, 25 bp, Mus musculus
cagcgtaactattccctggaagcaa

SEQ ID NO: 15073 - DNA, 25 bp, Mus musculus
cagcgtaagcggaatggacccgcct

SEQ ID NO: 15074 - DNA, 25 bp, Mus musculus
cagcgtaagtatgcacagatgaaga

SEQ ID NO: 15075 - DNA, 25 bp, Mus musculus
cagcgtcaaggaaaggctccggcct

SEQ ID NO: 15076 - DNA, 25 bp, Mus musculus
cagcgtcactcggatcttatcatga

SEQ ID NO: 15077 - DNA, 25 bp, Mus musculus
cagcgtcagcagtgcagttgcaaca

SEQ ID NO: 15078 - DNA, 25 bp, Mus musculus
cagcgtccccagagaagagcataga

SEQ ID NO: 15079 - DNA, 25 bp, Mus musculus
cagcgtctgtgtggacatcggttca

SEQ ID NO: 15080 - DNA, 25 bp, Mus musculus
cagcgtgaagcagccagggcagcaa

SEQ ID NO: 15081 - DNA, 25 bp, Mus musculus
cagcgtgactgtggaagaattctgt

SEQ ID NO: 15082 - DNA, 25 bp, Mus musculus
cagcgtgacttatggcatctggatc

SEQ ID NO: 15083 - DNA, 25 bp, Mus musculus
cagcgtgagctgattattggtgaca

SEQ ID NO: 15084 - DNA, 25 bp, Mus musculus
cagcgtgggcgagccctgtctacag

SEQ ID NO: 15085 - DNA, 25 bp, Mus musculus
cagcgtggtgaggaaccctgggttc

SEQ ID NO: 15086 - DNA, 25 bp, Mus musculus
cagcgtgtaggaataatacctccaa

SEQ ID NO: 15087 - DNA, 25 bp, Mus musculus
cagcgtgtcgctgcgggacttcaaa

SEQ ID NO: 15088 - DNA, 25 bp, Mus musculus
cagcgttccatgtccagcaccaggg

SEQ ID NO: 15089 - DNA, 25 bp, Mus musculus
cagcgttgttcagttcacaaatgag

SEQ ID NO: 15090 - DNA, 25 bp, Mus musculus
cagcgtttagccttccagttagcca

SEQ ID NO: 15091 - DNA, 25 bp, Mus musculus
cagcgtttatttgaaaatctacgta

SEQ ID NO: 15092 - DNA, 25 bp, Mus musculus
cagcgttttccaaagagtttgtcat

SEQ ID NO: 15093 - DNA, 25 bp, Mus musculus
cagctaaagttgctgagcagcagga

SEQ ID NO: 15094 - DNA, 25 bp, Mus musculus
cagctaagaacaaggccctgcagag

SEQ ID NO: 15095 - DNA, 25 bp, Mus musculus
cagctaaggaaccagttcataatca

SEQ ID NO: 15096 - DNA, 25 bp, Mus musculus
cagctaatagaagacatcgtgcgtg

SEQ ID NO: 15097 - DNA, 25 bp, Mus musculus
cagctaatgagactggacaatatgc

SEQ ID NO: 15098 - DNA, 25 bp, Mus musculus
cagctaatgctggattgttggcaga

SEQ ID NO: 15099 - DNA, 25 bp, Mus musculus
cagctaatggctcatttggattcca

SEQ ID NO: 15100 - DNA, 25 bp, Mus musculus
cagctacaacaaccgcagcaataaa

SEQ ID NO: 15101 - DNA, 25 bp, Mus musculus
cagctacaagatgtcactttcctgg

SEQ ID NO: 15102 - DNA, 25 bp, Mus musculus
cagctacagctcctactaccaagga

SEQ ID NO: 15103 - DNA, 25 bp, Mus musculus
cagctacatgagcagtacaagatcc

SEQ ID NO: 15104 - DNA, 25 bp, Mus musculus
cagctacatgagctctgggcctgtg

SEQ ID NO: 15105 - DNA, 25 bp, Mus musculus
cagctaccagctcaggagatacaag

SEQ ID NO: 15106 - DNA, 25 bp, Mus musculus
cagctacctgaataagcttccggtg

SEQ ID NO: 15107 - DNA, 25 bp, Mus musculus
cagctacctggtccctgaatcagac

SEQ ID NO: 15108 - DNA, 25 bp, Mus musculus
cagctacctggtgcctgaatcagac

SEQ ID NO: 15109 - DNA, 25 bp, Mus musculus
cagctacgacatatggagctagaag

SEQ ID NO: 15110 - DNA, 25 bp, Mus musculus
cagctagaaaatcagcttttacggg

SEQ ID NO: 15111 - DNA, 25 bp, Mus musculus
cagctagaggatgccgctatggaga

SEQ ID NO: 15112 - DNA, 25 bp, Mus musculus
cagctagcaacggtgctgtgttact

SEQ ID NO: 15113 - DNA, 25 bp, Mus musculus
cagctagtgactgtctctttctgcg

SEQ ID NO: 15114 - DNA, 25 bp, Mus musculus
cagctagtgcgcatgtttctcatga

SEQ ID NO: 15115 - DNA, 25 bp, Mus musculus
cagctagtggtctttttatccaggc

SEQ ID NO: 15116 - DNA, 25 bp, Mus musculus
cagctagttgctggtgttgcgttca

SEQ ID NO: 15117 - DNA, 25 bp, Mus musculus
cagctatatcactgggactgtggcc

SEQ ID NO: 15118 - DNA, 25 bp, Mus musculus
cagctatcccatcaataccctggtg

SEQ ID NO: 15119 - DNA, 25 bp, Mus musculus
cagctatctccggaacagggcagtt

SEQ ID NO: 15120 - DNA, 25 bp, Mus musculus
cagctatgagatgctcgtttccctg

SEQ ID NO: 15121 - DNA, 25 bp, Mus musculus
cagctatgcttatatcctggaggcc

SEQ ID NO: 15122 - DNA, 25 bp, Mus musculus
cagctatttagagcctgaaaagaaa

SEQ ID NO: 15123 - DNA, 25 bp, Mus musculus
cagctatttgacgttggtaactgac

SEQ ID NO: 15124 - DNA, 25 bp, Mus musculus
cagctcaaagatgtcgcgtatggca

SEQ ID NO: 15125 - DNA, 25 bp, Mus musculus
cagctcaacttccaggaacaggcgg

SEQ ID NO: 15126 - DNA, 25 bp, Mus musculus
cagctcacctatggagcagaacaaa

SEQ ID NO: 15127 - DNA, 25 bp, Mus musculus
cagctcagaagcttcaagtcaagaa

SEQ ID NO: 15128 - DNA, 25 bp, Mus musculus
cagctcagatcctgaagtccgtgga

SEQ ID NO: 15129 - DNA, 25 bp, Mus musculus
cagctcagcaagactttccaaagaa

SEQ ID NO: 15130 - DNA, 25 bp, Mus musculus
cagctcagcagggaggaccagatcg

SEQ ID NO: 15131 - DNA, 25 bp, Mus musculus
cagctcagctgggaatgtgcaatag

SEQ ID NO: 15132 - DNA, 25 bp, Mus musculus
cagctcaggagctacttgatgaaat

SEQ ID NO: 15133 - DNA, 25 bp, Mus musculus
cagctcaggctgaaaatcaagaaga

SEQ ID NO: 15134 - DNA, 25 bp, Mus musculus
cagctcagggaaggatcgcatttca

SEQ ID NO: 15135 - DNA, 25 bp, Mus musculus
cagctcagtaccgagaggcaatgga

SEQ ID NO: 15136 - DNA, 25 bp, Mus musculus
cagctcagtcacctcagcagcgagt

SEQ ID NO: 15137 - DNA, 25 bp, Mus musculus
cagctcagtgactgtaacctcgaac

SEQ ID NO: 15138 - DNA, 25 bp, Mus musculus
cagctcatctcgatttgactgcaac

SEQ ID NO: 15139 - DNA, 25 bp, Mus musculus
cagctcatctgtggatactgccgta

SEQ ID NO: 15140 - DNA, 25 bp, Mus musculus
cagctcatgctgatgggccttttga

SEQ ID NO: 15141 - DNA, 25 bp, Mus musculus
cagctcatgctgttgggccttttga

SEQ ID NO: 15142 - DNA, 25 bp, Mus musculus
cagctccaaggctgcttgccttgga

SEQ ID NO: 15143 - DNA, 25 bp, Mus musculus
cagctccagatgaaccagggtagtg

SEQ ID NO: 15144 - DNA, 25 bp, Mus musculus
cagctccagcaaccagatactgtgg

SEQ ID NO: 15145 - DNA, 25 bp, Mus musculus
cagctccagcaagagcttcagcgag

SEQ ID NO: 15146 - DNA, 25 bp, Mus musculus
cagctccagcaagcagatactgtgg

SEQ ID NO: 15147 - DNA, 25 bp, Mus musculus
cagctccagtttaaaagcctgcaaa

SEQ ID NO: 15148 - DNA, 25 bp, Mus musculus
cagctccatgggaagatctctggtt

SEQ ID NO: 15149 - DNA, 25 bp, Mus musculus
cagctcccttagcaatgacagcagt

SEQ ID NO: 15150 - DNA, 25 bp, Mus musculus
cagctcccttaggaatgacagcagt

SEQ ID NO: 15151 - DNA, 25 bp, Mus musculus
cagctccgaaagcaaaagagggagt

SEQ ID NO: 15152 - DNA, 25 bp, Mus musculus
cagctccgaattacgtatagaaaaa

SEQ ID NO: 15153 - DNA, 25 bp, Mus musculus
cagctccgcaggctaactttcctgg

SEQ ID NO: 15154 - DNA, 25 bp, Mus musculus
cagctccgtggtccaggccttgctg

SEQ ID NO: 15155 - DNA, 25 bp, Mus musculus
cagctcctccagagactccagtgtg

SEQ ID NO: 15156 - DNA, 25 bp, Mus musculus
cagctccttgctctgttatagcagg

SEQ ID NO: 15157 - DNA, 25 bp, Mus musculus
cagctcctttatcccggaaccttgg

SEQ ID NO: 15158 - DNA, 25 bp, Mus musculus
cagctcctttatgccggaaccttgg

SEQ ID NO: 15159 - DNA, 25 bp, Mus musculus
cagctcgagtcaacgtgcctgtcat

SEQ ID NO: 15160 - DNA, 25 bp, Mus musculus
cagctcggcctgcacatatggcagc

SEQ ID NO: 15161 - DNA, 25 bp, Mus musculus
cagctctatgtctgaaccttctttg

SEQ ID NO: 15162 - DNA, 25 bp, Mus musculus
cagctctcaactgtgttcatcaaac

SEQ ID NO: 15163 - DNA, 25 bp, Mus musculus
cagctctcggaagtctgtgctttct

SEQ ID NO: 15164 - DNA, 25 bp, Mus musculus
cagctctcgtgggagccttcgggtc

SEQ ID NO: 15165 - DNA, 25 bp, Mus musculus
cagctctcgtgttcatattctccag

SEQ ID NO: 15166 - DNA, 25 bp, Mus musculus
cagctctctaagtatgcaatgccag

SEQ ID NO: 15167 - DNA, 25 bp, Mus musculus
cagctctctgaccttgattgggatg

SEQ ID NO: 15168 - DNA, 25 bp, Mus musculus
cagctctctgactctgcaggatggt

SEQ ID NO: 15169 - DNA, 25 bp, Mus musculus
cagctctgatatacttctcttggga

SEQ ID NO: 15170 - DNA, 25 bp, Mus musculus
cagctctgatattcttctcttggga

SEQ ID NO: 15171 - DNA, 25 bp, Mus musculus
cagctctgcccaagctttggcagaa

SEQ ID NO: 15172 - DNA, 25 bp, Mus musculus
cagctctgcctggaccactggtttg

SEQ ID NO: 15173 - DNA, 25 bp, Mus musculus
cagctctggagttagccctgggtgt

SEQ ID NO: 15174 - DNA, 25 bp, Mus musculus
cagctctggtcagtgctctacttct

SEQ ID NO: 15175 - DNA, 25 bp, Mus musculus
cagctctgtccggatgacatccgta

SEQ ID NO: 15176 - DNA, 25 bp, Mus musculus
cagctctgttcaaatctggctcaga

SEQ ID NO: 15177 - DNA, 25 bp, Mus musculus
cagctcttggccagtgtcatcgcag

SEQ ID NO: 15178 - DNA, 25 bp, Mus musculus
cagctgaaaggactgtgcaagtgac

SEQ ID NO: 15179 - DNA, 25 bp, Mus musculus
cagctgaagacaattaacctgcaga

SEQ ID NO: 15180 - DNA, 25 bp, Mus musculus
cagctgaagtctcttcaatgcctgc

SEQ ID NO: 15181 - DNA, 25 bp, Mus musculus
cagctgaatttcttccgtgtggtag

SEQ ID NO: 15182 - DNA, 25 bp, Mus musculus
cagctgacaacttacctgctttcca

SEQ ID NO: 15183 - DNA, 25 bp, Mus musculus
cagctgacaagccttatgaagaggg

SEQ ID NO: 15184 - DNA, 25 bp, Mus musculus
cagctgacatggtcagagaaggtgc

SEQ ID NO: 15185 - DNA, 25 bp, Mus musculus
cagctgactcattagtagagagcag

SEQ ID NO: 15186 - DNA, 25 bp, Mus musculus
cagctgactctgaaaagccctgcct

SEQ ID NO: 15187 - DNA, 25 bp, Mus musculus
cagctgagagaccagcagaaagtcc

SEQ ID NO: 15188 - DNA, 25 bp, Mus musculus
cagctgagcaaacctttgcttgcct

SEQ ID NO: 15189 - DNA, 25 bp, Mus musculus
cagctgagcggagggcctacagcaa

SEQ ID NO: 15190 - DNA, 25 bp, Mus musculus
cagctgaggactcctccgcagtgca

SEQ ID NO: 15191 - DNA, 25 bp, Mus musculus
cagctgaggaggcaacacatgtgtc

SEQ ID NO: 15192 - DNA, 25 bp, Mus musculus
cagctgagtacaagtttagtgattc

SEQ ID NO: 15193 - DNA, 25 bp, Mus musculus
cagctgagtcattgtcttggtacaa

SEQ ID NO: 15194 - DNA, 25 bp, Mus musculus
cagctgatcccaaccactatggcag

SEQ ID NO: 15195 - DNA, 25 bp, Mus musculus
cagctgatgacaacaaacgtgtggc

SEQ ID NO: 15196 - DNA, 25 bp, Mus musculus
cagctgatgatttgtccctgtctga

SEQ ID NO: 15197 - DNA, 25 bp, Mus musculus
cagctgatggttgtcactggcatcc

SEQ ID NO: 15198 - DNA, 25 bp, Mus musculus
cagctgatgtcgtcgtcatgatgct

SEQ ID NO: 15199 - DNA, 25 bp, Mus musculus
cagctgcacaggagcgtttcctggg

SEQ ID NO: 15200 - DNA, 25 bp, Mus musculus
cagctgcacgagttagcgagctcat

SEQ ID NO: 15201 - DNA, 25 bp, Mus musculus
cagctgcagaatgaggaagagctgc

SEQ ID NO: 15202 - DNA, 25 bp, Mus musculus
cagctgcagacagttcagcagtcaa

SEQ ID NO: 15203 - DNA, 25 bp, Mus musculus
cagctgcaggtgttccagctgcagc

SEQ ID NO: 15204 - DNA, 25 bp, Mus musculus
cagctgcagtcagactcagaacttg

SEQ ID NO: 15205 - DNA, 25 bp, Mus musculus
cagctgccaggacactgctgccaga

SEQ ID NO: 15206 - DNA, 25 bp, Mus musculus
cagctgccagtcttggcatcttcga

SEQ ID NO: 15207 - DNA, 25 bp, Mus musculus
cagctgcccttgatgagatgttcca

SEQ ID NO: 15208 - DNA, 25 bp, Mus musculus
cagctgcctggacccattcgggagt

SEQ ID NO: 15209 - DNA, 25 bp, Mus musculus
cagctgcctggagccattcgggagt

SEQ ID NO: 15210 - DNA, 25 bp, Mus musculus
cagctgcctggcactttcggcatga

SEQ ID NO: 15211 - DNA, 25 bp, Mus musculus
cagctgcgctcctgacagccaggta

SEQ ID NO: 15212 - DNA, 25 bp, Mus musculus
cagctgcggcagcagtggctacttc

SEQ ID NO: 15213 - DNA, 25 bp, Mus musculus
cagctgcgtgcagaaatgctactgc

SEQ ID NO: 15214 - DNA, 25 bp, Mus musculus
cagctgctacccatggcttagatga

SEQ ID NO: 15215 - DNA, 25 bp, Mus musculus
cagctgctaccgttctgggtgtgaa

SEQ ID NO: 15216 - DNA, 25 bp, Mus musculus
cagctgctcagtctcgtgggtgcac

SEQ ID NO: 15217 - DNA, 25 bp, Mus musculus
cagctgctgaatcacaggccgatga

SEQ ID NO: 15218 - DNA, 25 bp, Mus musculus
cagctgctgattcacgcggccatga

SEQ ID NO: 15219 - DNA, 25 bp, Mus musculus
cagctgctgctcatagctcgagcca

SEQ ID NO: 15220 - DNA, 25 bp, Mus musculus
cagctgctgtcctattccgaatgtc

SEQ ID NO: 15221 - DNA, 25 bp, Mus musculus
cagctgctgttactacatctctcct

SEQ ID NO: 15222 - DNA, 25 bp, Mus musculus
cagctgctttgaaataccctggagc

SEQ ID NO: 15223 - DNA, 25 bp, Mus musculus
cagctgctttggttgacttgggcct

SEQ ID NO: 15224 - DNA, 25 bp, Mus musculus
cagctggacagcatgataagggtgc

SEQ ID NO: 15225 - DNA, 25 bp, Mus musculus
cagctggacagcttgataagggtgc

SEQ ID NO: 15226 - DNA, 25 bp, Mus musculus
cagctggaccgaattgattcactga

SEQ ID NO: 15227 - DNA, 25 bp, Mus musculus
cagctggagattccctgtcaggaac

SEQ ID NO: 15228 - DNA, 25 bp, Mus musculus
cagctggataagcacggccaggcta

SEQ ID NO: 15229 - DNA, 25 bp, Mus musculus
cagctggatctagcagagatagacc

SEQ ID NO: 15230 - DNA, 25 bp, Mus musculus
cagctggatgaccttaatatgcgat

SEQ ID NO: 15231 - DNA, 25 bp, Mus musculus
cagctggattttttaccggacaagc

SEQ ID NO: 15232 - DNA, 25 bp, Mus musculus
cagctggcagggagaacagcgacaa

SEQ ID NO: 15233 - DNA, 25 bp, Mus musculus
cagctggcctctgagaaggatgagc

SEQ ID NO: 15234 - DNA, 25 bp, Mus musculus
cagctggccttaatgttgactttga

SEQ ID NO: 15235 - DNA, 25 bp, Mus musculus
cagctggctaacaatggtacggatg

SEQ ID NO: 15236 - DNA, 25 bp, Mus musculus
cagctggctagaggcatggagtact

SEQ ID NO: 15237 - DNA, 25 bp, Mus musculus
cagctggctcagatccaggctcaga

SEQ ID NO: 15238 - DNA, 25 bp, Mus musculus
cagctgggaccatttctgacaaaaa

SEQ ID NO: 15239 - DNA, 25 bp, Mus musculus
cagctgggagatgctggtacttgtt

SEQ ID NO: 15240 - DNA, 25 bp, Mus musculus
cagctgggctatgatttggtgtctc

SEQ ID NO: 15241 - DNA, 25 bp, Mus musculus
cagctgggctttggcgtggccccag

SEQ ID NO: 15242 - DNA, 25 bp, Mus musculus
cagctgggtcttctcgccagagaca

SEQ ID NO: 15243 - DNA, 25 bp, Mus musculus
cagctggtgcagttgcttaacaagc

SEQ ID NO: 15244 - DNA, 25 bp, Mus musculus
cagctggtttgtaatcaacgtgatt

SEQ ID NO: 15245 - DNA, 25 bp, Mus musculus
cagctgtaaccaagcctcagcaggg

SEQ ID NO: 15246 - DNA, 25 bp, Mus musculus
cagctgtaaccatgcctcagcaggg

SEQ ID NO: 15247 - DNA, 25 bp, Mus musculus
cagctgtatgcctacgactggataa

SEQ ID NO: 15248 - DNA, 25 bp, Mus musculus
cagctgtcagtcacaaagcctctgg

SEQ ID NO: 15249 - DNA, 25 bp, Mus musculus
cagctgtcagtctcaaagcctctgg

SEQ ID NO: 15250 - DNA, 25 bp, Mus musculus
cagctgtcttctcgaggagacctca

SEQ ID NO: 15251 - DNA, 25 bp, Mus musculus
cagctgtgagaacggtgacaccacc

SEQ ID NO: 15252 - DNA, 25 bp, Mus musculus
cagctgtgagaagggtgacaccacc

SEQ ID NO: 15253 - DNA, 25 bp, Mus musculus
cagctgtgaggaaggctttcagatc

SEQ ID NO: 15254 - DNA, 25 bp, Mus musculus
cagctgtgatgacctcaccgctcta

SEQ ID NO: 15255 - DNA, 25 bp, Mus musculus
cagctgtgcgcaggaactcctgttc

SEQ ID NO: 15256 - DNA, 25 bp, Mus musculus
cagctgtgctctgataacgtgtggg

SEQ ID NO: 15257 - DNA, 25 bp, Mus musculus
cagctgtggctgcatctgagtcaga

SEQ ID NO: 15258 - DNA, 25 bp, Mus musculus
cagctgtgggtaccccacttatgag

SEQ ID NO: 15259 - DNA, 25 bp, Mus musculus
cagctgttcgtgaggataaccggcg

SEQ ID NO: 15260 - DNA, 25 bp, Mus musculus
cagctgttggacttggatggtttcc

SEQ ID NO: 15261 - DNA, 25 bp, Mus musculus
cagctgtttcagaaaagaagggatt

SEQ ID NO: 15262 - DNA, 25 bp, Mus musculus
cagcttacaaccagagaccctgagg

SEQ ID NO: 15263 - DNA, 25 bp, Mus musculus
cagcttactccttgtattcgaaatg

SEQ ID NO: 15264 - DNA, 25 bp, Mus musculus
cagcttatgccagcactggtcagca

SEQ ID NO: 15265 - DNA, 25 bp, Mus musculus
cagcttcacttcttccttgacttca

SEQ ID NO: 15266 - DNA, 25 bp, Mus musculus
cagcttcagagacagtttaagtaca

SEQ ID NO: 15267 - DNA, 25 bp, Mus musculus
cagcttcagcagataatgcgtctga

SEQ ID NO: 15268 - DNA, 25 bp, Mus musculus
cagcttcaggaagccctcaacgaga

SEQ ID NO: 15269 - DNA, 25 bp, Mus musculus
cagcttcatgctgatggccccttta

SEQ ID NO: 15270 - DNA, 25 bp, Mus musculus
cagcttcccagcgagaaggatggaa

SEQ ID NO: 15271 - DNA, 25 bp, Mus musculus
cagcttcccctgtggtgtctgcctg

SEQ ID NO: 15272 - DNA, 25 bp, Mus musculus
cagcttccggcttctgtttgatgtg

SEQ ID NO: 15273 - DNA, 25 bp, Mus musculus
cagcttcgatgagggcagtgtgtcc

SEQ ID NO: 15274 - DNA, 25 bp, Mus musculus
cagcttcgggaagaccagcaagtcc

SEQ ID NO: 15275 - DNA, 25 bp, Mus musculus
cagcttctaccatgccttttcagga

SEQ ID NO: 15276 - DNA, 25 bp, Mus musculus
cagcttctgctatatcatcagattc

SEQ ID NO: 15277 - DNA, 25 bp, Mus musculus
cagcttctggattccctcactaacg

SEQ ID NO: 15278 - DNA, 25 bp, Mus musculus
cagcttctttctcacacgcagatga

SEQ ID NO: 15279 - DNA, 25 bp, Mus musculus
cagcttgaaggagtctacagagaat

SEQ ID NO: 15280 - DNA, 25 bp, Mus musculus
cagcttgacaagaacaaactacagg

SEQ ID NO: 15281 - DNA, 25 bp, Mus musculus
cagcttgacaagaacgctctgtgag

SEQ ID NO: 15282 - DNA, 25 bp, Mus musculus
cagcttgagtgcctaaagcaatagg

SEQ ID NO: 15283 - DNA, 25 bp, Mus musculus
cagcttgatgaagggtggctccaag

SEQ ID NO: 15284 - DNA, 25 bp, Mus musculus
cagcttgatgacgaaactctttttc

SEQ ID NO: 15285 - DNA, 25 bp, Mus musculus
cagcttgctgcagaaaggcggctcc

SEQ ID NO: 15286 - DNA, 25 bp, Mus musculus
cagcttggaatcagagctggacacg

SEQ ID NO: 15287 - DNA, 25 bp, Mus musculus
cagcttggagacttggacacgggtc

SEQ ID NO: 15288 - DNA, 25 bp, Mus musculus
cagcttggcctgctacttcacgatg

SEQ ID NO: 15289 - DNA, 25 bp, Mus musculus
cagcttgggctgcttattatgctca

SEQ ID NO: 15290 - DNA, 25 bp, Mus musculus
cagcttgggttatgatattggcaac

SEQ ID NO: 15291 - DNA, 25 bp, Mus musculus
cagcttggtgagatccgggctgacc

SEQ ID NO: 15292 - DNA, 25 bp, Mus musculus
cagctttcctggaatgctgcacagg

SEQ ID NO: 15293 - DNA, 25 bp, Mus musculus
cagctttgactatgattactaccaa

SEQ ID NO: 15294 - DNA, 25 bp, Mus musculus
cagctttgacttcgtaagcaaggag

SEQ ID NO: 15295 - DNA, 25 bp, Mus musculus
cagctttgagctctacttggcccta

SEQ ID NO: 15296 - DNA, 25 bp, Mus musculus
cagctttgaggccatcaactcacag

SEQ ID NO: 15297 - DNA, 25 bp, Mus musculus
cagctttgattaaagatggcttcct

SEQ ID NO: 15298 - DNA, 25 bp, Mus musculus
cagctttgcggtttgtccattctca

SEQ ID NO: 15299 - DNA, 25 bp, Mus musculus
cagctttggcctgagtgatctctat

SEQ ID NO: 15300 - DNA, 25 bp, Mus musculus
cagctttggctatagagcgaggtcc

SEQ ID NO: 15301 - DNA, 25 bp, Mus musculus
cagctttgtgtctggcggtggtaca

SEQ ID NO: 15302 - DNA, 25 bp, Mus musculus
cagcttttacgggagaaaactcacg

SEQ ID NO: 15303 - DNA, 25 bp, Mus musculus
cagcttttttaaaggctgcagaaaa

SEQ ID NO: 15304 - DNA, 25 bp, Mus musculus
cagcttttttgacctggatcccaag

SEQ ID NO: 15305 - DNA, 25 bp, Mus musculus
caggaaaaacatgccaaaaactgca

SEQ ID NO: 15306 - DNA, 25 bp, Mus musculus
caggaaaacttgtacgagaggccca

SEQ ID NO: 15307 - DNA, 25 bp, Mus musculus
caggaaaagcaagaacaagttgaga

SEQ ID NO: 15308 - DNA, 25 bp, Mus musculus
caggaaaaggtgaagatctgataag

SEQ ID NO: 15309 - DNA, 25 bp, Mus musculus
caggaaacaatgtttttggacacag

SEQ ID NO: 15310 - DNA, 25 bp, Mus musculus
caggaaaccagaagccctggtgatt

SEQ ID NO: 15311 - DNA, 25 bp, Mus musculus
caggaaactcttacagaatttagtc

SEQ ID NO: 15312 - DNA, 25 bp, Mus musculus
caggaaacttcgcagtgagccacca

SEQ ID NO: 15313 - DNA, 25 bp, Mus musculus
caggaaacttgaagataatatggtc

SEQ ID NO: 15314 - DNA, 25 bp, Mus musculus
caggaaatcctggtgacacactggc

SEQ ID NO: 15315 - DNA, 25 bp, Mus musculus
caggaaatgcactcggagaagatga

SEQ ID NO: 15316 - DNA, 25 bp, Mus musculus
caggaaatgcctgagccaagattca

SEQ ID NO: 15317 - DNA, 25 bp, Mus musculus
caggaaatgtttcaaatctccccaa

SEQ ID NO: 15318 - DNA, 25 bp, Mus musculus
caggaaatgtttgaaatctccccaa

SEQ ID NO: 15319 - DNA, 25 bp, Mus musculus
caggaacaactttgacacggaagag

SEQ ID NO: 15320 - DNA, 25 bp, Mus musculus
caggaacagctccttgagaacatca

SEQ ID NO: 15321 - DNA, 25 bp, Mus musculus
caggaacagctgactcattagtaga

SEQ ID NO: 15322 - DNA, 25 bp, Mus musculus
caggaacaggtcagcctggtggact

SEQ ID NO: 15323 - DNA, 25 bp, Mus musculus
caggaacagtttactccaaccccag

SEQ ID NO: 15324 - DNA, 25 bp, Mus musculus
caggaacatcactgtgtttgtccca

SEQ ID NO: 15325 - DNA, 25 bp, Mus musculus
caggaaccaatctgtctctccagtt

SEQ ID NO: 15326 - DNA, 25 bp, Mus musculus
caggaaccctgctatctgctgagaa

SEQ ID NO: 15327 - DNA, 25 bp, Mus musculus
caggaaccctgtgagctggagaagc

SEQ ID NO: 15328 - DNA, 25 bp, Mus musculus
caggaacgaaaaatagcagcagaaa

SEQ ID NO: 15329 - DNA, 25 bp, Mus musculus
caggaactgctaatcaaccatggga

SEQ ID NO: 15330 - DNA, 25 bp, Mus musculus
caggaacttcgtgcagtatgcctgc

SEQ ID NO: 15331 - DNA, 25 bp, Mus musculus
caggaagacatcacagaagcctgtc

SEQ ID NO: 15332 - DNA, 25 bp, Mus musculus
caggaagacctgttggagaattcaa

SEQ ID NO: 15333 - DNA, 25 bp, Mus musculus
caggaagatgcattagcacaacagg

SEQ ID NO: 15334 - DNA, 25 bp, Mus musculus
caggaagatggaaagactggcagca

SEQ ID NO: 15335 - DNA, 25 bp, Mus musculus
caggaagattccttgaacagacaaa

SEQ ID NO: 15336 - DNA, 25 bp, Mus musculus
caggaagattgaaaacatgtgatat

SEQ ID NO: 15337 - DNA, 25 bp, Mus musculus
caggaagcagctgccaactggcact

SEQ ID NO: 15338 - DNA, 25 bp, Mus musculus
caggaagccactttgcattgcagga

SEQ ID NO: 15339 - DNA, 25 bp, Mus musculus
caggaagcctggatgtactacaagc

SEQ ID NO: 15340 - DNA, 25 bp, Mus musculus
caggaagctgatagattgaaaggac

SEQ ID NO: 15341 - DNA, 25 bp, Mus musculus
caggaaggagccaaagtctgcctga

SEQ ID NO: 15342 - DNA, 25 bp, Mus musculus
caggaaggagtttgagacactctgc

SEQ ID NO: 15343 - DNA, 25 bp, Mus musculus
caggaaggcgctcttgactctgctg

SEQ ID NO: 15344 - DNA, 25 bp, Mus musculus
caggaaggctattgcagagaggcat

SEQ ID NO: 15345 - DNA, 25 bp, Mus musculus
caggaaggtaacgttctttcagcca

SEQ ID NO: 15346 - DNA, 25 bp, Mus musculus
caggaaggtgactctgattctcata

SEQ ID NO: 15347 - DNA, 25 bp, Mus musculus
caggaagtactggacaaggatggat

SEQ ID NO: 15348 - DNA, 25 bp, Mus musculus
caggaagtctttaatgagctacctt

SEQ ID NO: 15349 - DNA, 25 bp, Mus musculus
caggaagtgaagctcattcaatgcc

SEQ ID NO: 15350 - DNA, 25 bp, Mus musculus
caggaagttctggacatgaggaaca

SEQ ID NO: 15351 - DNA, 25 bp, Mus musculus
caggaataaaaaggacgtttcagtg

SEQ ID NO: 15352 - DNA, 25 bp, Mus musculus
caggaataagagagggcaggtggtg

SEQ ID NO: 15353 - DNA, 25 bp, Mus musculus
caggaatacctctactgacagccaa

SEQ ID NO: 15354 - DNA, 25 bp, Mus musculus
caggaatcaagaaactcagccaggt

SEQ ID NO: 15355 - DNA, 25 bp, Mus musculus
caggaatcaagatactcagccaggt

SEQ ID NO: 15356 - DNA, 25 bp, Mus musculus
caggaatcagatacaaaggagacca

SEQ ID NO: 15357 - DNA, 25 bp, Mus musculus
caggaatgagcgagatgtgctcaga

SEQ ID NO: 15358 - DNA, 25 bp, Mus musculus
caggaatgctgccaaggtcctacaa

SEQ ID NO: 15359 - DNA, 25 bp, Mus musculus
caggaatggagctacctggtgactc

SEQ ID NO: 15360 - DNA, 25 bp, Mus musculus
caggaatgtcttccttaagtgggaa

SEQ ID NO: 15361 - DNA, 25 bp, Mus musculus
caggaatgtgaggtgcaggagaaca

SEQ ID NO: 15362 - DNA, 25 bp, Mus musculus
caggaattactacgtccgggctgcc

SEQ ID NO: 15363 - DNA, 25 bp, Mus musculus
caggaattcaaagagaagggctctg

SEQ ID NO: 15364 - DNA, 25 bp, Mus musculus
caggaattcacactttcaggaaccc

SEQ ID NO: 15365 - DNA, 25 bp, Mus musculus
caggaattcactgtagagacgagta

SEQ ID NO: 15366 - DNA, 25 bp, Mus musculus
caggaattgcttctctgctccaggc

SEQ ID NO: 15367 - DNA, 25 bp, Mus musculus
caggaattggaactccgttctctgg

SEQ ID NO: 15368 - DNA, 25 bp, Mus musculus
caggacaaatagaggcccaggcagg

SEQ ID NO: 15369 - DNA, 25 bp, Mus musculus
caggacacctggcatttctgctcac

SEQ ID NO: 15370 - DNA, 25 bp, Mus musculus
caggacagacaatacaagtggttta

SEQ ID NO: 15371 - DNA, 25 bp, Mus musculus
caggacagatgcaatcagtgaagaa

SEQ ID NO: 15372 - DNA, 25 bp, Mus musculus
caggacagcagtgcgtgccagcagt

SEQ ID NO: 15373 - DNA, 25 bp, Mus musculus
caggacagcggcacaggaagtgatc

SEQ ID NO: 15374 - DNA, 25 bp, Mus musculus
caggacaggtacttttccctgggct

SEQ ID NO: 15375 - DNA, 25 bp, Mus musculus
caggacagtgtcacccggctgttga

SEQ ID NO: 15376 - DNA, 25 bp, Mus musculus
caggacatgactcaacggtgcacag

SEQ ID NO: 15377 - DNA, 25 bp, Mus musculus
caggaccagctacttcagggctctg

SEQ ID NO: 15378 - DNA, 25 bp, Mus musculus
caggaccagctccaagtagagaggc

SEQ ID NO: 15379 - DNA, 25 bp, Mus musculus
caggaccatggcttcttcccatcag

SEQ ID NO: 15380 - DNA, 25 bp, Mus musculus
caggacccactgcacttagtaggcg

SEQ ID NO: 15381 - DNA, 25 bp, Mus musculus
caggacccactggacttagtaggcg

SEQ ID NO: 15382 - DNA, 25 bp, Mus musculus
caggacccggcaactggaggaacct

SEQ ID NO: 15383 - DNA, 25 bp, Mus musculus
caggaccctggctgttacccagaga

SEQ ID NO: 15384 - DNA, 25 bp, Mus musculus
caggacccttctgggaaggccttgt

SEQ ID NO: 15385 - DNA, 25 bp, Mus musculus
caggaccgggatgtgcctgtccaga

SEQ ID NO: 15386 - DNA, 25 bp, Mus musculus
caggacctaggaaacgccagtcttc

SEQ ID NO: 15387 - DNA, 25 bp, Mus musculus
caggacctccctttgcaaatgtaga

SEQ ID NO: 15388 - DNA, 25 bp, Mus musculus
caggacctggccaccttaaaacatg

SEQ ID NO: 15389 - DNA, 25 bp, Mus musculus
caggaccttcagatagaagtgaagg

SEQ ID NO: 15390 - DNA, 25 bp, Mus musculus
caggacgatgtgctcatctccttcc

SEQ ID NO: 15391 - DNA, 25 bp, Mus musculus
caggacggacttcgcttttggacaa

SEQ ID NO: 15392 - DNA, 25 bp, Mus musculus
caggacggacttggcttttggacaa

SEQ ID NO: 15393 - DNA, 25 bp, Mus musculus
caggacggcgactgtaaggtgtccc

SEQ ID NO: 15394 - DNA, 25 bp, Mus musculus
caggactacatcaacctggatgaaa

SEQ ID NO: 15395 - DNA, 25 bp, Mus musculus
caggactcgctgaaggagtttgtgc

SEQ ID NO: 15396 - DNA, 25 bp, Mus musculus
caggactgcacgcacacgtgaggaa

SEQ ID NO: 15397 - DNA, 25 bp, Mus musculus
caggactggaaatccgagaaatcta

SEQ ID NO: 15398 - DNA, 25 bp, Mus musculus
caggactggctcaatggcaaggagt

SEQ ID NO: 15399 - DNA, 25 bp, Mus musculus
caggactgggccagttactgaagag

SEQ ID NO: 15400 - DNA, 25 bp, Mus musculus
caggacttcagcaatgtcttgccga

SEQ ID NO: 15401 - DNA, 25 bp, Mus musculus
caggacttcatggacgaggttttac

SEQ ID NO: 15402 - DNA, 25 bp, Mus musculus
caggacttcgagtacatctggcaga

SEQ ID NO: 15403 - DNA, 25 bp, Mus musculus
caggacttgagtgtgatccagccaa

SEQ ID NO: 15404 - DNA, 25 bp, Mus musculus
caggactttgatgtggctaatgaca

SEQ ID NO: 15405 - DNA, 25 bp, Mus musculus
caggagaaactggtccacgatgtat

SEQ ID NO: 15406 - DNA, 25 bp, Mus musculus
caggagaaaggcaacagcgagctct

SEQ ID NO: 15407 - DNA, 25 bp, Mus musculus
caggagaacagatcagtggaggaca

SEQ ID NO: 15408 - DNA, 25 bp, Mus musculus
caggagaaccacctggaagtcgtca

SEQ ID NO: 15409 - DNA, 25 bp, Mus musculus
caggagaaggcacagatggaattac

SEQ ID NO: 15410 - DNA, 25 bp, Mus musculus
caggagaatctcagcaggtgacagg

SEQ ID NO: 15411 - DNA, 25 bp, Mus musculus
caggagaatctggacaatgacacgg

SEQ ID NO: 15412 - DNA, 25 bp, Mus musculus
caggagacaatatgggacatgtgat

SEQ ID NO: 15413 - DNA, 25 bp, Mus musculus
caggagaccagattcctaagtactg

SEQ ID NO: 15414 - DNA, 25 bp, Mus musculus
caggagaccaggcagctgcgctcct

SEQ ID NO: 15415 - DNA, 25 bp, Mus musculus
caggagagagatgttgagagaccca

SEQ ID NO: 15416 - DNA, 25 bp, Mus musculus
caggagagatctgctcgacaggact

SEQ ID NO: 15417 - DNA, 25 bp, Mus musculus
caggagagccaacacactggagagc

SEQ ID NO: 15418 - DNA, 25 bp, Mus musculus
caggagagccattcttcttacagga

SEQ ID NO: 15419 - DNA, 25 bp, Mus musculus
caggagaggcccgtgtctggaataa

SEQ ID NO: 15420 - DNA, 25 bp, Mus musculus
caggagatccagtctcacatgggac

SEQ ID NO: 15421 - DNA, 25 bp, Mus musculus
caggagatgcctaccccgagggtgt

SEQ ID NO: 15422 - DNA, 25 bp, Mus musculus
caggagattgtactcaagacagcag

SEQ ID NO: 15423 - DNA, 25 bp, Mus musculus
caggagcaccaactcaggcagcttg

SEQ ID NO: 15424 - DNA, 25 bp, Mus musculus
caggagcacggttatactgaagatg

SEQ ID NO: 15425 - DNA, 25 bp, Mus musculus
caggagcagatccaaactcggcagc

SEQ ID NO: 15426 - DNA, 25 bp, Mus musculus
caggagcagatgaacccaaaggaga

SEQ ID NO: 15427 - DNA, 25 bp, Mus musculus
caggagccattggtccatgcgtgtc

SEQ ID NO: 15428 - DNA, 25 bp, Mus musculus
caggagccgcattgaccaagcccag

SEQ ID NO: 15429 - DNA, 25 bp, Mus musculus
caggagcctcgccttgtgctggtct

SEQ ID NO: 15430 - DNA, 25 bp, Mus musculus
caggagcctctaaaggctgggcctt

SEQ ID NO: 15431 - DNA, 25 bp, Mus musculus
caggagcctgcaggacttggacatg

SEQ ID NO: 15432 - DNA, 25 bp, Mus musculus
caggagccttggagacggtacatta

SEQ ID NO: 15433 - DNA, 25 bp, Mus musculus
caggagcgatccctcactggatgac

SEQ ID NO: 15434 - DNA, 25 bp, Mus musculus
caggagcgtaatgtccaggtgttcc

SEQ ID NO: 15435 - DNA, 25 bp, Mus musculus
caggagctaagtgggcaattaaaaa

SEQ ID NO: 15436 - DNA, 25 bp, Mus musculus
caggagctcgtgtcctctgcaggtg

SEQ ID NO: 15437 - DNA, 25 bp, Mus musculus
caggagctgaccagcctccaacggg

SEQ ID NO: 15438 - DNA, 25 bp, Mus musculus
caggagctgacctgcctccaacggg

SEQ ID NO: 15439 - DNA, 25 bp, Mus musculus
caggagctgatggaccttgggctca

SEQ ID NO: 15440 - DNA, 25 bp, Mus musculus
caggagctggacagattcgccaatc

SEQ ID NO: 15441 - DNA, 25 bp, Mus musculus
caggagctgtccctttaacaaggag

SEQ ID NO: 15442 - DNA, 25 bp, Mus musculus
caggagcttaactgcctcttgcagc

SEQ ID NO: 15443 - DNA, 25 bp, Mus musculus
caggaggaaatcctttatatgttgg

SEQ ID NO: 15444 - DNA, 25 bp, Mus musculus
caggaggacagagaccgctgataag

SEQ ID NO: 15445 - DNA, 25 bp, Mus musculus
caggaggacctactgcaagtatagg

SEQ ID NO: 15446 - DNA, 25 bp, Mus musculus
caggaggacttcaagacgacagttc

SEQ ID NO: 15447 - DNA, 25 bp, Mus musculus
caggaggagctcagaaaggcgcaaa

SEQ ID NO: 15448 - DNA, 25 bp, Mus musculus
caggaggaggacaagaaagtgatct

SEQ ID NO: 15449 - DNA, 25 bp, Mus musculus
caggaggaggactagaaagtgatct

SEQ ID NO: 15450 - DNA, 25 bp, Mus musculus
caggaggaggacttccgtttgcaga

SEQ ID NO: 15451 - DNA, 25 bp, Mus musculus
caggaggataagaaggcaaacgaga

SEQ ID NO: 15452 - DNA, 25 bp, Mus musculus
caggaggcagccaggatttaataaa

SEQ ID NO: 15453 - DNA, 25 bp, Mus musculus
caggaggcagctcaagaccttagcc

SEQ ID NO: 15454 - DNA, 25 bp, Mus musculus
caggaggcagtagctaaggatccag

SEQ ID NO: 15455 - DNA, 25 bp, Mus musculus
caggaggccaatggaagcacagcgt

SEQ ID NO: 15456 - DNA, 25 bp, Mus musculus
caggagggaagctcctaggcctacc

SEQ ID NO: 15457 - DNA, 25 bp, Mus musculus
caggagggtatgacggccagtatta

SEQ ID NO: 15458 - DNA, 25 bp, Mus musculus
caggagggtgccagactacagcaga

SEQ ID NO: 15459 - DNA, 25 bp, Mus musculus
caggaggtatacaacctaattcgtt

SEQ ID NO: 15460 - DNA, 25 bp, Mus musculus
caggaggtatactacctaattcgtt

SEQ ID NO: 15461 - DNA, 25 bp, Mus musculus
caggaggtctgaacaccggaaagcg

SEQ ID NO: 15462 - DNA, 25 bp, Mus musculus
caggaggtgatgaactccaagctgg

SEQ ID NO: 15463 - DNA, 25 bp, Mus musculus
caggagtagatgatttgggaacaac

SEQ ID NO: 15464 - DNA, 25 bp, Mus musculus
caggagtagctcttctggatcagat

SEQ ID NO: 15465 - DNA, 25 bp, Mus musculus
caggagtatgctgccaagattatca

SEQ ID NO: 15466 - DNA, 25 bp, Mus musculus
caggagtcccctctttgacatcagg

SEQ ID NO: 15467 - DNA, 25 bp, Mus musculus
caggagtccctcaaggagtactttc

SEQ ID NO: 15468 - DNA, 25 bp, Mus musculus
caggagtccgagcacagccaggacc

SEQ ID NO: 15469 - DNA, 25 bp, Mus musculus
caggagtccttcaccgcggtgcagg

SEQ ID NO: 15470 - DNA, 25 bp, Mus musculus
caggagtctgctgtccatttgaaaa

SEQ ID NO: 15471 - DNA, 25 bp, Mus musculus
caggagtgaataagcactgtgccag

SEQ ID NO: 15472 - DNA, 25 bp, Mus musculus
caggagttaacctttgctagaaaca

SEQ ID NO: 15473 - DNA, 25 bp, Mus musculus
caggagttgctttctacagaagaga

SEQ ID NO: 15474 - DNA, 25 bp, Mus musculus
caggagttggaagaactcacagcta

SEQ ID NO: 15475 - DNA, 25 bp, Mus musculus
caggagtttgctgctgatgtacggc

SEQ ID NO: 15476 - DNA, 25 bp, Mus musculus
caggatacaaatcaggttctcttca

SEQ ID NO: 15477 - DNA, 25 bp, Mus musculus
caggatagaaaaacaagggctacag

SEQ ID NO: 15478 - DNA, 25 bp, Mus musculus
caggatagcacacctggacctaaag

SEQ ID NO: 15479 - DNA, 25 bp, Mus musculus
caggatagcttccttcatgtgaagg

SEQ ID NO: 15480 - DNA, 25 bp, Mus musculus
caggatatatttggctggcagctgc

SEQ ID NO: 15481 - DNA, 25 bp, Mus musculus
caggatatggagatccacaaggcca

SEQ ID NO: 15482 - DNA, 25 bp, Mus musculus
caggatatgtggtaacccggtggta

SEQ ID NO: 15483 - DNA, 25 bp, Mus musculus
caggatattgagaccctacatggct

SEQ ID NO: 15484 - DNA, 25 bp, Mus musculus
caggatcagagtcgtttatggatta

SEQ ID NO: 15485 - DNA, 25 bp, Mus musculus
caggatcagataaacataggcaatg

SEQ ID NO: 15486 - DNA, 25 bp, Mus musculus
caggatcagcttgatgacgaaactc

SEQ ID NO: 15487 - DNA, 25 bp, Mus musculus
caggatcccgaataagctgcttcag

SEQ ID NO: 15488 - DNA, 25 bp, Mus musculus
caggatccgagggaagcacgtctgt

SEQ ID NO: 15489 - DNA, 25 bp, Mus musculus
caggatccgcaatccacgtgggcta

SEQ ID NO: 15490 - DNA, 25 bp, Mus musculus
caggatctccagaaagactttgcac

SEQ ID NO: 15491 - DNA, 25 bp, Mus musculus
caggatctgactctcatctgtcggc

SEQ ID NO: 15492 - DNA, 25 bp, Mus musculus
caggatgaagaggagaccccacatg

SEQ ID NO: 15493 - DNA, 25 bp, Mus musculus
caggatgacctcctcggactcgatg

SEQ ID NO: 15494 - DNA, 25 bp, Mus musculus
caggatgacctcgtcggactcgatg

SEQ ID NO: 15495 - DNA, 25 bp, Mus musculus
caggatgcctggtccatgggcacaa

SEQ ID NO: 15496 - DNA, 25 bp, Mus musculus
caggatgctatgatgtactgcaagt

SEQ ID NO: 15497 - DNA, 25 bp, Mus musculus
caggatggaaacaacctttgggcct

SEQ ID NO: 15498 - DNA, 25 bp, Mus musculus
caggatggacgccactcatgagagt

SEQ ID NO: 15499 - DNA, 25 bp, Mus musculus
caggatggatctcgatgtggttaac

SEQ ID NO: 15500 - DNA, 25 bp, Mus musculus
caggatggattttatggtgcagaca

SEQ ID NO: 15501 - DNA, 25 bp, Mus musculus
caggatggcagcgtcgactttggca

SEQ ID NO: 15502 - DNA, 25 bp, Mus musculus
caggatggcaggcatcatctgaccc

SEQ ID NO: 15503 - DNA, 25 bp, Mus musculus
caggatggtgtctctcgaagattca

SEQ ID NO: 15504 - DNA, 25 bp, Mus musculus
caggattatgtcaatgggactgatc

SEQ ID NO: 15505 - DNA, 25 bp, Mus musculus
caggattctcagatgacccctttaa

SEQ ID NO: 15506 - DNA, 25 bp, Mus musculus
caggattgctgaatggtctggccac

SEQ ID NO: 15507 - DNA, 25 bp, Mus musculus
caggatttccacaggaggtggagaa

SEQ ID NO: 15508 - DNA, 25 bp, Mus musculus
caggatttggcactcctgcccagta

SEQ ID NO: 15509 - DNA, 25 bp, Mus musculus
caggattttgatgcatgcagggcaa

SEQ ID NO: 15510 - DNA, 25 bp, Mus musculus
caggatttttattccagaaggttgg

SEQ ID NO: 15511 - DNA, 25 bp, Mus musculus
caggcaagctgtctcgtcatttaag

SEQ ID NO: 15512 - DNA, 25 bp, Mus musculus
caggcaatatgggacggatatctac

SEQ ID NO: 15513 - DNA, 25 bp, Mus musculus
caggcaatgaatttaacaatcacaa

SEQ ID NO: 15514 - DNA, 25 bp, Mus musculus
caggcacatatggaagatctcgaaa

SEQ ID NO: 15515 - DNA, 25 bp, Mus musculus
caggcacatggaatctttgagtcag

SEQ ID NO: 15516 - DNA, 25 bp, Mus musculus
caggcaccactgtgtacagacagtt

SEQ ID NO: 15517 - DNA, 25 bp, Mus musculus
caggcacccacaaggaacatgactt

SEQ ID NO: 15518 - DNA, 25 bp, Mus musculus
caggcaccggaagctgagaactcca

SEQ ID NO: 15519 - DNA, 25 bp, Mus musculus
caggcactaaagagagctagctgca

SEQ ID NO: 15520 - DNA, 25 bp, Mus musculus
caggcactgctcatagacttgagag

SEQ ID NO: 15521 - DNA, 25 bp, Mus musculus
caggcagacagtgagatgacaggat

SEQ ID NO: 15522 - DNA, 25 bp, Mus musculus
caggcagcagctgctatgagccgag

SEQ ID NO: 15523 - DNA, 25 bp, Mus musculus
caggcagcatcgtcttgaaggtgct

SEQ ID NO: 15524 - DNA, 25 bp, Mus musculus
caggcagcgacagtgcgagctttcc

SEQ ID NO: 15525 - DNA, 25 bp, Mus musculus
caggcagctgggaccacgtggtggg

SEQ ID NO: 15526 - DNA, 25 bp, Mus musculus
caggcaggaggatgcacccatgatt

SEQ ID NO: 15527 - DNA, 25 bp, Mus musculus
caggcagtagaatttatgtccacca

SEQ ID NO: 15528 - DNA, 25 bp, Mus musculus
caggcagtagatatgaggactccaa

SEQ ID NO: 15529 - DNA, 25 bp, Mus musculus
caggcagtatgtgtcacacagcgac

SEQ ID NO: 15530 - DNA, 25 bp, Mus musculus
caggcataaagctttacctagtgca

SEQ ID NO: 15531 - DNA, 25 bp, Mus musculus
caggcatctcctggatgggatccag

SEQ ID NO: 15532 - DNA, 25 bp, Mus musculus
caggcattagtttctcagttaaaaa

SEQ ID NO: 15533 - DNA, 25 bp, Mus musculus
caggcattcacacttctcttgaaag

SEQ ID NO: 15534 - DNA, 25 bp, Mus musculus
caggcattgacaattgttggaacac

SEQ ID NO: 15535 - DNA, 25 bp, Mus musculus
caggcattgtgtatgggaactttgg

SEQ ID NO: 15536 - DNA, 25 bp, Mus musculus
caggcatttcaactgtgcagaagta

SEQ ID NO: 15537 - DNA, 25 bp, Mus musculus
caggccaaccaaaccacattgtgta

SEQ ID NO: 15538 - DNA, 25 bp, Mus musculus
caggccaaccaatccacattgtgta

SEQ ID NO: 15539 - DNA, 25 bp, Mus musculus
caggccaagggcagcgtgaagcctc

SEQ ID NO: 15540 - DNA, 25 bp, Mus musculus
caggccaagtcaaggaagccgtgaa

SEQ ID NO: 15541 - DNA, 25 bp, Mus musculus
caggccaccatttctgaaatcaaga

SEQ ID NO: 15542 - DNA, 25 bp, Mus musculus
caggccagaaggctgtcgaaccctt

SEQ ID NO: 15543 - DNA, 25 bp, Mus musculus
caggccagaggtttggatgatcaca

SEQ ID NO: 15544 - DNA, 25 bp, Mus musculus
caggccagcctgtttctaaaaacat

SEQ ID NO: 15545 - DNA, 25 bp, Mus musculus
caggccaggtgttcacaggaagatc

SEQ ID NO: 15546 - DNA, 25 bp, Mus musculus
caggccatgctgagtgtggacgact

SEQ ID NO: 15547 - DNA, 25 bp, Mus musculus
caggcccagcggactgttttgatac

SEQ ID NO: 15548 - DNA, 25 bp, Mus musculus
caggcccagggcagtgacttcagtg

SEQ ID NO: 15549 - DNA, 25 bp, Mus musculus
caggccccgctctgggtagctttgc

SEQ ID NO: 15550 - DNA, 25 bp, Mus musculus
caggcccctaagcaagacatttttt

SEQ ID NO: 15551 - DNA, 25 bp, Mus musculus
caggcccctgctgaaggacttctta

SEQ ID NO: 15552 - DNA, 25 bp, Mus musculus
caggccctataagccaatgaggatt

SEQ ID NO: 15553 - DNA, 25 bp, Mus musculus
caggccctgggctggaacatttacg

SEQ ID NO: 15554 - DNA, 25 bp, Mus musculus
caggccctggtagccggaagctgat

SEQ ID NO: 15555 - DNA, 25 bp, Mus musculus
caggccctggtttcattaggaagga

SEQ ID NO: 15556 - DNA, 25 bp, Mus musculus
caggccgcgtgctgagcctgtccgt

SEQ ID NO: 15557 - DNA, 25 bp, Mus musculus
caggccggtccaagatcacattcct

SEQ ID NO: 15558 - DNA, 25 bp, Mus musculus
caggcctcaacctctcatacagtga

SEQ ID NO: 15559 - DNA, 25 bp, Mus musculus
caggcctcaggcacattatagtcaa

SEQ ID NO: 15560 - DNA, 25 bp, Mus musculus
caggcctcagtgtccaaggctgctt

SEQ ID NO: 15561 - DNA, 25 bp, Mus musculus
caggcctccaagagagcacaaggaa

SEQ ID NO: 15562 - DNA, 25 bp, Mus musculus
caggcctggctgatggcagcctcac

SEQ ID NO: 15563 - DNA, 25 bp, Mus musculus
caggcctgtctggtcttgagattgg

SEQ ID NO: 15564 - DNA, 25 bp, Mus musculus
caggccttcaaccactatctcagtg

SEQ ID NO: 15565 - DNA, 25 bp, Mus musculus
caggccttctacagggccagtgaag

SEQ ID NO: 15566 - DNA, 25 bp, Mus musculus
caggccttgacctttgccaagaaac

SEQ ID NO: 15567 - DNA, 25 bp, Mus musculus
caggcgaataccactgtgtatatca

SEQ ID NO: 15568 - DNA, 25 bp, Mus musculus
caggcgacactgttgaacttctgag

SEQ ID NO: 15569 - DNA, 25 bp, Mus musculus
caggcgaggtggacatcaaaatagc

SEQ ID NO: 15570 - DNA, 25 bp, Mus musculus
caggcgatgtcttcagcagctgcat

SEQ ID NO: 15571 - DNA, 25 bp, Mus musculus
caggcgccaaagtggccactgcggc

SEQ ID NO: 15572 - DNA, 25 bp, Mus musculus
caggcgcttaaacggtggagtagag

SEQ ID NO: 15573 - DNA, 25 bp, Mus musculus
caggcgcttaaagggtggagtagag

SEQ ID NO: 15574 - DNA, 25 bp, Mus musculus
caggcggatcacagtcgctctggct

SEQ ID NO: 15575 - DNA, 25 bp, Mus musculus
caggcggctatgacagttcatctac

SEQ ID NO: 15576 - DNA, 25 bp, Mus musculus
caggcgtcggtttaacttagaggag

SEQ ID NO: 15577 - DNA, 25 bp, Mus musculus
caggcgtctgcaccaatactgtagg

SEQ ID NO: 15578 - DNA, 25 bp, Mus musculus
caggcgtctgcagcaatactgtagg

SEQ ID NO: 15579 - DNA, 25 bp, Mus musculus
caggcgttatcgttccggatccagg

SEQ ID NO: 15580 - DNA, 25 bp, Mus musculus
caggctaaaaagagagcgttctatg

SEQ ID NO: 15581 - DNA, 25 bp, Mus musculus
caggctacacactggacactcaaag

SEQ ID NO: 15582 - DNA, 25 bp, Mus musculus
caggctacactggatatttttgcga

SEQ ID NO: 15583 - DNA, 25 bp, Mus musculus
caggctacttaatatccagagtgga

SEQ ID NO: 15584 - DNA, 25 bp, Mus musculus
caggctagctgatgaacatgttctc

SEQ ID NO: 15585 - DNA, 25 bp, Mus musculus
caggctagtcccacaggtctatttt

SEQ ID NO: 15586 - DNA, 25 bp, Mus musculus
caggctatccctgtgcggcagcagg

SEQ ID NO: 15587 - DNA, 25 bp, Mus musculus
caggctatggatgactgcgagttcc

SEQ ID NO: 15588 - DNA, 25 bp, Mus musculus
caggctatgtcctcacagatggtga

SEQ ID NO: 15589 - DNA, 25 bp, Mus musculus
caggctatgtttgcccgaggaattg

SEQ ID NO: 15590 - DNA, 25 bp, Mus musculus
caggctcaaagctctaaggacattc

SEQ ID NO: 15591 - DNA, 25 bp, Mus musculus
caggctcatcttgtagctcaaacta

SEQ ID NO: 15592 - DNA, 25 bp, Mus musculus
caggctcattgctgctgagcgagag

SEQ ID NO: 15593 - DNA, 25 bp, Mus musculus
caggctccaagtccacaggagtgtg

SEQ ID NO: 15594 - DNA, 25 bp, Mus musculus
caggctccaagtgcacaggagtgtg

SEQ ID NO: 15595 - DNA, 25 bp, Mus musculus
caggctccagagtgacaacgagtac

SEQ ID NO: 15596 - DNA, 25 bp, Mus musculus
caggctccatcaggtgcaaaggata

SEQ ID NO: 15597 - DNA, 25 bp, Mus musculus
caggctcccgggatcggaatgtcaa

SEQ ID NO: 15598 - DNA, 25 bp, Mus musculus
caggctccctgggtgtcatggtgca

SEQ ID NO: 15599 - DNA, 25 bp, Mus musculus
caggctcgggttgatgtgctagaac

SEQ ID NO: 15600 - DNA, 25 bp, Mus musculus
caggctctagccaacatgcagttac

SEQ ID NO: 15601 - DNA, 25 bp, Mus musculus
caggctctcttggaaggacctctaa

SEQ ID NO: 15602 - DNA, 25 bp, Mus musculus
caggctctggcttgggcaagcagct

SEQ ID NO: 15603 - DNA, 25 bp, Mus musculus
caggctgaaagtgtaccagggctta

SEQ ID NO: 15604 - DNA, 25 bp, Mus musculus
caggctgaagcagatcgagaaggaa

SEQ ID NO: 15605 - DNA, 25 bp, Mus musculus
caggctgaagctgttccgacattac

SEQ ID NO: 15606 - DNA, 25 bp, Mus musculus
caggctgaccagtacgaccttagtt

SEQ ID NO: 15607 - DNA, 25 bp, Mus musculus
caggctgacttctagagtctgtgaa

SEQ ID NO: 15608 - DNA, 25 bp, Mus musculus
caggctgcaaggagcaacagcgatg

SEQ ID NO: 15609 - DNA, 25 bp, Mus musculus
caggctgccttctccctgatggcag

SEQ ID NO: 15610 - DNA, 25 bp, Mus musculus
caggctgcgcaagagcaggctctgt

SEQ ID NO: 15611 - DNA, 25 bp, Mus musculus
caggctgcgtccagtctctgagctc

SEQ ID NO: 15612 - DNA, 25 bp, Mus musculus
caggctgctgctcagtctttaaatg

SEQ ID NO: 15613 - DNA, 25 bp, Mus musculus
caggctggaaaagctgtggcacaag

SEQ ID NO: 15614 - DNA, 25 bp, Mus musculus
caggctggaactacgcaatcgggtg

SEQ ID NO: 15615 - DNA, 25 bp, Mus musculus
caggctgggctacttcagaaatgct

SEQ ID NO: 15616 - DNA, 25 bp, Mus musculus
caggctggttctgagaccacccgaa

SEQ ID NO: 15617 - DNA, 25 bp, Mus musculus
caggctgtaaacttcctggctgttt

SEQ ID NO: 15618 - DNA, 25 bp, Mus musculus
caggctgtactctggatcttgggac

SEQ ID NO: 15619 - DNA, 25 bp, Mus musculus
caggctgtcctgagactgatacaga

SEQ ID NO: 15620 - DNA, 25 bp, Mus musculus
caggctgtgatattgttattctggc

SEQ ID NO: 15621 - DNA, 25 bp, Mus musculus
caggctgtgcatgccgagctgtctc

SEQ ID NO: 15622 - DNA, 25 bp, Mus musculus
caggctgtgctgtatgccaaggctc

SEQ ID NO: 15623 - DNA, 25 bp, Mus musculus
caggctgtggattatctttgaatgc

SEQ ID NO: 15624 - DNA, 25 bp, Mus musculus
caggctgtgttcacgctgcctcagt

SEQ ID NO: 15625 - DNA, 25 bp, Mus musculus
caggctgtgttctcgctgcctcagt

SEQ ID NO: 15626 - DNA, 25 bp, Mus musculus
caggcttacgatttcccggccatca

SEQ ID NO: 15627 - DNA, 25 bp, Mus musculus
caggcttagagcctgcctctccaga

SEQ ID NO: 15628 - DNA, 25 bp, Mus musculus
caggcttatgcgtggctatgtcatg

SEQ ID NO: 15629 - DNA, 25 bp, Mus musculus
caggcttccacgaacgtccagaaga

SEQ ID NO: 15630 - DNA, 25 bp, Mus musculus
caggcttccacgtacgtccagaaga

SEQ ID NO: 15631 - DNA, 25 bp, Mus musculus
caggcttcctccaggccaagaggag

SEQ ID NO: 15632 - DNA, 25 bp, Mus musculus
caggcttctggctccttgagggtga

SEQ ID NO: 15633 - DNA, 25 bp, Mus musculus
caggcttcttgcaattctggaggct

SEQ ID NO: 15634 - DNA, 25 bp, Mus musculus
caggcttggtgagcaagactggcaa

SEQ ID NO: 15635 - DNA, 25 bp, Mus musculus
caggctttcttgtgtaacctgcatc

SEQ ID NO: 15636 - DNA, 25 bp, Mus musculus
caggctttgaaaccatcccatataa

SEQ ID NO: 15637 - DNA, 25 bp, Mus musculus
caggctttgaagaagagctttctgg

SEQ ID NO: 15638 - DNA, 25 bp, Mus musculus
caggctttgtcttgaatggctccat

SEQ ID NO: 15639 - DNA, 25 bp, Mus musculus
caggcttttcttacagctcctgggt

SEQ ID NO: 15640 - DNA, 25 bp, Mus musculus
cagggaaaaaacctccatgctgtgt

SEQ ID NO: 15641 - DNA, 25 bp, Mus musculus
cagggaaatttcatacgttcttgcc

SEQ ID NO: 15642 - DNA, 25 bp, Mus musculus
cagggaaatttcttacgttcttgcc

SEQ ID NO: 15643 - DNA, 25 bp, Mus musculus
cagggaacccacttctcttctcagg

SEQ ID NO: 15644 - DNA, 25 bp, Mus musculus
cagggaactcctgggtgcaagagct

SEQ ID NO: 15645 - DNA, 25 bp, Mus musculus
cagggaagctgttccctgcgctgcg

SEQ ID NO: 15646 - DNA, 25 bp, Mus musculus
cagggaaggaacaaagcattgatta

SEQ ID NO: 15647 - DNA, 25 bp, Mus musculus
cagggaaggttatcagaccgctacg

SEQ ID NO: 15648 - DNA, 25 bp, Mus musculus
cagggaagtcctacggcattatgga

SEQ ID NO: 15649 - DNA, 25 bp, Mus musculus
cagggaataacaaggagacagtgct

SEQ ID NO: 15650 - DNA, 25 bp, Mus musculus
cagggaatggaacaattatatacca

SEQ ID NO: 15651 - DNA, 25 bp, Mus musculus
cagggacaacggatcagcttgacaa

SEQ ID NO: 15652 - DNA, 25 bp, Mus musculus
cagggacaagaagttgttgcaagtg

SEQ ID NO: 15653 - DNA, 25 bp, Mus musculus
cagggacaataagaccatctcgttc

SEQ ID NO: 15654 - DNA, 25 bp, Mus musculus
cagggacagaacagctgacagagac

SEQ ID NO: 15655 - DNA, 25 bp, Mus musculus
cagggaccaccttgaacactatgga

SEQ ID NO: 15656 - DNA, 25 bp, Mus musculus
cagggaccatgccagaagtgcttct

SEQ ID NO: 15657 - DNA, 25 bp, Mus musculus
cagggacgtgcctacctcttcaact

SEQ ID NO: 15658 - DNA, 25 bp, Mus musculus
cagggacgttgtcaccctggtgaaa

SEQ ID NO: 15659 - DNA, 25 bp, Mus musculus
cagggacgttgtgaccctggtgaaa

SEQ ID NO: 15660 - DNA, 25 bp, Mus musculus
cagggactaagtccctccagggttc

SEQ ID NO: 15661 - DNA, 25 bp, Mus musculus
cagggactaagtgcctccagggttc

SEQ ID NO: 15662 - DNA, 25 bp, Mus musculus
cagggactatttttggaagccagat

SEQ ID NO: 15663 - DNA, 25 bp, Mus musculus
cagggactcgtgaaacagcaggatg

SEQ ID NO: 15664 - DNA, 25 bp, Mus musculus
cagggactgaagaacacctctgtct

SEQ ID NO: 15665 - DNA, 25 bp, Mus musculus
cagggactgcagtgctacgagtgct

SEQ ID NO: 15666 - DNA, 25 bp, Mus musculus
cagggactgtcacaacgtgtctgtg

SEQ ID NO: 15667 - DNA, 25 bp, Mus musculus
cagggagaagattgtcaagtacgag

SEQ ID NO: 15668 - DNA, 25 bp, Mus musculus
cagggagagtggagataattgtcaa

SEQ ID NO: 15669 - DNA, 25 bp, Mus musculus
cagggagagtggtgataattgtcaa

SEQ ID NO: 15670 - DNA, 25 bp, Mus musculus
cagggaggagcaatacagctggcta

SEQ ID NO: 15671 - DNA, 25 bp, Mus musculus
cagggaggatattagccagtatggc

SEQ ID NO: 15672 - DNA, 25 bp, Mus musculus
cagggagtgtctgagtcttctgtaa

SEQ ID NO: 15673 - DNA, 25 bp, Mus musculus
cagggagtgtgagagccccgaggtg

SEQ ID NO: 15674 - DNA, 25 bp, Mus musculus
cagggatactctcatgaacttggtc

SEQ ID NO: 15675 - DNA, 25 bp, Mus musculus
cagggatcaagtccagaggctccta

SEQ ID NO: 15676 - DNA, 25 bp, Mus musculus
cagggatccgagctgctcatgagcc

SEQ ID NO: 15677 - DNA, 25 bp, Mus musculus
cagggatccgaggtgctcatgagcc

SEQ ID NO: 15678 - DNA, 25 bp, Mus musculus
cagggatcgattgcctctgattctt

SEQ ID NO: 15679 - DNA, 25 bp, Mus musculus
cagggatcgtaggtggtctgattca

SEQ ID NO: 15680 - DNA, 25 bp, Mus musculus
cagggatggaccaagctcttgttgg

SEQ ID NO: 15681 - DNA, 25 bp, Mus musculus
cagggatgtctacagcagctgtgac

SEQ ID NO: 15682 - DNA, 25 bp, Mus musculus
cagggatgtgaaacctcacaatgtc

SEQ ID NO: 15683 - DNA, 25 bp, Mus musculus
cagggatgtgttaatgatgttgctt

SEQ ID NO: 15684 - DNA, 25 bp, Mus musculus
cagggattcccacatcaaagaaaag

SEQ ID NO: 15685 - DNA, 25 bp, Mus musculus
cagggattgcttcaactgtcgcttc

SEQ ID NO: 15686 - DNA, 25 bp, Mus musculus
cagggattggacacgctatggtaaa

SEQ ID NO: 15687 - DNA, 25 bp, Mus musculus
cagggattgtggttgtaagccttgc

SEQ ID NO: 15688 - DNA, 25 bp, Mus musculus
cagggcaacattgaagaggcagttc

SEQ ID NO: 15689 - DNA, 25 bp, Mus musculus
cagggcaactcctgacaagtgtgga

SEQ ID NO: 15690 - DNA, 25 bp, Mus musculus
cagggcaagcaagttggcccaggtc

SEQ ID NO: 15691 - DNA, 25 bp, Mus musculus
cagggcacagcggagtgaaaagcat

SEQ ID NO: 15692 - DNA, 25 bp, Mus musculus
cagggcaccaacatcctgtttgcct

SEQ ID NO: 15693 - DNA, 25 bp, Mus musculus
cagggcaccaacttcctgtttgcct

SEQ ID NO: 15694 - DNA, 25 bp, Mus musculus
cagggcacccctgttcagacagtga

SEQ ID NO: 15695 - DNA, 25 bp, Mus musculus
cagggcagctagtgagtcgcttgac

SEQ ID NO: 15696 - DNA, 25 bp, Mus musculus
cagggcagctggacaacatgaagat

SEQ ID NO: 15697 - DNA, 25 bp, Mus musculus
cagggcagggttagtgttgtcatca

SEQ ID NO: 15698 - DNA, 25 bp, Mus musculus
cagggcatgtcctttatagctgcag

SEQ ID NO: 15699 - DNA, 25 bp, Mus musculus
cagggccaacagagatgtgtgacca

SEQ ID NO: 15700 - DNA, 25 bp, Mus musculus
cagggccacacgcatatcatcaatg

SEQ ID NO: 15701 - DNA, 25 bp, Mus musculus
cagggccagaccaaagagaagatgc

SEQ ID NO: 15702 - DNA, 25 bp, Mus musculus
cagggccagagatgatcagagctct

SEQ ID NO: 15703 - DNA, 25 bp, Mus musculus
cagggccagatactccttcgcagtt

SEQ ID NO: 15704 - DNA, 25 bp, Mus musculus
cagggccagatagtccttcgcagtt

SEQ ID NO: 15705 - DNA, 25 bp, Mus musculus
cagggcctatggcaacctgggtaac

SEQ ID NO: 15706 - DNA, 25 bp, Mus musculus
cagggcctggacgaatcctgtgaag

SEQ ID NO: 15707 - DNA, 25 bp, Mus musculus
cagggcctggcttcatctgacactg

SEQ ID NO: 15708 - DNA, 25 bp, Mus musculus
cagggcgctttgcagtgttatactc

SEQ ID NO: 15709 - DNA, 25 bp, Mus musculus
cagggcggcaggtcaagctgtgggt

SEQ ID NO: 15710 - DNA, 25 bp, Mus musculus
cagggctcgccctgattggttgctc

SEQ ID NO: 15711 - DNA, 25 bp, Mus musculus
cagggctctctgcagaatcacagat

SEQ ID NO: 15712 - DNA, 25 bp, Mus musculus
cagggctctgagcacactgtgaaca

SEQ ID NO: 15713 - DNA, 25 bp, Mus musculus
cagggctgcatggagcaagccagtc

SEQ ID NO: 15714 - DNA, 25 bp, Mus musculus
cagggctggactacactgttgaaga

SEQ ID NO: 15715 - DNA, 25 bp, Mus musculus
cagggctgggtacgcaaaacttgaa

SEQ ID NO: 15716 - DNA, 25 bp, Mus musculus
cagggcttatattgtgtggctatcc

SEQ ID NO: 15717 - DNA, 25 bp, Mus musculus
cagggcttccagctggtcaatggca

SEQ ID NO: 15718 - DNA, 25 bp, Mus musculus
cagggcttccaggtggtcaatggca

SEQ ID NO: 15719 - DNA, 25 bp, Mus musculus
cagggcttccctggccatgcgtggt

SEQ ID NO: 15720 - DNA, 25 bp, Mus musculus
cagggcttgcgatgtaagacttgca

SEQ ID NO: 15721 - DNA, 25 bp, Mus musculus
cagggtactgctacgatttccgcaa

SEQ ID NO: 15722 - DNA, 25 bp, Mus musculus
cagggtactgcttcgatttccgcaa

SEQ ID NO: 15723 - DNA, 25 bp, Mus musculus
cagggtagttcagccaccagcatgt

SEQ ID NO: 15724 - DNA, 25 bp, Mus musculus
cagggtcaaagccatcagccaaaga

SEQ ID NO: 15725 - DNA, 25 bp, Mus musculus
cagggtcaacaagcagctgcatctg

SEQ ID NO: 15726 - DNA, 25 bp, Mus musculus
cagggtcagctgcaagaacatcaaa

SEQ ID NO: 15727 - DNA, 25 bp, Mus musculus
cagggtcatacaagatgagttttac

SEQ ID NO: 15728 - DNA, 25 bp, Mus musculus
cagggtcatccagagtttgctgttg

SEQ ID NO: 15729 - DNA, 25 bp, Mus musculus
cagggtcccttgcatctccgactgg

SEQ ID NO: 15730 - DNA, 25 bp, Mus musculus
cagggtcctttcatggcatgtaaca

SEQ ID NO: 15731 - DNA, 25 bp, Mus musculus
cagggtcctttcttggcatgtaaca

SEQ ID NO: 15732 - DNA, 25 bp, Mus musculus
cagggtcggagacctccgatgctaa

SEQ ID NO: 15733 - DNA, 25 bp, Mus musculus
cagggtctacatatcactcaacttt

SEQ ID NO: 15734 - DNA, 25 bp, Mus musculus
cagggtctacatttcactcaacttt

SEQ ID NO: 15735 - DNA, 25 bp, Mus musculus
cagggtctgagaggcatcactggca

SEQ ID NO: 15736 - DNA, 25 bp, Mus musculus
cagggtctttggactactaccaaca

SEQ ID NO: 15737 - DNA, 25 bp, Mus musculus
cagggtgacattaagcagcaaaatg

SEQ ID NO: 15738 - DNA, 25 bp, Mus musculus
cagggtgcaactcccgcctatggtg

SEQ ID NO: 15739 - DNA, 25 bp, Mus musculus
cagggtggacgtcattgtagccaac

SEQ ID NO: 15740 - DNA, 25 bp, Mus musculus
cagggtggacgtgattgtagccaac

SEQ ID NO: 15741 - DNA, 25 bp, Mus musculus
cagggtggcttcctacctggtgtcc

SEQ ID NO: 15742 - DNA, 25 bp, Mus musculus
cagggtgtctgtctccgctttggcc

SEQ ID NO: 15743 - DNA, 25 bp, Mus musculus
cagggtgtctgtgtccgctttggcc

SEQ ID NO: 15744 - DNA, 25 bp, Mus musculus
cagggttcccgcagcaatggatgcc

SEQ ID NO: 15745 - DNA, 25 bp, Mus musculus
cagggttcccgctgcaatggatgcc

SEQ ID NO: 15746 - DNA, 25 bp, Mus musculus
cagggttccggactgaatgcgaaaa

SEQ ID NO: 15747 - DNA, 25 bp, Mus musculus
cagggttgacgactctcaccaaaag

SEQ ID NO: 15748 - DNA, 25 bp, Mus musculus
caggtaaaccttgagctgcacatta

SEQ ID NO: 15749 - DNA, 25 bp, Mus musculus
caggtaaatgcattggagattactc

SEQ ID NO: 15750 - DNA, 25 bp, Mus musculus
caggtaagctgaggtggagactacc

SEQ ID NO: 15751 - DNA, 25 bp, Mus musculus
caggtacacagctgaaccagtttca

SEQ ID NO: 15752 - DNA, 25 bp, Mus musculus
caggtacagcacaggcagcgacagt

SEQ ID NO: 15753 - DNA, 25 bp, Mus musculus
caggtacagggtgacctactcgagc

SEQ ID NO: 15754 - DNA, 25 bp, Mus musculus
caggtaccatgaagctggagttggc

SEQ ID NO: 15755 - DNA, 25 bp, Mus musculus
caggtacctcctactcggataccat

SEQ ID NO: 15756 - DNA, 25 bp, Mus musculus
caggtacctccttctcggataccat

SEQ ID NO: 15757 - DNA, 25 bp, Mus musculus
caggtacctgacaatgatgagcagt

SEQ ID NO: 15758 - DNA, 25 bp, Mus musculus
caggtacctggagttgctcatggca

SEQ ID NO: 15759 - DNA, 25 bp, Mus musculus
caggtacggctgaaacaccggaagc

SEQ ID NO: 15760 - DNA, 25 bp, Mus musculus
caggtagcctttctccagtcagcta

SEQ ID NO: 15761 - DNA, 25 bp, Mus musculus
caggtagttgaatctgttggaaacc

SEQ ID NO: 15762 - DNA, 25 bp, Mus musculus
caggtatatggctgacatgattgcc

SEQ ID NO: 15763 - DNA, 25 bp, Mus musculus
caggtatctcggtctgtcgtcagca

SEQ ID NO: 15764 - DNA, 25 bp, Mus musculus
caggtatttctatgtcggctatttg

SEQ ID NO: 15765 - DNA, 25 bp, Mus musculus
caggtcaaattcttttgattgtggg

SEQ ID NO: 15766 - DNA, 25 bp, Mus musculus
caggtcacccagcaagtcagttgta

SEQ ID NO: 15767 - DNA, 25 bp, Mus musculus
caggtcacccggagtgcttctcact

SEQ ID NO: 15768 - DNA, 25 bp, Mus musculus
caggtcagccttcgatactggtcac

SEQ ID NO: 15769 - DNA, 25 bp, Mus musculus
caggtcagccttggatactggtcac

SEQ ID NO: 15770 - DNA, 25 bp, Mus musculus
caggtcattaggaactacactggca

SEQ ID NO: 15771 - DNA, 25 bp, Mus musculus
caggtccaggagattccaagaagga

SEQ ID NO: 15772 - DNA, 25 bp, Mus musculus
caggtccaggtccagaaagaaccta

SEQ ID NO: 15773 - DNA, 25 bp, Mus musculus
caggtccatttgatagcctagaaga

SEQ ID NO: 15774 - DNA, 25 bp, Mus musculus
caggtcccagaatgacagctgccta

SEQ ID NO: 15775 - DNA, 25 bp, Mus musculus
caggtccgaactgctctagtgttgt

SEQ ID NO: 15776 - DNA, 25 bp, Mus musculus
caggtcctacaacccagtgaaaaga

SEQ ID NO: 15777 - DNA, 25 bp, Mus musculus
caggtcctgaattctctgggtctgg

SEQ ID NO: 15778 - DNA, 25 bp, Mus musculus
caggtcctgaggacataggccctcc

SEQ ID NO: 15779 - DNA, 25 bp, Mus musculus
caggtcctgcctatcagctgagttc

SEQ ID NO: 15780 - DNA, 25 bp, Mus musculus
caggtcctgcctttcagctgagttc

SEQ ID NO: 15781 - DNA, 25 bp, Mus musculus
caggtcctgctgtgtctatgctcag

SEQ ID NO: 15782 - DNA, 25 bp, Mus musculus
caggtcctggagacaaccagcaggt

SEQ ID NO: 15783 - DNA, 25 bp, Mus musculus
caggtcctgggcatggtagagaacc

SEQ ID NO: 15784 - DNA, 25 bp, Mus musculus
caggtcctgggcttggtagagaacc

SEQ ID NO: 15785 - DNA, 25 bp, Mus musculus
caggtcctggtgtcttcgtcgcggc

SEQ ID NO: 15786 - DNA, 25 bp, Mus musculus
caggtcgaaaccctctgttccaaga

SEQ ID NO: 15787 - DNA, 25 bp, Mus musculus
caggtcgctctggatatccaggcct

SEQ ID NO: 15788 - DNA, 25 bp, Mus musculus
caggtcggccctgagattgagcagt

SEQ ID NO: 15789 - DNA, 25 bp, Mus musculus
caggtctacaccatcttgactgtgc

SEQ ID NO: 15790 - DNA, 25 bp, Mus musculus
caggtctcatgggataactgagtcg

SEQ ID NO: 15791 - DNA, 25 bp, Mus musculus
caggtctctggtaccatcatggatc

SEQ ID NO: 15792 - DNA, 25 bp, Mus musculus
caggtctctggttccatcatggatc

SEQ ID NO: 15793 - DNA, 25 bp, Mus musculus
caggtctgtgaagatagcctcgaga

SEQ ID NO: 15794 - DNA, 25 bp, Mus musculus
caggtcttccacgtggattgcttca

SEQ ID NO: 15795 - DNA, 25 bp, Mus musculus
caggtctttatgtatggacacaaag

SEQ ID NO: 15796 - DNA, 25 bp, Mus musculus
caggtgaacaaggacccagaggtga

SEQ ID NO: 15797 - DNA, 25 bp, Mus musculus
caggtgaactgtcataactggttgc

SEQ ID NO: 15798 - DNA, 25 bp, Mus musculus
caggtgaattctggtaattacgtgg

SEQ ID NO: 15799 - DNA, 25 bp, Mus musculus
caggtgacatgccaacttaccagat

SEQ ID NO: 15800 - DNA, 25 bp, Mus musculus
caggtgaggaagaaacccacagtgg

SEQ ID NO: 15801 - DNA, 25 bp, Mus musculus
caggtgatacactttcggtcccggc

SEQ ID NO: 15802 - DNA, 25 bp, Mus musculus
caggtgatacccattgaagaatttc

SEQ ID NO: 15803 - DNA, 25 bp, Mus musculus
caggtgatcacgtatgtccttcgat

SEQ ID NO: 15804 - DNA, 25 bp, Mus musculus
caggtgattggtagcctggtgtccc

SEQ ID NO: 15805 - DNA, 25 bp, Mus musculus
caggtgcaaaggataactcggagac

SEQ ID NO: 15806 - DNA, 25 bp, Mus musculus
caggtgcagagatccaagatggcag

SEQ ID NO: 15807 - DNA, 25 bp, Mus musculus
caggtgcaggcccagttgtcacctc

SEQ ID NO: 15808 - DNA, 25 bp, Mus musculus
caggtgcatgccgatgggtcatgca

SEQ ID NO: 15809 - DNA, 25 bp, Mus musculus
caggtgcatggcatcgtgagctttg

SEQ ID NO: 15810 - DNA, 25 bp, Mus musculus
caggtgcattgccaagcttgcccag

SEQ ID NO: 15811 - DNA, 25 bp, Mus musculus
caggtgccaagctcaggatgagaag

SEQ ID NO: 15812 - DNA, 25 bp, Mus musculus
caggtgccatcacagcttgctttcc

SEQ ID NO: 15813 - DNA, 25 bp, Mus musculus
caggtgcgaggctccgtgctcttct

SEQ ID NO: 15814 - DNA, 25 bp, Mus musculus
caggtgcgccttgaagagatgtcct

SEQ ID NO: 15815 - DNA, 25 bp, Mus musculus
caggtgctaaaggagcttctgggtc

SEQ ID NO: 15816 - DNA, 25 bp, Mus musculus
caggtgctactacgctactatgagt

SEQ ID NO: 15817 - DNA, 25 bp, Mus musculus
caggtgctgtagatctctccgatcc

SEQ ID NO: 15818 - DNA, 25 bp, Mus musculus
caggtgcttactattcctcagtccc

SEQ ID NO: 15819 - DNA, 25 bp, Mus musculus
caggtggaagccagcttacaaccag

SEQ ID NO: 15820 - DNA, 25 bp, Mus musculus
caggtggaagtctccaagacagtaa

SEQ ID NO: 15821 - DNA, 25 bp, Mus musculus
caggtggagggtttcatcaatggca

SEQ ID NO: 15822 - DNA, 25 bp, Mus musculus
caggtggatgccagaagctggtcaa

SEQ ID NO: 15823 - DNA, 25 bp, Mus musculus
caggtggcagaaaaggtggcctcca

SEQ ID NO: 15824 - DNA, 25 bp, Mus musculus
caggtggctagcatgaccaagccta

SEQ ID NO: 15825 - DNA, 25 bp, Mus musculus
caggtgggagtaatccagtttggcc

SEQ ID NO: 15826 - DNA, 25 bp, Mus musculus
caggtggtagagatgttgcttgaca

SEQ ID NO: 15827 - DNA, 25 bp, Mus musculus
caggtggttcacaatcacttataac

SEQ ID NO: 15828 - DNA, 25 bp, Mus musculus
caggtggttcaggacccggcaactg

SEQ ID NO: 15829 - DNA, 25 bp, Mus musculus
caggtgtagaatggaaaaactgttt

SEQ ID NO: 15830 - DNA, 25 bp, Mus musculus
caggtgtcagagctgcgaatctctt

SEQ ID NO: 15831 - DNA, 25 bp, Mus musculus
caggtgtcccgcctgaaaggcagat

SEQ ID NO: 15832 - DNA, 25 bp, Mus musculus
caggtgtcccgcgtgaaaggcagat

SEQ ID NO: 15833 - DNA, 25 bp, Mus musculus
caggtgtgggtgacctttatctcag

SEQ ID NO: 15834 - DNA, 25 bp, Mus musculus
caggtgttcctcatctctggtggct

SEQ ID NO: 15835 - DNA, 25 bp, Mus musculus
caggtgttgcagttctactgctgaa

SEQ ID NO: 15836 - DNA, 25 bp, Mus musculus
caggtgttgctgtctcccaagagca

SEQ ID NO: 15837 - DNA, 25 bp, Mus musculus
caggtgtttaccaaggaggaagcca

SEQ ID NO: 15838 - DNA, 25 bp, Mus musculus
caggtgtttctagattctgtcaaat

SEQ ID NO: 15839 - DNA, 25 bp, Mus musculus
caggttaaaagagaggcaaagaaga

SEQ ID NO: 15840 - DNA, 25 bp, Mus musculus
caggttatcttcaagttccatccca

SEQ ID NO: 15841 - DNA, 25 bp, Mus musculus
caggttattctggacaatggcgcca

SEQ ID NO: 15842 - DNA, 25 bp, Mus musculus
caggttcaggagatccagtctcaca

SEQ ID NO: 15843 - DNA, 25 bp, Mus musculus
caggttccaaatcatcagtgaagca

SEQ ID NO: 15844 - DNA, 25 bp, Mus musculus
caggttccaggaacttcgattggac

SEQ ID NO: 15845 - DNA, 25 bp, Mus musculus
caggttcctttggattgctccacag

SEQ ID NO: 15846 - DNA, 25 bp, Mus musculus
caggttcttttgaaacagccatgcg

SEQ ID NO: 15847 - DNA, 25 bp, Mus musculus
caggttgattacagctgacatggtc

SEQ ID NO: 15848 - DNA, 25 bp, Mus musculus
caggttggatggttttacgttgact

SEQ ID NO: 15849 - DNA, 25 bp, Mus musculus
caggttggcacgaagctcctgaagg

SEQ ID NO: 15850 - DNA, 25 bp, Mus musculus
caggttgtagctccgtcagacatga

SEQ ID NO: 15851 - DNA, 25 bp, Mus musculus
caggttgtcatatccttctatgagg

SEQ ID NO: 15852 - DNA, 25 bp, Mus musculus
caggttgttggcagctacactttcc

SEQ ID NO: 15853 - DNA, 25 bp, Mus musculus
caggtttattgctgctggaagactc

SEQ ID NO: 15854 - DNA, 25 bp, Mus musculus
caggtttctgttacaagctgtgaat

SEQ ID NO: 15855 - DNA, 25 bp, Mus musculus
caggtttgctgtacccgaacccagc

SEQ ID NO: 15856 - DNA, 25 bp, Mus musculus
caggttttgatgagatgcagccgac

SEQ ID NO: 15857 - DNA, 25 bp, Mus musculus
cagtaaaatgggagacagagagaag

SEQ ID NO: 15858 - DNA, 25 bp, Mus musculus
cagtaaactaagcagactgtgacca

SEQ ID NO: 15859 - DNA, 25 bp, Mus musculus
cagtaaagagtctacagagaagcct

SEQ ID NO: 15860 - DNA, 25 bp, Mus musculus
cagtaaagatgcactgcagttggca

SEQ ID NO: 15861 - DNA, 25 bp, Mus musculus
cagtaaagctgtcaaggacagccat

SEQ ID NO: 15862 - DNA, 25 bp, Mus musculus
cagtaacaagcttgcgctgcagaca

SEQ ID NO: 15863 - DNA, 25 bp, Mus musculus
cagtaacatgagaaactagggcagt

SEQ ID NO: 15864 - DNA, 25 bp, Mus musculus
cagtaacattcagcactttgtggag

SEQ ID NO: 15865 - DNA, 25 bp, Mus musculus
cagtaacctgctgaccagcggtgaa

SEQ ID NO: 15866 - DNA, 25 bp, Mus musculus
cagtaacctttgtggatggccgctc

SEQ ID NO: 15867 - DNA, 25 bp, Mus musculus
cagtaactccagtgatccagagaat

SEQ ID NO: 15868 - DNA, 25 bp, Mus musculus
cagtaactccgcctggcaaatctat

SEQ ID NO: 15869 - DNA, 25 bp, Mus musculus
cagtaacttccccatatgcagcatc

SEQ ID NO: 15870 - DNA, 25 bp, Mus musculus
cagtaagagctgttctacaagggac

SEQ ID NO: 15871 - DNA, 25 bp, Mus musculus
cagtaagatctgttggcataacgac

SEQ ID NO: 15872 - DNA, 25 bp, Mus musculus
cagtaagtcagccaatagcccagat

SEQ ID NO: 15873 - DNA, 25 bp, Mus musculus
cagtaagtctacgtgggaacggaag

SEQ ID NO: 15874 - DNA, 25 bp, Mus musculus
cagtaatggaatcctacgccttctt

SEQ ID NO: 15875 - DNA, 25 bp, Mus musculus
cagtaatggatgctccgcgccgttt

SEQ ID NO: 15876 - DNA, 25 bp, Mus musculus
cagtacaagtgcctggtcatcaagt

SEQ ID NO: 15877 - DNA, 25 bp, Mus musculus
cagtacaatggaccagaagagaaca

SEQ ID NO: 15878 - DNA, 25 bp, Mus musculus
cagtacaattaaatgtagagatctc

SEQ ID NO: 15879 - DNA, 25 bp, Mus musculus
cagtacacacttggaaaagccaagg

SEQ ID NO: 15880 - DNA, 25 bp, Mus musculus
cagtacacctatgaggaacgcagag

SEQ ID NO: 15881 - DNA, 25 bp, Mus musculus
cagtacactggaaagctccgaatga

SEQ ID NO: 15882 - DNA, 25 bp, Mus musculus
cagtacacttatggccgagttcagc

SEQ ID NO: 15883 - DNA, 25 bp, Mus musculus
cagtacagccttgtggtgttcaaca

SEQ ID NO: 15884 - DNA, 25 bp, Mus musculus
cagtacagcttttggctctatgagc

SEQ ID NO: 15885 - DNA, 25 bp, Mus musculus
cagtacagttgatggaaagaaggat

SEQ ID NO: 15886 - DNA, 25 bp, Mus musculus
cagtacatcacatagttcctgttta

SEQ ID NO: 15887 - DNA, 25 bp, Mus musculus
cagtacatcaccagatgttttttgg

SEQ ID NO: 15888 - DNA, 25 bp, Mus musculus
cagtacatctctgttctcatgaaga

SEQ ID NO: 15889 - DNA, 25 bp, Mus musculus
cagtaccacacttgcttttttccag

SEQ ID NO: 15890 - DNA, 25 bp, Mus musculus
cagtaccacctatgatgggactaca

SEQ ID NO: 15891 - DNA, 25 bp, Mus musculus
cagtaccagagacaaagacaagctt

SEQ ID NO: 15892 - DNA, 25 bp, Mus musculus
cagtaccagagagaaagacaagctt

SEQ ID NO: 15893 - DNA, 25 bp, Mus musculus
cagtacctacctcaaatggtgacca

SEQ ID NO: 15894 - DNA, 25 bp, Mus musculus
cagtacctagtaatcaatatttcca

SEQ ID NO: 15895 - DNA, 25 bp, Mus musculus
cagtacctcagggatgacacttgga

SEQ ID NO: 15896 - DNA, 25 bp, Mus musculus
cagtacgaaaccctgagcgaggagc

SEQ ID NO: 15897 - DNA, 25 bp, Mus musculus
cagtacgtcatccaataagaacatc

SEQ ID NO: 15898 - DNA, 25 bp, Mus musculus
cagtactgaactcaagaccacaagt

SEQ ID NO: 15899 - DNA, 25 bp, Mus musculus
cagtactgggtggtatttaaggaca

SEQ ID NO: 15900 - DNA, 25 bp, Mus musculus
cagtacttcataggtgtcctggaca

SEQ ID NO: 15901 - DNA, 25 bp, Mus musculus
cagtactttaatgtgggacttatcc

SEQ ID NO: 15902 - DNA, 25 bp, Mus musculus
cagtactttgccagcattgcagcca

SEQ ID NO: 15903 - DNA, 25 bp, Mus musculus
cagtagagctggattaaaacacagg

SEQ ID NO: 15904 - DNA, 25 bp, Mus musculus
cagtagagtttaatcattctggaga

SEQ ID NO: 15905 - DNA, 25 bp, Mus musculus
cagtagatcacatcttggcaggttc

SEQ ID NO: 15906 - DNA, 25 bp, Mus musculus
cagtagatgcacaggtgcgccttga

SEQ ID NO: 15907 - DNA, 25 bp, Mus musculus
cagtagattggcaaaatataggaca

SEQ ID NO: 15908 - DNA, 25 bp, Mus musculus
cagtagcaggctgtaactgagacag

SEQ ID NO: 15909 - DNA, 25 bp, Mus musculus
cagtagccaagaattcataagatcc

SEQ ID NO: 15910 - DNA, 25 bp, Mus musculus
cagtagcccgtcatcaaagtggtca

SEQ ID NO: 15911 - DNA, 25 bp, Mus musculus
cagtagcccgtcttcaaagtggtca

SEQ ID NO: 15912 - DNA, 25 bp, Mus musculus
cagtagctctgtcctgcagtatgct

SEQ ID NO: 15913 - DNA, 25 bp, Mus musculus
cagtagctgacttgctggcttttgc

SEQ ID NO: 15914 - DNA, 25 bp, Mus musculus
cagtagcttgggatggaggtctttc

SEQ ID NO: 15915 - DNA, 25 bp, Mus musculus
cagtagcttgggttggaggtctttc

SEQ ID NO: 15916 - DNA, 25 bp, Mus musculus
cagtaggacggaaatcctgcatttc

SEQ ID NO: 15917 - DNA, 25 bp, Mus musculus
cagtaggtccctctgcagtcttagc

SEQ ID NO: 15918 - DNA, 25 bp, Mus musculus
cagtagtctgggacaaggtcaccgg

SEQ ID NO: 15919 - DNA, 25 bp, Mus musculus
cagtagtgatgtgaacagtgatggc

SEQ ID NO: 15920 - DNA, 25 bp, Mus musculus
cagtagtgattttggtcctgatgta

SEQ ID NO: 15921 - DNA, 25 bp, Mus musculus
cagtagttggaaattttggtgaagc

SEQ ID NO: 15922 - DNA, 25 bp, Mus musculus
cagtagttggaatttttggtgaagc

SEQ ID NO: 15923 - DNA, 25 bp, Mus musculus
cagtagtttgccaactggaagttct

SEQ ID NO: 15924 - DNA, 25 bp, Mus musculus
cagtataaactacattgatgtgact

SEQ ID NO: 15925 - DNA, 25 bp, Mus musculus
cagtataaactagattgatgtgact

SEQ ID NO: 15926 - DNA, 25 bp, Mus musculus
cagtataaagctgacatgttcaagc

SEQ ID NO: 15927 - DNA, 25 bp, Mus musculus
cagtatacattagaacacatgcatg

SEQ ID NO: 15928 - DNA, 25 bp, Mus musculus
cagtatacgttaataattcaagcca

SEQ ID NO: 15929 - DNA, 25 bp, Mus musculus
cagtatacgttattaattcaagcca

SEQ ID NO: 15930 - DNA, 25 bp, Mus musculus
cagtatagcagttcagccctgccat

SEQ ID NO: 15931 - DNA, 25 bp, Mus musculus
cagtatatcccgaagctacgcaaag

SEQ ID NO: 15932 - DNA, 25 bp, Mus musculus
cagtatatggcaaatgggtggcaag

SEQ ID NO: 15933 - DNA, 25 bp, Mus musculus
cagtatcaaagtgctctgttttggg

SEQ ID NO: 15934 - DNA, 25 bp, Mus musculus
cagtatccgacaccaggcttttcca

SEQ ID NO: 15935 - DNA, 25 bp, Mus musculus
cagtatcctggctgcgcactttggg

SEQ ID NO: 15936 - DNA, 25 bp, Mus musculus
cagtatctaatgtatgggatggtga

SEQ ID NO: 15937 - DNA, 25 bp, Mus musculus
cagtatctgatagtgcagctgcttc

SEQ ID NO: 15938 - DNA, 25 bp, Mus musculus
cagtatgaaggatgtgatgcaactc

SEQ ID NO: 15939 - DNA, 25 bp, Mus musculus
cagtatgagaacgtggatgaagact

SEQ ID NO: 15940 - DNA, 25 bp, Mus musculus
cagtatgcagtgtaagagcagatgc

SEQ ID NO: 15941 - DNA, 25 bp, Mus musculus
cagtatgccaaggatttcagcccca

SEQ ID NO: 15942 - DNA, 25 bp, Mus musculus
cagtatggacagtatatggcaaatg

SEQ ID NO: 15943 - DNA, 25 bp, Mus musculus
cagtatggatgagagtgaggccaca

SEQ ID NO: 15944 - DNA, 25 bp, Mus musculus
cagtatggcattgcccggttcttca

SEQ ID NO: 15945 - DNA, 25 bp, Mus musculus
cagtatgggcacaaaaagaaggcta

SEQ ID NO: 15946 - DNA, 25 bp, Mus musculus
cagtatgtccccagaattgtgtttg

SEQ ID NO: 15947 - DNA, 25 bp, Mus musculus
cagtatgtgaaggacttgaagaaac

SEQ ID NO: 15948 - DNA, 25 bp, Mus musculus
cagtatgtgatgtctctctccaggg

SEQ ID NO: 15949 - DNA, 25 bp, Mus musculus
cagtattatctaacatcgccagaat

SEQ ID NO: 15950 - DNA, 25 bp, Mus musculus
cagtattatctatcatcgccagaat

SEQ ID NO: 15951 - DNA, 25 bp, Mus musculus
cagtatttctgaagaagggtttcac

SEQ ID NO: 15952 - DNA, 25 bp, Mus musculus
cagtattttatgtctacccgctgct

SEQ ID NO: 15953 - DNA, 25 bp, Mus musculus
cagtcaaaggcaagaggtatcaagg

SEQ ID NO: 15954 - DNA, 25 bp, Mus musculus
cagtcaaaggttcagaagtagacac

SEQ ID NO: 15955 - DNA, 25 bp, Mus musculus
cagtcaacctcaagaagtggagttt

SEQ ID NO: 15956 - DNA, 25 bp, Mus musculus
cagtcaagctcagatggtagctgta

SEQ ID NO: 15957 - DNA, 25 bp, Mus musculus
cagtcaagtccaaaaaactgtactg

SEQ ID NO: 15958 - DNA, 25 bp, Mus musculus
cagtcaagttcttcaggttcctcaa

SEQ ID NO: 15959 - DNA, 25 bp, Mus musculus
cagtcaatggctagattgctcagaa

SEQ ID NO: 15960 - DNA, 25 bp, Mus musculus
cagtcaatgggagtctttttctgcc

SEQ ID NO: 15961 - DNA, 25 bp, Mus musculus
cagtcacacctcagatccaggcatt

SEQ ID NO: 15962 - DNA, 25 bp, Mus musculus
cagtcacactgaagcagagaaggac

SEQ ID NO: 15963 - DNA, 25 bp, Mus musculus
cagtcaccacaccttggactgagga

SEQ ID NO: 15964 - DNA, 25 bp, Mus musculus
cagtcaccagcgtgtgttccgagtc

SEQ ID NO: 15965 - DNA, 25 bp, Mus musculus
cagtcaccattgtccaaactcagag

SEQ ID NO: 15966 - DNA, 25 bp, Mus musculus
cagtcacgggccctctggaattcga

SEQ ID NO: 15967 - DNA, 25 bp, Mus musculus
cagtcactaaggagctgttgttaac

SEQ ID NO: 15968 - DNA, 25 bp, Mus musculus
cagtcactacggctgcaatgcagaa

SEQ ID NO: 15969 - DNA, 25 bp, Mus musculus
cagtcactccacagacctcatggag

SEQ ID NO: 15970 - DNA, 25 bp, Mus musculus
cagtcactgcgagtgtaacgagcga

SEQ ID NO: 15971 - DNA, 25 bp, Mus musculus
cagtcactgggcaggatgaagccat

SEQ ID NO: 15972 - DNA, 25 bp, Mus musculus
cagtcactggtgcaaagactgcaat

SEQ ID NO: 15973 - DNA, 25 bp, Mus musculus
cagtcactgtgtcataaaagaaatc

SEQ ID NO: 15974 - DNA, 25 bp, Mus musculus
cagtcagaagaaggctgctattgaa

SEQ ID NO: 15975 - DNA, 25 bp, Mus musculus
cagtcagaagccagtagacagtggt

SEQ ID NO: 15976 - DNA, 25 bp, Mus musculus
cagtcagaagcctgtagacagtggt

SEQ ID NO: 15977 - DNA, 25 bp, Mus musculus
cagtcagacctcttcttttacgaac

SEQ ID NO: 15978 - DNA, 25 bp, Mus musculus
cagtcagacttcctcaggttctgcc

SEQ ID NO: 15979 - DNA, 25 bp, Mus musculus
cagtcagcaagggagcaagacaagg

SEQ ID NO: 15980 - DNA, 25 bp, Mus musculus
cagtcagctccgtttttcatcccaa

SEQ ID NO: 15981 - DNA, 25 bp, Mus musculus
cagtcagctctatggagacctaaag

SEQ ID NO: 15982 - DNA, 25 bp, Mus musculus
cagtcagctgctatttcaaagaaaa

SEQ ID NO: 15983 - DNA, 25 bp, Mus musculus
cagtcagcttttcatcgctgtgaca

SEQ ID NO: 15984 - DNA, 25 bp, Mus musculus
cagtcagcttttgatcgctgtgaca

SEQ ID NO: 15985 - DNA, 25 bp, Mus musculus
cagtcagggacgtgcctacctcttc

SEQ ID NO: 15986 - DNA, 25 bp, Mus musculus
cagtcagggcgggactactgggact

SEQ ID NO: 15987 - DNA, 25 bp, Mus musculus
cagtcaggttcacaagaaaagcaca

SEQ ID NO: 15988 - DNA, 25 bp, Mus musculus
cagtcagtgcctgcatcaaaacggg

SEQ ID NO: 15989 - DNA, 25 bp, Mus musculus
cagtcagtgggaactacaagaaagg

SEQ ID NO: 15990 - DNA, 25 bp, Mus musculus
cagtcagtgggatctacaagaaagg

SEQ ID NO: 15991 - DNA, 25 bp, Mus musculus
cagtcagttgcaagcagagaaaaac

SEQ ID NO: 15992 - DNA, 25 bp, Mus musculus
cagtcagttgcatgcagagaaaaac

SEQ ID NO: 15993 - DNA, 25 bp, Mus musculus
cagtcatcccttagctgtggaggga

SEQ ID NO: 15994 - DNA, 25 bp, Mus musculus
cagtcatccggcctctgtcagtgtt

SEQ ID NO: 15995 - DNA, 25 bp, Mus musculus
cagtcatgactcagccagaggaaga

SEQ ID NO: 15996 - DNA, 25 bp, Mus musculus
cagtcatggatctgctctctagcag

SEQ ID NO: 15997 - DNA, 25 bp, Mus musculus
cagtcattcaatgacaagcgtaaaa

SEQ ID NO: 15998 - DNA, 25 bp, Mus musculus
cagtcattgaaacacaggctggtga

SEQ ID NO: 15999 - DNA, 25 bp, Mus musculus
cagtcattggccgatacctgctgag

SEQ ID NO: 16000 - DNA, 25 bp, Mus musculus
cagtccaagtgtggctcgaaggata

SEQ ID NO: 16001 - DNA, 25 bp, Mus musculus
cagtccagggcccaattgtgttagc

SEQ ID NO: 16002 - DNA, 25 bp, Mus musculus
cagtccagttctcaggattcagacc

SEQ ID NO: 16003 - DNA, 25 bp, Mus musculus
cagtccatagctgtgcccagatcaa

SEQ ID NO: 16004 - DNA, 25 bp, Mus musculus
cagtccatcgggattcaggtagagg

SEQ ID NO: 16005 - DNA, 25 bp, Mus musculus
cagtccatgaagattatgcatgaga

SEQ ID NO: 16006 - DNA, 25 bp, Mus musculus
cagtccattcccttttcaacgtatt

SEQ ID NO: 16007 - DNA, 25 bp, Mus musculus
cagtcccaagaaatgttttgaaggt

SEQ ID NO: 16008 - DNA, 25 bp, Mus musculus
cagtcccaatgggacaaagtgaagg

SEQ ID NO: 16009 - DNA, 25 bp, Mus musculus
cagtcccctgctaatggtcatagca

SEQ ID NO: 16010 - DNA, 25 bp, Mus musculus
cagtcccctgtttctcaccaaagga

SEQ ID NO: 16011 - DNA, 25 bp, Mus musculus
cagtcccgtcgttatgactggtgaa

SEQ ID NO: 16012 - DNA, 25 bp, Mus musculus
cagtccctaagtagaagatctggca

SEQ ID NO: 16013 - DNA, 25 bp, Mus musculus
cagtccctcttgagatgctggaggc

SEQ ID NO: 16014 - DNA, 25 bp, Mus musculus
cagtccctgtcaagcaggaggccat

SEQ ID NO: 16015 - DNA, 25 bp, Mus musculus
cagtccgatgggaggaatatctcct

SEQ ID NO: 16016 - DNA, 25 bp, Mus musculus
cagtccgcctgtagcatgtgtggca

SEQ ID NO: 16017 - DNA, 25 bp, Mus musculus
cagtccgctggaatgctatatgaaa

SEQ ID NO: 16018 - DNA, 25 bp, Mus musculus
cagtccgctggattgctatatgaaa

SEQ ID NO: 16019 - DNA, 25 bp, Mus musculus
cagtccggctgtcgcgtcgcctgat

SEQ ID NO: 16020 - DNA, 25 bp, Mus musculus
cagtcctatctttgaagatgatgaa

SEQ ID NO: 16021 - DNA, 25 bp, Mus musculus
cagtcctatgactacagatacacaa

SEQ ID NO: 16022 - DNA, 25 bp, Mus musculus
cagtcctcagagagaatctgaagtt

SEQ ID NO: 16023 - DNA, 25 bp, Mus musculus
cagtcctgacaaaaaagctaagcgg

SEQ ID NO: 16024 - DNA, 25 bp, Mus musculus
cagtcctgactttagcctttgacaa

SEQ ID NO: 16025 - DNA, 25 bp, Mus musculus
cagtcctgcggtacacactaaacca

SEQ ID NO: 16026 - DNA, 25 bp, Mus musculus
cagtcctgcttcaacttccaaagtg

SEQ ID NO: 16027 - DNA, 25 bp, Mus musculus
cagtcctggacttgtgtgctgctcc

SEQ ID NO: 16028 - DNA, 25 bp, Mus musculus
cagtcctgggcagctatgtttccac

SEQ ID NO: 16029 - DNA, 25 bp, Mus musculus
cagtcgacagccactgtgtctgtga

SEQ ID NO: 16030 - DNA, 25 bp, Mus musculus
cagtcgacagcctctgtgtctgtga

SEQ ID NO: 16031 - DNA, 25 bp, Mus musculus
cagtcgattaggaacccacgaaggc

SEQ ID NO: 16032 - DNA, 25 bp, Mus musculus
cagtcgcaggtgtggcgggcaaggc

SEQ ID NO: 16033 - DNA, 25 bp, Mus musculus
cagtcgcatgacaggtggtggcttt

SEQ ID NO: 16034 - DNA, 25 bp, Mus musculus
cagtcgccactatgttgacaggcta

SEQ ID NO: 16035 - DNA, 25 bp, Mus musculus
cagtcgcggaagatcttcaactgca

SEQ ID NO: 16036 - DNA, 25 bp, Mus musculus
cagtcgcggaagttcttcaactgca

SEQ ID NO: 16037 - DNA, 25 bp, Mus musculus
cagtcgctggcaagatgatgcccag

SEQ ID NO: 16038 - DNA, 25 bp, Mus musculus
cagtcggatgatgtctgtggctgcc

SEQ ID NO: 16039 - DNA, 25 bp, Mus musculus
cagtcggctgtgaacacgctccatt

SEQ ID NO: 16040 - DNA, 25 bp, Mus musculus
cagtcgggggcttcagatggctcac

SEQ ID NO: 16041 - DNA, 25 bp, Mus musculus
cagtcgtggcatataaggatgccat

SEQ ID NO: 16042 - DNA, 25 bp, Mus musculus
cagtctaacgctgaatagaagtggt

SEQ ID NO: 16043 - DNA, 25 bp, Mus musculus
cagtctaccacttctgattatcagt

SEQ ID NO: 16044 - DNA, 25 bp, Mus musculus
cagtctagccagagttcaaagtgaa

SEQ ID NO: 16045 - DNA, 25 bp, Mus musculus
cagtctcactgcatggagccagagg

SEQ ID NO: 16046 - DNA, 25 bp, Mus musculus
cagtctcagctggatgaagccaaga

SEQ ID NO: 16047 - DNA, 25 bp, Mus musculus
cagtctcatcagtggtattcctggg

SEQ ID NO: 16048 - DNA, 25 bp, Mus musculus
cagtctcatccagtaagggcaaagg

SEQ ID NO: 16049 - DNA, 25 bp, Mus musculus
cagtctccctgtggagcgccgtcct

SEQ ID NO: 16050 - DNA, 25 bp, Mus musculus
cagtctcgggatgtcacgtggttga

SEQ ID NO: 16051 - DNA, 25 bp, Mus musculus
cagtctctgccatcttccagttttc

SEQ ID NO: 16052 - DNA, 25 bp, Mus musculus
cagtctctgtgagtataaggacatc

SEQ ID NO: 16053 - DNA, 25 bp, Mus musculus
cagtctgaactggacaaagtggctc

SEQ ID NO: 16054 - DNA, 25 bp, Mus musculus
cagtctgactctgctggaaaaccct

SEQ ID NO: 16055 - DNA, 25 bp, Mus musculus
cagtctgagaagacagctgttaaca

SEQ ID NO: 16056 - DNA, 25 bp, Mus musculus
cagtctggctcagcagactcctgta

SEQ ID NO: 16057 - DNA, 25 bp, Mus musculus
cagtctgggaagtcacgtgacaaga

SEQ ID NO: 16058 - DNA, 25 bp, Mus musculus
cagtctgggaatctgtaagtgattc

SEQ ID NO: 16059 - DNA, 25 bp, Mus musculus
cagtctgtcatggtggaaccaggaa

SEQ ID NO: 16060 - DNA, 25 bp, Mus musculus
cagtctgtctgcctacaatgtcaag

SEQ ID NO: 16061 - DNA, 25 bp, Mus musculus
cagtctgtttgaaccctctggatgg

SEQ ID NO: 16062 - DNA, 25 bp, Mus musculus
cagtcttaccgaaggatgtgcacga

SEQ ID NO: 16063 - DNA, 25 bp, Mus musculus
cagtcttaccgatggatgtgcacga

SEQ ID NO: 16064 - DNA, 25 bp, Mus musculus
cagtcttagctggaagcaccaggcc

SEQ ID NO: 16065 - DNA, 25 bp, Mus musculus
cagtcttatgaaatccgaatgctag

SEQ ID NO: 16066 - DNA, 25 bp, Mus musculus
cagtcttattgacttagtggtggct

SEQ ID NO: 16067 - DNA, 25 bp, Mus musculus
cagtcttattgagttagtggtggct

SEQ ID NO: 16068 - DNA, 25 bp, Mus musculus
cagtcttcaagagagccttgatgag

SEQ ID NO: 16069 - DNA, 25 bp, Mus musculus
cagtcttcagcctattatcaaaacg

SEQ ID NO: 16070 - DNA, 25 bp, Mus musculus
cagtcttcagggtctcaagatctac

SEQ ID NO: 16071 - DNA, 25 bp, Mus musculus
cagtcttccactcttggagctcaca

SEQ ID NO: 16072 - DNA, 25 bp, Mus musculus
cagtcttccgcgtaccctggaagca

SEQ ID NO: 16073 - DNA, 25 bp, Mus musculus
cagtcttctcttgaggaggttccac

SEQ ID NO: 16074 - DNA, 25 bp, Mus musculus
cagtcttctggtatctctccagttc

SEQ ID NO: 16075 - DNA, 25 bp, Mus musculus
cagtcttgaaactatcttctatgag

SEQ ID NO: 16076 - DNA, 25 bp, Mus musculus
cagtcttgccagaacactggtagta

SEQ ID NO: 16077 - DNA, 25 bp, Mus musculus
cagtcttgccagtacactggtagta

SEQ ID NO: 16078 - DNA, 25 bp, Mus musculus
cagtcttggcatcttcgaagtaagg

SEQ ID NO: 16079 - DNA, 25 bp, Mus musculus
cagtcttggctcacgttcctgtgca

SEQ ID NO: 16080 - DNA, 25 bp, Mus musculus
cagtctttaaaagtccagtgttaca

SEQ ID NO: 16081 - DNA, 25 bp, Mus musculus
cagtctttacctgtgtgcgggaacc

SEQ ID NO: 16082 - DNA, 25 bp, Mus musculus
cagtctttcttttggcgggtagtgc

SEQ ID NO: 16083 - DNA, 25 bp, Mus musculus
cagtcttttcattcttaggcctgaa

SEQ ID NO: 16084 - DNA, 25 bp, Mus musculus
cagtgaaaacagacctgaaaatgag

SEQ ID NO: 16085 - DNA, 25 bp, Mus musculus
cagtgaaaagaactccgcagaaacc

SEQ ID NO: 16086 - DNA, 25 bp, Mus musculus
cagtgaaacatctagaagacattgt

SEQ ID NO: 16087 - DNA, 25 bp, Mus musculus
cagtgaaactgagttagagaggatt

SEQ ID NO: 16088 - DNA, 25 bp, Mus musculus
cagtgaaagcgtggaaagaagcaca

SEQ ID NO: 16089 - DNA, 25 bp, Mus musculus
cagtgaaaggagtattcatgcagac

SEQ ID NO: 16090 - DNA, 25 bp, Mus musculus
cagtgaaaggctacttcctggctgg

SEQ ID NO: 16091 - DNA, 25 bp, Mus musculus
cagtgaaatcagtaatttagccggc

SEQ ID NO: 16092 - DNA, 25 bp, Mus musculus
cagtgaaatccatgtttcacacgca

SEQ ID NO: 16093 - DNA, 25 bp, Mus musculus
cagtgaaatggatggaaggactcac

SEQ ID NO: 16094 - DNA, 25 bp, Mus musculus
cagtgaaccccagaccagactgata

SEQ ID NO: 16095 - DNA, 25 bp, Mus musculus
cagtgaactggtgcagaaccatgct

SEQ ID NO: 16096 - DNA, 25 bp, Mus musculus
cagtgaagatttgggacctgcgcca

SEQ ID NO: 16097 - DNA, 25 bp, Mus musculus
cagtgaagccgatagcatagacagt

SEQ ID NO: 16098 - DNA, 25 bp, Mus musculus
cagtgaatacccttcaccctggcag

SEQ ID NO: 16099 - DNA, 25 bp, Mus musculus
cagtgaatgagcacggcaatgtgcc

SEQ ID NO: 16100 - DNA, 25 bp, Mus musculus
cagtgaatgtcctgcagaaaatgag

SEQ ID NO: 16101 - DNA, 25 bp, Mus musculus
cagtgacaacatttggaccaaaggc

SEQ ID NO: 16102 - DNA, 25 bp, Mus musculus
cagtgacaagtccagcacctatgtg

SEQ ID NO: 16103 - DNA, 25 bp, Mus musculus
cagtgacaggtgtgacctctgtgga

SEQ ID NO: 16104 - DNA, 25 bp, Mus musculus
cagtgaccagttcctcttcttaatt

SEQ ID NO: 16105 - DNA, 25 bp, Mus musculus
cagtgacccctgaggagtgtcagct

SEQ ID NO: 16106 - DNA, 25 bp, Mus musculus
cagtgacccgagacagtctgagcaa

SEQ ID NO: 16107 - DNA, 25 bp, Mus musculus
cagtgaccctccgatcagtgagagt

SEQ ID NO: 16108 - DNA, 25 bp, Mus musculus
cagtgaccgaaagctgggccagttt

SEQ ID NO: 16109 - DNA, 25 bp, Mus musculus
cagtgaccggaaatgcgagtgccaa

SEQ ID NO: 16110 - DNA, 25 bp, Mus musculus
cagtgaccggaggtacaaagtgtgc

SEQ ID NO: 16111 - DNA, 25 bp, Mus musculus
cagtgaccggcaggctttggtcaaa

SEQ ID NO: 16112 - DNA, 25 bp, Mus musculus
cagtgacctttatgcaatgggtgtc

SEQ ID NO: 16113 - DNA, 25 bp, Mus musculus
cagtgacgatgatgccctcctcaag

SEQ ID NO: 16114 - DNA, 25 bp, Mus musculus
cagtgactatcatctgttccacagg

SEQ ID NO: 16115 - DNA, 25 bp, Mus musculus
cagtgactcctacagattgatccag

SEQ ID NO: 16116 - DNA, 25 bp, Mus musculus
cagtgactcggagcgtttgaaacgc

SEQ ID NO: 16117 - DNA, 25 bp, Mus musculus
cagtgactcttacccacatggatgg

SEQ ID NO: 16118 - DNA, 25 bp, Mus musculus
cagtgactcttagccacatggatgg

SEQ ID NO: 16119 - DNA, 25 bp, Mus musculus
cagtgagaatctccgagctggcatt

SEQ ID NO: 16120 - DNA, 25 bp, Mus musculus
cagtgagaatctgcgagctggcatt

SEQ ID NO: 16121 - DNA, 25 bp, Mus musculus
cagtgagagccaaccagagctgctt

SEQ ID NO: 16122 - DNA, 25 bp, Mus musculus
cagtgagagcgtaaaagataaaagg

SEQ ID NO: 16123 - DNA, 25 bp, Mus musculus
cagtgagagtctgagcattgagaac

SEQ ID NO: 16124 - DNA, 25 bp, Mus musculus
cagtgagatcgagcgaagggatccc

SEQ ID NO: 16125 - DNA, 25 bp, Mus musculus
cagtgagcagaatatgacctttgac

SEQ ID NO: 16126 - DNA, 25 bp, Mus musculus
cagtgagcgtgctggaatccgcaga

SEQ ID NO: 16127 - DNA, 25 bp, Mus musculus
cagtgagctgcctgcgtcccaaaga

SEQ ID NO: 16128 - DNA, 25 bp, Mus musculus
cagtgaggaattgtactgtatctgc

SEQ ID NO: 16129 - DNA, 25 bp, Mus musculus
cagtgaggaccaaacgagacacagt

SEQ ID NO: 16130 - DNA, 25 bp, Mus musculus
cagtgaggctattgctaccctggct

SEQ ID NO: 16131 - DNA, 25 bp, Mus musculus
cagtgagggcaggtgtatctgcaca

SEQ ID NO: 16132 - DNA, 25 bp, Mus musculus
cagtgagtggtctcgttagcagcca

SEQ ID NO: 16133 - DNA, 25 bp, Mus musculus
cagtgatatgaatggaaagagagac

SEQ ID NO: 16134 - DNA, 25 bp, Mus musculus
cagtgatcaaggatgagggactgca

SEQ ID NO: 16135 - DNA, 25 bp, Mus musculus
cagtgatcacttgaatgacagtcga

SEQ ID NO: 16136 - DNA, 25 bp, Mus musculus
cagtgatcattctaacctgcaagag

SEQ ID NO: 16137 - DNA, 25 bp, Mus musculus
cagtgatccaatgcggaaaaatctc

SEQ ID NO: 16138 - DNA, 25 bp, Mus musculus
cagtgatccagccagctttgctgta

SEQ ID NO: 16139 - DNA, 25 bp, Mus musculus
cagtgatgacctattccgcttttcc

SEQ ID NO: 16140 - DNA, 25 bp, Mus musculus
cagtgatgaggatctgccctccggc

SEQ ID NO: 16141 - DNA, 25 bp, Mus musculus
cagtgatgaggctgtaatcaataaa

SEQ ID NO: 16142 - DNA, 25 bp, Mus musculus
cagtgatgatgctgagctgagcaag

SEQ ID NO: 16143 - DNA, 25 bp, Mus musculus
cagtgatggagcacgcgctgctcaa

SEQ ID NO: 16144 - DNA, 25 bp, Mus musculus
cagtgatggcaatcagagacaagat

SEQ ID NO: 16145 - DNA, 25 bp, Mus musculus
cagtgatggcattaggaccttaata

SEQ ID NO: 16146 - DNA, 25 bp, Mus musculus
cagtgatgtgtccatagccttctcg

SEQ ID NO: 16147 - DNA, 25 bp, Mus musculus
cagtgatttttgaaccagatgcaat

SEQ ID NO: 16148 - DNA, 25 bp, Mus musculus
cagtgcaagtaggatgtttagcaac

SEQ ID NO: 16149 - DNA, 25 bp, Mus musculus
cagtgcacatgtattgatggcgccg

SEQ ID NO: 16150 - DNA, 25 bp, Mus musculus
cagtgcacatgttttgatggcgccg

SEQ ID NO: 16151 - DNA, 25 bp, Mus musculus
cagtgcagacagcagatcctttcac

SEQ ID NO: 16152 - DNA, 25 bp, Mus musculus
cagtgcagactggattgaggagccc

SEQ ID NO: 16153 - DNA, 25 bp, Mus musculus
cagtgcatactttatcaccaagcaa

SEQ ID NO: 16154 - DNA, 25 bp, Mus musculus
cagtgcatcgggatagtagtctggc

SEQ ID NO: 16155 - DNA, 25 bp, Mus musculus
cagtgcattagcagtgaaatgggcg

SEQ ID NO: 16156 - DNA, 25 bp, Mus musculus
cagtgccaacgtcaagcaagtggac

SEQ ID NO: 16157 - DNA, 25 bp, Mus musculus
cagtgccagctccagatagtatgag

SEQ ID NO: 16158 - DNA, 25 bp, Mus musculus
cagtgccatccagaggcagctgaag

SEQ ID NO: 16159 - DNA, 25 bp, Mus musculus
cagtgcccgtaatagcaccactact

SEQ ID NO: 16160 - DNA, 25 bp, Mus musculus
cagtgccctaccctcattgtgcatg

SEQ ID NO: 16161 - DNA, 25 bp, Mus musculus
cagtgccctattctgtcctctggca

SEQ ID NO: 16162 - DNA, 25 bp, Mus musculus
cagtgccctattgtgtcctctggca

SEQ ID NO: 16163 - DNA, 25 bp, Mus musculus
cagtgccctgctggattcctgcatg

SEQ ID NO: 16164 - DNA, 25 bp, Mus musculus
cagtgccggcagagtacccagcctg

SEQ ID NO: 16165 - DNA, 25 bp, Mus musculus
cagtgcctcaataaaacagctcagt

SEQ ID NO: 16166 - DNA, 25 bp, Mus musculus
cagtgcctgcaatcaggtcgtcaag

SEQ ID NO: 16167 - DNA, 25 bp, Mus musculus
cagtgcctggtaaagtacatagacc

SEQ ID NO: 16168 - DNA, 25 bp, Mus musculus
cagtgcctgtgtattctggccctgt

SEQ ID NO: 16169 - DNA, 25 bp, Mus musculus
cagtgcgatacagtgatgattcaga

SEQ ID NO: 16170 - DNA, 25 bp, Mus musculus
cagtgcgcttcacgcagctggacga

SEQ ID NO: 16171 - DNA, 25 bp, Mus musculus
cagtgctaaaagtctccgggggaga

SEQ ID NO: 16172 - DNA, 25 bp, Mus musculus
cagtgctaatcgagatatttccgtt

SEQ ID NO: 16173 - DNA, 25 bp, Mus musculus
cagtgctacagtttgaaggccaaaa

SEQ ID NO: 16174 - DNA, 25 bp, Mus musculus
cagtgctcaccagagaggatgggct

SEQ ID NO: 16175 - DNA, 25 bp, Mus musculus
cagtgctcagctccgcatatgcgct

SEQ ID NO: 16176 - DNA, 25 bp, Mus musculus
cagtgctccgggaactggaaaaaga

SEQ ID NO: 16177 - DNA, 25 bp, Mus musculus
cagtgctcggcattctttgcccaaa

SEQ ID NO: 16178 - DNA, 25 bp, Mus musculus
cagtgctgagaaatggaaccggttg

SEQ ID NO: 16179 - DNA, 25 bp, Mus musculus
cagtgctgcactacaagactttgtc

SEQ ID NO: 16180 - DNA, 25 bp, Mus musculus
cagtgctgcccacgatggacaacat

SEQ ID NO: 16181 - DNA, 25 bp, Mus musculus
cagtgctgcccaggatggacaacat

SEQ ID NO: 16182 - DNA, 25 bp, Mus musculus
cagtgctgcctgatgacagtcgggc

SEQ ID NO: 16183 - DNA, 25 bp, Mus musculus
cagtgctggccaacatagggagtga

SEQ ID NO: 16184 - DNA, 25 bp, Mus musculus
cagtgctggtgctggatgtcactga

SEQ ID NO: 16185 - DNA, 25 bp, Mus musculus
cagtgctgtcgaaaagcccagggta

SEQ ID NO: 16186 - DNA, 25 bp, Mus musculus
cagtgcttcgcaagatggaaaatta

SEQ ID NO: 16187 - DNA, 25 bp, Mus musculus
cagtgcttgacaaagagaatattct

SEQ ID NO: 16188 - DNA, 25 bp, Mus musculus
cagtgcttgacatagagaatattct

SEQ ID NO: 16189 - DNA, 25 bp, Mus musculus
cagtgcttgctaaatgttctgtaca

SEQ ID NO: 16190 - DNA, 25 bp, Mus musculus
cagtgcttggaaggcatccatctca

SEQ ID NO: 16191 - DNA, 25 bp, Mus musculus
cagtgcttggcagcattcagcagag

SEQ ID NO: 16192 - DNA, 25 bp, Mus musculus
cagtgcttgtaagtgtgaggtcagc

SEQ ID NO: 16193 - DNA, 25 bp, Mus musculus
cagtggaaagctaaccctgagacag

SEQ ID NO: 16194 - DNA, 25 bp, Mus musculus
cagtggaagctagactggaggaaaa

SEQ ID NO: 16195 - DNA, 25 bp, Mus musculus
cagtggaaggctttaagccttacgg

SEQ ID NO: 16196 - DNA, 25 bp, Mus musculus
cagtggaatctgcactcgaacagtg

SEQ ID NO: 16197 - DNA, 25 bp, Mus musculus
cagtggacactgatgagatcccagc

SEQ ID NO: 16198 - DNA, 25 bp, Mus musculus
cagtggaccgaccaaaactctttgt

SEQ ID NO: 16199 - DNA, 25 bp, Mus musculus
cagtggagaacaagacgggatccta

SEQ ID NO: 16200 - DNA, 25 bp, Mus musculus
cagtggagaagtcatggtcagcacc

SEQ ID NO: 16201 - DNA, 25 bp, Mus musculus
cagtggagactttggcaacctagaa

SEQ ID NO: 16202 - DNA, 25 bp, Mus musculus
cagtggaggattacttcatcgccaa

SEQ ID NO: 16203 - DNA, 25 bp, Mus musculus
cagtggaggccatctcggcaatggt

SEQ ID NO: 16204 - DNA, 25 bp, Mus musculus
cagtggaggctcaggcttgctacag

SEQ ID NO: 16205 - DNA, 25 bp, Mus musculus
cagtggaggtgacatcctgtgaaca

SEQ ID NO: 16206 - DNA, 25 bp, Mus musculus
cagtggaggtgctgttccaaccccg

SEQ ID NO: 16207 - DNA, 25 bp, Mus musculus
cagtggagttcctgtgggacccttc

SEQ ID NO: 16208 - DNA, 25 bp, Mus musculus
cagtggatacggtgaaggaaaagtc

SEQ ID NO: 16209 - DNA, 25 bp, Mus musculus
cagtggatcgccgttgaggtcacaa

SEQ ID NO: 16210 - DNA, 25 bp, Mus musculus
cagtggatggaaacggtgaaggtgc

SEQ ID NO: 16211 - DNA, 25 bp, Mus musculus
cagtggatgtacaaaaacattcccc

SEQ ID NO: 16212 - DNA, 25 bp, Mus musculus
cagtggatgtcagccagcccagctt

SEQ ID NO: 16213 - DNA, 25 bp, Mus musculus
cagtggattgatattacagatgtac

SEQ ID NO: 16214 - DNA, 25 bp, Mus musculus
cagtggattgattttacagatgtac

SEQ ID NO: 16215 - DNA, 25 bp, Mus musculus
cagtggatttcactatcgccagttc

SEQ ID NO: 16216 - DNA, 25 bp, Mus musculus
cagtggcacagctgtatctctgagt

SEQ ID NO: 16217 - DNA, 25 bp, Mus musculus
cagtggcatatgtgggcaaagagca

SEQ ID NO: 16218 - DNA, 25 bp, Mus musculus
cagtggcatctgtatcattgtgggc

SEQ ID NO: 16219 - DNA, 25 bp, Mus musculus
cagtggcatcttcaggagccctggt

SEQ ID NO: 16220 - DNA, 25 bp, Mus musculus
cagtggcatgaagatattactcagg

SEQ ID NO: 16221 - DNA, 25 bp, Mus musculus
cagtggcatgctcccagttccattg

SEQ ID NO: 16222 - DNA, 25 bp, Mus musculus
cagtggcattgggaagtgcattgct

SEQ ID NO: 16223 - DNA, 25 bp, Mus musculus
cagtggcctggcctatctgaatggt

SEQ ID NO: 16224 - DNA, 25 bp, Mus musculus
cagtggctgaagaagtgtctctatt

SEQ ID NO: 16225 - DNA, 25 bp, Mus musculus
cagtggctgctgtattgacatagcg

SEQ ID NO: 16226 - DNA, 25 bp, Mus musculus
cagtggctgtaagaaatccaggagg

SEQ ID NO: 16227 - DNA, 25 bp, Mus musculus
cagtggcttatttatcggcctggct

SEQ ID NO: 16228 - DNA, 25 bp, Mus musculus
cagtgggaaacattatggcatctat

SEQ ID NO: 16229 - DNA, 25 bp, Mus musculus
cagtgggaaagaaataaagtggagc

SEQ ID NO: 16230 - DNA, 25 bp, Mus musculus
cagtgggaactacaagaaaggagaa

SEQ ID NO: 16231 - DNA, 25 bp, Mus musculus
cagtgggaactagaagaaaggagaa

SEQ ID NO: 16232 - DNA, 25 bp, Mus musculus
cagtgggaactgtcaccacccttac

SEQ ID NO: 16233 - DNA, 25 bp, Mus musculus
cagtgggaagccctctggatcagca

SEQ ID NO: 16234 - DNA, 25 bp, Mus musculus
cagtgggaatcgataaagacaaacc

SEQ ID NO: 16235 - DNA, 25 bp, Mus musculus
cagtgggaatgacctgactaacttc

SEQ ID NO: 16236 - DNA, 25 bp, Mus musculus
cagtgggacctcttcggttctcagc

SEQ ID NO: 16237 - DNA, 25 bp, Mus musculus
cagtgggacgcacattctaatgata

SEQ ID NO: 16238 - DNA, 25 bp, Mus musculus
cagtgggactggttcgggcctacca

SEQ ID NO: 16239 - DNA, 25 bp, Mus musculus
cagtgggagacatttagtgaacgct

SEQ ID NO: 16240 - DNA, 25 bp, Mus musculus
cagtgggagagtttttgtggaatac

SEQ ID NO: 16241 - DNA, 25 bp, Mus musculus
cagtgggatctgtcagagcagagac

SEQ ID NO: 16242 - DNA, 25 bp, Mus musculus
cagtgggattatgaatgcgagccag

SEQ ID NO: 16243 - DNA, 25 bp, Mus musculus
cagtgggcagaattccagatgcaga

SEQ ID NO: 16244 - DNA, 25 bp, Mus musculus
cagtgggctgtactctgccctgtac

SEQ ID NO: 16245 - DNA, 25 bp, Mus musculus
cagtgggtcagcgtgacttatggca

SEQ ID NO: 16246 - DNA, 25 bp, Mus musculus
cagtggtacttggtcaagatcgcca

SEQ ID NO: 16247 - DNA, 25 bp, Mus musculus
cagtggtagcagctacagtggctcc

SEQ ID NO: 16248 - DNA, 25 bp, Mus musculus
cagtggtcatttcagatgcgattca

SEQ ID NO: 16249 - DNA, 25 bp, Mus musculus
cagtggtccagaatcttttactgtc

SEQ ID NO: 16250 - DNA, 25 bp, Mus musculus
cagtggtccagatatgaagtttgca

SEQ ID NO: 16251 - DNA, 25 bp, Mus musculus
cagtggtcctccattcgccttcgga

SEQ ID NO: 16252 - DNA, 25 bp, Mus musculus
cagtggtccttcagcaccatcagca

SEQ ID NO: 16253 - DNA, 25 bp, Mus musculus
cagtggtcgactgccatcatttggc

SEQ ID NO: 16254 - DNA, 25 bp, Mus musculus
cagtggtctgtatcctggagattgt

SEQ ID NO: 16255 - DNA, 25 bp, Mus musculus
cagtggtgaccagaagccaacttca

SEQ ID NO: 16256 - DNA, 25 bp, Mus musculus
cagtggtgacgttctctatgacaaa

SEQ ID NO: 16257 - DNA, 25 bp, Mus musculus
cagtggtggcatcaggccttctaca

SEQ ID NO: 16258 - DNA, 25 bp, Mus musculus
cagtggttgggaggtcgacaaatca

SEQ ID NO: 16259 - DNA, 25 bp, Mus musculus
cagtgtaaaccccagctacctggtg

SEQ ID NO: 16260 - DNA, 25 bp, Mus musculus
cagtgtaaacccgagctacctggtg

SEQ ID NO: 16261 - DNA, 25 bp, Mus musculus
cagtgtaactccttcaagactggag

SEQ ID NO: 16262 - DNA, 25 bp, Mus musculus
cagtgtatgaagaccaactagcaaa

SEQ ID NO: 16263 - DNA, 25 bp, Mus musculus
cagtgtatggcaataaattgctaca

SEQ ID NO: 16264 - DNA, 25 bp, Mus musculus
cagtgtattctaaaaagggactgga

SEQ ID NO: 16265 - DNA, 25 bp, Mus musculus
cagtgtcaacgtgaggctggaagac

SEQ ID NO: 16266 - DNA, 25 bp, Mus musculus
cagtgtcaaggtggaaggaaacagc

SEQ ID NO: 16267 - DNA, 25 bp, Mus musculus
cagtgtcaccccatgttgcaagcac

SEQ ID NO: 16268 - DNA, 25 bp, Mus musculus
cagtgtcattgaagaagtgattcgg

SEQ ID NO: 16269 - DNA, 25 bp, Mus musculus
cagtgtcctcagtcacacgatattg

SEQ ID NO: 16270 - DNA, 25 bp, Mus musculus
cagtgtcgtatagactagaagactt

SEQ ID NO: 16271 - DNA, 25 bp, Mus musculus
cagtgtctcactgacaagggagagg

SEQ ID NO: 16272 - DNA, 25 bp, Mus musculus
cagtgtctgaaggataaccacgaca

SEQ ID NO: 16273 - DNA, 25 bp, Mus musculus
cagtgtctgcctctctcattgcaaa

SEQ ID NO: 16274 - DNA, 25 bp, Mus musculus
cagtgtcttagtgcagaggctctgc

SEQ ID NO: 16275 - DNA, 25 bp, Mus musculus
cagtgtgaagcgcatgacgcctgac

SEQ ID NO: 16276 - DNA, 25 bp, Mus musculus
cagtgtgaagcggatgacgcctgac

SEQ ID NO: 16277 - DNA, 25 bp, Mus musculus
cagtgtgaggcagtcgtgcgctttc

SEQ ID NO: 16278 - DNA, 25 bp, Mus musculus
cagtgtgatccctgtataccaggca

SEQ ID NO: 16279 - DNA, 25 bp, Mus musculus
cagtgtgatgcatgtaaagccttgt

SEQ ID NO: 16280 - DNA, 25 bp, Mus musculus
cagtgtgattgtactcgcacgggct

SEQ ID NO: 16281 - DNA, 25 bp, Mus musculus
cagtgtgattgttctcgcacgggct

SEQ ID NO: 16282 - DNA, 25 bp, Mus musculus
cagtgtgcaaggaaaatacttaaca

SEQ ID NO: 16283 - DNA, 25 bp, Mus musculus
cagtgtgcaaggtaaatacttaaca

SEQ ID NO: 16284 - DNA, 25 bp, Mus musculus
cagtgtgcgtgtttttgacttccta

SEQ ID NO: 16285 - DNA, 25 bp, Mus musculus
cagtgtggccagaggcatcttaagt

SEQ ID NO: 16286 - DNA, 25 bp, Mus musculus
cagtgtggtcacgtgtccatgtggc

SEQ ID NO: 16287 - DNA, 25 bp, Mus musculus
cagtgtggttgagcagcactgccag

SEQ ID NO: 16288 - DNA, 25 bp, Mus musculus
cagtgtgtaatccagactggccttc

SEQ ID NO: 16289 - DNA, 25 bp, Mus musculus
cagtgtgtacagatgaacgatgtca

SEQ ID NO: 16290 - DNA, 25 bp, Mus musculus
cagtgtgtcagattactagagtcta

SEQ ID NO: 16291 - DNA, 25 bp, Mus musculus
cagtgtgtctccctgctgcgggaca

SEQ ID NO: 16292 - DNA, 25 bp, Mus musculus
cagtgtgtctggtaaatgagttagc

SEQ ID NO: 16293 - DNA, 25 bp, Mus musculus
cagtgtgtgaagaaacactaaagac

SEQ ID NO: 16294 - DNA, 25 bp, Mus musculus
cagtgtgtgtgcaaccagggttaca

SEQ ID NO: 16295 - DNA, 25 bp, Mus musculus
cagtgttaaaactgaacgagcaggg

SEQ ID NO: 16296 - DNA, 25 bp, Mus musculus
cagtgttatactcgtgccatccaga

SEQ ID NO: 16297 - DNA, 25 bp, Mus musculus
cagtgttcatcctcttcaccttgga

SEQ ID NO: 16298 - DNA, 25 bp, Mus musculus
cagtgttccaggaccagtatggcga

SEQ ID NO: 16299 - DNA, 25 bp, Mus musculus
cagtgttgccagtcaatggctagat

SEQ ID NO: 16300 - DNA, 25 bp, Mus musculus
cagtgttgctgctcccagacaagaa

SEQ ID NO: 16301 - DNA, 25 bp, Mus musculus
cagtgttgggcttcgccggctgcat

SEQ ID NO: 16302 - DNA, 25 bp, Mus musculus
cagtgttgtgcatcctcagttatga

SEQ ID NO: 16303 - DNA, 25 bp, Mus musculus
cagtgttgtggtctccttcttcctc

SEQ ID NO: 16304 - DNA, 25 bp, Mus musculus
cagtgttgttggctactgtatgccc

SEQ ID NO: 16305 - DNA, 25 bp, Mus musculus
cagtgttgttgggtactgtatgccc

SEQ ID NO: 16306 - DNA, 25 bp, Mus musculus
cagtgttttagcttgtgagagtctc

SEQ ID NO: 16307 - DNA, 25 bp, Mus musculus
cagtgtttttggatcataacatgac

SEQ ID NO: 16308 - DNA, 25 bp, Mus musculus
cagttaactggaagaccaaacaagc

SEQ ID NO: 16309 - DNA, 25 bp, Mus musculus
cagttaagaataatggatcagacct

SEQ ID NO: 16310 - DNA, 25 bp, Mus musculus
cagttaagcaggctccacggaagtg

SEQ ID NO: 16311 - DNA, 25 bp, Mus musculus
cagttaaggaggatacactttccac

SEQ ID NO: 16312 - DNA, 25 bp, Mus musculus
cagttaaggcgacgtcttcatgaag

SEQ ID NO: 16313 - DNA, 25 bp, Mus musculus
cagttacaaggaattcagattcagg

SEQ ID NO: 16314 - DNA, 25 bp, Mus musculus
cagttacatggaatgtgagaggcac

SEQ ID NO: 16315 - DNA, 25 bp, Mus musculus
cagttacctttaatgggatttgtgg

SEQ ID NO: 16316 - DNA, 25 bp, Mus musculus
cagttactaccagaagtctgagaag

SEQ ID NO: 16317 - DNA, 25 bp, Mus musculus
cagttactgccttggagccaggctg

SEQ ID NO: 16318 - DNA, 25 bp, Mus musculus
cagttagaggacaacctgcaagagt

SEQ ID NO: 16319 - DNA, 25 bp, Mus musculus
cagttagaggcttgtggaatgagaa

SEQ ID NO: 16320 - DNA, 25 bp, Mus musculus
cagttataaaactggcccacaccta

SEQ ID NO: 16321 - DNA, 25 bp, Mus musculus
cagttatatagcaagcttacagtaa

SEQ ID NO: 16322 - DNA, 25 bp, Mus musculus
cagttatatcgatctgctaaacaca

SEQ ID NO: 16323 - DNA, 25 bp, Mus musculus
cagttatcacgaccctcaagggaca

SEQ ID NO: 16324 - DNA, 25 bp, Mus musculus
cagttatctgaggtgatggtacatc

SEQ ID NO: 16325 - DNA, 25 bp, Mus musculus
cagttatgatggctttggacccttc

SEQ ID NO: 16326 - DNA, 25 bp, Mus musculus
cagttattcattagtccaagtgtcc

SEQ ID NO: 16327 - DNA, 25 bp, Mus musculus
cagttattcatttgtccaagtgtcc

SEQ ID NO: 16328 - DNA, 25 bp, Mus musculus
cagttcaaactctgttgtccttggg

SEQ ID NO: 16329 - DNA, 25 bp, Mus musculus
cagttcaagcaccatggctcaggcc

SEQ ID NO: 16330 - DNA, 25 bp, Mus musculus
cagttcaccgggacctggaagccca

SEQ ID NO: 16331 - DNA, 25 bp, Mus musculus
cagttcagacaaggcccctgtggtg

SEQ ID NO: 16332 - DNA, 25 bp, Mus musculus
cagttcagctgtacagaagcagtga

SEQ ID NO: 16333 - DNA, 25 bp, Mus musculus
cagttcatccatctattatgccgag

SEQ ID NO: 16334 - DNA, 25 bp, Mus musculus
cagttcattccatcagagttcagag

SEQ ID NO: 16335 - DNA, 25 bp, Mus musculus
cagttccaagaaaggttaccaagtg

SEQ ID NO: 16336 - DNA, 25 bp, Mus musculus
cagttccacttcaccaacagagact

SEQ ID NO: 16337 - DNA, 25 bp, Mus musculus
cagttccataagcagattgctgtca

SEQ ID NO: 16338 - DNA, 25 bp, Mus musculus
cagttcccgagagcatagtcaagag

SEQ ID NO: 16339 - DNA, 25 bp, Mus musculus
cagttccctcttcaggacagagcca

SEQ ID NO: 16340 - DNA, 25 bp, Mus musculus
cagttccctggcttttccttcctgg

SEQ ID NO: 16341 - DNA, 25 bp, Mus musculus
cagttcgccagccaagccaatatgg

SEQ ID NO: 16342 - DNA, 25 bp, Mus musculus
cagttcgggaagactttaggaggat

SEQ ID NO: 16343 - DNA, 25 bp, Mus musculus
cagttcgtgaggtggccttgttaag

SEQ ID NO: 16344 - DNA, 25 bp, Mus musculus
cagttctaccatccagatcagaaag

SEQ ID NO: 16345 - DNA, 25 bp, Mus musculus
cagttctcactatggcagctctagg

SEQ ID NO: 16346 - DNA, 25 bp, Mus musculus
cagttctcaggattcagaccaaaga

SEQ ID NO: 16347 - DNA, 25 bp, Mus musculus
cagttctctttcctttgatggtggc

SEQ ID NO: 16348 - DNA, 25 bp, Mus musculus
cagttctgagaagaagtgaaaagtt

SEQ ID NO: 16349 - DNA, 25 bp, Mus musculus
cagttctgcagtccaccaatcgcaa

SEQ ID NO: 16350 - DNA, 25 bp, Mus musculus
cagttctgctcacctgtgaatgaga

SEQ ID NO: 16351 - DNA, 25 bp, Mus musculus
cagttctgctgagggcagctttgct

SEQ ID NO: 16352 - DNA, 25 bp, Mus musculus
cagttctgggtaaatctgctgttcc

SEQ ID NO: 16353 - DNA, 25 bp, Mus musculus
cagttctgttatttattgaatgacc

SEQ ID NO: 16354 - DNA, 25 bp, Mus musculus
cagttcttcaaccaccacatgttcg

SEQ ID NO: 16355 - DNA, 25 bp, Mus musculus
cagttcttgtctgttcagaaggccc

SEQ ID NO: 16356 - DNA, 25 bp, Mus musculus
cagttcttgtttagagctccgggca

SEQ ID NO: 16357 - DNA, 25 bp, Mus musculus
cagttgaacatatgacctgattcca

SEQ ID NO: 16358 - DNA, 25 bp, Mus musculus
cagttgaaccctgaggtgacgcaga

SEQ ID NO: 16359 - DNA, 25 bp, Mus musculus
cagttgaactgaaggtattctggga

SEQ ID NO: 16360 - DNA, 25 bp, Mus musculus
cagttgaagctcattttaagactcg

SEQ ID NO: 16361 - DNA, 25 bp, Mus musculus
cagttgaatcacagcaggatcgaag

SEQ ID NO: 16362 - DNA, 25 bp, Mus musculus
cagttgaatcaggaggtaggagcca

SEQ ID NO: 16363 - DNA, 25 bp, Mus musculus
cagttgaccttcaacatggaggctg

SEQ ID NO: 16364 - DNA, 25 bp, Mus musculus
cagttgagatggacattcaggctgc

SEQ ID NO: 16365 - DNA, 25 bp, Mus musculus
cagttgagcatgactccagagtggt

SEQ ID NO: 16366 - DNA, 25 bp, Mus musculus
cagttgatggccttgttagcatggg

SEQ ID NO: 16367 - DNA, 25 bp, Mus musculus
cagttgcacctaagtcaggagggac

SEQ ID NO: 16368 - DNA, 25 bp, Mus musculus
cagttgcactgaggagccagaggaa

SEQ ID NO: 16369 - DNA, 25 bp, Mus musculus
cagttgcagaagttgggcctaccac

SEQ ID NO: 16370 - DNA, 25 bp, Mus musculus
cagttgcagagggaactttctcaag

SEQ ID NO: 16371 - DNA, 25 bp, Mus musculus
cagttgcagccccaacctgtttgtc

SEQ ID NO: 16372 - DNA, 25 bp, Mus musculus
cagttgcaggaagcaatcgagcatt

SEQ ID NO: 16373 - DNA, 25 bp, Mus musculus
cagttgccagattgcctcaaaggtt

SEQ ID NO: 16374 - DNA, 25 bp, Mus musculus
cagttgccctcggactatccaagta

SEQ ID NO: 16375 - DNA, 25 bp, Mus musculus
cagttgccgggactgtatccagtcg

SEQ ID NO: 16376 - DNA, 25 bp, Mus musculus
cagttgcgtgatgcaaagaacttaa

SEQ ID NO: 16377 - DNA, 25 bp, Mus musculus
cagttgctactaacagagggtcctc

SEQ ID NO: 16378 - DNA, 25 bp, Mus musculus
cagttggagaatggttgcaagctat

SEQ ID NO: 16379 - DNA, 25 bp, Mus musculus
cagttggagggaagtgcctgttacc

SEQ ID NO: 16380 - DNA, 25 bp, Mus musculus
cagttggatcttttacttcgtggct

SEQ ID NO: 16381 - DNA, 25 bp, Mus musculus
cagttggatgaaaggctgcaggagc

SEQ ID NO: 16382 - DNA, 25 bp, Mus musculus
cagttggcacaatagacgtttctta

SEQ ID NO: 16383 - DNA, 25 bp, Mus musculus
cagttggctaaatctgagctgttca

SEQ ID NO: 16384 - DNA, 25 bp, Mus musculus
cagttggctgaaatgcttcctggag

SEQ ID NO: 16385 - DNA, 25 bp, Mus musculus
cagttgggaatactcacagtgcagt

SEQ ID NO: 16386 - DNA, 25 bp, Mus musculus
cagttgggaatagtcacagtgcagt

SEQ ID NO: 16387 - DNA, 25 bp, Mus musculus
cagttgggttcaaccaatgggaagc

SEQ ID NO: 16388 - DNA, 25 bp, Mus musculus
cagttggtaaagaaagggaagagca

SEQ ID NO: 16389 - DNA, 25 bp, Mus musculus
cagttggtgcccattcctttggttg

SEQ ID NO: 16390 - DNA, 25 bp, Mus musculus
cagttgtacaacagacgatctctgg

SEQ ID NO: 16391 - DNA, 25 bp, Mus musculus
cagttgtagtatgggatgctagtac

SEQ ID NO: 16392 - DNA, 25 bp, Mus musculus
cagttgtcagagtcattaaccccgg

SEQ ID NO: 16393 - DNA, 25 bp, Mus musculus
cagttgtggcacaggaggtctgaac

SEQ ID NO: 16394 - DNA, 25 bp, Mus musculus
cagttgtggccagctttgtttcata

SEQ ID NO: 16395 - DNA, 25 bp, Mus musculus
cagttgttaaagcaagttgaggcac

SEQ ID NO: 16396 - DNA, 25 bp, Mus musculus
cagttgttcgaagctattgtgggca

SEQ ID NO: 16397 - DNA, 25 bp, Mus musculus
cagttgtttagactgccgtctgcac

SEQ ID NO: 16398 - DNA, 25 bp, Mus musculus
cagtttaactgtctcagaagggacc

SEQ ID NO: 16399 - DNA, 25 bp, Mus musculus
cagtttaactgtgtcagaagggacc

SEQ ID NO: 16400 - DNA, 25 bp, Mus musculus
cagtttacaaagaaaatggattctc

SEQ ID NO: 16401 - DNA, 25 bp, Mus musculus
cagtttacagtcatcacatgtcccc

SEQ ID NO: 16402 - DNA, 25 bp, Mus musculus
cagtttagatcttggaggcatatca

SEQ ID NO: 16403 - DNA, 25 bp, Mus musculus
cagtttaggacactgcatttactca

SEQ ID NO: 16404 - DNA, 25 bp, Mus musculus
cagtttatctcacagacagcctgag

SEQ ID NO: 16405 - DNA, 25 bp, Mus musculus
cagtttatgaaacatactgatcctc

SEQ ID NO: 16406 - DNA, 25 bp, Mus musculus
cagtttatggtttccaatggaggca

SEQ ID NO: 16407 - DNA, 25 bp, Mus musculus
cagtttatgtcggagggatcagacg

SEQ ID NO: 16408 - DNA, 25 bp, Mus musculus
cagtttattatggaaatggccaaaa

SEQ ID NO: 16409 - DNA, 25 bp, Mus musculus
cagtttcaacagaaggcgcaaatac

SEQ ID NO: 16410 - DNA, 25 bp, Mus musculus
cagtttcaacgagggcctgctgcca

SEQ ID NO: 16411 - DNA, 25 bp, Mus musculus
cagtttccaccatgaatctttcgaa

SEQ ID NO: 16412 - DNA, 25 bp, Mus musculus
cagtttccaggcagaggaatatggg

SEQ ID NO: 16413 - DNA, 25 bp, Mus musculus
cagtttccatgaaatctgcctatgg

SEQ ID NO: 16414 - DNA, 25 bp, Mus musculus
cagtttccatgatatctgcctatgg

SEQ ID NO: 16415 - DNA, 25 bp, Mus musculus
cagtttcccttgtgggaatccttga

SEQ ID NO: 16416 - DNA, 25 bp, Mus musculus
cagtttcctcaaatggtcaccgacc

SEQ ID NO: 16417 - DNA, 25 bp, Mus musculus
cagtttcgaattcaaagcattgtaa

SEQ ID NO: 16418 - DNA, 25 bp, Mus musculus
cagtttcggaagaatgatggctcct

SEQ ID NO: 16419 - DNA, 25 bp, Mus musculus
cagtttctgctagatgactcagaag

SEQ ID NO: 16420 - DNA, 25 bp, Mus musculus
cagtttcttcatgaatgtagtccca

SEQ ID NO: 16421 - DNA, 25 bp, Mus musculus
cagtttcttctgaagtgcaatcaac

SEQ ID NO: 16422 - DNA, 25 bp, Mus musculus
cagtttcttctgttcaagttgcaaa

SEQ ID NO: 16423 - DNA, 25 bp, Mus musculus
cagtttcttgtgtatcagatgttga

SEQ ID NO: 16424 - DNA, 25 bp, Mus musculus
cagtttgaaaggctagctctcattt

SEQ ID NO: 16425 - DNA, 25 bp, Mus musculus
cagtttgaagatattatgaccaatc

SEQ ID NO: 16426 - DNA, 25 bp, Mus musculus
cagtttgacctaatagatgaatcca

SEQ ID NO: 16427 - DNA, 25 bp, Mus musculus
cagtttgagcacctggaccctcaga

SEQ ID NO: 16428 - DNA, 25 bp, Mus musculus
cagtttgagtcctacaggacctgga

SEQ ID NO: 16429 - DNA, 25 bp, Mus musculus
cagtttgattgcttctatagccagc

SEQ ID NO: 16430 - DNA, 25 bp, Mus musculus
cagtttgctgtgcacttgatgccac

SEQ ID NO: 16431 - DNA, 25 bp, Mus musculus
cagtttgcttccagcctcccttgtt

SEQ ID NO: 16432 - DNA, 25 bp, Mus musculus
cagtttggcgacattagcagattca

SEQ ID NO: 16433 - DNA, 25 bp, Mus musculus
cagtttgggctgataaactcccatg

SEQ ID NO: 16434 - DNA, 25 bp, Mus musculus
cagtttggtcaaaggataatctcta

SEQ ID NO: 16435 - DNA, 25 bp, Mus musculus
cagtttgtcacacagtatcagcatt

SEQ ID NO: 16436 - DNA, 25 bp, Mus musculus
cagtttgtctgtgcacacacgggta

SEQ ID NO: 16437 - DNA, 25 bp, Mus musculus
cagtttgtgtgctctgacggctcgg

SEQ ID NO: 16438 - DNA, 25 bp, Mus musculus
cagttttctgccagcctgcacgtgg

SEQ ID NO: 16439 - DNA, 25 bp, Mus musculus
cagttttctggtggtctccagcgaa

SEQ ID NO: 16440 - DNA, 25 bp, Mus musculus
cagttttggcttggatcgttatgaa

SEQ ID NO: 16441 - DNA, 25 bp, Mus musculus
cagtttttctcacctcagatgaaga

SEQ ID NO: 16442 - DNA, 25 bp, Mus musculus
cagtttttctcagctcagatgaaga

SEQ ID NO: 16443 - DNA, 25 bp, Mus musculus
cataaaaaccacatcgtgcacaggg

SEQ ID NO: 16444 - DNA, 25 bp, Mus musculus
cataaaacttgaaattctcaacagg

SEQ ID NO: 16445 - DNA, 25 bp, Mus musculus
cataaaagaaatcagtttgacaaag

SEQ ID NO: 16446 - DNA, 25 bp, Mus musculus
cataaaagtctcacttctgaatgcc

SEQ ID NO: 16447 - DNA, 25 bp, Mus musculus
cataaacaagattttgcctcagtac

SEQ ID NO: 16448 - DNA, 25 bp, Mus musculus
cataaaccacgaggatcctaagacg

SEQ ID NO: 16449 - DNA, 25 bp, Mus musculus
cataaaccatccttgctacagccta

SEQ ID NO: 16450 - DNA, 25 bp, Mus musculus
cataaacgactttgggagagagagg

SEQ ID NO: 16451 - DNA, 25 bp, Mus musculus
cataaacgatagtctggaaattaca

SEQ ID NO: 16452 - DNA, 25 bp, Mus musculus
cataaactcattatcagtggattct

SEQ ID NO: 16453 - DNA, 25 bp, Mus musculus
cataaactgtggagccaacgtggac

SEQ ID NO: 16454 - DNA, 25 bp, Mus musculus
cataaagccccgacgtaagttggcg

SEQ ID NO: 16455 - DNA, 25 bp, Mus musculus
cataaagttggagcggatgctcacg

SEQ ID NO: 16456 - DNA, 25 bp, Mus musculus
cataaatacaaacgtgggcaagaag

SEQ ID NO: 16457 - DNA, 25 bp, Mus musculus
cataaatactctgtggcgggtaaaa

SEQ ID NO: 16458 - DNA, 25 bp, Mus musculus
cataaattgcgtagatgtgcttggg

SEQ ID NO: 16459 - DNA, 25 bp, Mus musculus
cataaatttgataccgaggaccatc

SEQ ID NO: 16460 - DNA, 25 bp, Mus musculus
cataacagaatccatgccaccgatg

SEQ ID NO: 16461 - DNA, 25 bp, Mus musculus
cataacatccggtcatcctgggcct

SEQ ID NO: 16462 - DNA, 25 bp, Mus musculus
cataaccgttggataatgtcacatg

SEQ ID NO: 16463 - DNA, 25 bp, Mus musculus
cataacctaactaaaaggtggctca

SEQ ID NO: 16464 - DNA, 25 bp, Mus musculus
cataacggattctaacggaagacac

SEQ ID NO: 16465 - DNA, 25 bp, Mus musculus
cataactcaagtattccacaaggcc

SEQ ID NO: 16466 - DNA, 25 bp, Mus musculus
cataagacagcatctggcatctatt

SEQ ID NO: 16467 - DNA, 25 bp, Mus musculus
cataagatcccactggatgggtagc

SEQ ID NO: 16468 - DNA, 25 bp, Mus musculus
cataagcagattgctgtcatgagag

SEQ ID NO: 16469 - DNA, 25 bp, Mus musculus
cataagcagcatctagccaggcagt

SEQ ID NO: 16470 - DNA, 25 bp, Mus musculus
cataagcagttgcagaagttgggcc

SEQ ID NO: 16471 - DNA, 25 bp, Mus musculus
cataagccagagcatcgttcttcca

SEQ ID NO: 16472 - DNA, 25 bp, Mus musculus
cataagccagaggatcgttcttcca

SEQ ID NO: 16473 - DNA, 25 bp, Mus musculus
cataagcgagtatgaagaggactta

SEQ ID NO: 16474 - DNA, 25 bp, Mus musculus
cataaggagcattatcctgggaata

SEQ ID NO: 16475 - DNA, 25 bp, Mus musculus
cataaggctagaaaatttccatagg

SEQ ID NO: 16476 - DNA, 25 bp, Mus musculus
cataaggctagataatttccatagg

SEQ ID NO: 16477 - DNA, 25 bp, Mus musculus
cataagggacaacctctaccgccat

SEQ ID NO: 16478 - DNA, 25 bp, Mus musculus
cataagggctaaattcatgggttcc

SEQ ID NO: 16479 - DNA, 25 bp, Mus musculus
cataaggtgtacgaacttagccggg

SEQ ID NO: 16480 - DNA, 25 bp, Mus musculus
cataagtgaccgttttggcaggaat

SEQ ID NO: 16481 - DNA, 25 bp, Mus musculus
cataagtgcggagtgccccatgaga

SEQ ID NO: 16482 - DNA, 25 bp, Mus musculus
cataataactggagatactttgagc

SEQ ID NO: 16483 - DNA, 25 bp, Mus musculus
cataatctgtccttcagcattgctg

SEQ ID NO: 16484 - DNA, 25 bp, Mus musculus
cataatctgtctctagtggcacaca

SEQ ID NO: 16485 - DNA, 25 bp, Mus musculus
cataatctgtctgtagtggcacaca

SEQ ID NO: 16486 - DNA, 25 bp, Mus musculus
cataatgacatatgtgtccagcttc

SEQ ID NO: 16487 - DNA, 25 bp, Mus musculus
cataatgcagtcctttgaaaaccca

SEQ ID NO: 16488 - DNA, 25 bp, Mus musculus
cataatgcccgtgtgcgactttggc

SEQ ID NO: 16489 - DNA, 25 bp, Mus musculus
cataatggcttttaatgcagccgat

SEQ ID NO: 16490 - DNA, 25 bp, Mus musculus
cataatgggtgaagacgaattggca

SEQ ID NO: 16491 - DNA, 25 bp, Mus musculus
cataattaaatccagaaggaaaacg

SEQ ID NO: 16492 - DNA, 25 bp, Mus musculus
cataattagtcacagccatgactag

SEQ ID NO: 16493 - DNA, 25 bp, Mus musculus
cataattagtcagagccatgactag

SEQ ID NO: 16494 - DNA, 25 bp, Mus musculus
catacacagactacagtgactcggt

SEQ ID NO: 16495 - DNA, 25 bp, Mus musculus
catacacgttccctgatgcactggt

SEQ ID NO: 16496 - DNA, 25 bp, Mus musculus
catacacttgtggaatctgctctca

SEQ ID NO: 16497 - DNA, 25 bp, Mus musculus
catacagaccgacactgggtggcga

SEQ ID NO: 16498 - DNA, 25 bp, Mus musculus
catacagattctgcgataatgtttg

SEQ ID NO: 16499 - DNA, 25 bp, Mus musculus
catacagccttggagcagatgcgga

SEQ ID NO: 16500 - DNA, 25 bp, Mus musculus
catacaggaacatcatgctatagag

SEQ ID NO: 16501 - DNA, 25 bp, Mus musculus
catacaggaggactcttagccttcc

SEQ ID NO: 16502 - DNA, 25 bp, Mus musculus
catacatcctcagtctgggagtggt

SEQ ID NO: 16503 - DNA, 25 bp, Mus musculus
catacatctggattggactccatga

SEQ ID NO: 16504 - DNA, 25 bp, Mus musculus
catacatctttgaactatgcaagcc

SEQ ID NO: 16505 - DNA, 25 bp, Mus musculus
catacatggttgaaggcggcagttc

SEQ ID NO: 16506 - DNA, 25 bp, Mus musculus
cataccaatgcgtcgctggatgccg

SEQ ID NO: 16507 - DNA, 25 bp, Mus musculus
cataccagaaactgggctgtgtcca

SEQ ID NO: 16508 - DNA, 25 bp, Mus musculus
cataccatccagacactgtttagta

SEQ ID NO: 16509 - DNA, 25 bp, Mus musculus
cataccatgcgttacaaggccctgg

SEQ ID NO: 16510 - DNA, 25 bp, Mus musculus
cataccatgggtcagggttccggac

SEQ ID NO: 16511 - DNA, 25 bp, Mus musculus
catacccagttgagatacttccagg

SEQ ID NO: 16512 - DNA, 25 bp, Mus musculus
catacccctgggtgcagtggacagg

SEQ ID NO: 16513 - DNA, 25 bp, Mus musculus
catacctaataggacaagtggctgc

SEQ ID NO: 16514 - DNA, 25 bp, Mus musculus
catacctagaaactcatcagcacct

SEQ ID NO: 16515 - DNA, 25 bp, Mus musculus
catacctatgacacgtttaaagagg

SEQ ID NO: 16516 - DNA, 25 bp, Mus musculus
catacctgaagtggattttctgtca

SEQ ID NO: 16517 - DNA, 25 bp, Mus musculus
catacctgccttcatgactggaaag

SEQ ID NO: 16518 - DNA, 25 bp, Mus musculus
cataccttatgccttattaggtgga

SEQ ID NO: 16519 - DNA, 25 bp, Mus musculus
cataccttccaactttcactgtgaa

SEQ ID NO: 16520 - DNA, 25 bp, Mus musculus
catacgagccacagctgtcaaagga

SEQ ID NO: 16521 - DNA, 25 bp, Mus musculus
catacgaggaaactacattttctga

SEQ ID NO: 16522 - DNA, 25 bp, Mus musculus
catacgaggagacttctgcatccaa

SEQ ID NO: 16523 - DNA, 25 bp, Mus musculus
catacgataagactgtggccctggg

SEQ ID NO: 16524 - DNA, 25 bp, Mus musculus
catacggaactcatgaagaccccgg

SEQ ID NO: 16525 - DNA, 25 bp, Mus musculus
catacgtgccatgacttctggcaga

SEQ ID NO: 16526 - DNA, 25 bp, Mus musculus
catacgtggacataccaagcgctgg

SEQ ID NO: 16527 - DNA, 25 bp, Mus musculus
catactaactggtgtaaaagagcaa

SEQ ID NO: 16528 - DNA, 25 bp, Mus musculus
catactaccaatcacaggcacgagg

SEQ ID NO: 16529 - DNA, 25 bp, Mus musculus
catactactcattctctgccacaag

SEQ ID NO: 16530 - DNA, 25 bp, Mus musculus
catactcagcagagaaaggttggga

SEQ ID NO: 16531 - DNA, 25 bp, Mus musculus
catactgaattcatcctgtgggtct

SEQ ID NO: 16532 - DNA, 25 bp, Mus musculus
catactgcttggtttcatggttgag

SEQ ID NO: 16533 - DNA, 25 bp, Mus musculus
catactgtatgctgattcgaattgc

SEQ ID NO: 16534 - DNA, 25 bp, Mus musculus
catactgtccatgttgccaactctg

SEQ ID NO: 16535 - DNA, 25 bp, Mus musculus
catacttacggtcctgggaaatgta

SEQ ID NO: 16536 - DNA, 25 bp, Mus musculus
catacttcctgccagtgattgggtt

SEQ ID NO: 16537 - DNA, 25 bp, Mus musculus
catacttctgctaatctgctaatgt

SEQ ID NO: 16538 - DNA, 25 bp, Mus musculus
catagaaaaccacacttgctgggac

SEQ ID NO: 16539 - DNA, 25 bp, Mus musculus
catagaaaaccagacttgctgggac

SEQ ID NO: 16540 - DNA, 25 bp, Mus musculus
catagaaaagcattagcagtcttag

SEQ ID NO: 16541 - DNA, 25 bp, Mus musculus
catagaacagatgtgctatgcccag

SEQ ID NO: 16542 - DNA, 25 bp, Mus musculus
catagaacccgtcgaactgaagtaa

SEQ ID NO: 16543 - DNA, 25 bp, Mus musculus
catagaactaaacccaacccactgg

SEQ ID NO: 16544 - DNA, 25 bp, Mus musculus
catagaactaaagccaacccactgg

SEQ ID NO: 16545 - DNA, 25 bp, Mus musculus
catagaagataatgctacagttttt

SEQ ID NO: 16546 - DNA, 25 bp, Mus musculus
catagaagatgggtccatacaccga

SEQ ID NO: 16547 - DNA, 25 bp, Mus musculus
catagaagctccacagagcagcagc

SEQ ID NO: 16548 - DNA, 25 bp, Mus musculus
catagaagggtcctcagagagcagt

SEQ ID NO: 16549 - DNA, 25 bp, Mus musculus
catagaagttgatgtgccctggagc

SEQ ID NO: 16550 - DNA, 25 bp, Mus musculus
catagaatcaaagcaccgaagcctg

SEQ ID NO: 16551 - DNA, 25 bp, Mus musculus
catagacaagatgcagatgaatacc

SEQ ID NO: 16552 - DNA, 25 bp, Mus musculus
catagacagtgatcaagaagatccc

SEQ ID NO: 16553 - DNA, 25 bp, Mus musculus
catagactgccactggattgatatt

SEQ ID NO: 16554 - DNA, 25 bp, Mus musculus
catagactgccagtggattgatatt

SEQ ID NO: 16555 - DNA, 25 bp, Mus musculus
catagacttgccaagaaaagtgtaa

SEQ ID NO: 16556 - DNA, 25 bp, Mus musculus
catagagaacagcactgacaaccct

SEQ ID NO: 16557 - DNA, 25 bp, Mus musculus
catagagaacgctcatgggcagctg

SEQ ID NO: 16558 - DNA, 25 bp, Mus musculus
catagagaaggagaatgagcgagtc

SEQ ID NO: 16559 - DNA, 25 bp, Mus musculus
catagagacttcttgccatggctgc

SEQ ID NO: 16560 - DNA, 25 bp, Mus musculus
catagagctgttggatgattttgat

SEQ ID NO: 16561 - DNA, 25 bp, Mus musculus
catagaggctactatagaaacagct

SEQ ID NO: 16562 - DNA, 25 bp, Mus musculus
catagaggctcttgtacgcaccgtc

SEQ ID NO: 16563 - DNA, 25 bp, Mus musculus
catagagttaataggaaaccgcaag

SEQ ID NO: 16564 - DNA, 25 bp, Mus musculus
catagatcgcatcgtgggcgacgac

SEQ ID NO: 16565 - DNA, 25 bp, Mus musculus
catagatcgcatggtgggcgacgac

SEQ ID NO: 16566 - DNA, 25 bp, Mus musculus
catagatgaatgagccaatgacact

SEQ ID NO: 16567 - DNA, 25 bp, Mus musculus
catagatgaatgtgccaatgacact

SEQ ID NO: 16568 - DNA, 25 bp, Mus musculus
catagatgaggtgtccctgagcgcc

SEQ ID NO: 16569 - DNA, 25 bp, Mus musculus
catagatgctactggcttagatgca

SEQ ID NO: 16570 - DNA, 25 bp, Mus musculus
catagatgctgcagaggaggctttt

SEQ ID NO: 16571 - DNA, 25 bp, Mus musculus
catagatgtgccagtctgggtgcca

SEQ ID NO: 16572 - DNA, 25 bp, Mus musculus
catagattttggtggcaagtttcac

SEQ ID NO: 16573 - DNA, 25 bp, Mus musculus
catagcaagctgtctgtgatccaca

SEQ ID NO: 16574 - DNA, 25 bp, Mus musculus
catagcagaaaagctgacatgttgg

SEQ ID NO: 16575 - DNA, 25 bp, Mus musculus
catagcatggtcatccactcacatc

SEQ ID NO: 16576 - DNA, 25 bp, Mus musculus
catagccaggagttcacatctcggg

SEQ ID NO: 16577 - DNA, 25 bp, Mus musculus
catagcccctcctcatctgtgatgg

SEQ ID NO: 16578 - DNA, 25 bp, Mus musculus
catagccggtgcaagcaaaaaccag

SEQ ID NO: 16579 - DNA, 25 bp, Mus musculus
catagctctgtttcatttgctggcc

SEQ ID NO: 16580 - DNA, 25 bp, Mus musculus
catagctggacagagcatcggaggc

SEQ ID NO: 16581 - DNA, 25 bp, Mus musculus
catagctgtcttccagccgcctgtt

SEQ ID NO: 16582 - DNA, 25 bp, Mus musculus
cataggaatggcctgtaggcctttt

SEQ ID NO: 16583 - DNA, 25 bp, Mus musculus
cataggacttgaatgtgacagagta

SEQ ID NO: 16584 - DNA, 25 bp, Mus musculus
cataggcaatgccatgtttattgaa

SEQ ID NO: 16585 - DNA, 25 bp, Mus musculus
cataggtgtcctggacattgccggc

SEQ ID NO: 16586 - DNA, 25 bp, Mus musculus
catagtaaaagatagttctgctgcc

SEQ ID NO: 16587 - DNA, 25 bp, Mus musculus
catagtagcaagtcctctggtagga

SEQ ID NO: 16588 - DNA, 25 bp, Mus musculus
catagtcaattacttcatgtacgtc

SEQ ID NO: 16589 - DNA, 25 bp, Mus musculus
catagtcacattaccatgcctaggt

SEQ ID NO: 16590 - DNA, 25 bp, Mus musculus
catagtcagcacgaagactggttta

SEQ ID NO: 16591 - DNA, 25 bp, Mus musculus
catagtgaagatacccacgtgcgtt

SEQ ID NO: 16592 - DNA, 25 bp, Mus musculus
catagtgaagattcccacgtgcgtt

SEQ ID NO: 16593 - DNA, 25 bp, Mus musculus
catagtgagtctgcttccagtagac

SEQ ID NO: 16594 - DNA, 25 bp, Mus musculus
catagtgatgatctttgttgtggaa

SEQ ID NO: 16595 - DNA, 25 bp, Mus musculus
catagtggcctcgtgaccttccaag

SEQ ID NO: 16596 - DNA, 25 bp, Mus musculus
catagtgggacaccatgaagtacag

SEQ ID NO: 16597 - DNA, 25 bp, Mus musculus
catagtgtcgacagtgattccttgt

SEQ ID NO: 16598 - DNA, 25 bp, Mus musculus
catagtgtggccttcatcgtcctca

SEQ ID NO: 16599 - DNA, 25 bp, Mus musculus
catagttcccatagccccgagaaag

SEQ ID NO: 16600 - DNA, 25 bp, Mus musculus
catagttcgagatcacttgggcgac

SEQ ID NO: 16601 - DNA, 25 bp, Mus musculus
catagttcttctcgtccaagcagtc

SEQ ID NO: 16602 - DNA, 25 bp, Mus musculus
catagttggtcttggtggaaaagca

SEQ ID NO: 16603 - DNA, 25 bp, Mus musculus
catagtttgggactgactggcattc

SEQ ID NO: 16604 - DNA, 25 bp, Mus musculus
catataaacagtcaagtctccattg

SEQ ID NO: 16605 - DNA, 25 bp, Mus musculus
catataaacagtgaagtctccattg

SEQ ID NO: 16606 - DNA, 25 bp, Mus musculus
catatacaggtcttagcaagaaaga

SEQ ID NO: 16607 - DNA, 25 bp, Mus musculus
catatacttggaatacaaaggagga

SEQ ID NO: 16608 - DNA, 25 bp, Mus musculus
catatagggcggatgtcagagacta

SEQ ID NO: 16609 - DNA, 25 bp, Mus musculus
catatagggcggttgtcagagacta

SEQ ID NO: 16610 - DNA, 25 bp, Mus musculus
catatagtatttcttggtagccctg

SEQ ID NO: 16611 - DNA, 25 bp, Mus musculus
catatatactgatagcagtttgccc

SEQ ID NO: 16612 - DNA, 25 bp, Mus musculus
catatatgcttgagtgctctgcagc

SEQ ID NO: 16613 - DNA, 25 bp, Mus musculus
catatcaactatggaaatggaacaa

SEQ ID NO: 16614 - DNA, 25 bp, Mus musculus
catatcaatggagcaagtcacagtc

SEQ ID NO: 16615 - DNA, 25 bp, Mus musculus
catatcaccgttggccatgagacag

SEQ ID NO: 16616 - DNA, 25 bp, Mus musculus
catatcatgaaaagaaagtttacca

SEQ ID NO: 16617 - DNA, 25 bp, Mus musculus
catatcatgaagtgggtcagtgacg

SEQ ID NO: 16618 - DNA, 25 bp, Mus musculus
catatccacgtttgctaatccatca

SEQ ID NO: 16619 - DNA, 25 bp, Mus musculus
catatccagatcaccagagaagatg

SEQ ID NO: 16620 - DNA, 25 bp, Mus musculus
catatccagcagtaccatatggaag

SEQ ID NO: 16621 - DNA, 25 bp, Mus musculus
catatccatcattgtgacagaccag

SEQ ID NO: 16622 - DNA, 25 bp, Mus musculus
catatccccaagtgggaactgtttc

SEQ ID NO: 16623 - DNA, 25 bp, Mus musculus
catatccccggccagatgttcatct

SEQ ID NO: 16624 - DNA, 25 bp, Mus musculus
catatcctgtggcatgtgggactct

SEQ ID NO: 16625 - DNA, 25 bp, Mus musculus
catatccttcagtggcatagagtca

SEQ ID NO: 16626 - DNA, 25 bp, Mus musculus
catatctctgcccttacttgtgatg

SEQ ID NO: 16627 - DNA, 25 bp, Mus musculus
catatctgctttccgtctggacaca

SEQ ID NO: 16628 - DNA, 25 bp, Mus musculus
catatcttactgtcggagcagcggt

SEQ ID NO: 16629 - DNA, 25 bp, Mus musculus
catatgaagataaaagggctgttgt

SEQ ID NO: 16630 - DNA, 25 bp, Mus musculus
catatgaagcctgcacctgtaggct

SEQ ID NO: 16631 - DNA, 25 bp, Mus musculus
catatgaattctgttatggacgtca

SEQ ID NO: 16632 - DNA, 25 bp, Mus musculus
catatgacactccaaaaccagcggg

SEQ ID NO: 16633 - DNA, 25 bp, Mus musculus
catatgactacacacagctgcaggg

SEQ ID NO: 16634 - DNA, 25 bp, Mus musculus
catatgactgccctccacggtagat

SEQ ID NO: 16635 - DNA, 25 bp, Mus musculus
catatgagagcgagccttggaagta

SEQ ID NO: 16636 - DNA, 25 bp, Mus musculus
catatgatcagcagatatgggaaaa

SEQ ID NO: 16637 - DNA, 25 bp, Mus musculus
catatgatcttggtgctgcggacag

SEQ ID NO: 16638 - DNA, 25 bp, Mus musculus
catatgattgaacatgcacagaaag

SEQ ID NO: 16639 - DNA, 25 bp, Mus musculus
catatgcacaataagaagcacacac

SEQ ID NO: 16640 - DNA, 25 bp, Mus musculus
catatgccactggacagggagaaga

SEQ ID NO: 16641 - DNA, 25 bp, Mus musculus
catatgccccagagtgatatagctg

SEQ ID NO: 16642 - DNA, 25 bp, Mus musculus
catatgccccagtgtgatatagctg

SEQ ID NO: 16643 - DNA, 25 bp, Mus musculus
catatgcctggacacagccaaggat

SEQ ID NO: 16644 - DNA, 25 bp, Mus musculus
catatgctcggtgtgcaatagaaaa

SEQ ID NO: 16645 - DNA, 25 bp, Mus musculus
catatggaatggtgaagtgtctccc

SEQ ID NO: 16646 - DNA, 25 bp, Mus musculus
catatggatcagaacccatactatg

SEQ ID NO: 16647 - DNA, 25 bp, Mus musculus
catatggctctgaggagtatttgca

SEQ ID NO: 16648 - DNA, 25 bp, Mus musculus
catatggtccctcaccattgggccg

SEQ ID NO: 16649 - DNA, 25 bp, Mus musculus
catatggttccgagtgccctattca

SEQ ID NO: 16650 - DNA, 25 bp, Mus musculus
catatgtccccaaagagtttaaagc

SEQ ID NO: 16651 - DNA, 25 bp, Mus musculus
catatgtcctttcaatggccccatt

SEQ ID NO: 16652 - DNA, 25 bp, Mus musculus
catatgtggacatcaagactggcaa

SEQ ID NO: 16653 - DNA, 25 bp, Mus musculus
catatgtggtttgtaatgcaccaac

SEQ ID NO: 16654 - DNA, 25 bp, Mus musculus
catatgttcagcatctgaggtggag

SEQ ID NO: 16655 - DNA, 25 bp, Mus musculus
catattaagtatggacaacagcagc

SEQ ID NO: 16656 - DNA, 25 bp, Mus musculus
catattcaatccaagtgtggttcca

SEQ ID NO: 16657 - DNA, 25 bp, Mus musculus
catattcgacagtcacacgtgacca

SEQ ID NO: 16658 - DNA, 25 bp, Mus musculus
catattggatacagatgagcaagaa

SEQ ID NO: 16659 - DNA, 25 bp, Mus musculus
catattggctggagtcagttttcat

SEQ ID NO: 16660 - DNA, 25 bp, Mus musculus
catattttaccaaggagaacagctc

SEQ ID NO: 16661 - DNA, 25 bp, Mus musculus
catcaaaaagatggcaaagcaaggc

SEQ ID NO: 16662 - DNA, 25 bp, Mus musculus
catcaaaaatggagtggacgtcaac

SEQ ID NO: 16663 - DNA, 25 bp, Mus musculus
catcaaaatcacagtggacggcccc

SEQ ID NO: 16664 - DNA, 25 bp, Mus musculus
catcaaaattgcttgggaaagccca

SEQ ID NO: 16665 - DNA, 25 bp, Mus musculus
catcaaacacagacaacctgttggg

SEQ ID NO: 16666 - DNA, 25 bp, Mus musculus
catcaaacctgacgcccagagtttg

SEQ ID NO: 16667 - DNA, 25 bp, Mus musculus
catcaaagagcaactggcacctgtt

SEQ ID NO: 16668 - DNA, 25 bp, Mus musculus
catcaaagtaatctcccggaaccgt

SEQ ID NO: 16669 - DNA, 25 bp, Mus musculus
catcaaagtccaacttgtcgaacca

SEQ ID NO: 16670 - DNA, 25 bp, Mus musculus
catcaaatgggtctttggagggcct

SEQ ID NO: 16671 - DNA, 25 bp, Mus musculus
catcaaattcatggcatatgagcag

SEQ ID NO: 16672 - DNA, 25 bp, Mus musculus
catcaaatttgtactcagtggagca

SEQ ID NO: 16673 - DNA, 25 bp, Mus musculus
catcaacaaactgaccctgagcggg

SEQ ID NO: 16674 - DNA, 25 bp, Mus musculus
catcaacaagggtcttgtgagaaag

SEQ ID NO: 16675 - DNA, 25 bp, Mus musculus
catcaacacactgtgcttatgacag

SEQ ID NO: 16676 - DNA, 25 bp, Mus musculus
catcaacacagagttccgacggatt

SEQ ID NO: 16677 - DNA, 25 bp, Mus musculus
catcaacagaaaaaattggtacttc

SEQ ID NO: 16678 - DNA, 25 bp, Mus musculus
catcaacatggctggagagcccaag

SEQ ID NO: 16679 - DNA, 25 bp, Mus musculus
catcaaccagagcagattccagccg

SEQ ID NO: 16680 - DNA, 25 bp, Mus musculus
catcaacctcataaaggatggcggg

SEQ ID NO: 16681 - DNA, 25 bp, Mus musculus
catcaacctgcctgggtggtatcac

SEQ ID NO: 16682 - DNA, 25 bp, Mus musculus
catcaacctggctggagagaatatc

SEQ ID NO: 16683 - DNA, 25 bp, Mus musculus
catcaacgaggtgatagcatccctg

SEQ ID NO: 16684 - DNA, 25 bp, Mus musculus
catcaacgtagaaaatgaggacaca

SEQ ID NO: 16685 - DNA, 25 bp, Mus musculus
catcaacgtcaaggcgctctataat

SEQ ID NO: 16686 - DNA, 25 bp, Mus musculus
catcaactggagtatactcagaaca

SEQ ID NO: 16687 - DNA, 25 bp, Mus musculus
catcaacttcccttctatatcttgg

SEQ ID NO: 16688 - DNA, 25 bp, Mus musculus
catcaagactggctctgagcgtgta

SEQ ID NO: 16689 - DNA, 25 bp, Mus musculus
catcaaggcatatgtcacccggtcc

SEQ ID NO: 16690 - DNA, 25 bp, Mus musculus
catcaagtacattgggatgcggaat

SEQ ID NO: 16691 - DNA, 25 bp, Mus musculus
catcaagtgacaatatcatggtgca

SEQ ID NO: 16692 - DNA, 25 bp, Mus musculus
catcaagtgacactcgtcagggccg

SEQ ID NO: 16693 - DNA, 25 bp, Mus musculus
catcaagtgccctacaaggtgatca

SEQ ID NO: 16694 - DNA, 25 bp, Mus musculus
catcaagtgttgcaggagaaacttc

SEQ ID NO: 16695 - DNA, 25 bp, Mus musculus
catcaagttatcatcaacctgggag

SEQ ID NO: 16696 - DNA, 25 bp, Mus musculus
catcaagttgaactaccaccatttg

SEQ ID NO: 16697 - DNA, 25 bp, Mus musculus
catcaagttgaagtaccaccatttg

SEQ ID NO: 16698 - DNA, 25 bp, Mus musculus
catcaatgcccatgactacagccag

SEQ ID NO: 16699 - DNA, 25 bp, Mus musculus
catcacaaatgcttgaaaactgggt

SEQ ID NO: 16700 - DNA, 25 bp, Mus musculus
catcacaattggctttggacagatc

SEQ ID NO: 16701 - DNA, 25 bp, Mus musculus
catcacagatgccatctcaggactg

SEQ ID NO: 16702 - DNA, 25 bp, Mus musculus
catcacagggtcctttgaccacaca

SEQ ID NO: 16703 - DNA, 25 bp, Mus musculus
catcacattcgggatagggctcaca

SEQ ID NO: 16704 - DNA, 25 bp, Mus musculus
catcaccaagtactccatgcagtca

SEQ ID NO: 16705 - DNA, 25 bp, Mus musculus
catcaccactcaggaggaacacaag

SEQ ID NO: 16706 - DNA, 25 bp, Mus musculus
catcaccagatgttttttggtgcgt

SEQ ID NO: 16707 - DNA, 25 bp, Mus musculus
catcaccggcatatcagggctcaag

SEQ ID NO: 16708 - DNA, 25 bp, Mus musculus
catcacctcgaaagcgccagaaaga

SEQ ID NO: 16709 - DNA, 25 bp, Mus musculus
catcacctgctgctttatgaagagg

SEQ ID NO: 16710 - DNA, 25 bp, Mus musculus
catcaccttgggtccgaaatccaga

SEQ ID NO: 16711 - DNA, 25 bp, Mus musculus
catcacgcagattgtgggccacagc

SEQ ID NO: 16712 - DNA, 25 bp, Mus musculus
catcacgcagctcacacagaagctg

SEQ ID NO: 16713 - DNA, 25 bp, Mus musculus
catcacgcccattttggttctgacc

SEQ ID NO: 16714 - DNA, 25 bp, Mus musculus
catcacgggtggattcaggcaaccc

SEQ ID NO: 16715 - DNA, 25 bp, Mus musculus
catcactcactctttggagatgtga

SEQ ID NO: 16716 - DNA, 25 bp, Mus musculus
catcactgagataaagtctacttgg

SEQ ID NO: 16717 - DNA, 25 bp, Mus musculus
catcactggaaataaggaccagagc

SEQ ID NO: 16718 - DNA, 25 bp, Mus musculus
catcactggcatagttggagacaaa

SEQ ID NO: 16719 - DNA, 25 bp, Mus musculus
catcactgtatgtgtcaagagcaga

SEQ ID NO: 16720 - DNA, 25 bp, Mus musculus
catcactgtggatcagacatggaga

SEQ ID NO: 16721 - DNA, 25 bp, Mus musculus
catcacttagcagtttccctgagtc

SEQ ID NO: 16722 - DNA, 25 bp, Mus musculus
catcagaaaagacatggtcatccta

SEQ ID NO: 16723 - DNA, 25 bp, Mus musculus
catcagaacaccctagaaggcgtgg

SEQ ID NO: 16724 - DNA, 25 bp, Mus musculus
catcagaagttgatattttactgca

SEQ ID NO: 16725 - DNA, 25 bp, Mus musculus
catcagaccatgataggatgggcaa

SEQ ID NO: 16726 - DNA, 25 bp, Mus musculus
catcagacgccacagggcttgatgc

SEQ ID NO: 16727 - DNA, 25 bp, Mus musculus
catcagacgcttcatatatgtgaaa

SEQ ID NO: 16728 - DNA, 25 bp, Mus musculus
catcagagaacgagaacgtattaca

SEQ ID NO: 16729 - DNA, 25 bp, Mus musculus
catcagagacaacaagcagtactgt

SEQ ID NO: 16730 - DNA, 25 bp, Mus musculus
catcagatatacacattgacaatgg

SEQ ID NO: 16731 - DNA, 25 bp, Mus musculus
catcagatatggtatttcttagaac

SEQ ID NO: 16732 - DNA, 25 bp, Mus musculus
catcagatccttcagcattgccaga

SEQ ID NO: 16733 - DNA, 25 bp, Mus musculus
catcagatgaacactgaaagaggag

SEQ ID NO: 16734 - DNA, 25 bp, Mus musculus
catcagatgcaggagggcggtgtga

SEQ ID NO: 16735 - DNA, 25 bp, Mus musculus
catcagatgggcgtagtccatcggg

SEQ ID NO: 16736 - DNA, 25 bp, Mus musculus
catcagatttctgttacgaatgtgt

SEQ ID NO: 16737 - DNA, 25 bp, Mus musculus
catcagcaagattctggaagacttg

SEQ ID NO: 16738 - DNA, 25 bp, Mus musculus
catcagcagcctgcgtgagatcaca

SEQ ID NO: 16739 - DNA, 25 bp, Mus musculus
catcagcagcgcaggccctgctggg

SEQ ID NO: 16740 - DNA, 25 bp, Mus musculus
catcagcatcccacagacactggag

SEQ ID NO: 16741 - DNA, 25 bp, Mus musculus
catcagcatgcgtaagttgggagag

SEQ ID NO: 16742 - DNA, 25 bp, Mus musculus
catcagccaaactcgacaagtaaag

SEQ ID NO: 16743 - DNA, 25 bp, Mus musculus
catcagccgaaagtccagaaatgag

SEQ ID NO: 16744 - DNA, 25 bp, Mus musculus
catcagcctcttcatctacatggtg

SEQ ID NO: 16745 - DNA, 25 bp, Mus musculus
catcagcggggtatcgccctctggg

SEQ ID NO: 16746 - DNA, 25 bp, Mus musculus
catcagcgtctgcaagaaaaatacg

SEQ ID NO: 16747 - DNA, 25 bp, Mus musculus
catcagctaattccctgaaagatga

SEQ ID NO: 16748 - DNA, 25 bp, Mus musculus
catcagctcgagtctctaaaggtct

SEQ ID NO: 16749 - DNA, 25 bp, Mus musculus
catcagctctctgaccttgattggg

SEQ ID NO: 16750 - DNA, 25 bp, Mus musculus
catcagctgtgaacgcgcaggtgct

SEQ ID NO: 16751 - DNA, 25 bp, Mus musculus
catcaggaacgttctgtggacacac

SEQ ID NO: 16752 - DNA, 25 bp, Mus musculus
catcaggccaaatgcaacatctgca

SEQ ID NO: 16753 - DNA, 25 bp, Mus musculus
catcaggctactgggcttgttgaag

SEQ ID NO: 16754 - DNA, 25 bp, Mus musculus
catcaggctgtaaacttcctggctg

SEQ ID NO: 16755 - DNA, 25 bp, Mus musculus
catcagggatgaacatttgagactc

SEQ ID NO: 16756 - DNA, 25 bp, Mus musculus
catcagggctctctgcagaatcaca

SEQ ID NO: 16757 - DNA, 25 bp, Mus musculus
catcagggtttggattgctcatctc

SEQ ID NO: 16758 - DNA, 25 bp, Mus musculus
catcagtaaaaacgagtttgcccag

SEQ ID NO: 16759 - DNA, 25 bp, Mus musculus
catcagtaatggaatcctacgcctt

SEQ ID NO: 16760 - DNA, 25 bp, Mus musculus
catcagtagcatatcttcaaaaaga

SEQ ID NO: 16761 - DNA, 25 bp, Mus musculus
catcagtatcggttgtgatactgcc

SEQ ID NO: 16762 - DNA, 25 bp, Mus musculus
catcagtatgggagaatcaagattc

SEQ ID NO: 16763 - DNA, 25 bp, Mus musculus
catcagtcaaggagaacaaaaatat

SEQ ID NO: 16764 - DNA, 25 bp, Mus musculus
catcagtcgcttggccagctttggg

SEQ ID NO: 16765 - DNA, 25 bp, Mus musculus
catcagtgaagagcctccgtttgct

SEQ ID NO: 16766 - DNA, 25 bp, Mus musculus
catcagtgagctccgccattggtgg

SEQ ID NO: 16767 - DNA, 25 bp, Mus musculus
catcagtggctcctgctggctgcat

SEQ ID NO: 16768 - DNA, 25 bp, Mus musculus
catcagtgggacttgctgcatgcgg

SEQ ID NO: 16769 - DNA, 25 bp, Mus musculus
catcagtgttgccagtcaatggcta

SEQ ID NO: 16770 - DNA, 25 bp, Mus musculus
catcagttctatcttgtgggaaaag

SEQ ID NO: 16771 - DNA, 25 bp, Mus musculus
catcagttcttcagcttcactcaga

SEQ ID NO: 16772 - DNA, 25 bp, Mus musculus
catcataaggatccctaacaggttc

SEQ ID NO: 16773 - DNA, 25 bp, Mus musculus
catcatattttaccaaggagaacag

SEQ ID NO: 16774 - DNA, 25 bp, Mus musculus
catcatcaagaaagtgatcgggcag

SEQ ID NO: 16775 - DNA, 25 bp, Mus musculus
catcatcacttcatcacaagaagaa

SEQ ID NO: 16776 - DNA, 25 bp, Mus musculus
catcatcagtatccttgtctctgcc

SEQ ID NO: 16777 - DNA, 25 bp, Mus musculus
catcatcatgcccttcaaagctgca

SEQ ID NO: 16778 - DNA, 25 bp, Mus musculus
catcatcatgtggaagctgaccaga

SEQ ID NO: 16779 - DNA, 25 bp, Mus musculus
catcatccacgttccagcagaacag

SEQ ID NO: 16780 - DNA, 25 bp, Mus musculus
catcatcctcccacttgggagaatt

SEQ ID NO: 16781 - DNA, 25 bp, Mus musculus
catcatcctccctcttgggagaatt

SEQ ID NO: 16782 - DNA, 25 bp, Mus musculus
catcatctagagatggatggaaggg

SEQ ID NO: 16783 - DNA, 25 bp, Mus musculus
catcatctgcgcttatgtacttcat

SEQ ID NO: 16784 - DNA, 25 bp, Mus musculus
catcatcttatcatttctggcacaa

SEQ ID NO: 16785 - DNA, 25 bp, Mus musculus
catcatcttcatcctgtttggctgt

SEQ ID NO: 16786 - DNA, 25 bp, Mus musculus
catcatcttcatgctgtttggctgt

SEQ ID NO: 16787 - DNA, 25 bp, Mus musculus
catcatcttcgtttctgacagagca

SEQ ID NO: 16788 - DNA, 25 bp, Mus musculus
catcatgacgaagatggacctgctg

SEQ ID NO: 16789 - DNA, 25 bp, Mus musculus
catcatgacttacgtgtcctgcttc

SEQ ID NO: 16790 - DNA, 25 bp, Mus musculus
catcatgagagcaatggctttgcgg

SEQ ID NO: 16791 - DNA, 25 bp, Mus musculus
catcatgagggaattccgatcaggg

SEQ ID NO: 16792 - DNA, 25 bp, Mus musculus
catcatgatagaagaattgtcccat

SEQ ID NO: 16793 - DNA, 25 bp, Mus musculus
catcatgatcatagcaggagtggag

SEQ ID NO: 16794 - DNA, 25 bp, Mus musculus
catcatgattgtgaggagggccatc

SEQ ID NO: 16795 - DNA, 25 bp, Mus musculus
catcatgccccgactgagtgaggag

SEQ ID NO: 16796 - DNA, 25 bp, Mus musculus
catcatgcctccttggattgtagac

SEQ ID NO: 16797 - DNA, 25 bp, Mus musculus
catcatgctaatctgcaatgccaaa

SEQ ID NO: 16798 - DNA, 25 bp, Mus musculus
catcatggactagagtagtggcaag

SEQ ID NO: 16799 - DNA, 25 bp, Mus musculus
catcatggagaatatccgatttggg

SEQ ID NO: 16800 - DNA, 25 bp, Mus musculus
catcatggcacctgcagaagctata

SEQ ID NO: 16801 - DNA, 25 bp, Mus musculus
catcatggctggtttccacagctgc

SEQ ID NO: 16802 - DNA, 25 bp, Mus musculus
catcatgggagaaatgatcaaaggt

SEQ ID NO: 16803 - DNA, 25 bp, Mus musculus
catcatgggcgtcaatgtgggtact

SEQ ID NO: 16804 - DNA, 25 bp, Mus musculus
catcatgtggcactaacacccgttc

SEQ ID NO: 16805 - DNA, 25 bp, Mus musculus
catcatgttgagcatccaagcggga

SEQ ID NO: 16806 - DNA, 25 bp, Mus musculus
catcattcaagtgaagaaaactgac

SEQ ID NO: 16807 - DNA, 25 bp, Mus musculus
catcattccacagaggaaccgaagc

SEQ ID NO: 16808 - DNA, 25 bp, Mus musculus
catcattcccaacgagcgaaaggct

SEQ ID NO: 16809 - DNA, 25 bp, Mus musculus
catcattcgtcctctgcccagagtg

SEQ ID NO: 16810 - DNA, 25 bp, Mus musculus
catcattctggccagtggtggaccc

SEQ ID NO: 16811 - DNA, 25 bp, Mus musculus
catcattgccgagatctggttccca

SEQ ID NO: 16812 - DNA, 25 bp, Mus musculus
catcattggcctttcaggtttccac

SEQ ID NO: 16813 - DNA, 25 bp, Mus musculus
catcattggtatggcagtgggagta

SEQ ID NO: 16814 - DNA, 25 bp, Mus musculus
catcattgtcatggccaatggccaa

SEQ ID NO: 16815 - DNA, 25 bp, Mus musculus
catcattgtgacagaccagaatgac

SEQ ID NO: 16816 - DNA, 25 bp, Mus musculus
catcattgttcaagactggtctgcc

SEQ ID NO: 16817 - DNA, 25 bp, Mus musculus
catcatttaccggatgttgctacaa

SEQ ID NO: 16818 - DNA, 25 bp, Mus musculus
catccaaaagacttgaagctcagtg

SEQ ID NO: 16819 - DNA, 25 bp, Mus musculus
catccaaagtaccaagagactgcct

SEQ ID NO: 16820 - DNA, 25 bp, Mus musculus
catccaaagtccaagtccaagagag

SEQ ID NO: 16821 - DNA, 25 bp, Mus musculus
catccaactccagcgtggtgaggaa

SEQ ID NO: 16822 - DNA, 25 bp, Mus musculus
catccaactttgtggaattgctgga

SEQ ID NO: 16823 - DNA, 25 bp, Mus musculus
catccaaggaagatgctcggcttca

SEQ ID NO: 16824 - DNA, 25 bp, Mus musculus
catccaaggccagggccattgtggc

SEQ ID NO: 16825 - DNA, 25 bp, Mus musculus
catccaaggtgatctgggaccatct

SEQ ID NO: 16826 - DNA, 25 bp, Mus musculus
catccacaaggaggcccagaggatc

SEQ ID NO: 16827 - DNA, 25 bp, Mus musculus
catccacactccctgtctgttgggt

SEQ ID NO: 16828 - DNA, 25 bp, Mus musculus
catccacaggatttactttgaataa

SEQ ID NO: 16829 - DNA, 25 bp, Mus musculus
catccacatggtttctgagaagtga

SEQ ID NO: 16830 - DNA, 25 bp, Mus musculus
catccaccctgctctgaagggtata

SEQ ID NO: 16831 - DNA, 25 bp, Mus musculus
catccacctaagctgtaataggacc

SEQ ID NO: 16832 - DNA, 25 bp, Mus musculus
catccacctggaacaagtgtttgag

SEQ ID NO: 16833 - DNA, 25 bp, Mus musculus
catccacggacaagaagactggtga

SEQ ID NO: 16834 - DNA, 25 bp, Mus musculus
catccacgtttctgtcccattctgt

SEQ ID NO: 16835 - DNA, 25 bp, Mus musculus
catccactgagaattccaatgcagg

SEQ ID NO: 16836 - DNA, 25 bp, Mus musculus
catccactgcaacatgacactgctt

SEQ ID NO: 16837 - DNA, 25 bp, Mus musculus
catccactgtgactgtcggtgtagt

SEQ ID NO: 16838 - DNA, 25 bp, Mus musculus
catccacttccagctgaagacaatt

SEQ ID NO: 16839 - DNA, 25 bp, Mus musculus
catccagaaaagagcgctgccagtt

SEQ ID NO: 16840 - DNA, 25 bp, Mus musculus
catccagacactgtttagtaaactt

SEQ ID NO: 16841 - DNA, 25 bp, Mus musculus
catccagaggcagagtttgtccaac

SEQ ID NO: 16842 - DNA, 25 bp, Mus musculus
catccagcgcttctacaagaatgcg

SEQ ID NO: 16843 - DNA, 25 bp, Mus musculus
catccagctaaccatgggaccgttt

SEQ ID NO: 16844 - DNA, 25 bp, Mus musculus
catccaggccgaggctgtgcggaaa

SEQ ID NO: 16845 - DNA, 25 bp, Mus musculus
catccaggctgcatgaatgccaagc

SEQ ID NO: 16846 - DNA, 25 bp, Mus musculus
catccaggctgtggtcgaagtctgc

SEQ ID NO: 16847 - DNA, 25 bp, Mus musculus
catccagggaaatgaaggacctatt

SEQ ID NO: 16848 - DNA, 25 bp, Mus musculus
catccagggacgcaggatcttaaag

SEQ ID NO: 16849 - DNA, 25 bp, Mus musculus
catccagggaggtctaatcaacagc

SEQ ID NO: 16850 - DNA, 25 bp, Mus musculus
catccagtactttgccagcattgca

SEQ ID NO: 16851 - DNA, 25 bp, Mus musculus
catccagtagctgtagacttcagaa

SEQ ID NO: 16852 - DNA, 25 bp, Mus musculus
catccagtatggagacgctgccctg

SEQ ID NO: 16853 - DNA, 25 bp, Mus musculus
catccagtatggtgacgctgccctg

SEQ ID NO: 16854 - DNA, 25 bp, Mus musculus
catccagtctgtgcagatctgcaga

SEQ ID NO: 16855 - DNA, 25 bp, Mus musculus
catccagtgatgatgaaattgactt

SEQ ID NO: 16856 - DNA, 25 bp, Mus musculus
catccagtgggacttgcggaagacc

SEQ ID NO: 16857 - DNA, 25 bp, Mus musculus
catccagtgtgtgatcaatgctatg

SEQ ID NO: 16858 - DNA, 25 bp, Mus musculus
catccagttgaaaacctcggttatt

SEQ ID NO: 16859 - DNA, 25 bp, Mus musculus
catccagtttgtcacacagtatcag

SEQ ID NO: 16860 - DNA, 25 bp, Mus musculus
catccatccttctgacctatgtgta

SEQ ID NO: 16861 - DNA, 25 bp, Mus musculus
catccatcggctggagaagatcctg

SEQ ID NO: 16862 - DNA, 25 bp, Mus musculus
catccatgccatgcagtgtgatccg

SEQ ID NO: 16863 - DNA, 25 bp, Mus musculus
catccatgggaaacagtcactacgg

SEQ ID NO: 16864 - DNA, 25 bp, Mus musculus
catccatgtggccatcgtctgtgcc

SEQ ID NO: 16865 - DNA, 25 bp, Mus musculus
catccatgtggcgatcgtctgtgcc

SEQ ID NO: 16866 - DNA, 25 bp, Mus musculus
catcccacggacacaagtagaaaaa

SEQ ID NO: 16867 - DNA, 25 bp, Mus musculus
catcccagccggagtgcccaggaaa

SEQ ID NO: 16868 - DNA, 25 bp, Mus musculus
catcccagtatgagagtaggtgtcc

SEQ ID NO: 16869 - DNA, 25 bp, Mus musculus
catccccagctaacatcttttccag

SEQ ID NO: 16870 - DNA, 25 bp, Mus musculus
catccccattgaccttcaagcaggt

SEQ ID NO: 16871 - DNA, 25 bp, Mus musculus
catcccctgacctatgaaggtggtg

SEQ ID NO: 16872 - DNA, 25 bp, Mus musculus
catcccctgaggaattggaccaggg

SEQ ID NO: 16873 - DNA, 25 bp, Mus musculus
catcccggaaatatgaagaattgct

SEQ ID NO: 16874 - DNA, 25 bp, Mus musculus
catccctcagctacgagctggcctt

SEQ ID NO: 16875 - DNA, 25 bp, Mus musculus
catccctgaacactgggagtattac

SEQ ID NO: 16876 - DNA, 25 bp, Mus musculus
catccctgagtcatcatcttcgaaa

SEQ ID NO: 16877 - DNA, 25 bp, Mus musculus
catccctgccagttactaagagagg

SEQ ID NO: 16878 - DNA, 25 bp, Mus musculus
catccctggcagtttgagtcctaca

SEQ ID NO: 16879 - DNA, 25 bp, Mus musculus
catccctggcctcggaaatgggctg

SEQ ID NO: 16880 - DNA, 25 bp, Mus musculus
catccctggtgctaagcatgggaac

SEQ ID NO: 16881 - DNA, 25 bp, Mus musculus
catcccttaagcagcagaggagcac

SEQ ID NO: 16882 - DNA, 25 bp, Mus musculus
catcccttatggagaccaaaggctg

SEQ ID NO: 16883 - DNA, 25 bp, Mus musculus
catcccttgcccagctacgtgaaaa

SEQ ID NO: 16884 - DNA, 25 bp, Mus musculus
catccgaactgggagtccactaagt

SEQ ID NO: 16885 - DNA, 25 bp, Mus musculus
catccgccagcagctctatgtggga

SEQ ID NO: 16886 - DNA, 25 bp, Mus musculus
catccgctacatgggcgaaagaaga

SEQ ID NO: 16887 - DNA, 25 bp, Mus musculus
catccggacattggtcgtgtcaatt

SEQ ID NO: 16888 - DNA, 25 bp, Mus musculus
catccggactgcatgttagtgccaa

SEQ ID NO: 16889 - DNA, 25 bp, Mus musculus
catccggataggtagcactgggctt

SEQ ID NO: 16890 - DNA, 25 bp, Mus musculus
catccggcagatgggaattgtacag

SEQ ID NO: 16891 - DNA, 25 bp, Mus musculus
catccggcctctgtcagtgtttggt

SEQ ID NO: 16892 - DNA, 25 bp, Mus musculus
catccgggaggtccgaccatgtaca

SEQ ID NO: 16893 - DNA, 25 bp, Mus musculus
catccggtgtgaaaaaggcaatact

SEQ ID NO: 16894 - DNA, 25 bp, Mus musculus
catccgtacagctggtgcaaagttg

SEQ ID NO: 16895 - DNA, 25 bp, Mus musculus
catccgtactttcgtcatgcttaca

SEQ ID NO: 16896 - DNA, 25 bp, Mus musculus
catccgtgaactaaatgcctttgaa

SEQ ID NO: 16897 - DNA, 25 bp, Mus musculus
catcctaagctacattccaagtttg

SEQ ID NO: 16898 - DNA, 25 bp, Mus musculus
catcctacaggtaactcctcagtta

SEQ ID NO: 16899 - DNA, 25 bp, Mus musculus
catcctatccaacccagtggcaggg

SEQ ID NO: 16900 - DNA, 25 bp, Mus musculus
catcctatgaatcaattgtctgtaa

SEQ ID NO: 16901 - DNA, 25 bp, Mus musculus
catcctcagttatgacacgctacag

SEQ ID NO: 16902 - DNA, 25 bp, Mus musculus
catcctccgcaaagcgctggataag

SEQ ID NO: 16903 - DNA, 25 bp, Mus musculus
catcctccgtggtggcgctgagcag

SEQ ID NO: 16904 - DNA, 25 bp, Mus musculus
catcctcctggctgttcttgccggg

SEQ ID NO: 16905 - DNA, 25 bp, Mus musculus
catcctcgccttcctggtgtgattc

SEQ ID NO: 16906 - DNA, 25 bp, Mus musculus
catcctctacaatgccacaaagctt

SEQ ID NO: 16907 - DNA, 25 bp, Mus musculus
catcctctgacatgtgtggtaactc

SEQ ID NO: 16908 - DNA, 25 bp, Mus musculus
catcctctgaggagaagtcgccttt

SEQ ID NO: 16909 - DNA, 25 bp, Mus musculus
catcctctgctgtgtcaggtgccgg

SEQ ID NO: 16910 - DNA, 25 bp, Mus musculus
catcctctgcttgggaatgatgtca

SEQ ID NO: 16911 - DNA, 25 bp, Mus musculus
catcctgatgtgctgccagtgtcca

SEQ ID NO: 16912 - DNA, 25 bp, Mus musculus
catcctgcaagattactgtgatgcc

SEQ ID NO: 16913 - DNA, 25 bp, Mus musculus
catcctgcctggtggagctcggtac

SEQ ID NO: 16914 - DNA, 25 bp, Mus musculus
catcctgccttgataaacttggtga

SEQ ID NO: 16915 - DNA, 25 bp, Mus musculus
catcctggatgcttgtttccactgg

SEQ ID NO: 16916 - DNA, 25 bp, Mus musculus
catcctggggcagacctgaaggaga

SEQ ID NO: 16917 - DNA, 25 bp, Mus musculus
catcctgggtgtgtccctggccgtg

SEQ ID NO: 16918 - DNA, 25 bp, Mus musculus
catcctggtatgaggagttccggcg

SEQ ID NO: 16919 - DNA, 25 bp, Mus musculus
catcctggtgtatgttggccacgag

SEQ ID NO: 16920 - DNA, 25 bp, Mus musculus
catcctgtgaaaatactcttaatac

SEQ ID NO: 16921 - DNA, 25 bp, Mus musculus
catcctgtgcacatgtatcgatggc

SEQ ID NO: 16922 - DNA, 25 bp, Mus musculus
catcctgtgctgataacatcgagaa

SEQ ID NO: 16923 - DNA, 25 bp, Mus musculus
catcctgtggctgcattgttcaacc

SEQ ID NO: 16924 - DNA, 25 bp, Mus musculus
catcctgtgtcgctgtgagaatatt

SEQ ID NO: 16925 - DNA, 25 bp, Mus musculus
catcctgtttctcgctgtgcaggga

SEQ ID NO: 16926 - DNA, 25 bp, Mus musculus
catcctgtttctggctgtgcaggga

SEQ ID NO: 16927 - DNA, 25 bp, Mus musculus
catccttagtgaggaggagttctat

SEQ ID NO: 16928 - DNA, 25 bp, Mus musculus
catccttgcctcagaatgtgggagg

SEQ ID NO: 16929 - DNA, 25 bp, Mus musculus
catccttggctgcagaataaattca

SEQ ID NO: 16930 - DNA, 25 bp, Mus musculus
catccttgggaaggacaccgtgagg

SEQ ID NO: 16931 - DNA, 25 bp, Mus musculus
catccttggtccagtggttctggga

SEQ ID NO: 16932 - DNA, 25 bp, Mus musculus
catccttgtttcttgcgtggacagg

SEQ ID NO: 16933 - DNA, 25 bp, Mus musculus
catcctttaccagtaaaccatgaag

SEQ ID NO: 16934 - DNA, 25 bp, Mus musculus
catcctttctgtggagctcacgaac

SEQ ID NO: 16935 - DNA, 25 bp, Mus musculus
catcctttgaacatgctggcccgtc

SEQ ID NO: 16936 - DNA, 25 bp, Mus musculus
catcctttgcatcatttatagttca

SEQ ID NO: 16937 - DNA, 25 bp, Mus musculus
catcgaaccagtggggttgcagccc

SEQ ID NO: 16938 - DNA, 25 bp, Mus musculus
catcgaagacggcaatttggaagaa

SEQ ID NO: 16939 - DNA, 25 bp, Mus musculus
catcgaagatgacttggtatcggcc

SEQ ID NO: 16940 - DNA, 25 bp, Mus musculus
catcgaataatcatccaggagagaa

SEQ ID NO: 16941 - DNA, 25 bp, Mus musculus
catcgaatcctggaccggatgcgct

SEQ ID NO: 16942 - DNA, 25 bp, Mus musculus
catcgacactgtaggcactgaaggc

SEQ ID NO: 16943 - DNA, 25 bp, Mus musculus
catcgacagagaagagcaggagtcc

SEQ ID NO: 16944 - DNA, 25 bp, Mus musculus
catcgacatcaaaccaagaaatcca

SEQ ID NO: 16945 - DNA, 25 bp, Mus musculus
catcgacgagctcctgtatgagcag

SEQ ID NO: 16946 - DNA, 25 bp, Mus musculus
catcgactctcacgtcctgtgtggg

SEQ ID NO: 16947 - DNA, 25 bp, Mus musculus
catcgactggatgacatgaaccaaa

SEQ ID NO: 16948 - DNA, 25 bp, Mus musculus
catcgactgtgagcggtattcggcc

SEQ ID NO: 16949 - DNA, 25 bp, Mus musculus
catcgacttatagacgaatatgctt

SEQ ID NO: 16950 - DNA, 25 bp, Mus musculus
catcgacttcaaggtcaagacggtc

SEQ ID NO: 16951 - DNA, 25 bp, Mus musculus
catcgacttcttcaggttcaacgca

SEQ ID NO: 16952 - DNA, 25 bp, Mus musculus
catcgagaacttgagtggctttctg

SEQ ID NO: 16953 - DNA, 25 bp, Mus musculus
catcgagaagtgttcagtgcctggt

SEQ ID NO: 16954 - DNA, 25 bp, Mus musculus
catcgagacagaaacaaccattggg

SEQ ID NO: 16955 - DNA, 25 bp, Mus musculus
catcgagacctgaagccagaaaaca

SEQ ID NO: 16956 - DNA, 25 bp, Mus musculus
catcgagagccgtgagctgagtgac

SEQ ID NO: 16957 - DNA, 25 bp, Mus musculus
catcgagtggatgcgtaggcatctt

SEQ ID NO: 16958 - DNA, 25 bp, Mus musculus
catcgatctctccatggtgactgat

SEQ ID NO: 16959 - DNA, 25 bp, Mus musculus
catcgcagtcaaacttggactttgg

SEQ ID NO: 16960 - DNA, 25 bp, Mus musculus
catcgcagtcaatcttggactttgg

SEQ ID NO: 16961 - DNA, 25 bp, Mus musculus
catcgccagcgagttttatgagcag

SEQ ID NO: 16962 - DNA, 25 bp, Mus musculus
catcgccagtccaggaacaagtggt

SEQ ID NO: 16963 - DNA, 25 bp, Mus musculus
catcgccatctacgtcaggtcagct

SEQ ID NO: 16964 - DNA, 25 bp, Mus musculus
catcgccatgtccttgcagatggat

SEQ ID NO: 16965 - DNA, 25 bp, Mus musculus
catcgcctggtggtattaccagtat

SEQ ID NO: 16966 - DNA, 25 bp, Mus musculus
catcgcgctgggaagatgacgtgat

SEQ ID NO: 16967 - DNA, 25 bp, Mus musculus
catcgcgctgggtagatgacgtgat

SEQ ID NO: 16968 - DNA, 25 bp, Mus musculus
catcgcgggtctggaggaaaacttc

SEQ ID NO: 16969 - DNA, 25 bp, Mus musculus
catcgctagtgactacaggctggaa

SEQ ID NO: 16970 - DNA, 25 bp, Mus musculus
catcgctgatagacagagtgccttg

SEQ ID NO: 16971 - DNA, 25 bp, Mus musculus
catcgctgtggagagggcagcagga

SEQ ID NO: 16972 - DNA, 25 bp, Mus musculus
catcggaggcctcttgtatgcactg

SEQ ID NO: 16973 - DNA, 25 bp, Mus musculus
catcggataccagtatgggcacaaa

SEQ ID NO: 16974 - DNA, 25 bp, Mus musculus
catcggatgcagttctgcctgggct

SEQ ID NO: 16975 - DNA, 25 bp, Mus musculus
catcggatgggcaggagcttctctc

SEQ ID NO: 16976 - DNA, 25 bp, Mus musculus
catcggcgaagagaacagagagtcg

SEQ ID NO: 16977 - DNA, 25 bp, Mus musculus
catcggcgaagatgtatacgggcag

SEQ ID NO: 16978 - DNA, 25 bp, Mus musculus
catcggctcttagataccttcacga

SEQ ID NO: 16979 - DNA, 25 bp, Mus musculus
catcggctgtgggttctcaactggc

SEQ ID NO: 16980 - DNA, 25 bp, Mus musculus
catcgggaatcaggagatgctgctg

SEQ ID NO: 16981 - DNA, 25 bp, Mus musculus
catcgggatagtagtctggccctgg

SEQ ID NO: 16982 - DNA, 25 bp, Mus musculus
catcgggattcaggtagaggacgac

SEQ ID NO: 16983 - DNA, 25 bp, Mus musculus
catcgggcctttgcaggaaccggtc

SEQ ID NO: 16984 - DNA, 25 bp, Mus musculus
catcgggcgcatcttccatatcgtg

SEQ ID NO: 16985 - DNA, 25 bp, Mus musculus
catcgggcttcttttgcgtggacga

SEQ ID NO: 16986 - DNA, 25 bp, Mus musculus
catcgggtctctggatgtggtcaag

SEQ ID NO: 16987 - DNA, 25 bp, Mus musculus
catcggtgggcgacaactttgcctt

SEQ ID NO: 16988 - DNA, 25 bp, Mus musculus
catcggtttgtagcggacagcaaag

SEQ ID NO: 16989 - DNA, 25 bp, Mus musculus
catcgtacctttggagaaagaaaga

SEQ ID NO: 16990 - DNA, 25 bp, Mus musculus
catcgtcggcctctttatcttctac

SEQ ID NO: 16991 - DNA, 25 bp, Mus musculus
catcgtctcctgaaaacttccaagt

SEQ ID NO: 16992 - DNA, 25 bp, Mus musculus
catcgtctggcacgtgcggagtaaa

SEQ ID NO: 16993 - DNA, 25 bp, Mus musculus
catcgtggcccactggtatttgtcc

SEQ ID NO: 16994 - DNA, 25 bp, Mus musculus
catcgtggcccggtgtccaatgtgc

SEQ ID NO: 16995 - DNA, 25 bp, Mus musculus
catcgtgtacgacagcaacaccagt

SEQ ID NO: 16996 - DNA, 25 bp, Mus musculus
catcgtgtgggaagaacggagtaac

SEQ ID NO: 16997 - DNA, 25 bp, Mus musculus
catcgtgttgtggaacagttacaaa

SEQ ID NO: 16998 - DNA, 25 bp, Mus musculus
catcgtgtttattattggaggagcc

SEQ ID NO: 16999 - DNA, 25 bp, Mus musculus
catctaaaaatgttggaaccggatt

SEQ ID NO: 17000 - DNA, 25 bp, Mus musculus
catctaactgacaaactcatgatgg

SEQ ID NO: 17001 - DNA, 25 bp, Mus musculus
catctaagagccaagatgtacggca

SEQ ID NO: 17002 - DNA, 25 bp, Mus musculus
catctaatcagccagagtgcacaga

SEQ ID NO: 17003 - DNA, 25 bp, Mus musculus
catctacacggtgctggagtgccag

SEQ ID NO: 17004 - DNA, 25 bp, Mus musculus
catctacatagctttctctctccag

SEQ ID NO: 17005 - DNA, 25 bp, Mus musculus
catctacgtcaggtcagctgtctca

SEQ ID NO: 17006 - DNA, 25 bp, Mus musculus
catctacgtcgcgattggtcagaag

SEQ ID NO: 17007 - DNA, 25 bp, Mus musculus
catctactgtgtgcagtgagtggtc

SEQ ID NO: 17008 - DNA, 25 bp, Mus musculus
catctacttcaactctttcctggag

SEQ ID NO: 17009 - DNA, 25 bp, Mus musculus
catctactttgaagttgtcaatcag

SEQ ID NO: 17010 - DNA, 25 bp, Mus musculus
catctagtactggaattcgaaaaca

SEQ ID NO: 17011 - DNA, 25 bp, Mus musculus
catctagtgctttttgcatggccca

SEQ ID NO: 17012 - DNA, 25 bp, Mus musculus
catctataagatgaagagcggcacc

SEQ ID NO: 17013 - DNA, 25 bp, Mus musculus
catctatagaccagaagcttgagaa

SEQ ID NO: 17014 - DNA, 25 bp, Mus musculus
catctatgacctgaaggaccagatt

SEQ ID NO: 17015 - DNA, 25 bp, Mus musculus
catctatgacgatctatccaagcag

SEQ ID NO: 17016 - DNA, 25 bp, Mus musculus
catctatggcttcaaggccaccttc

SEQ ID NO: 17017 - DNA, 25 bp, Mus musculus
catctatgtttttgacttgcatgga

SEQ ID NO: 17018 - DNA, 25 bp, Mus musculus
catctcaaagaaggacccagaggat

SEQ ID NO: 17019 - DNA, 25 bp, Mus musculus
catctcaagatggtggacagtttcc

SEQ ID NO: 17020 - DNA, 25 bp, Mus musculus
catctcacaagccctgttttgcttt

SEQ ID NO: 17021 - DNA, 25 bp, Mus musculus
catctcaccataggagcactgggat

SEQ ID NO: 17022 - DNA, 25 bp, Mus musculus
catctcactcactgcaaatgtcatg

SEQ ID NO: 17023 - DNA, 25 bp, Mus musculus
catctcactcctcggataagctctg

SEQ ID NO: 17024 - DNA, 25 bp, Mus musculus
catctcagagcggaaggtgtgcagc

SEQ ID NO: 17025 - DNA, 25 bp, Mus musculus
catctcagagttacaggatgacctg

SEQ ID NO: 17026 - DNA, 25 bp, Mus musculus
catctcagcccgacttgggaaagct

SEQ ID NO: 17027 - DNA, 25 bp, Mus musculus
catctcaggacacctgtcagtcaca

SEQ ID NO: 17028 - DNA, 25 bp, Mus musculus
catctcaggacagctgtcagtcaca

SEQ ID NO: 17029 - DNA, 25 bp, Mus musculus
catctcaggcgcatgcggaactgga

SEQ ID NO: 17030 - DNA, 25 bp, Mus musculus
catctcaggcgcttgcggaactgga

SEQ ID NO: 17031 - DNA, 25 bp, Mus musculus
catctcaggcggatcacagtcgctc

SEQ ID NO: 17032 - DNA, 25 bp, Mus musculus
catctcagtgaacgaggacatgaca

SEQ ID NO: 17033 - DNA, 25 bp, Mus musculus
catctcagtgccctggtggcatctg

SEQ ID NO: 17034 - DNA, 25 bp, Mus musculus
catctccaacatcttaacttttaag

SEQ ID NO: 17035 - DNA, 25 bp, Mus musculus
catctccagaggaggacagattgct

SEQ ID NO: 17036 - DNA, 25 bp, Mus musculus
catctccagagttctgtggatcctc

SEQ ID NO: 17037 - DNA, 25 bp, Mus musculus
catctccagcatgttatagatgcag

SEQ ID NO: 17038 - DNA, 25 bp, Mus musculus
catctccatggctgagaccagcatg

SEQ ID NO: 17039 - DNA, 25 bp, Mus musculus
catctcccaagagacagactagctg

SEQ ID NO: 17040 - DNA, 25 bp, Mus musculus
catctcccaatttcagagaccgaag

SEQ ID NO: 17041 - DNA, 25 bp, Mus musculus
catctcctatgtgtacactgctgag

SEQ ID NO: 17042 - DNA, 25 bp, Mus musculus
catctcctgaaggacacaggctttc

SEQ ID NO: 17043 - DNA, 25 bp, Mus musculus
catctcctgacatctgaccatacag

SEQ ID NO: 17044 - DNA, 25 bp, Mus musculus
catctccttgggatcctaaagaaaa

SEQ ID NO: 17045 - DNA, 25 bp, Mus musculus
catctcggaatacatctaccactgc

SEQ ID NO: 17046 - DNA, 25 bp, Mus musculus
catctcggcaatggttgtcttcctt

SEQ ID NO: 17047 - DNA, 25 bp, Mus musculus
catctcggcgctgacagatctgggc

SEQ ID NO: 17048 - DNA, 25 bp, Mus musculus
catctcggtcactgtgggaggatga

SEQ ID NO: 17049 - DNA, 25 bp, Mus musculus
catctcgtggagatagcaccaaagt

SEQ ID NO: 17050 - DNA, 25 bp, Mus musculus
catctcgttctctgagatggtgcag

SEQ ID NO: 17051 - DNA, 25 bp, Mus musculus
catctctaatgtccagcaatgtggg

SEQ ID NO: 17052 - DNA, 25 bp, Mus musculus
catctctcaagcagcaaagtttgat

SEQ ID NO: 17053 - DNA, 25 bp, Mus musculus
catctctcacagttgaacctttgca

SEQ ID NO: 17054 - DNA, 25 bp, Mus musculus
catctctcaccaaggggactatgca

SEQ ID NO: 17055 - DNA, 25 bp, Mus musculus
catctctcctttctgcagatacagg

SEQ ID NO: 17056 - DNA, 25 bp, Mus musculus
catctctgaaagaggaaatggctct

SEQ ID NO: 17057 - DNA, 25 bp, Mus musculus
catctctgagttagcctgttacaca

SEQ ID NO: 17058 - DNA, 25 bp, Mus musculus
catctctgagtttttggccacatgc

SEQ ID NO: 17059 - DNA, 25 bp, Mus musculus
catctctgggacatcaaggtggcgg

SEQ ID NO: 17060 - DNA, 25 bp, Mus musculus
catctctggtggctttcggagcatt

SEQ ID NO: 17061 - DNA, 25 bp, Mus musculus
catctctgtgatggtgtcaacttgg

SEQ ID NO: 17062 - DNA, 25 bp, Mus musculus
catctctgttctcatgaagatcaca

SEQ ID NO: 17063 - DNA, 25 bp, Mus musculus
catctcttcaaactgtggcaccaca

SEQ ID NO: 17064 - DNA, 25 bp, Mus musculus
catctcttcggctttcggccgacgt

SEQ ID NO: 17065 - DNA, 25 bp, Mus musculus
catctctttcaacgacaagaagttt

SEQ ID NO: 17066 - DNA, 25 bp, Mus musculus
catctcttttggctgggaccagtga

SEQ ID NO: 17067 - DNA, 25 bp, Mus musculus
catctgaaaaactgccacaggaatt

SEQ ID NO: 17068 - DNA, 25 bp, Mus musculus
catctgaaaaccattcacatttggg

SEQ ID NO: 17069 - DNA, 25 bp, Mus musculus
catctgaatttcatagcagaaaagc

SEQ ID NO: 17070 - DNA, 25 bp, Mus musculus
catctgactggattcgggtggaccc

SEQ ID NO: 17071 - DNA, 25 bp, Mus musculus
catctgaggaccttgaactaccagg

SEQ ID NO: 17072 - DNA, 25 bp, Mus musculus
catctgagtaaccttttccttaaag

SEQ ID NO: 17073 - DNA, 25 bp, Mus musculus
catctgagtctggaatcagtgctaa

SEQ ID NO: 17074 - DNA, 25 bp, Mus musculus
catctgatccccaaaacggtatcca

SEQ ID NO: 17075 - DNA, 25 bp, Mus musculus
catctgatgctgtgactccaggatg

SEQ ID NO: 17076 - DNA, 25 bp, Mus musculus
catctgatggaaaatggagccctag

SEQ ID NO: 17077 - DNA, 25 bp, Mus musculus
catctgatggctcacgcgagctcct

SEQ ID NO: 17078 - DNA, 25 bp, Mus musculus
catctgatttgaaggcagactcaat

SEQ ID NO: 17079 - DNA, 25 bp, Mus musculus
catctgcactagtgagagtgtggtt

SEQ ID NO: 17080 - DNA, 25 bp, Mus musculus
catctgcactcaatgcctggagagg

SEQ ID NO: 17081 - DNA, 25 bp, Mus musculus
catctgcaggctgcgtgtgaggtac

SEQ ID NO: 17082 - DNA, 25 bp, Mus musculus
catctgcccattgtgtatgaaaaac

SEQ ID NO: 17083 - DNA, 25 bp, Mus musculus
catctgcccggcatgtgggatgcaa

SEQ ID NO: 17084 - DNA, 25 bp, Mus musculus
catctgccgtagagcatgctgtgcg

SEQ ID NO: 17085 - DNA, 25 bp, Mus musculus
catctgcgaagcacagaaccaggcg

SEQ ID NO: 17086 - DNA, 25 bp, Mus musculus
catctgcgaccaccggagggaagac

SEQ ID NO: 17087 - DNA, 25 bp, Mus musculus
catctgctacttcctggactacggg

SEQ ID NO: 17088 - DNA, 25 bp, Mus musculus
catctgctggataacacggagaggc

SEQ ID NO: 17089 - DNA, 25 bp, Mus musculus
catctgcttgtaactgccagggaag

SEQ ID NO: 17090 - DNA, 25 bp, Mus musculus
catctgctttatctgcccggctctg

SEQ ID NO: 17091 - DNA, 25 bp, Mus musculus
catctggactggcatagaaaagagg

SEQ ID NO: 17092 - DNA, 25 bp, Mus musculus
catctggagtgcactaataccgctc

SEQ ID NO: 17093 - DNA, 25 bp, Mus musculus
catctgggactgttgaggtgtgaac

SEQ ID NO: 17094 - DNA, 25 bp, Mus musculus
catctgggttctggactctgttggc

SEQ ID NO: 17095 - DNA, 25 bp, Mus musculus
catctggtgtctgtactcggagctg

SEQ ID NO: 17096 - DNA, 25 bp, Mus musculus
catctggttggacagcctattagct

SEQ ID NO: 17097 - DNA, 25 bp, Mus musculus
catctgtaaaaccagagccagctag

SEQ ID NO: 17098 - DNA, 25 bp, Mus musculus
catctgtaatgattgtaagcgggca

SEQ ID NO: 17099 - DNA, 25 bp, Mus musculus
catctgtagtgagattgacctcggg

SEQ ID NO: 17100 - DNA, 25 bp, Mus musculus
catctgtccagcttcatcaagcatg

SEQ ID NO: 17101 - DNA, 25 bp, Mus musculus
catctgtccatcagatgacccctag

SEQ ID NO: 17102 - DNA, 25 bp, Mus musculus
catctgtccgtttgctggaaggtgt

SEQ ID NO: 17103 - DNA, 25 bp, Mus musculus
catctgtctctaaccatcgctgtgg

SEQ ID NO: 17104 - DNA, 25 bp, Mus musculus
catctgtctctatccatcgctgtgg

SEQ ID NO: 17105 - DNA, 25 bp, Mus musculus
catctgtctgctggagtatccccgg

SEQ ID NO: 17106 - DNA, 25 bp, Mus musculus
catctgtctgtatgagcaaggcaga

SEQ ID NO: 17107 - DNA, 25 bp, Mus musculus
catctgtcttgctcgggccaaggag

SEQ ID NO: 17108 - DNA, 25 bp, Mus musculus
catctgtgagcatgctgtatgagaa

SEQ ID NO: 17109 - DNA, 25 bp, Mus musculus
catctgtgatggacctccttccctt

SEQ ID NO: 17110 - DNA, 25 bp, Mus musculus
catctgtggtatcatgcctgtttga

SEQ ID NO: 17111 - DNA, 25 bp, Mus musculus
catctgtgtttcgaagtgaggagat

SEQ ID NO: 17112 - DNA, 25 bp, Mus musculus
catctgtgtttgatcgccttggtgc

SEQ ID NO: 17113 - DNA, 25 bp, Mus musculus
catctgttgctattgccaccgccat

SEQ ID NO: 17114 - DNA, 25 bp, Mus musculus
catcttagcattctctcagggaagc

SEQ ID NO: 17115 - DNA, 25 bp, Mus musculus
catcttaggacccattgtggataag

SEQ ID NO: 17116 - DNA, 25 bp, Mus musculus
catcttatcctggtggatccatggg

SEQ ID NO: 17117 - DNA, 25 bp, Mus musculus
catcttatggaagagtctgttggga

SEQ ID NO: 17118 - DNA, 25 bp, Mus musculus
catcttcacccatctttggaagaag

SEQ ID NO: 17119 - DNA, 25 bp, Mus musculus
catcttcagtggagaattatatgga

SEQ ID NO: 17120 - DNA, 25 bp, Mus musculus
catcttcagtggcaccgtggtctag

SEQ ID NO: 17121 - DNA, 25 bp, Mus musculus
catcttcagtgggaccgtggtctag

SEQ ID NO: 17122 - DNA, 25 bp, Mus musculus
catcttcatgcgcaaggacaccaaa

SEQ ID NO: 17123 - DNA, 25 bp, Mus musculus
catcttccattaaagagagagaggg

SEQ ID NO: 17124 - DNA, 25 bp, Mus musculus
catcttcgaggtttcaaagagtctc

SEQ ID NO: 17125 - DNA, 25 bp, Mus musculus
catcttctattctgccaatcactga

SEQ ID NO: 17126 - DNA, 25 bp, Mus musculus
catcttctctatttccagctggctt

SEQ ID NO: 17127 - DNA, 25 bp, Mus musculus
catcttctgatacccgtcagtcagg

SEQ ID NO: 17128 - DNA, 25 bp, Mus musculus
catcttctgggtgtccgtgctctgc

SEQ ID NO: 17129 - DNA, 25 bp, Mus musculus
catcttctgtaagggagcgaccacc

SEQ ID NO: 17130 - DNA, 25 bp, Mus musculus
catcttctttatggtaaccgagctc

SEQ ID NO: 17131 - DNA, 25 bp, Mus musculus
catcttgatagacaaggtcatggac

SEQ ID NO: 17132 - DNA, 25 bp, Mus musculus
catcttgcgaagtccccaagctctt

SEQ ID NO: 17133 - DNA, 25 bp, Mus musculus
catcttggcttctagccctgagcag

SEQ ID NO: 17134 - DNA, 25 bp, Mus musculus
catcttgggctttgcctccggctac

SEQ ID NO: 17135 - DNA, 25 bp, Mus musculus
catcttgggtatggatgaactttct

SEQ ID NO: 17136 - DNA, 25 bp, Mus musculus
catcttgtagccctggaagccgcta

SEQ ID NO: 17137 - DNA, 25 bp, Mus musculus
catcttgtgtacgaagaaggtatag

SEQ ID NO: 17138 - DNA, 25 bp, Mus musculus
catctttaagtctggtggcatccca

SEQ ID NO: 17139 - DNA, 25 bp, Mus musculus
catctttatggagtatatgccaggg

SEQ ID NO: 17140 - DNA, 25 bp, Mus musculus
catctttccaccatagaaaaggact

SEQ ID NO: 17141 - DNA, 25 bp, Mus musculus
catctttccgtatcagttcatggac

SEQ ID NO: 17142 - DNA, 25 bp, Mus musculus
catctttctttgacctgtacacaca

SEQ ID NO: 17143 - DNA, 25 bp, Mus musculus
catctttgagatcaatgaggccttt

SEQ ID NO: 17144 - DNA, 25 bp, Mus musculus
catctttgaggtggtagcacaggac

SEQ ID NO: 17145 - DNA, 25 bp, Mus musculus
catcttttaaagtcagtggcaacgt

SEQ ID NO: 17146 - DNA, 25 bp, Mus musculus
catcttttgccaaagtttgattcac

SEQ ID NO: 17147 - DNA, 25 bp, Mus musculus
catgaaactgggagagaagctcact

SEQ ID NO: 17148 - DNA, 25 bp, Mus musculus
catgaaacttggagagctggagcta

SEQ ID NO: 17149 - DNA, 25 bp, Mus musculus
catgaaagagatccaatctacaaga

SEQ ID NO: 17150 - DNA, 25 bp, Mus musculus
catgaaagagatgcaatctacaaga

SEQ ID NO: 17151 - DNA, 25 bp, Mus musculus
catgaaaggttgtctgttgctggaa

SEQ ID NO: 17152 - DNA, 25 bp, Mus musculus
catgaaagtcattgaaagccgagcc

SEQ ID NO: 17153 - DNA, 25 bp, Mus musculus
catgaaagtgagagactagaggcct

SEQ ID NO: 17154 - DNA, 25 bp, Mus musculus
catgaaagttgacctgagcacagca

SEQ ID NO: 17155 - DNA, 25 bp, Mus musculus
catgaaatcagcagcctccctgaga

SEQ ID NO: 17156 - DNA, 25 bp, Mus musculus
catgaaatggaggttcctagaagca

SEQ ID NO: 17157 - DNA, 25 bp, Mus musculus
catgaaatggccgtcaatttgtcca

SEQ ID NO: 17158 - DNA, 25 bp, Mus musculus
catgaacaagctaaaaaacaacaag

SEQ ID NO: 17159 - DNA, 25 bp, Mus musculus
catgaacacatagaaatccttacag

SEQ ID NO: 17160 - DNA, 25 bp, Mus musculus
catgaacactgaggagttccgtgac

SEQ ID NO: 17161 - DNA, 25 bp, Mus musculus
catgaacagctggaaaaaataataa

SEQ ID NO: 17162 - DNA, 25 bp, Mus musculus
catgaacatgcagagtctgaatggg

SEQ ID NO: 17163 - DNA, 25 bp, Mus musculus
catgaacccgagtgtggttggcgtc

SEQ ID NO: 17164 - DNA, 25 bp, Mus musculus
catgaaccgactcatcatgaactac

SEQ ID NO: 17165 - DNA, 25 bp, Mus musculus
catgaaccgcatatctactcggatg

SEQ ID NO: 17166 - DNA, 25 bp, Mus musculus
catgaaccgcatttctactcggatg

SEQ ID NO: 17167 - DNA, 25 bp, Mus musculus
catgaacgacgtagccattgtgaag

SEQ ID NO: 17168 - DNA, 25 bp, Mus musculus
catgaacgcaatgcatttgagtgac

SEQ ID NO: 17169 - DNA, 25 bp, Mus musculus
catgaacgtcttaatgctagatgag

SEQ ID NO: 17170 - DNA, 25 bp, Mus musculus
catgaactgtggacaaacagagaca

SEQ ID NO: 17171 - DNA, 25 bp, Mus musculus
catgaacttcactccgacacggaca

SEQ ID NO: 17172 - DNA, 25 bp, Mus musculus
catgaagaaagacgagcttacaaag

SEQ ID NO: 17173 - DNA, 25 bp, Mus musculus
catgaagaaggagatatgcaatgcc

SEQ ID NO: 17174 - DNA, 25 bp, Mus musculus
catgaagacattctgtggcacacca

SEQ ID NO: 17175 - DNA, 25 bp, Mus musculus
catgaagagttcacaagaagcaacg

SEQ ID NO: 17176 - DNA, 25 bp, Mus musculus
catgaagatacttccaagatgaacc

SEQ ID NO: 17177 - DNA, 25 bp, Mus musculus
catgaagattggcattgaggcaaag

SEQ ID NO: 17178 - DNA, 25 bp, Mus musculus
catgaagcaggccattgtggataaa

SEQ ID NO: 17179 - DNA, 25 bp, Mus musculus
catgaagcagtactggacaacgtgc

SEQ ID NO: 17180 - DNA, 25 bp, Mus musculus
catgaagctattggagaactccagc

SEQ ID NO: 17181 - DNA, 25 bp, Mus musculus
catgaagctgggaaaaccaccagac

SEQ ID NO: 17182 - DNA, 25 bp, Mus musculus
catgaagctgttgtccgacggacga

SEQ ID NO: 17183 - DNA, 25 bp, Mus musculus
catgaaggaccgatcttcaactccc

SEQ ID NO: 17184 - DNA, 25 bp, Mus musculus
catgaaggctgtccaggaaggaaac

SEQ ID NO: 17185 - DNA, 25 bp, Mus musculus
catgaaggtagttgtgacaggagtc

SEQ ID NO: 17186 - DNA, 25 bp, Mus musculus
catgaaggtggtgaacctgaagcag

SEQ ID NO: 17187 - DNA, 25 bp, Mus musculus
catgaagtattatgcactgtgtggc

SEQ ID NO: 17188 - DNA, 25 bp, Mus musculus
catgaagtgccaaggataaggcctg

SEQ ID NO: 17189 - DNA, 25 bp, Mus musculus
catgaagttcaagcagaagcagcgg

SEQ ID NO: 17190 - DNA, 25 bp, Mus musculus
catgaatcacatctaatgctgacag

SEQ ID NO: 17191 - DNA, 25 bp, Mus musculus
catgaatcacatgtaatgctgacag

SEQ ID NO: 17192 - DNA, 25 bp, Mus musculus
catgaatcacgagtggattggaaac

SEQ ID NO: 17193 - DNA, 25 bp, Mus musculus
catgaatgacgtttcgcaaaaggca

SEQ ID NO: 17194 - DNA, 25 bp, Mus musculus
catgaatgactttggcactgtcaat

SEQ ID NO: 17195 - DNA, 25 bp, Mus musculus
catgaatgagatctaccgtaatggc

SEQ ID NO: 17196 - DNA, 25 bp, Mus musculus
catgaatgccaagccatgctgctgc

SEQ ID NO: 17197 - DNA, 25 bp, Mus musculus
catgaatggctatggatcacacacc

SEQ ID NO: 17198 - DNA, 25 bp, Mus musculus
catgaatgggtttattgaccagatc

SEQ ID NO: 17199 - DNA, 25 bp, Mus musculus
catgaattcaaaggcgatttaccag

SEQ ID NO: 17200 - DNA, 25 bp, Mus musculus
catgacagatagtgacgacactacg

SEQ ID NO: 17201 - DNA, 25 bp, Mus musculus
catgacagggctgcatggagcaagc

SEQ ID NO: 17202 - DNA, 25 bp, Mus musculus
catgacagtatttctgaagaagggt

SEQ ID NO: 17203 - DNA, 25 bp, Mus musculus
catgacagtcctttaatagagaagc

SEQ ID NO: 17204 - DNA, 25 bp, Mus musculus
catgacatcagcctggaggagtttg

SEQ ID NO: 17205 - DNA, 25 bp, Mus musculus
catgacatggactcttgtttgtaca

SEQ ID NO: 17206 - DNA, 25 bp, Mus musculus
catgaccaaacaaggaacctggagg

SEQ ID NO: 17207 - DNA, 25 bp, Mus musculus
catgaccatacaggtaggcctttcc

SEQ ID NO: 17208 - DNA, 25 bp, Mus musculus
catgacccaagatgactacaaacca

SEQ ID NO: 17209 - DNA, 25 bp, Mus musculus
catgaccccagctgatgatttctgt

SEQ ID NO: 17210 - DNA, 25 bp, Mus musculus
catgaccctgtgtggttggtaacct

SEQ ID NO: 17211 - DNA, 25 bp, Mus musculus
catgacctacaatatgcaggcttat

SEQ ID NO: 17212 - DNA, 25 bp, Mus musculus
catgacctgacaaaggttgtcttag

SEQ ID NO: 17213 - DNA, 25 bp, Mus musculus
catgacgatgctgtcagtaagatct

SEQ ID NO: 17214 - DNA, 25 bp, Mus musculus
catgacgcatggctgaatgtggcaa

SEQ ID NO: 17215 - DNA, 25 bp, Mus musculus
catgacggtttgagctctcgtgccc

SEQ ID NO: 17216 - DNA, 25 bp, Mus musculus
catgacgtcagtagcatctagtaat

SEQ ID NO: 17217 - DNA, 25 bp, Mus musculus
catgactaagagaagaaaccactgg

SEQ ID NO: 17218 - DNA, 25 bp, Mus musculus
catgactacatcagctgggagtcct

SEQ ID NO: 17219 - DNA, 25 bp, Mus musculus
catgactacatctgctgggagtcct

SEQ ID NO: 17220 - DNA, 25 bp, Mus musculus
catgactatatcttggcaacagcaa

SEQ ID NO: 17221 - DNA, 25 bp, Mus musculus
catgactattgtagatgagctgggc

SEQ ID NO: 17222 - DNA, 25 bp, Mus musculus
catgactccaaggtgaagatttgga

SEQ ID NO: 17223 - DNA, 25 bp, Mus musculus
catgactcccgcagccagagggcat

SEQ ID NO: 17224 - DNA, 25 bp, Mus musculus
catgactcgcatagtaatgatagag

SEQ ID NO: 17225 - DNA, 25 bp, Mus musculus
catgactcgcattgtaatgatagag

SEQ ID NO: 17226 - DNA, 25 bp, Mus musculus
catgactcttgagatccgtgaagga

SEQ ID NO: 17227 - DNA, 25 bp, Mus musculus
catgactgcactctatgtgacagac

SEQ ID NO: 17228 - DNA, 25 bp, Mus musculus
catgactggtattgttttgaatgcc

SEQ ID NO: 17229 - DNA, 25 bp, Mus musculus
catgactgtcattctctcccaagtg

SEQ ID NO: 17230 - DNA, 25 bp, Mus musculus
catgactttgtcactcggtatttga

SEQ ID NO: 17231 - DNA, 25 bp, Mus musculus
catgagaaccggaagaacacgctcc

SEQ ID NO: 17232 - DNA, 25 bp, Mus musculus
catgagaagtggaaccgtcttctgc

SEQ ID NO: 17233 - DNA, 25 bp, Mus musculus
catgagaagtttctccctcctgcaa

SEQ ID NO: 17234 - DNA, 25 bp, Mus musculus
catgagaatgatccagctacacaac

SEQ ID NO: 17235 - DNA, 25 bp, Mus musculus
catgagaccctgagtgaagacagaa

SEQ ID NO: 17236 - DNA, 25 bp, Mus musculus
catgagactctgaatgtagtggagg

SEQ ID NO: 17237 - DNA, 25 bp, Mus musculus
catgagagaaacacctcgggagcca

SEQ ID NO: 17238 - DNA, 25 bp, Mus musculus
catgagagcgcacgccctggaaaag

SEQ ID NO: 17239 - DNA, 25 bp, Mus musculus
catgagagcttttgtggaaaacatc

SEQ ID NO: 17240 - DNA, 25 bp, Mus musculus
catgagaggtacaactagatcttcc

SEQ ID NO: 17241 - DNA, 25 bp, Mus musculus
catgagaggtactactagatcttcc

SEQ ID NO: 17242 - DNA, 25 bp, Mus musculus
catgagatagaaaacgtggacagta

SEQ ID NO: 17243 - DNA, 25 bp, Mus musculus
catgagcaacgatgacgcagtccga

SEQ ID NO: 17244 - DNA, 25 bp, Mus musculus
catgagcagaaaaagtccagcaagc

SEQ ID NO: 17245 - DNA, 25 bp, Mus musculus
catgagcagccgtgtccacgaggct

SEQ ID NO: 17246 - DNA, 25 bp, Mus musculus
catgagcagtacaagatccacaaag

SEQ ID NO: 17247 - DNA, 25 bp, Mus musculus
catgagcagtgctgggaacagtagc

SEQ ID NO: 17248 - DNA, 25 bp, Mus musculus
catgagcagttcagggttaggtagc

SEQ ID NO: 17249 - DNA, 25 bp, Mus musculus
catgagcatgcagtcagctgtgggt

SEQ ID NO: 17250 - DNA, 25 bp, Mus musculus
catgagcattttggcactccagtca

SEQ ID NO: 17251 - DNA, 25 bp, Mus musculus
catgagccggagacagacatcttat

SEQ ID NO: 17252 - DNA, 25 bp, Mus musculus
catgagccggagtcagacatcttat

SEQ ID NO: 17253 - DNA, 25 bp, Mus musculus
catgagcctccagtacaagacttta

SEQ ID NO: 17254 - DNA, 25 bp, Mus musculus
catgagcgtgcagtcactcaatggg

SEQ ID NO: 17255 - DNA, 25 bp, Mus musculus
catgagctgcgtaaggaagacagag

SEQ ID NO: 17256 - DNA, 25 bp, Mus musculus
catgaggaacaattgctgcagcgcc

SEQ ID NO: 17257 - DNA, 25 bp, Mus musculus
catgaggaccttcagccatgtgcgt

SEQ ID NO: 17258 - DNA, 25 bp, Mus musculus
catgaggagttggtgcgctacctgt

SEQ ID NO: 17259 - DNA, 25 bp, Mus musculus
catgaggatccagcagtttcggaag

SEQ ID NO: 17260 - DNA, 25 bp, Mus musculus
catgaggcagtgaaatccatgtttc

SEQ ID NO: 17261 - DNA, 25 bp, Mus musculus
catgaggctcgttttaagaaaatgg

SEQ ID NO: 17262 - DNA, 25 bp, Mus musculus
catgaggctggaatcactgatattg

SEQ ID NO: 17263 - DNA, 25 bp, Mus musculus
catgaggtgaccgtggtggacaact

SEQ ID NO: 17264 - DNA, 25 bp, Mus musculus
catgaggttgattgggtattcagag

SEQ ID NO: 17265 - DNA, 25 bp, Mus musculus
catgagtatcgatgacatggtcttc

SEQ ID NO: 17266 - DNA, 25 bp, Mus musculus
catgagtctcgttaaggtagaaggt

SEQ ID NO: 17267 - DNA, 25 bp, Mus musculus
catgagtgaacagcagcatacgttc

SEQ ID NO: 17268 - DNA, 25 bp, Mus musculus
catgagtgagatctacctgaggtgc

SEQ ID NO: 17269 - DNA, 25 bp, Mus musculus
catgagtgagttcatgggcctcatc

SEQ ID NO: 17270 - DNA, 25 bp, Mus musculus
catgagtgctgaggaccggaagtct

SEQ ID NO: 17271 - DNA, 25 bp, Mus musculus
catgagtggtattgttaagcccctt

SEQ ID NO: 17272 - DNA, 25 bp, Mus musculus
catgatagcagcagcatggcagaga

SEQ ID NO: 17273 - DNA, 25 bp, Mus musculus
catgatcaagttccagcccctaaat

SEQ ID NO: 17274 - DNA, 25 bp, Mus musculus
catgatcaatgttggctctggcttg

SEQ ID NO: 17275 - DNA, 25 bp, Mus musculus
catgatcaattcctcctgcgaccag

SEQ ID NO: 17276 - DNA, 25 bp, Mus musculus
catgatcatagcaggagtggagagc

SEQ ID NO: 17277 - DNA, 25 bp, Mus musculus
catgatcgccacaggcagcattggg

SEQ ID NO: 17278 - DNA, 25 bp, Mus musculus
catgatcgtggacaagctgctggac

SEQ ID NO: 17279 - DNA, 25 bp, Mus musculus
catgatcgtgttttcgatgttaacg

SEQ ID NO: 17280 - DNA, 25 bp, Mus musculus
catgatcgttgtaatggctcaggat

SEQ ID NO: 17281 - DNA, 25 bp, Mus musculus
catgatgaaacatactgtgaccctg

SEQ ID NO: 17282 - DNA, 25 bp, Mus musculus
catgatgaacacagagaccacctga

SEQ ID NO: 17283 - DNA, 25 bp, Mus musculus
catgatgaacactgagaccacctga

SEQ ID NO: 17284 - DNA, 25 bp, Mus musculus
catgatgacacccactcaagaatag

SEQ ID NO: 17285 - DNA, 25 bp, Mus musculus
catgatgactggctttgctccagac

SEQ ID NO: 17286 - DNA, 25 bp, Mus musculus
catgatgagtacctctccacttgac

SEQ ID NO: 17287 - DNA, 25 bp, Mus musculus
catgatgattaaagcggtggtgcca

SEQ ID NO: 17288 - DNA, 25 bp, Mus musculus
catgatgattctgccgtgcaggcag

SEQ ID NO: 17289 - DNA, 25 bp, Mus musculus
catgatgcacccctggtacatacct

SEQ ID NO: 17290 - DNA, 25 bp, Mus musculus
catgatgcatggaaacacctgctcc

SEQ ID NO: 17291 - DNA, 25 bp, Mus musculus
catgatgccagaggagatcgagctg

SEQ ID NO: 17292 - DNA, 25 bp, Mus musculus
catgatgctagtgatgagaagattc

SEQ ID NO: 17293 - DNA, 25 bp, Mus musculus
catgatgctctcttccacgccaaga

SEQ ID NO: 17294 - DNA, 25 bp, Mus musculus
catgatgctggtaatgactcgggtc

SEQ ID NO: 17295 - DNA, 25 bp, Mus musculus
catgatggatttggagaagcccacc

SEQ ID NO: 17296 - DNA, 25 bp, Mus musculus
catgatggcccaatggagccagttt

SEQ ID NO: 17297 - DNA, 25 bp, Mus musculus
catgatgggacggaaccagactgct

SEQ ID NO: 17298 - DNA, 25 bp, Mus musculus
catgatggtcggacagtggcagtta

SEQ ID NO: 17299 - DNA, 25 bp, Mus musculus
catgatgtagaagggcggtacatgc

SEQ ID NO: 17300 - DNA, 25 bp, Mus musculus
catgatgtagacacactggtactga

SEQ ID NO: 17301 - DNA, 25 bp, Mus musculus
catgatgtctatcacatggcagtag

SEQ ID NO: 17302 - DNA, 25 bp, Mus musculus
catgatgtggtcgagccgctctaca

SEQ ID NO: 17303 - DNA, 25 bp, Mus musculus
catgattatcgagcataagattgtc

SEQ ID NO: 17304 - DNA, 25 bp, Mus musculus
catgattatggagaaattggtgcca

SEQ ID NO: 17305 - DNA, 25 bp, Mus musculus
catgattctgatagcggcaagttcc

SEQ ID NO: 17306 - DNA, 25 bp, Mus musculus
catgattggagatggagctacggac

SEQ ID NO: 17307 - DNA, 25 bp, Mus musculus
catgattggcgatgacatcgtgggt

SEQ ID NO: 17308 - DNA, 25 bp, Mus musculus
catgattgggctgatgctgggatcc

SEQ ID NO: 17309 - DNA, 25 bp, Mus musculus
catgattgtgaggagggccatcaag

SEQ ID NO: 17310 - DNA, 25 bp, Mus musculus
catgattgtgcccaagcagcggaaa

SEQ ID NO: 17311 - DNA, 25 bp, Mus musculus
catgattttcaagctcttgcattag

SEQ ID NO: 17312 - DNA, 25 bp, Mus musculus
catgattttcctggttagaagacca

SEQ ID NO: 17313 - DNA, 25 bp, Mus musculus
catgcaacagtcacaggagaagatc

SEQ ID NO: 17314 - DNA, 25 bp, Mus musculus
catgcaactggcatataacttgctg

SEQ ID NO: 17315 - DNA, 25 bp, Mus musculus
catgcaagagactgtacagttccag

SEQ ID NO: 17316 - DNA, 25 bp, Mus musculus
catgcaagaggttgttctgagcctg

SEQ ID NO: 17317 - DNA, 25 bp, Mus musculus
catgcacacaaggtggccaagttct

SEQ ID NO: 17318 - DNA, 25 bp, Mus musculus
catgcacagaaagagcttcagaagt

SEQ ID NO: 17319 - DNA, 25 bp, Mus musculus
catgcacagatgctctcagcttttt

SEQ ID NO: 17320 - DNA, 25 bp, Mus musculus
catgcacatacaacatgaagaaatt

SEQ ID NO: 17321 - DNA, 25 bp, Mus musculus
catgcacatttgaccaagagcagat

SEQ ID NO: 17322 - DNA, 25 bp, Mus musculus
catgcaccagctgcgatgcaatggc

SEQ ID NO: 17323 - DNA, 25 bp, Mus musculus
catgcaccagggtgcactggcgcag

SEQ ID NO: 17324 - DNA, 25 bp, Mus musculus
catgcacccggttctatcatccaga

SEQ ID NO: 17325 - DNA, 25 bp, Mus musculus
catgcacctggaggatttcccgatg

SEQ ID NO: 17326 - DNA, 25 bp, Mus musculus
catgcacggtgttgggtgtcctttc

SEQ ID NO: 17327 - DNA, 25 bp, Mus musculus
catgcagaagattatacctcactat

SEQ ID NO: 17328 - DNA, 25 bp, Mus musculus
catgcagactctttgaataaccttg

SEQ ID NO: 17329 - DNA, 25 bp, Mus musculus
catgcagatgcaaaagtccaggtgc

SEQ ID NO: 17330 - DNA, 25 bp, Mus musculus
catgcagcaaggtatcaaggccggg

SEQ ID NO: 17331 - DNA, 25 bp, Mus musculus
catgcagcagggactatgctaccgg

SEQ ID NO: 17332 - DNA, 25 bp, Mus musculus
catgcagcagggtctatgctaccgg

SEQ ID NO: 17333 - DNA, 25 bp, Mus musculus
catgcagccagttcgctctctgttg

SEQ ID NO: 17334 - DNA, 25 bp, Mus musculus
catgcagctggttaccgaaatgggc

SEQ ID NO: 17335 - DNA, 25 bp, Mus musculus
catgcaggagcaacagcgaaagctg

SEQ ID NO: 17336 - DNA, 25 bp, Mus musculus
catgcaggccgtgaaagtagaaagg

SEQ ID NO: 17337 - DNA, 25 bp, Mus musculus
catgcagggactgaaagagatgaag

SEQ ID NO: 17338 - DNA, 25 bp, Mus musculus
catgcaggtccagattcagttggtc

SEQ ID NO: 17339 - DNA, 25 bp, Mus musculus
catgcaggtttctaagtatggtgac

SEQ ID NO: 17340 - DNA, 25 bp, Mus musculus
catgcagtatctaatgtatgggatg

SEQ ID NO: 17341 - DNA, 25 bp, Mus musculus
catgcagtcagtagcaagcagagaa

SEQ ID NO: 17342 - DNA, 25 bp, Mus musculus
catgcagtcagttgcaagcagagaa

SEQ ID NO: 17343 - DNA, 25 bp, Mus musculus
catgcagtgggtactcctaggactt

SEQ ID NO: 17344 - DNA, 25 bp, Mus musculus
catgcagtgtagactctgcgcgacc

SEQ ID NO: 17345 - DNA, 25 bp, Mus musculus
catgcagtgtgcaaggaaaatactt

SEQ ID NO: 17346 - DNA, 25 bp, Mus musculus
catgcagtgtgctaggaaaatactt

SEQ ID NO: 17347 - DNA, 25 bp, Mus musculus
catgcataatacagttggtgggacc

SEQ ID NO: 17348 - DNA, 25 bp, Mus musculus
catgcataatcctgataagtttgag

SEQ ID NO: 17349 - DNA, 25 bp, Mus musculus
catgcatgactacgatcacccaggg

SEQ ID NO: 17350 - DNA, 25 bp, Mus musculus
catgcatggcgtctaatgagcagga

SEQ ID NO: 17351 - DNA, 25 bp, Mus musculus
catgcatgtatgttttaaaggaaat

SEQ ID NO: 17352 - DNA, 25 bp, Mus musculus
catgcatgtccagtgcagtgagcac

SEQ ID NO: 17353 - DNA, 25 bp, Mus musculus
catgcatttgctggcagtgattgga

SEQ ID NO: 17354 - DNA, 25 bp, Mus musculus
catgccaactcaccgcagttttggt

SEQ ID NO: 17355 - DNA, 25 bp, Mus musculus
catgccaacttaccagatccgagct

SEQ ID NO: 17356 - DNA, 25 bp, Mus musculus
catgccaccaggaagtgatggttag

SEQ ID NO: 17357 - DNA, 25 bp, Mus musculus
catgccactgcagaactgtgatgac

SEQ ID NO: 17358 - DNA, 25 bp, Mus musculus
catgccagcaagtagatcagccaaa

SEQ ID NO: 17359 - DNA, 25 bp, Mus musculus
catgccagggtatggctatagagca

SEQ ID NO: 17360 - DNA, 25 bp, Mus musculus
catgcccagcagcaaaaagttgtca

SEQ ID NO: 17361 - DNA, 25 bp, Mus musculus
catgcccagtgtcagatgtctccag

SEQ ID NO: 17362 - DNA, 25 bp, Mus musculus
catgcccatacggattgaaaaccca

SEQ ID NO: 17363 - DNA, 25 bp, Mus musculus
catgccccacaggatttgttctgct

SEQ ID NO: 17364 - DNA, 25 bp, Mus musculus
catgccccacattcctgaggatgag

SEQ ID NO: 17365 - DNA, 25 bp, Mus musculus
catgcccctagtatcgacatcacta

SEQ ID NO: 17366 - DNA, 25 bp, Mus musculus
catgcccctagtttcgacatcacta

SEQ ID NO: 17367 - DNA, 25 bp, Mus musculus
catgcccggaagtgcaatgagaccg

SEQ ID NO: 17368 - DNA, 25 bp, Mus musculus
catgcccggttacgctgcatgtgca

SEQ ID NO: 17369 - DNA, 25 bp, Mus musculus
catgccctacgttggtataatcaca

SEQ ID NO: 17370 - DNA, 25 bp, Mus musculus
catgccctccttggtggatgagatc

SEQ ID NO: 17371 - DNA, 25 bp, Mus musculus
catgccctgcatcctgtgcacatgt

SEQ ID NO: 17372 - DNA, 25 bp, Mus musculus
catgccctgtggtgtgatcctggct

SEQ ID NO: 17373 - DNA, 25 bp, Mus musculus
catgccgagtgacctgtccactagt

SEQ ID NO: 17374 - DNA, 25 bp, Mus musculus
catgccgatcttagtaactacgatg

SEQ ID NO: 17375 - DNA, 25 bp, Mus musculus
catgccggcccagtccatgtgggag

SEQ ID NO: 17376 - DNA, 25 bp, Mus musculus
catgccggcctggaatctggagatc

SEQ ID NO: 17377 - DNA, 25 bp, Mus musculus
catgcctactatcttgctgcaatag

SEQ ID NO: 17378 - DNA, 25 bp, Mus musculus
catgcctacttttatcttcgaacac

SEQ ID NO: 17379 - DNA, 25 bp, Mus musculus
catgcctagtgttggatggtccacc

SEQ ID NO: 17380 - DNA, 25 bp, Mus musculus
catgcctatacgtcgagccgtgaat

SEQ ID NO: 17381 - DNA, 25 bp, Mus musculus
catgcctatgccacaggctgcacaa

SEQ ID NO: 17382 - DNA, 25 bp, Mus musculus
catgcctatgcctcaggctgcacaa

SEQ ID NO: 17383 - DNA, 25 bp, Mus musculus
catgcctcatggagggagcccaaac

SEQ ID NO: 17384 - DNA, 25 bp, Mus musculus
catgcctccttggattgtagacaca

SEQ ID NO: 17385 - DNA, 25 bp, Mus musculus
catgcctcgttccatgagaggattt

SEQ ID NO: 17386 - DNA, 25 bp, Mus musculus
catgcctgctgatctgcctgccatt

SEQ ID NO: 17387 - DNA, 25 bp, Mus musculus
catgccttcaggcttttgaaaagtt

SEQ ID NO: 17388 - DNA, 25 bp, Mus musculus
catgcctttggaaaagtgtgtcagt

SEQ ID NO: 17389 - DNA, 25 bp, Mus musculus
catgcgacaactgctggacagcgag

SEQ ID NO: 17390 - DNA, 25 bp, Mus musculus
catgcgagatctatgccagagcggc

SEQ ID NO: 17391 - DNA, 25 bp, Mus musculus
catgcgatacctgcctgagctctgg

SEQ ID NO: 17392 - DNA, 25 bp, Mus musculus
catgcgcacagtatctgaaagagag

SEQ ID NO: 17393 - DNA, 25 bp, Mus musculus
catgcgcattgagttcaagaagata

SEQ ID NO: 17394 - DNA, 25 bp, Mus musculus
catgcggacagcaaccgctttgagg

SEQ ID NO: 17395 - DNA, 25 bp, Mus musculus
catgcggcctgctttggtctccagc

SEQ ID NO: 17396 - DNA, 25 bp, Mus musculus
catgcgtctgagaattcctttgttt

SEQ ID NO: 17397 - DNA, 25 bp, Mus musculus
catgcgttggaagaaatggttagcc

SEQ ID NO: 17398 - DNA, 25 bp, Mus musculus
catgctagcctggaccatttttcag

SEQ ID NO: 17399 - DNA, 25 bp, Mus musculus
catgctagtgattcaagttcatcca

SEQ ID NO: 17400 - DNA, 25 bp, Mus musculus
catgctcaacgtgttcctcaagtcg

SEQ ID NO: 17401 - DNA, 25 bp, Mus musculus
catgctcacagtggtctgtatcctg

SEQ ID NO: 17402 - DNA, 25 bp, Mus musculus
catgctcactagagtgttcgtggga

SEQ ID NO: 17403 - DNA, 25 bp, Mus musculus
catgctcagcgataaggatcctatg

SEQ ID NO: 17404 - DNA, 25 bp, Mus musculus
catgctccagtgtgcaccagccagg

SEQ ID NO: 17405 - DNA, 25 bp, Mus musculus
catgctcccagttccattgttgaca

SEQ ID NO: 17406 - DNA, 25 bp, Mus musculus
catgctcccgatggcaggtctgcga

SEQ ID NO: 17407 - DNA, 25 bp, Mus musculus
catgctccggatccagcatcatcgg

SEQ ID NO: 17408 - DNA, 25 bp, Mus musculus
catgctcctgcgtctctacctggtg

SEQ ID NO: 17409 - DNA, 25 bp, Mus musculus
catgctcctgttcaggcacgcaggg

SEQ ID NO: 17410 - DNA, 25 bp, Mus musculus
catgctcggtttggaatgagaaaaa

SEQ ID NO: 17411 - DNA, 25 bp, Mus musculus
catgctgaacagatggacgtggcgc

SEQ ID NO: 17412 - DNA, 25 bp, Mus musculus
catgctgaagccctcgtcactggtt

SEQ ID NO: 17413 - DNA, 25 bp, Mus musculus
catgctgaagttggatggctgtttc

SEQ ID NO: 17414 - DNA, 25 bp, Mus musculus
catgctgactttgtccttgaactga

SEQ ID NO: 17415 - DNA, 25 bp, Mus musculus
catgctgagtgtggacgactgcttt

SEQ ID NO: 17416 - DNA, 25 bp, Mus musculus
catgctgatggcagacaaggagaag

SEQ ID NO: 17417 - DNA, 25 bp, Mus musculus
catgctgatttctgcccttcggatg

SEQ ID NO: 17418 - DNA, 25 bp, Mus musculus
catgctgcaaagagctttgctccta

SEQ ID NO: 17419 - DNA, 25 bp, Mus musculus
catgctgcaagtaggagcactgcac

SEQ ID NO: 17420 - DNA, 25 bp, Mus musculus
catgctgcaagttggagcactgcac

SEQ ID NO: 17421 - DNA, 25 bp, Mus musculus
catgctgcatagagaatagggcggt

SEQ ID NO: 17422 - DNA, 25 bp, Mus musculus
catgctggaggagggttctttccgt

SEQ ID NO: 17423 - DNA, 25 bp, Mus musculus
catgctggatgagagcagcctctat

SEQ ID NO: 17424 - DNA, 25 bp, Mus musculus
catgctggctagctacgccgtctac

SEQ ID NO: 17425 - DNA, 25 bp, Mus musculus
catgctggtctatgtatggagccgt

SEQ ID NO: 17426 - DNA, 25 bp, Mus musculus
catgctgtaccccaaggaggacaag

SEQ ID NO: 17427 - DNA, 25 bp, Mus musculus
catgctgtatgcacaagctgtgcga

SEQ ID NO: 17428 - DNA, 25 bp, Mus musculus
catgctgtccagtgggcctgcctgg

SEQ ID NO: 17429 - DNA, 25 bp, Mus musculus
catgctgtgagatgcccatgaggcc

SEQ ID NO: 17430 - DNA, 25 bp, Mus musculus
catgctgtgcatcgaggagcgactc

SEQ ID NO: 17431 - DNA, 25 bp, Mus musculus
catgctgtgcccttttgtcgtggtc

SEQ ID NO: 17432 - DNA, 25 bp, Mus musculus
catgctgtgtgtgaaaacgtgaacg

SEQ ID NO: 17433 - DNA, 25 bp, Mus musculus
catgctgttggctggcccagaccac

SEQ ID NO: 17434 - DNA, 25 bp, Mus musculus
catgctgtttctataggtccaacgt

SEQ ID NO: 17435 - DNA, 25 bp, Mus musculus
catgcttagcatgtacgtaggtctc

SEQ ID NO: 17436 - DNA, 25 bp, Mus musculus
catgcttgcatgctacgcggggcac

SEQ ID NO: 17437 - DNA, 25 bp, Mus musculus
catgcttgtgcttgtgattctgtcc

SEQ ID NO: 17438 - DNA, 25 bp, Mus musculus
catggaaaaagcttgatggacagtg

SEQ ID NO: 17439 - DNA, 25 bp, Mus musculus
catggaaaagggtgactgaggaacc

SEQ ID NO: 17440 - DNA, 25 bp, Mus musculus
catggaaaatctcccgaggagctgt

SEQ ID NO: 17441 - DNA, 25 bp, Mus musculus
catggaaacacctgctccttctgca

SEQ ID NO: 17442 - DNA, 25 bp, Mus musculus
catggaaagcacagacagtgtggcc

SEQ ID NO: 17443 - DNA, 25 bp, Mus musculus
catggaaccaacctcacctgtcagg

SEQ ID NO: 17444 - DNA, 25 bp, Mus musculus
catggaacccaagttttacagcagc

SEQ ID NO: 17445 - DNA, 25 bp, Mus musculus
catggaagcatgtctcagccagcgg

SEQ ID NO: 17446 - DNA, 25 bp, Mus musculus
catggaagcctccagcctgatgtgg

SEQ ID NO: 17447 - DNA, 25 bp, Mus musculus
catggaaggcaacaggtgtcacagc

SEQ ID NO: 17448 - DNA, 25 bp, Mus musculus
catggaaggtatcccatctgatccc

SEQ ID NO: 17449 - DNA, 25 bp, Mus musculus
catggaaggtgtaaaggccaccacc

SEQ ID NO: 17450 - DNA, 25 bp, Mus musculus
catggaatatctcgtgaaatggaag

SEQ ID NO: 17451 - DNA, 25 bp, Mus musculus
catggaatcacagagcaaagggaca

SEQ ID NO: 17452 - DNA, 25 bp, Mus musculus
catggaatcagagcctcttcctggc

SEQ ID NO: 17453 - DNA, 25 bp, Mus musculus
catggaatgggcttaaggctccttg

SEQ ID NO: 17454 - DNA, 25 bp, Mus musculus
catggaattccggaaacattgctgt

SEQ ID NO: 17455 - DNA, 25 bp, Mus musculus
catggaattgccaatgaagacattg

SEQ ID NO: 17456 - DNA, 25 bp, Mus musculus
catggaattgcctatgaagacattg

SEQ ID NO: 17457 - DNA, 25 bp, Mus musculus
catggacaaaactgaaaacacagcc

SEQ ID NO: 17458 - DNA, 25 bp, Mus musculus
catggacacagatggctcttacttc

SEQ ID NO: 17459 - DNA, 25 bp, Mus musculus
catggacagtttgctcctgggaggc

SEQ ID NO: 17460 - DNA, 25 bp, Mus musculus
catggacatatctgctatcgacttg

SEQ ID NO: 17461 - DNA, 25 bp, Mus musculus
catggacatctgctggaaaaaagtc

SEQ ID NO: 17462 - DNA, 25 bp, Mus musculus
catggacatctggtggaaaaaagtc

SEQ ID NO: 17463 - DNA, 25 bp, Mus musculus
catggacatgcggaaagcccttttc

SEQ ID NO: 17464 - DNA, 25 bp, Mus musculus
catggacatgtttgggatgatgaac

SEQ ID NO: 17465 - DNA, 25 bp, Mus musculus
catggacctagagcgagccaagcgg

SEQ ID NO: 17466 - DNA, 25 bp, Mus musculus
catggacctgttgtttgggcgccgg

SEQ ID NO: 17467 - DNA, 25 bp, Mus musculus
catggactcggatttcttcgactcc

SEQ ID NO: 17468 - DNA, 25 bp, Mus musculus
catggactctgacactgttgcctct

SEQ ID NO: 17469 - DNA, 25 bp, Mus musculus
catggactgcatgaacaagctaaaa

SEQ ID NO: 17470 - DNA, 25 bp, Mus musculus
catggactttcattttaatgctctc

SEQ ID NO: 17471 - DNA, 25 bp, Mus musculus
catggagaaaatggagccaataaac

SEQ ID NO: 17472 - DNA, 25 bp, Mus musculus
catggagaaggactgtcaagacatc

SEQ ID NO: 17473 - DNA, 25 bp, Mus musculus
catggagacactgtgcttgatctgt

SEQ ID NO: 17474 - DNA, 25 bp, Mus musculus
catggagactgctgagaagctggcc

SEQ ID NO: 17475 - DNA, 25 bp, Mus musculus
catggagatgacttgattgtgaccc

SEQ ID NO: 17476 - DNA, 25 bp, Mus musculus
catggagcagatcatcaaggccaag

SEQ ID NO: 17477 - DNA, 25 bp, Mus musculus
catggagcctgcgtttcacagaggg

SEQ ID NO: 17478 - DNA, 25 bp, Mus musculus
catggaggaatacgagcctcgaaat

SEQ ID NO: 17479 - DNA, 25 bp, Mus musculus
catggaggatctacgcaaccgactc

SEQ ID NO: 17480 - DNA, 25 bp, Mus musculus
catggaggcactggccttagctgag

SEQ ID NO: 17481 - DNA, 25 bp, Mus musculus
catggagggtagtcttgtcaaacac

SEQ ID NO: 17482 - DNA, 25 bp, Mus musculus
catggagggttgtgagccctatgct

SEQ ID NO: 17483 - DNA, 25 bp, Mus musculus
catggaggtacggagccttgttacc

SEQ ID NO: 17484 - DNA, 25 bp, Mus musculus
catggaggtgcaatcgtgttgagct

SEQ ID NO: 17485 - DNA, 25 bp, Mus musculus
catggaggtgcagacgtaagccctg

SEQ ID NO: 17486 - DNA, 25 bp, Mus musculus
catggagtatagctgtggcactgca

SEQ ID NO: 17487 - DNA, 25 bp, Mus musculus
catggagtatctgtggtttttgtca

SEQ ID NO: 17488 - DNA, 25 bp, Mus musculus
catggagtcaggagatgatgccaca

SEQ ID NO: 17489 - DNA, 25 bp, Mus musculus
catggagtctgaggtctacgacacc

SEQ ID NO: 17490 - DNA, 25 bp, Mus musculus
catggagtggaggtgctgtcagggt

SEQ ID NO: 17491 - DNA, 25 bp, Mus musculus
catggagttggattctgcctctgtc

SEQ ID NO: 17492 - DNA, 25 bp, Mus musculus
catggataaagaggcctgtaaaaac

SEQ ID NO: 17493 - DNA, 25 bp, Mus musculus
catggataagcacgctgatgcccct

SEQ ID NO: 17494 - DNA, 25 bp, Mus musculus
catggataatttccagtatgtgggc

SEQ ID NO: 17495 - DNA, 25 bp, Mus musculus
catggatctgaaagtgacaagcatt

SEQ ID NO: 17496 - DNA, 25 bp, Mus musculus
catggatgaatcactgcagtttaac

SEQ ID NO: 17497 - DNA, 25 bp, Mus musculus
catggatgagacctgcatagaccag

SEQ ID NO: 17498 - DNA, 25 bp, Mus musculus
catggatgatatgggcatctgtccg

SEQ ID NO: 17499 - DNA, 25 bp, Mus musculus
catggatggcttcttgcaggacccc

SEQ ID NO: 17500 - DNA, 25 bp, Mus musculus
catggattccagtcgagatgaggtc

SEQ ID NO: 17501 - DNA, 25 bp, Mus musculus
catggatttgctgcctgacagacgt

SEQ ID NO: 17502 - DNA, 25 bp, Mus musculus
catggcaactggaaagtccaaaggc

SEQ ID NO: 17503 - DNA, 25 bp, Mus musculus
catggcaaggcactgacctgatgca

SEQ ID NO: 17504 - DNA, 25 bp, Mus musculus
catggcacctgcagaagctatacct

SEQ ID NO: 17505 - DNA, 25 bp, Mus musculus
catggcacgcttaggcttgctcgcg

SEQ ID NO: 17506 - DNA, 25 bp, Mus musculus
catggcacgctttggcttgctcgcg

SEQ ID NO: 17507 - DNA, 25 bp, Mus musculus
catggcagagatgtggactcgtagc

SEQ ID NO: 17508 - DNA, 25 bp, Mus musculus
catggcagcagcaactacactgggc

SEQ ID NO: 17509 - DNA, 25 bp, Mus musculus
catggcagcagctactacactgggc

SEQ ID NO: 17510 - DNA, 25 bp, Mus musculus
catggcataaggagcattatcctgg

SEQ ID NO: 17511 - DNA, 25 bp, Mus musculus
catggcatattatgagtttctgaaa

SEQ ID NO: 17512 - DNA, 25 bp, Mus musculus
catggcatctaagaaatttgccgtt

SEQ ID NO: 17513 - DNA, 25 bp, Mus musculus
catggcatctgtgtttcgaagtgag

SEQ ID NO: 17514 - DNA, 25 bp, Mus musculus
catggcatcttcaactggctcacag

SEQ ID NO: 17515 - DNA, 25 bp, Mus musculus
catggcatgggagacaccttcttgg

SEQ ID NO: 17516 - DNA, 25 bp, Mus musculus
catggcatgttccatggcgtgtggt

SEQ ID NO: 17517 - DNA, 25 bp, Mus musculus
catggccagaaaagcatcgttcaga

SEQ ID NO: 17518 - DNA, 25 bp, Mus musculus
catggccagaaatgcatcgttcaga

SEQ ID NO: 17519 - DNA, 25 bp, Mus musculus
catggccagcccaagaaccaggaaa

SEQ ID NO: 17520 - DNA, 25 bp, Mus musculus
catggccagggcatccagtatatct

SEQ ID NO: 17521 - DNA, 25 bp, Mus musculus
catggccatggacatgcggaaagcc

SEQ ID NO: 17522 - DNA, 25 bp, Mus musculus
catggcccacgttgccttgattcct

SEQ ID NO: 17523 - DNA, 25 bp, Mus musculus
catggcctacaataaagcaccacgg

SEQ ID NO: 17524 - DNA, 25 bp, Mus musculus
catggcctacctccagaggcaagct

SEQ ID NO: 17525 - DNA, 25 bp, Mus musculus
catggcctatgcagactatcatgac

SEQ ID NO: 17526 - DNA, 25 bp, Mus musculus
catggcctctgtgaatacccttttc

SEQ ID NO: 17527 - DNA, 25 bp, Mus musculus
catggcgaacttaaccagaagctga

SEQ ID NO: 17528 - DNA, 25 bp, Mus musculus
catggcgcactgtgagtttcttctc

SEQ ID NO: 17529 - DNA, 25 bp, Mus musculus
catggcggctcctcgacttcacttt

SEQ ID NO: 17530 - DNA, 25 bp, Mus musculus
catggcggtgagacttcctggatca

SEQ ID NO: 17531 - DNA, 25 bp, Mus musculus
catggcgtctaatgagcaggacagt

SEQ ID NO: 17532 - DNA, 25 bp, Mus musculus
catggctacccggaaggaactagaa

SEQ ID NO: 17533 - DNA, 25 bp, Mus musculus
catggctcagcaacattatatgggc

SEQ ID NO: 17534 - DNA, 25 bp, Mus musculus
catggctcaggatcagaccctggag

SEQ ID NO: 17535 - DNA, 25 bp, Mus musculus
catggctctgctgcagagagctctg

SEQ ID NO: 17536 - DNA, 25 bp, Mus musculus
catggctgaagcagtgggaatcgat

SEQ ID NO: 17537 - DNA, 25 bp, Mus musculus
catggctgaatgtggcaaggttgct

SEQ ID NO: 17538 - DNA, 25 bp, Mus musculus
catggctgagaccagcatgatgcca

SEQ ID NO: 17539 - DNA, 25 bp, Mus musculus
catggctgattgctgttaccagaga

SEQ ID NO: 17540 - DNA, 25 bp, Mus musculus
catggctgcagctaaggtgtgtgaa

SEQ ID NO: 17541 - DNA, 25 bp, Mus musculus
catggctgggctcatccctgctctg

SEQ ID NO: 17542 - DNA, 25 bp, Mus musculus
catggctgtgacgtggcctgatcta

SEQ ID NO: 17543 - DNA, 25 bp, Mus musculus
catggcttacttggtgctgctcaga

SEQ ID NO: 17544 - DNA, 25 bp, Mus musculus
catggctttgcaccttgcacgacat

SEQ ID NO: 17545 - DNA, 25 bp, Mus musculus
catgggaaatcctcttctgtgtatt

SEQ ID NO: 17546 - DNA, 25 bp, Mus musculus
catgggaacatccaagtcagttgtg

SEQ ID NO: 17547 - DNA, 25 bp, Mus musculus
catgggaagagagcaagcagtattg

SEQ ID NO: 17548 - DNA, 25 bp, Mus musculus
catgggaagggtcctactatctccc

SEQ ID NO: 17549 - DNA, 25 bp, Mus musculus
catgggaagtcctgctactgctgga

SEQ ID NO: 17550 - DNA, 25 bp, Mus musculus
catgggaccatcatttttattccag

SEQ ID NO: 17551 - DNA, 25 bp, Mus musculus
catgggaccgtttggctctggccac

SEQ ID NO: 17552 - DNA, 25 bp, Mus musculus
catgggagacaccttcttgggacgt

SEQ ID NO: 17553 - DNA, 25 bp, Mus musculus
catgggagacttcaatgctggctgc

SEQ ID NO: 17554 - DNA, 25 bp, Mus musculus
catgggagagtactttagagacaac

SEQ ID NO: 17555 - DNA, 25 bp, Mus musculus
catgggaggagcattgccttttaaa

SEQ ID NO: 17556 - DNA, 25 bp, Mus musculus
catgggaggttacaaccattctgtg

SEQ ID NO: 17557 - DNA, 25 bp, Mus musculus
catgggcaactggaacttctgggtc

SEQ ID NO: 17558 - DNA, 25 bp, Mus musculus
catgggcacaatgcaggaaaggatc

SEQ ID NO: 17559 - DNA, 25 bp, Mus musculus
catgggcactgatctgggcaaactc

SEQ ID NO: 17560 - DNA, 25 bp, Mus musculus
catgggcagcactgatagaatagag

SEQ ID NO: 17561 - DNA, 25 bp, Mus musculus
catgggcctcattgacattctgaca

SEQ ID NO: 17562 - DNA, 25 bp, Mus musculus
catgggccttgtaggcttcatgatc

SEQ ID NO: 17563 - DNA, 25 bp, Mus musculus
catgggcgtcaatgtgggtacttcg

SEQ ID NO: 17564 - DNA, 25 bp, Mus musculus
catgggctaccttacgatatgccac

SEQ ID NO: 17565 - DNA, 25 bp, Mus musculus
catgggctatggagccgccacatct

SEQ ID NO: 17566 - DNA, 25 bp, Mus musculus
catgggtaagagatctgacctatct

SEQ ID NO: 17567 - DNA, 25 bp, Mus musculus
catgggtaccgagaaggaagagccc

SEQ ID NO: 17568 - DNA, 25 bp, Mus musculus
catgggtccctgtcgcttctgcggt

SEQ ID NO: 17569 - DNA, 25 bp, Mus musculus
catgggtgtgtggagctccatccac

SEQ ID NO: 17570 - DNA, 25 bp, Mus musculus
catgggttgactccttgcttctgcc

SEQ ID NO: 17571 - DNA, 25 bp, Mus musculus
catggtagaaatccaagaactgctg

SEQ ID NO: 17572 - DNA, 25 bp, Mus musculus
catggtagaagagcttgagaaagcc

SEQ ID NO: 17573 - DNA, 25 bp, Mus musculus
catggtagggcatcccgctctgctg

SEQ ID NO: 17574 - DNA, 25 bp, Mus musculus
catggtagtcagtgaactcacgtcc

SEQ ID NO: 17575 - DNA, 25 bp, Mus musculus
catggtcacgtgctgcatcttccca

SEQ ID NO: 17576 - DNA, 25 bp, Mus musculus
catggtcactgcaagtgtatccaat

SEQ ID NO: 17577 - DNA, 25 bp, Mus musculus
catggtcagagaaggtgcggcagta

SEQ ID NO: 17578 - DNA, 25 bp, Mus musculus
catggtcatttcctcagtgattgga

SEQ ID NO: 17579 - DNA, 25 bp, Mus musculus
catggtccagcatcagtgtggagga

SEQ ID NO: 17580 - DNA, 25 bp, Mus musculus
catggtccgagagcccatcttcaag

SEQ ID NO: 17581 - DNA, 25 bp, Mus musculus
catggtccggagagcagacatctgg

SEQ ID NO: 17582 - DNA, 25 bp, Mus musculus
catggtctctatcctagacccagaa

SEQ ID NO: 17583 - DNA, 25 bp, Mus musculus
catggtctgggacttctggagtctt

SEQ ID NO: 17584 - DNA, 25 bp, Mus musculus
catggtgatagctcccaagggtgtc

SEQ ID NO: 17585 - DNA, 25 bp, Mus musculus
catggtgatgacacagtacatccgc

SEQ ID NO: 17586 - DNA, 25 bp, Mus musculus
catggtgcaggtgcgggagcggatt

SEQ ID NO: 17587 - DNA, 25 bp, Mus musculus
catggtgcccttctacattggttac

SEQ ID NO: 17588 - DNA, 25 bp, Mus musculus
catggtggaaattcaggctggtact

SEQ ID NO: 17589 - DNA, 25 bp, Mus musculus
catggtggaccagagtgagctagct

SEQ ID NO: 17590 - DNA, 25 bp, Mus musculus
catggtggatatgagtgttcagaaa

SEQ ID NO: 17591 - DNA, 25 bp, Mus musculus
catggtggcagctggattgatcctt

SEQ ID NO: 17592 - DNA, 25 bp, Mus musculus
catggtggtggccactcttacaacc

SEQ ID NO: 17593 - DNA, 25 bp, Mus musculus
catggtggttcattcctgcagtgcc

SEQ ID NO: 17594 - DNA, 25 bp, Mus musculus
catggtgtcccatactgagcgggcc

SEQ ID NO: 17595 - DNA, 25 bp, Mus musculus
catggtgtctgccactgcaatgccg

SEQ ID NO: 17596 - DNA, 25 bp, Mus musculus
catggttacgcatgctcggcttcag

SEQ ID NO: 17597 - DNA, 25 bp, Mus musculus
catggttgctgctcagaaaggttac

SEQ ID NO: 17598 - DNA, 25 bp, Mus musculus
catggttgtgcctccccaggaacct

SEQ ID NO: 17599 - DNA, 25 bp, Mus musculus
catggtttatgacggcttcgggcct

SEQ ID NO: 17600 - DNA, 25 bp, Mus musculus
catggtttatgatccatctctgtga

SEQ ID NO: 17601 - DNA, 25 bp, Mus musculus
catggtttcctattcctttctggag

SEQ ID NO: 17602 - DNA, 25 bp, Mus musculus
catggtttctctagagatcccacag

SEQ ID NO: 17603 - DNA, 25 bp, Mus musculus
catggtttgcatcattgccaaccca

SEQ ID NO: 17604 - DNA, 25 bp, Mus musculus
catggttttcatccctagtggctac

SEQ ID NO: 17605 - DNA, 25 bp, Mus musculus
catggttttcatgcctagtggctac

SEQ ID NO: 17606 - DNA, 25 bp, Mus musculus
catgtaaagccttgttccgcacgcc

SEQ ID NO: 17607 - DNA, 25 bp, Mus musculus
catgtacaatgcttttggcaagccc

SEQ ID NO: 17608 - DNA, 25 bp, Mus musculus
catgtacacgcctggagatgcctga

SEQ ID NO: 17609 - DNA, 25 bp, Mus musculus
catgtacagagaatggctggtcccc

SEQ ID NO: 17610 - DNA, 25 bp, Mus musculus
catgtacaggaacatggggagtcct

SEQ ID NO: 17611 - DNA, 25 bp, Mus musculus
catgtaccataaccattgaggttga

SEQ ID NO: 17612 - DNA, 25 bp, Mus musculus
catgtacctgagagtaatatgaatg

SEQ ID NO: 17613 - DNA, 25 bp, Mus musculus
catgtacctgccaccctggctttga

SEQ ID NO: 17614 - DNA, 25 bp, Mus musculus
catgtacgtaggtctcatcaccatc

SEQ ID NO: 17615 - DNA, 25 bp, Mus musculus
catgtactacaatgtcatcaatgcc

SEQ ID NO: 17616 - DNA, 25 bp, Mus musculus
catgtagaagtattttgttatgcca

SEQ ID NO: 17617 - DNA, 25 bp, Mus musculus
catgtagcagcgcattacgataatc

SEQ ID NO: 17618 - DNA, 25 bp, Mus musculus
catgtagccatgaagacaggatggg

SEQ ID NO: 17619 - DNA, 25 bp, Mus musculus
catgtagccatgtagacaggatggg

SEQ ID NO: 17620 - DNA, 25 bp, Mus musculus
catgtagtagccagacacgagtata

SEQ ID NO: 17621 - DNA, 25 bp, Mus musculus
catgtatacgatctgcagtgaccac

SEQ ID NO: 17622 - DNA, 25 bp, Mus musculus
catgtatatcaggtactgctgtgat

SEQ ID NO: 17623 - DNA, 25 bp, Mus musculus
catgtatatctactggactcagctc

SEQ ID NO: 17624 - DNA, 25 bp, Mus musculus
catgtatctgtcagctaaagggccc

SEQ ID NO: 17625 - DNA, 25 bp, Mus musculus
catgtatgacatcgccaaccaggag

SEQ ID NO: 17626 - DNA, 25 bp, Mus musculus
catgtatgagtgtaagccagcggct

SEQ ID NO: 17627 - DNA, 25 bp, Mus musculus
catgtatgataaactaaggatgttg

SEQ ID NO: 17628 - DNA, 25 bp, Mus musculus
catgtatgggaatggcaaagactat

SEQ ID NO: 17629 - DNA, 25 bp, Mus musculus
catgtattctcatactagactccct

SEQ ID NO: 17630 - DNA, 25 bp, Mus musculus
catgtatttgacagttacggagggc

SEQ ID NO: 17631 - DNA, 25 bp, Mus musculus
catgtatttgactgttacggagggc

SEQ ID NO: 17632 - DNA, 25 bp, Mus musculus
catgtatttttagaagacagtcctg

SEQ ID NO: 17633 - DNA, 25 bp, Mus musculus
catgtcaagttgttaccatcgcgcc

SEQ ID NO: 17634 - DNA, 25 bp, Mus musculus
catgtcacgagagcgtgagcttctg

SEQ ID NO: 17635 - DNA, 25 bp, Mus musculus
catgtcagatcaagaggaggagatg

SEQ ID NO: 17636 - DNA, 25 bp, Mus musculus
catgtcagcatttgtgaaggcctcg

SEQ ID NO: 17637 - DNA, 25 bp, Mus musculus
catgtcagcggtggaccgtggaggc

SEQ ID NO: 17638 - DNA, 25 bp, Mus musculus
catgtcaggccgtgtgcgtggtaac

SEQ ID NO: 17639 - DNA, 25 bp, Mus musculus
catgtcagtgaccaaagtagtagtc

SEQ ID NO: 17640 - DNA, 25 bp, Mus musculus
catgtcagtgtttttgtgtataaca

SEQ ID NO: 17641 - DNA, 25 bp, Mus musculus
catgtcatcgagtggctgcgctttg

SEQ ID NO: 17642 - DNA, 25 bp, Mus musculus
catgtcatttgaggagctgttgaga

SEQ ID NO: 17643 - DNA, 25 bp, Mus musculus
catgtccaaaagctaaatctgctgc

SEQ ID NO: 17644 - DNA, 25 bp, Mus musculus
catgtccaccttcccgcagtgaggg

SEQ ID NO: 17645 - DNA, 25 bp, Mus musculus
catgtcccacctcagtgactgtgag

SEQ ID NO: 17646 - DNA, 25 bp, Mus musculus
catgtccctgcgctcaagtatggca

SEQ ID NO: 17647 - DNA, 25 bp, Mus musculus
catgtccgccaggattctgaggtgg

SEQ ID NO: 17648 - DNA, 25 bp, Mus musculus
catgtcctatattcaactcttcaag

SEQ ID NO: 17649 - DNA, 25 bp, Mus musculus
catgtccttgcagatggatcgcagg

SEQ ID NO: 17650 - DNA, 25 bp, Mus musculus
catgtcggacctgacgtcagtgcgc

SEQ ID NO: 17651 - DNA, 25 bp, Mus musculus
catgtcggaggcgagacttatggcc

SEQ ID NO: 17652 - DNA, 25 bp, Mus musculus
catgtcgtcctgtcgagtggataag

SEQ ID NO: 17653 - DNA, 25 bp, Mus musculus
catgtcgtggctcactcaaggctga

SEQ ID NO: 17654 - DNA, 25 bp, Mus musculus
catgtcgtggctgactcaaggctga

SEQ ID NO: 17655 - DNA, 25 bp, Mus musculus
catgtctacagtctgagaagacagc

SEQ ID NO: 17656 - DNA, 25 bp, Mus musculus
catgtctcaatccatagaagtcttg

SEQ ID NO: 17657 - DNA, 25 bp, Mus musculus
catgtctgaaggcacaagtggcagt

SEQ ID NO: 17658 - DNA, 25 bp, Mus musculus
catgtctgctggtaggacatcatgt

SEQ ID NO: 17659 - DNA, 25 bp, Mus musculus
catgtctggagcgaaaccaagcgtc

SEQ ID NO: 17660 - DNA, 25 bp, Mus musculus
catgtcttcgcagagatgggagtta

SEQ ID NO: 17661 - DNA, 25 bp, Mus musculus
catgtgaccgcctttgagccaatca

SEQ ID NO: 17662 - DNA, 25 bp, Mus musculus
catgtgacctacaggctgtactgcc

SEQ ID NO: 17663 - DNA, 25 bp, Mus musculus
catgtgaggaacaactcacttcatt

SEQ ID NO: 17664 - DNA, 25 bp, Mus musculus
catgtgaggaactactcacttcatt

SEQ ID NO: 17665 - DNA, 25 bp, Mus musculus
catgtgatatgttatcaagagttaa

SEQ ID NO: 17666 - DNA, 25 bp, Mus musculus
catgtgcagctgtcaacaggagcaa

SEQ ID NO: 17667 - DNA, 25 bp, Mus musculus
catgtgcataattagattaaagtta

SEQ ID NO: 17668 - DNA, 25 bp, Mus musculus
catgtgccaatgtcctcagtgacct

SEQ ID NO: 17669 - DNA, 25 bp, Mus musculus
catgtgccggatcatagttcatttc

SEQ ID NO: 17670 - DNA, 25 bp, Mus musculus
catgtgcctcctcagaagaatggtg

SEQ ID NO: 17671 - DNA, 25 bp, Mus musculus
catgtgcctgactgggtttggattg

SEQ ID NO: 17672 - DNA, 25 bp, Mus musculus
catgtgcgacctgataatgatcctc

SEQ ID NO: 17673 - DNA, 25 bp, Mus musculus
catgtgcggatggtcatcatcaacc

SEQ ID NO: 17674 - DNA, 25 bp, Mus musculus
catgtggaaccacttaggaagcatc

SEQ ID NO: 17675 - DNA, 25 bp, Mus musculus
catgtggaagtatgtcccgatgctg

SEQ ID NO: 17676 - DNA, 25 bp, Mus musculus
catgtggacaattggcctccaagac

SEQ ID NO: 17677 - DNA, 25 bp, Mus musculus
catgtggacgtgtttcgagattcca

SEQ ID NO: 17678 - DNA, 25 bp, Mus musculus
catgtggccatcctctgtgccggat

SEQ ID NO: 17679 - DNA, 25 bp, Mus musculus
catgtggccatcgtctgtgccggat

SEQ ID NO: 17680 - DNA, 25 bp, Mus musculus
catgtggctcaagattaccattccc

SEQ ID NO: 17681 - DNA, 25 bp, Mus musculus
catgtgggaccagctagaggatgcc

SEQ ID NO: 17682 - DNA, 25 bp, Mus musculus
catgtgggtagaagacttgttggac

SEQ ID NO: 17683 - DNA, 25 bp, Mus musculus
catgtggtttgctggcggcttccac

SEQ ID NO: 17684 - DNA, 25 bp, Mus musculus
catgtgtaaatatccctgcctctcc

SEQ ID NO: 17685 - DNA, 25 bp, Mus musculus
catgtgtatccttttccggaatgga

SEQ ID NO: 17686 - DNA, 25 bp, Mus musculus
catgtgtcgacggatggtctgcgac

SEQ ID NO: 17687 - DNA, 25 bp, Mus musculus
catgtgtgaagccatgctgatcctg

SEQ ID NO: 17688 - DNA, 25 bp, Mus musculus
catgtgttaagcagatactgcaaag

SEQ ID NO: 17689 - DNA, 25 bp, Mus musculus
catgtgtttcttttggtcctaagaa

SEQ ID NO: 17690 - DNA, 25 bp, Mus musculus
catgttaaggagactcagcctccag

SEQ ID NO: 17691 - DNA, 25 bp, Mus musculus
catgttaagtgaaaatggccaattc

SEQ ID NO: 17692 - DNA, 25 bp, Mus musculus
catgttaccaaggacttacaaaaat

SEQ ID NO: 17693 - DNA, 25 bp, Mus musculus
catgttactagacacctgtcaggag

SEQ ID NO: 17694 - DNA, 25 bp, Mus musculus
catgttagcggcttcctactggtcg

SEQ ID NO: 17695 - DNA, 25 bp, Mus musculus
catgttatagatgcagaggattccc

SEQ ID NO: 17696 - DNA, 25 bp, Mus musculus
catgttataggaattggcagcaggt

SEQ ID NO: 17697 - DNA, 25 bp, Mus musculus
catgttatcagccagacaggaggat

SEQ ID NO: 17698 - DNA, 25 bp, Mus musculus
catgttatttgaaagcaattgagac

SEQ ID NO: 17699 - DNA, 25 bp, Mus musculus
catgttcagcaagtgccagaggctc

SEQ ID NO: 17700 - DNA, 25 bp, Mus musculus
catgttcaggagtgcagcaggcctc

SEQ ID NO: 17701 - DNA, 25 bp, Mus musculus
catgttccacaaactgcgctttcag

SEQ ID NO: 17702 - DNA, 25 bp, Mus musculus
catgttccagaagcacatggacgga

SEQ ID NO: 17703 - DNA, 25 bp, Mus musculus
catgttccatctgagaagatctcca

SEQ ID NO: 17704 - DNA, 25 bp, Mus musculus
catgttccctctgccgaggtgggcg

SEQ ID NO: 17705 - DNA, 25 bp, Mus musculus
catgttccctgagacgctagatgag

SEQ ID NO: 17706 - DNA, 25 bp, Mus musculus
catgttcctagagattatggctccc

SEQ ID NO: 17707 - DNA, 25 bp, Mus musculus
catgttcggcccacttctgtgcggt

SEQ ID NO: 17708 - DNA, 25 bp, Mus musculus
catgttcggccctcttctgtgcggt

SEQ ID NO: 17709 - DNA, 25 bp, Mus musculus
catgttcggtgtcgtaggcatcccc

SEQ ID NO: 17710 - DNA, 25 bp, Mus musculus
catgttctattgtgcacactggcaa

SEQ ID NO: 17711 - DNA, 25 bp, Mus musculus
catgttctcattgggttgtatgtca

SEQ ID NO: 17712 - DNA, 25 bp, Mus musculus
catgttctctaggagtccccaggag

SEQ ID NO: 17713 - DNA, 25 bp, Mus musculus
catgttctgcagaattccctgctgc

SEQ ID NO: 17714 - DNA, 25 bp, Mus musculus
catgttcttggtgaagtcggccagc

SEQ ID NO: 17715 - DNA, 25 bp, Mus musculus
catgttctttggtatgcttagccga

SEQ ID NO: 17716 - DNA, 25 bp, Mus musculus
catgttgacaaaggcacagcagaag

SEQ ID NO: 17717 - DNA, 25 bp, Mus musculus
catgttgaccaagatgatggcccta

SEQ ID NO: 17718 - DNA, 25 bp, Mus musculus
catgttgatgggaatttgtgtatca

SEQ ID NO: 17719 - DNA, 25 bp, Mus musculus
catgttgcaagcactgagactcagg

SEQ ID NO: 17720 - DNA, 25 bp, Mus musculus
catgttgctgaaagctgtttggagg

SEQ ID NO: 17721 - DNA, 25 bp, Mus musculus
catgttgctgttgacggcaggactg

SEQ ID NO: 17722 - DNA, 25 bp, Mus musculus
catgttgcttggtagagattcctgc

SEQ ID NO: 17723 - DNA, 25 bp, Mus musculus
catgttggaacatggtgtataccca

SEQ ID NO: 17724 - DNA, 25 bp, Mus musculus
catgttgggccgtatcatctttgcc

SEQ ID NO: 17725 - DNA, 25 bp, Mus musculus
catgttgtcaaagctacagattgcc

SEQ ID NO: 17726 - DNA, 25 bp, Mus musculus
catgttgtcaggagacctcccattc

SEQ ID NO: 17727 - DNA, 25 bp, Mus musculus
catgttgtcaggtggctccgatggc

SEQ ID NO: 17728 - DNA, 25 bp, Mus musculus
catgttgtcctcaaccttgacacca

SEQ ID NO: 17729 - DNA, 25 bp, Mus musculus
catgttgttcttcgtcaaccctggg

SEQ ID NO: 17730 - DNA, 25 bp, Mus musculus
catgtttccagattcgatgtgatcc

SEQ ID NO: 17731 - DNA, 25 bp, Mus musculus
catgtttgaagaaaattatcctgaa

SEQ ID NO: 17732 - DNA, 25 bp, Mus musculus
catgtttgatccagtccctgtcaag

SEQ ID NO: 17733 - DNA, 25 bp, Mus musculus
catgtttgccagctacgtccctgaa

SEQ ID NO: 17734 - DNA, 25 bp, Mus musculus
catgtttgggattttgttgaagaaa

SEQ ID NO: 17735 - DNA, 25 bp, Mus musculus
catgtttgtaaagatcagccagcca

SEQ ID NO: 17736 - DNA, 25 bp, Mus musculus
catgtttgttcagacaatcctttcc

SEQ ID NO: 17737 - DNA, 25 bp, Mus musculus
catgtttttcttgggaacgcgctga

SEQ ID NO: 17738 - DNA, 25 bp, Mus musculus
cattaaaagaagttgtgattcatcc

SEQ ID NO: 17739 - DNA, 25 bp, Mus musculus
cattaaaatgatatcccgagggagc

SEQ ID NO: 17740 - DNA, 25 bp, Mus musculus
cattaaaatgatttcccgagggagc

SEQ ID NO: 17741 - DNA, 25 bp, Mus musculus
cattaaacgttcatgtccaggtggt

SEQ ID NO: 17742 - DNA, 25 bp, Mus musculus
cattaacaggatgccaagccatgag

SEQ ID NO: 17743 - DNA, 25 bp, Mus musculus
cattaaccaagatcctcaggctgga

SEQ ID NO: 17744 - DNA, 25 bp, Mus musculus
cattaaccagcaaggcaaatggagt

SEQ ID NO: 17745 - DNA, 25 bp, Mus musculus
cattaaccccggagagcagagtgat

SEQ ID NO: 17746 - DNA, 25 bp, Mus musculus
cattaacgctaacagccacggaggc

SEQ ID NO: 17747 - DNA, 25 bp, Mus musculus
cattaactgtgcctatgtcaagtgg

SEQ ID NO: 17748 - DNA, 25 bp, Mus musculus
cattaagaacgctgagcttgctttg

SEQ ID NO: 17749 - DNA, 25 bp, Mus musculus
cattaagaggacaagagagcccaga

SEQ ID NO: 17750 - DNA, 25 bp, Mus musculus
cattaagagtgacgatgaagctgcc

SEQ ID NO: 17751 - DNA, 25 bp, Mus musculus
cattaagagtgaggatgaagctgcc

SEQ ID NO: 17752 - DNA, 25 bp, Mus musculus
cattaagcagagcaaggatggctcg

SEQ ID NO: 17753 - DNA, 25 bp, Mus musculus
cattaagctggagagacacgtgccc

SEQ ID NO: 17754 - DNA, 25 bp, Mus musculus
cattaaggtgtgtggtcgtgttacc

SEQ ID NO: 17755 - DNA, 25 bp, Mus musculus
cattaagtgcatcttcggaaaaata

SEQ ID NO: 17756 - DNA, 25 bp, Mus musculus
cattaatcgctcttgttcaggtcac

SEQ ID NO: 17757 - DNA, 25 bp, Mus musculus
cattaatcgttcagctcgactgttc

SEQ ID NO: 17758 - DNA, 25 bp, Mus musculus
cattaatcgttctgctcgactgttc

SEQ ID NO: 17759 - DNA, 25 bp, Mus musculus
cattaatgtgacagctacagccatg

SEQ ID NO: 17760 - DNA, 25 bp, Mus musculus
cattaatgtgggtttgtctgtgtcc

SEQ ID NO: 17761 - DNA, 25 bp, Mus musculus
cattaattcgcttagcagaagccca

SEQ ID NO: 17762 - DNA, 25 bp, Mus musculus
cattacaaacaccaatgaattctcg

SEQ ID NO: 17763 - DNA, 25 bp, Mus musculus
cattacactggatggctctgagcga

SEQ ID NO: 17764 - DNA, 25 bp, Mus musculus
cattacagattaaaacaagcttggc

SEQ ID NO: 17765 - DNA, 25 bp, Mus musculus
cattacaggcagttacaagatcacc

SEQ ID NO: 17766 - DNA, 25 bp, Mus musculus
cattacccgatggtagaatactgca

SEQ ID NO: 17767 - DNA, 25 bp, Mus musculus
cattacctggaatattgatggatta

SEQ ID NO: 17768 - DNA, 25 bp, Mus musculus
cattacgaggattcttgcatttcga

SEQ ID NO: 17769 - DNA, 25 bp, Mus musculus
cattacgataatcagaaagtggccc

SEQ ID NO: 17770 - DNA, 25 bp, Mus musculus
cattacgatgccacctatcacaagg

SEQ ID NO: 17771 - DNA, 25 bp, Mus musculus
cattacgcagaagatcactagtttg

SEQ ID NO: 17772 - DNA, 25 bp, Mus musculus
cattacgtcaccaagtgagaagcca

SEQ ID NO: 17773 - DNA, 25 bp, Mus musculus
cattactaacacctatgattagggc

SEQ ID NO: 17774 - DNA, 25 bp, Mus musculus
cattactaacacgtatgattagggc

SEQ ID NO: 17775 - DNA, 25 bp, Mus musculus
cattactctggaatttatggcctga

SEQ ID NO: 17776 - DNA, 25 bp, Mus musculus
cattactctggattttatggcctga

SEQ ID NO: 17777 - DNA, 25 bp, Mus musculus
cattactgagcaattgaagcctggc

SEQ ID NO: 17778 - DNA, 25 bp, Mus musculus
cattacttagtggatttggatacca

SEQ ID NO: 17779 - DNA, 25 bp, Mus musculus
cattagaaaggcagcttttgagtgt

SEQ ID NO: 17780 - DNA, 25 bp, Mus musculus
cattagactttgcaagatattcaga

SEQ ID NO: 17781 - DNA, 25 bp, Mus musculus
cattagagcagtttgaaggtggccc

SEQ ID NO: 17782 - DNA, 25 bp, Mus musculus
cattagaggacacactggttaaaaa

SEQ ID NO: 17783 - DNA, 25 bp, Mus musculus
cattagatgcccagaaatggagtta

SEQ ID NO: 17784 - DNA, 25 bp, Mus musculus
cattagatgccctgaaatggagtta

SEQ ID NO: 17785 - DNA, 25 bp, Mus musculus
cattagcacaacaggcctttgaaga

SEQ ID NO: 17786 - DNA, 25 bp, Mus musculus
cattagcagtcttagaaaaggccct

SEQ ID NO: 17787 - DNA, 25 bp, Mus musculus
cattagcagtgagcgctcctatcag

SEQ ID NO: 17788 - DNA, 25 bp, Mus musculus
cattagcatcccgtgccactataaa

SEQ ID NO: 17789 - DNA, 25 bp, Mus musculus
cattagcgtcatatccagtggcctg

SEQ ID NO: 17790 - DNA, 25 bp, Mus musculus
cattagctcacggaaagggaacttt

SEQ ID NO: 17791 - DNA, 25 bp, Mus musculus
cattaggaaacctggcccagaacca

SEQ ID NO: 17792 - DNA, 25 bp, Mus musculus
cattaggaccctgcaggcgcagtgg

SEQ ID NO: 17793 - DNA, 25 bp, Mus musculus
cattaggagggtatatcattgttgg

SEQ ID NO: 17794 - DNA, 25 bp, Mus musculus
cattaggagggtttatcattgttgg

SEQ ID NO: 17795 - DNA, 25 bp, Mus musculus
cattagtactcttgactcattagac

SEQ ID NO: 17796 - DNA, 25 bp, Mus musculus
cattagtctttgtccttctgatggc

SEQ ID NO: 17797 - DNA, 25 bp, Mus musculus
cattagtgataaagatgcctcagtg

SEQ ID NO: 17798 - DNA, 25 bp, Mus musculus
cattataagcttgattggcatcgct

SEQ ID NO: 17799 - DNA, 25 bp, Mus musculus
cattatatggctgcccacgggtgct

SEQ ID NO: 17800 - DNA, 25 bp, Mus musculus
cattatatgggcaagagacacagga

SEQ ID NO: 17801 - DNA, 25 bp, Mus musculus
cattatcaaccccatctcaggacag

SEQ ID NO: 17802 - DNA, 25 bp, Mus musculus
cattatcaacccgatctcaggacag

SEQ ID NO: 17803 - DNA, 25 bp, Mus musculus
cattatcacagaatcagggaatccc

SEQ ID NO: 17804 - DNA, 25 bp, Mus musculus
cattatcacagattcagggaatccc

SEQ ID NO: 17805 - DNA, 25 bp, Mus musculus
cattatccagcacatgatgacttct

SEQ ID NO: 17806 - DNA, 25 bp, Mus musculus
cattatcggaaaacggatgcaaaac

SEQ ID NO: 17807 - DNA, 25 bp, Mus musculus
cattatcgggtaccgaatcacagta

SEQ ID NO: 17808 - DNA, 25 bp, Mus musculus
cattatctctgaaaaaatctcaacc

SEQ ID NO: 17809 - DNA, 25 bp, Mus musculus
cattatctggcagaggttcagaagg

SEQ ID NO: 17810 - DNA, 25 bp, Mus musculus
cattatgaacacagaacaaagccaa

SEQ ID NO: 17811 - DNA, 25 bp, Mus musculus
cattatgaacactgaacaaagccaa

SEQ ID NO: 17812 - DNA, 25 bp, Mus musculus
cattatgcaggctaggctgaccctg

SEQ ID NO: 17813 - DNA, 25 bp, Mus musculus
cattatgccagtacattcaggcttc

SEQ ID NO: 17814 - DNA, 25 bp, Mus musculus
cattatggacctggacatttatcag

SEQ ID NO: 17815 - DNA, 25 bp, Mus musculus
cattatggagattgccatcattgca

SEQ ID NO: 17816 - DNA, 25 bp, Mus musculus
cattatgtgacaaggagaggtgtgt

SEQ ID NO: 17817 - DNA, 25 bp, Mus musculus
cattatgtgcccgaattccagaaag

SEQ ID NO: 17818 - DNA, 25 bp, Mus musculus
cattatgtttcagacgggactctgc

SEQ ID NO: 17819 - DNA, 25 bp, Mus musculus
cattatgtttgtctgcctgtgctca

SEQ ID NO: 17820 - DNA, 25 bp, Mus musculus
cattattaagcagggtgagccaatc

SEQ ID NO: 17821 - DNA, 25 bp, Mus musculus
cattattgctggtggtgtggaccca

SEQ ID NO: 17822 - DNA, 25 bp, Mus musculus
cattcaaaaaaggataaccccagct

SEQ ID NO: 17823 - DNA, 25 bp, Mus musculus
cattcaaaacacgaccttcagcaga

SEQ ID NO: 17824 - DNA, 25 bp, Mus musculus
cattcaagacaaagtccattccatc

SEQ ID NO: 17825 - DNA, 25 bp, Mus musculus
cattcaagagtggactcgttagaaa

SEQ ID NO: 17826 - DNA, 25 bp, Mus musculus
cattcaagctcaagactttggtgga

SEQ ID NO: 17827 - DNA, 25 bp, Mus musculus
cattcaagcttctatttctggaggc

SEQ ID NO: 17828 - DNA, 25 bp, Mus musculus
cattcaagggaagagaaatcaaacc

SEQ ID NO: 17829 - DNA, 25 bp, Mus musculus
cattcaagtcaggaggctcatagct

SEQ ID NO: 17830 - DNA, 25 bp, Mus musculus
cattcaatattaacagggttgcagc

SEQ ID NO: 17831 - DNA, 25 bp, Mus musculus
cattcaccagttgaaatgtgccctg

SEQ ID NO: 17832 - DNA, 25 bp, Mus musculus
cattcactcctaccatggcttggat

SEQ ID NO: 17833 - DNA, 25 bp, Mus musculus
cattcactgctgtctgtcagaaaga

SEQ ID NO: 17834 - DNA, 25 bp, Mus musculus
cattcagaatggagaggaagtggtc

SEQ ID NO: 17835 - DNA, 25 bp, Mus musculus
cattcagcagagtgaagttcacgcg

SEQ ID NO: 17836 - DNA, 25 bp, Mus musculus
cattcagcagccaagctgacaatcc

SEQ ID NO: 17837 - DNA, 25 bp, Mus musculus
cattcagcagggactcgtgaaacag

SEQ ID NO: 17838 - DNA, 25 bp, Mus musculus
cattcagcatcatggatgaatttca

SEQ ID NO: 17839 - DNA, 25 bp, Mus musculus
cattcagcattcgattagcatgcct

SEQ ID NO: 17840 - DNA, 25 bp, Mus musculus
cattcagccagctcagggcattcag

SEQ ID NO: 17841 - DNA, 25 bp, Mus musculus
cattcagcctttggtgatcctccag

SEQ ID NO: 17842 - DNA, 25 bp, Mus musculus
cattcaggccagaaagcggaggccg

SEQ ID NO: 17843 - DNA, 25 bp, Mus musculus
cattcaggccgcctgcaggcctttg

SEQ ID NO: 17844 - DNA, 25 bp, Mus musculus
cattcagtaaatccaaactgctatg

SEQ ID NO: 17845 - DNA, 25 bp, Mus musculus
cattcagtcctgtcccatcataagg

SEQ ID NO: 17846 - DNA, 25 bp, Mus musculus
cattcagtgggagagccggacttac

SEQ ID NO: 17847 - DNA, 25 bp, Mus musculus
cattcagttaccttccaggaaagac

SEQ ID NO: 17848 - DNA, 25 bp, Mus musculus
cattcagttggatggagaaatcttt

SEQ ID NO: 17849 - DNA, 25 bp, Mus musculus
cattcatacctccaggtccaggaga

SEQ ID NO: 17850 - DNA, 25 bp, Mus musculus
cattcatatattacaccttgagatg

SEQ ID NO: 17851 - DNA, 25 bp, Mus musculus
cattcatatatttcaccttgagatg

SEQ ID NO: 17852 - DNA, 25 bp, Mus musculus
cattcatatcaagcgtggtccgaaa

SEQ ID NO: 17853 - DNA, 25 bp, Mus musculus
cattcatccttaaaacacgtgggaa

SEQ ID NO: 17854 - DNA, 25 bp, Mus musculus
cattcatgcccactgaaatttggaa

SEQ ID NO: 17855 - DNA, 25 bp, Mus musculus
cattcatgggcactgatctgggcaa

SEQ ID NO: 17856 - DNA, 25 bp, Mus musculus
cattcatgttcgaaggccacgacac

SEQ ID NO: 17857 - DNA, 25 bp, Mus musculus
cattcattatcggaaaacggatgca

SEQ ID NO: 17858 - DNA, 25 bp, Mus musculus
cattcattcagccagctgctttgtt

SEQ ID NO: 17859 - DNA, 25 bp, Mus musculus
cattcattgcagagagaatcttctg

SEQ ID NO: 17860 - DNA, 25 bp, Mus musculus
cattcatttttagcagggactgaag

SEQ ID NO: 17861 - DNA, 25 bp, Mus musculus
cattccaaagatttatgtgcaccgc

SEQ ID NO: 17862 - DNA, 25 bp, Mus musculus
cattccaaggacttatcccaaagcc

SEQ ID NO: 17863 - DNA, 25 bp, Mus musculus
cattccaatttaccaagtgtactgc

SEQ ID NO: 17864 - DNA, 25 bp, Mus musculus
cattccaccagctcagagtacctat

SEQ ID NO: 17865 - DNA, 25 bp, Mus musculus
cattccagaaacttgcatctgaaga

SEQ ID NO: 17866 - DNA, 25 bp, Mus musculus
cattccagactgcacgggtgtccag

SEQ ID NO: 17867 - DNA, 25 bp, Mus musculus
cattccagatgcctggccaatctgc

SEQ ID NO: 17868 - DNA, 25 bp, Mus musculus
cattccagggctgtcggaagctgca

SEQ ID NO: 17869 - DNA, 25 bp, Mus musculus
cattccaggttaaaagagaggcaaa

SEQ ID NO: 17870 - DNA, 25 bp, Mus musculus
cattccagtctcacctgcttcagtg

SEQ ID NO: 17871 - DNA, 25 bp, Mus musculus
cattccataagtatgcctgccatga

SEQ ID NO: 17872 - DNA, 25 bp, Mus musculus
cattcccaaagaagttggcttctga

SEQ ID NO: 17873 - DNA, 25 bp, Mus musculus
cattcccaagcagtactacgtgcga

SEQ ID NO: 17874 - DNA, 25 bp, Mus musculus
cattcccaggagttgctttctacag

SEQ ID NO: 17875 - DNA, 25 bp, Mus musculus
cattcccatggatgaatcactgcag

SEQ ID NO: 17876 - DNA, 25 bp, Mus musculus
cattccccatcatggaggccgagag

SEQ ID NO: 17877 - DNA, 25 bp, Mus musculus
cattccctacccaagtgtccatgag

SEQ ID NO: 17878 - DNA, 25 bp, Mus musculus
cattccctggactgtgactgacctt

SEQ ID NO: 17879 - DNA, 25 bp, Mus musculus
cattcccttaggacattagggtctc

SEQ ID NO: 17880 - DNA, 25 bp, Mus musculus
cattccgatgaccaacagctgtgat

SEQ ID NO: 17881 - DNA, 25 bp, Mus musculus
cattccgatgacgaacagctgtgat

SEQ ID NO: 17882 - DNA, 25 bp, Mus musculus
cattccgtggtaacaggagtccagg

SEQ ID NO: 17883 - DNA, 25 bp, Mus musculus
cattcctacctagatgccatcagga

SEQ ID NO: 17884 - DNA, 25 bp, Mus musculus
cattcctcagtttggttccatatcc

SEQ ID NO: 17885 - DNA, 25 bp, Mus musculus
cattcctgagataaacttgcttgat

SEQ ID NO: 17886 - DNA, 25 bp, Mus musculus
cattcctgcagtgccagactttgga

SEQ ID NO: 17887 - DNA, 25 bp, Mus musculus
cattcctgccaaatatgagtatgtt

SEQ ID NO: 17888 - DNA, 25 bp, Mus musculus
cattcctggaggctgcaatttggag

SEQ ID NO: 17889 - DNA, 25 bp, Mus musculus
cattcctggtgtatatgtcccatgg

SEQ ID NO: 17890 - DNA, 25 bp, Mus musculus
cattcctggtgtttatgtcccatgg

SEQ ID NO: 17891 - DNA, 25 bp, Mus musculus
cattccttaaatctaatttgctagg

SEQ ID NO: 17892 - DNA, 25 bp, Mus musculus
cattccttaaatgtaatttgctagg

SEQ ID NO: 17893 - DNA, 25 bp, Mus musculus
cattccttgctccaggatttgggac

SEQ ID NO: 17894 - DNA, 25 bp, Mus musculus
cattcgaacagaggaggtggctacc

SEQ ID NO: 17895 - DNA, 25 bp, Mus musculus
cattcgaatggttggccacaatgtg

SEQ ID NO: 17896 - DNA, 25 bp, Mus musculus
cattcgaggacttctgggaagagca

SEQ ID NO: 17897 - DNA, 25 bp, Mus musculus
cattcgaggatgtggctgtgcatct

SEQ ID NO: 17898 - DNA, 25 bp, Mus musculus
cattcgatacattcagcagggactc

SEQ ID NO: 17899 - DNA, 25 bp, Mus musculus
cattcgcagccgctggctcaggcaa

SEQ ID NO: 17900 - DNA, 25 bp, Mus musculus
cattcgcctcataggcgagtttgtc

SEQ ID NO: 17901 - DNA, 25 bp, Mus musculus
cattcgcctcattggcgagtttgtc

SEQ ID NO: 17902 - DNA, 25 bp, Mus musculus
cattcgcctctcaggtgacactgga

SEQ ID NO: 17903 - DNA, 25 bp, Mus musculus
cattcgctccatctttggaaatgcg

SEQ ID NO: 17904 - DNA, 25 bp, Mus musculus
cattcggatttcttcaatgtcaagg

SEQ ID NO: 17905 - DNA, 25 bp, Mus musculus
cattcggccgccagcattttggcct

SEQ ID NO: 17906 - DNA, 25 bp, Mus musculus
cattcgggcaaggaaggggacaaat

SEQ ID NO: 17907 - DNA, 25 bp, Mus musculus
cattcggtccatgggctggaagatc

SEQ ID NO: 17908 - DNA, 25 bp, Mus musculus
cattcggtggatttactaaaacaag

SEQ ID NO: 17909 - DNA, 25 bp, Mus musculus
cattcgtgacaatgaagccacttca

SEQ ID NO: 17910 - DNA, 25 bp, Mus musculus
cattctaaaggtgccaggaacaacc

SEQ ID NO: 17911 - DNA, 25 bp, Mus musculus
cattctacagtatgcacagaccact

SEQ ID NO: 17912 - DNA, 25 bp, Mus musculus
cattctacgaactagtggactggtt

SEQ ID NO: 17913 - DNA, 25 bp, Mus musculus
cattctagctgacagaattctgctg

SEQ ID NO: 17914 - DNA, 25 bp, Mus musculus
cattctagttcgctacacccagaaa

SEQ ID NO: 17915 - DNA, 25 bp, Mus musculus
cattctcagagtttataccagctca

SEQ ID NO: 17916 - DNA, 25 bp, Mus musculus
cattctcatcttctgtaagggagcg

SEQ ID NO: 17917 - DNA, 25 bp, Mus musculus
cattctccatgctgtaaggcgatga

SEQ ID NO: 17918 - DNA, 25 bp, Mus musculus
cattctctacatatctctgccctta

SEQ ID NO: 17919 - DNA, 25 bp, Mus musculus
cattctctcccaagtgtcattctgg

SEQ ID NO: 17920 - DNA, 25 bp, Mus musculus
cattctgaaggcctatgacgggcgt

SEQ ID NO: 17921 - DNA, 25 bp, Mus musculus
cattctgacgtctatgtgaaaacca

SEQ ID NO: 17922 - DNA, 25 bp, Mus musculus
cattctgactgataaatgtagacta

SEQ ID NO: 17923 - DNA, 25 bp, Mus musculus
cattctgacttacacatcttggact

SEQ ID NO: 17924 - DNA, 25 bp, Mus musculus
cattctgagcattagtgacgaggca

SEQ ID NO: 17925 - DNA, 25 bp, Mus musculus
cattctgcaaaagttaatgccaaga

SEQ ID NO: 17926 - DNA, 25 bp, Mus musculus
cattctgcatgttcctaggaagcca

SEQ ID NO: 17927 - DNA, 25 bp, Mus musculus
cattctgccagaccagagctatttg

SEQ ID NO: 17928 - DNA, 25 bp, Mus musculus
cattctgcgaacaaactcagcggac

SEQ ID NO: 17929 - DNA, 25 bp, Mus musculus
cattctgcgaactaactcagcggac

SEQ ID NO: 17930 - DNA, 25 bp, Mus musculus
cattctggagaattactagccacag

SEQ ID NO: 17931 - DNA, 25 bp, Mus musculus
cattctggaggtgatcgccaagcac

SEQ ID NO: 17932 - DNA, 25 bp, Mus musculus
cattctggctcacagatgtcataga

SEQ ID NO: 17933 - DNA, 25 bp, Mus musculus
cattctgggaatgccggtggtggag

SEQ ID NO: 17934 - DNA, 25 bp, Mus musculus
cattctggtagatgactacagcgac

SEQ ID NO: 17935 - DNA, 25 bp, Mus musculus
cattctggtaggaaccactggaccc

SEQ ID NO: 17936 - DNA, 25 bp, Mus musculus
cattctggtggtagaagcagaagga

SEQ ID NO: 17937 - DNA, 25 bp, Mus musculus
cattctgtactaacagacgacttta

SEQ ID NO: 17938 - DNA, 25 bp, Mus musculus
cattctgtgagtccaacttatagag

SEQ ID NO: 17939 - DNA, 25 bp, Mus musculus
cattctgtggacttacgatatgtgg

SEQ ID NO: 17940 - DNA, 25 bp, Mus musculus
cattctgttccccaggctctgaagg

SEQ ID NO: 17941 - DNA, 25 bp, Mus musculus
cattctgtttagtgggcagggcttt

SEQ ID NO: 17942 - DNA, 25 bp, Mus musculus
cattcttagttaaaagtggctccgc

SEQ ID NO: 17943 - DNA, 25 bp, Mus musculus
cattcttcagctggccttaatgttg

SEQ ID NO: 17944 - DNA, 25 bp, Mus musculus
cattcttggaagatccagaatttgc

SEQ ID NO: 17945 - DNA, 25 bp, Mus musculus
cattcttggatgatgtggttccctt

SEQ ID NO: 17946 - DNA, 25 bp, Mus musculus
cattcttggatgttgtggttccctt

SEQ ID NO: 17947 - DNA, 25 bp, Mus musculus
cattcttgttgaggcaaatgaagcc

SEQ ID NO: 17948 - DNA, 25 bp, Mus musculus
cattctttgcatggcccgtctgaag

SEQ ID NO: 17949 - DNA, 25 bp, Mus musculus
cattctttgtacagaaactaaaagg

SEQ ID NO: 17950 - DNA, 25 bp, Mus musculus
cattcttttgatgtccgagtgctaa

SEQ ID NO: 17951 - DNA, 25 bp, Mus musculus
cattcttttgttatggcagccatcc

SEQ ID NO: 17952 - DNA, 25 bp, Mus musculus
cattgaaaaatacctggctccagcg

SEQ ID NO: 17953 - DNA, 25 bp, Mus musculus
cattgaaaactctataactatgaat

SEQ ID NO: 17954 - DNA, 25 bp, Mus musculus
cattgaaaagtattgaagggcctcc

SEQ ID NO: 17955 - DNA, 25 bp, Mus musculus
cattgaaaatggactgatccgaagc

SEQ ID NO: 17956 - DNA, 25 bp, Mus musculus
cattgaaaccgattcccaagacttc

SEQ ID NO: 17957 - DNA, 25 bp, Mus musculus
cattgaaagaagaatcagggactat

SEQ ID NO: 17958 - DNA, 25 bp, Mus musculus
cattgaaagccgagcccaaaaagat

SEQ ID NO: 17959 - DNA, 25 bp, Mus musculus
cattgaaagtctgtatactctgtgt

SEQ ID NO: 17960 - DNA, 25 bp, Mus musculus
cattgaacgggagctgcagtgcatg

SEQ ID NO: 17961 - DNA, 25 bp, Mus musculus
cattgaagacgttcagccgctgtcc

SEQ ID NO: 17962 - DNA, 25 bp, Mus musculus
cattgaagagacgttcttgccccta

SEQ ID NO: 17963 - DNA, 25 bp, Mus musculus
cattgaagatgtgcagctcgtggtc

SEQ ID NO: 17964 - DNA, 25 bp, Mus musculus
cattgaaggagaagccctggtcacc

SEQ ID NO: 17965 - DNA, 25 bp, Mus musculus
cattgaagtatatcttggccgggca

SEQ ID NO: 17966 - DNA, 25 bp, Mus musculus
cattgaagtttgatcaactgtaagg

SEQ ID NO: 17967 - DNA, 25 bp, Mus musculus
cattgaatcccatgtgagccatcat

SEQ ID NO: 17968 - DNA, 25 bp, Mus musculus
cattgaattagcaaccggagcagcg

SEQ ID NO: 17969 - DNA, 25 bp, Mus musculus
cattgacaaaatcatcagctggcag

SEQ ID NO: 17970 - DNA, 25 bp, Mus musculus
cattgacaatggatttctttctgaa

SEQ ID NO: 17971 - DNA, 25 bp, Mus musculus
cattgacatagcgtttgcgtaccca

SEQ ID NO: 17972 - DNA, 25 bp, Mus musculus
cattgaccagcaacgcaatacaagt

SEQ ID NO: 17973 - DNA, 25 bp, Mus musculus
cattgaccctgcagcctgggtctct

SEQ ID NO: 17974 - DNA, 25 bp, Mus musculus
cattgacctggcaacgcctttacac

SEQ ID NO: 17975 - DNA, 25 bp, Mus musculus
cattgaccttcaagcaggtcactta

SEQ ID NO: 17976 - DNA, 25 bp, Mus musculus
cattgactaccctgtggacttggag

SEQ ID NO: 17977 - DNA, 25 bp, Mus musculus
cattgactataatcgggttctggat

SEQ ID NO: 17978 - DNA, 25 bp, Mus musculus
cattgactgattttctgatcctgag

SEQ ID NO: 17979 - DNA, 25 bp, Mus musculus
cattgacttcatgtcaagggagacc

SEQ ID NO: 17980 - DNA, 25 bp, Mus musculus
cattgacttccgagatgaagacgga

SEQ ID NO: 17981 - DNA, 25 bp, Mus musculus
cattgagaaacaagaactctaaaca

SEQ ID NO: 17982 - DNA, 25 bp, Mus musculus
cattgagatgctggaaacagacacc

SEQ ID NO: 17983 - DNA, 25 bp, Mus musculus
cattgagcagcgtcagcagtgcagt

SEQ ID NO: 17984 - DNA, 25 bp, Mus musculus
cattgagcgcaggacctgatctcac

SEQ ID NO: 17985 - DNA, 25 bp, Mus musculus
cattgagcgtccagcagatgtggaa

SEQ ID NO: 17986 - DNA, 25 bp, Mus musculus
cattgaggatcaagacagtcagact

SEQ ID NO: 17987 - DNA, 25 bp, Mus musculus
cattgaggccaagctgcaagctctc

SEQ ID NO: 17988 - DNA, 25 bp, Mus musculus
cattgagggtatcatctttggtggc

SEQ ID NO: 17989 - DNA, 25 bp, Mus musculus
cattgagtcggaatgaagttgtcgg

SEQ ID NO: 17990 - DNA, 25 bp, Mus musculus
cattgatagcaagacctggcgggag

SEQ ID NO: 17991 - DNA, 25 bp, Mus musculus
cattgatatgaaccatggacaagta

SEQ ID NO: 17992 - DNA, 25 bp, Mus musculus
cattgatcgatgattactctggaag

SEQ ID NO: 17993 - DNA, 25 bp, Mus musculus
cattgatcgccctaaaggactggca

SEQ ID NO: 17994 - DNA, 25 bp, Mus musculus
cattgatctctataagcagctaaag

SEQ ID NO: 17995 - DNA, 25 bp, Mus musculus
cattgatgcggtgttgctgctccag

SEQ ID NO: 17996 - DNA, 25 bp, Mus musculus
cattgatgcttttctcaatgaaatg

SEQ ID NO: 17997 - DNA, 25 bp, Mus musculus
cattgatgtaatggatgcagtggga

SEQ ID NO: 17998 - DNA, 25 bp, Mus musculus
cattgatgtcattcattatcggaaa

SEQ ID NO: 17999 - DNA, 25 bp, Mus musculus
cattgattacaacggcgagcggaca

SEQ ID NO: 18000 - DNA, 25 bp, Mus musculus
cattgattcagggacaagaagttgt

SEQ ID NO: 18001 - DNA, 25 bp, Mus musculus
cattgattgaatgcggaatgaagta

SEQ ID NO: 18002 - DNA, 25 bp, Mus musculus
cattgattgtgcttctgtatatggc

SEQ ID NO: 18003 - DNA, 25 bp, Mus musculus
cattgatttaggtcgagttgatcca

SEQ ID NO: 18004 - DNA, 25 bp, Mus musculus
cattgcaaaacttgatcctctcgga

SEQ ID NO: 18005 - DNA, 25 bp, Mus musculus
cattgcaaatggtgatagcactaac

SEQ ID NO: 18006 - DNA, 25 bp, Mus musculus
cattgcaagaggcttgcccctgagt

SEQ ID NO: 18007 - DNA, 25 bp, Mus musculus
cattgcaatgattaaaatggtcgtc

SEQ ID NO: 18008 - DNA, 25 bp, Mus musculus
cattgcactgtgcatagaagatggg

SEQ ID NO: 18009 - DNA, 25 bp, Mus musculus
cattgcagaagttggccttcccatt

SEQ ID NO: 18010 - DNA, 25 bp, Mus musculus
cattgcagaccttttgggtggtccc

SEQ ID NO: 18011 - DNA, 25 bp, Mus musculus
cattgcagagctctgggccgtgttc

SEQ ID NO: 18012 - DNA, 25 bp, Mus musculus
cattgcagagctgtgggccgtgttc

SEQ ID NO: 18013 - DNA, 25 bp, Mus musculus
cattgcaggaggtttaaataggctc

SEQ ID NO: 18014 - DNA, 25 bp, Mus musculus
cattgcaggcattgttagacttggc

SEQ ID NO: 18015 - DNA, 25 bp, Mus musculus
cattgcagttccctgaagagacttg

SEQ ID NO: 18016 - DNA, 25 bp, Mus musculus
cattgcatacatcccagggacttgg

SEQ ID NO: 18017 - DNA, 25 bp, Mus musculus
cattgcatatccaggcaggcgacac

SEQ ID NO: 18018 - DNA, 25 bp, Mus musculus
cattgcatcagggatggccatagaa

SEQ ID NO: 18019 - DNA, 25 bp, Mus musculus
cattgccaatgcaaggacctactaa

SEQ ID NO: 18020 - DNA, 25 bp, Mus musculus
cattgccagcacaggtcagacgttc

SEQ ID NO: 18021 - DNA, 25 bp, Mus musculus
cattgccatccgaactgggagtcca

SEQ ID NO: 18022 - DNA, 25 bp, Mus musculus
cattgcccagcatttcggaagcgga

SEQ ID NO: 18023 - DNA, 25 bp, Mus musculus
cattgcccctgctttgtgcgagttc

SEQ ID NO: 18024 - DNA, 25 bp, Mus musculus
cattgcccgcaccatcaatgaggtg

SEQ ID NO: 18025 - DNA, 25 bp, Mus musculus
cattgcccggctatatgtggttcca

SEQ ID NO: 18026 - DNA, 25 bp, Mus musculus
cattgccctcagcactggaagaggc

SEQ ID NO: 18027 - DNA, 25 bp, Mus musculus
cattgcccttgactctctcagctgg

SEQ ID NO: 18028 - DNA, 25 bp, Mus musculus
cattgcccttggtgaaccgaaatgg

SEQ ID NO: 18029 - DNA, 25 bp, Mus musculus
cattgccgagctacataaagagaca

SEQ ID NO: 18030 - DNA, 25 bp, Mus musculus
cattgcctctttactcagaagatcg

SEQ ID NO: 18031 - DNA, 25 bp, Mus musculus
cattgcctgcctcaggaatgagcga

SEQ ID NO: 18032 - DNA, 25 bp, Mus musculus
cattgcctggatgaagtttgatgcc

SEQ ID NO: 18033 - DNA, 25 bp, Mus musculus
cattgcgagtgcacagaaaccgcct

SEQ ID NO: 18034 - DNA, 25 bp, Mus musculus
cattgcgcgttgcttaactcccagg

SEQ ID NO: 18035 - DNA, 25 bp, Mus musculus
cattgcgcgttggttaactcccagg

SEQ ID NO: 18036 - DNA, 25 bp, Mus musculus
cattgctaagaagaagcgctggaac

SEQ ID NO: 18037 - DNA, 25 bp, Mus musculus
cattgctaagatggactcaacagcc

SEQ ID NO: 18038 - DNA, 25 bp, Mus musculus
cattgctcaaggctgtgatgcgccg

SEQ ID NO: 18039 - DNA, 25 bp, Mus musculus
cattgctctgaaactccgattcagc

SEQ ID NO: 18040 - DNA, 25 bp, Mus musculus
cattgctgaccgcttcaacgtagac

SEQ ID NO: 18041 - DNA, 25 bp, Mus musculus
cattgctgagacatgagtggtattg

SEQ ID NO: 18042 - DNA, 25 bp, Mus musculus
cattgctgagtctgatgaaatgagt

SEQ ID NO: 18043 - DNA, 25 bp, Mus musculus
cattgctggtattttgaaggactct

SEQ ID NO: 18044 - DNA, 25 bp, Mus musculus
cattgctttcaaatcttctacccca

SEQ ID NO: 18045 - DNA, 25 bp, Mus musculus
cattgctttcaattcttctacccca

SEQ ID NO: 18046 - DNA, 25 bp, Mus musculus
cattggaaagaactgcccgactgtt

SEQ ID NO: 18047 - DNA, 25 bp, Mus musculus
cattggaaagaagtgcccgactgtt

SEQ ID NO: 18048 - DNA, 25 bp, Mus musculus
cattggaaatgaagcggcagaaaat

SEQ ID NO: 18049 - DNA, 25 bp, Mus musculus
cattggaacaactgcatgctgtgga

SEQ ID NO: 18050 - DNA, 25 bp, Mus musculus
cattggaacaggtgaccgtggaaac

SEQ ID NO: 18051 - DNA, 25 bp, Mus musculus
cattggaagaaggaatggaattgga

SEQ ID NO: 18052 - DNA, 25 bp, Mus musculus
cattggaagaatgaagacaagaact

SEQ ID NO: 18053 - DNA, 25 bp, Mus musculus
cattggacaggaggtccacagaatc

SEQ ID NO: 18054 - DNA, 25 bp, Mus musculus
cattggaccgggatgggaccctagt

SEQ ID NO: 18055 - DNA, 25 bp, Mus musculus
cattggacctggtcttgtgctctcc

SEQ ID NO: 18056 - DNA, 25 bp, Mus musculus
cattggagaattcattatggtggac

SEQ ID NO: 18057 - DNA, 25 bp, Mus musculus
cattggagcccgcaacattgaagat

SEQ ID NO: 18058 - DNA, 25 bp, Mus musculus
cattggaggtgacccttttaatggg

SEQ ID NO: 18059 - DNA, 25 bp, Mus musculus
cattggagtgtcttctcacggtgga

SEQ ID NO: 18060 - DNA, 25 bp, Mus musculus
cattggatacaaactggcccttact

SEQ ID NO: 18061 - DNA, 25 bp, Mus musculus
cattggatccgtccggtaccgagtc

SEQ ID NO: 18062 - DNA, 25 bp, Mus musculus
cattggatccgtgcggtaccgagtc

SEQ ID NO: 18063 - DNA, 25 bp, Mus musculus
cattggatgaggctcttgccaaaga

SEQ ID NO: 18064 - DNA, 25 bp, Mus musculus
cattggatgttccatcagcaggcgc

SEQ ID NO: 18065 - DNA, 25 bp, Mus musculus
cattggattgtcctatttgtgacca

SEQ ID NO: 18066 - DNA, 25 bp, Mus musculus
cattggatttggagactacgtggca

SEQ ID NO: 18067 - DNA, 25 bp, Mus musculus
cattggatttggtgactacgtggca

SEQ ID NO: 18068 - DNA, 25 bp, Mus musculus
cattggcaggcacgcccatggcgac

SEQ ID NO: 18069 - DNA, 25 bp, Mus musculus
cattggcatcaccataaccgttgga

SEQ ID NO: 18070 - DNA, 25 bp, Mus musculus
cattggcattcaggtcattcacaaa

SEQ ID NO: 18071 - DNA, 25 bp, Mus musculus
cattggcattgaggagctggacacc

SEQ ID NO: 18072 - DNA, 25 bp, Mus musculus
cattggccacatctgtcacagcgca

SEQ ID NO: 18073 - DNA, 25 bp, Mus musculus
cattggctatgaggtcctggtctct

SEQ ID NO: 18074 - DNA, 25 bp, Mus musculus
cattggctcatttgccccagaagat

SEQ ID NO: 18075 - DNA, 25 bp, Mus musculus
cattggctccatagcaagaatgtgt

SEQ ID NO: 18076 - DNA, 25 bp, Mus musculus
cattggctctctgatggacgactac

SEQ ID NO: 18077 - DNA, 25 bp, Mus musculus
cattggctctgatagtaagcctggc

SEQ ID NO: 18078 - DNA, 25 bp, Mus musculus
cattggctgctgacattgacatcga

SEQ ID NO: 18079 - DNA, 25 bp, Mus musculus
cattggctgcttctcagctgcggga

SEQ ID NO: 18080 - DNA, 25 bp, Mus musculus
cattggctgggtccccatcgggtct

SEQ ID NO: 18081 - DNA, 25 bp, Mus musculus
cattggcttgggttacgaacacggc

SEQ ID NO: 18082 - DNA, 25 bp, Mus musculus
cattgggaagggtgatgctttgccc

SEQ ID NO: 18083 - DNA, 25 bp, Mus musculus
cattgggatacagatccatcagttc

SEQ ID NO: 18084 - DNA, 25 bp, Mus musculus
cattgggatgctcatgctgtccgcc

SEQ ID NO: 18085 - DNA, 25 bp, Mus musculus
cattgggcaagccattgtgtatgtc

SEQ ID NO: 18086 - DNA, 25 bp, Mus musculus
cattgggcagactgtatcaagcgag

SEQ ID NO: 18087 - DNA, 25 bp, Mus musculus
cattgggcagcttttgctccagaca

SEQ ID NO: 18088 - DNA, 25 bp, Mus musculus
cattgggcatgcgaaagctgctctt

SEQ ID NO: 18089 - DNA, 25 bp, Mus musculus
cattgggcccctagtaaagaccatc

SEQ ID NO: 18090 - DNA, 25 bp, Mus musculus
cattgggctaataggcctcattggt

SEQ ID NO: 18091 - DNA, 25 bp, Mus musculus
cattgggtctaagaaaatcagctca

SEQ ID NO: 18092 - DNA, 25 bp, Mus musculus
cattgggttgtatgtcaacatgctc

SEQ ID NO: 18093 - DNA, 25 bp, Mus musculus
cattggtatcacattgagacgctgc

SEQ ID NO: 18094 - DNA, 25 bp, Mus musculus
cattggtctggttcagggcctccgg

SEQ ID NO: 18095 - DNA, 25 bp, Mus musculus
cattggtgatccagaggacttttgt

SEQ ID NO: 18096 - DNA, 25 bp, Mus musculus
cattggtgccactgtccatgagctt

SEQ ID NO: 18097 - DNA, 25 bp, Mus musculus
cattggtggtggagtcttccaggct

SEQ ID NO: 18098 - DNA, 25 bp, Mus musculus
cattggtgtccatgaacttgcggca

SEQ ID NO: 18099 - DNA, 25 bp, Mus musculus
cattgtagagatacttctaatgtgg

SEQ ID NO: 18100 - DNA, 25 bp, Mus musculus
cattgtatcatcatcacttcatcac

SEQ ID NO: 18101 - DNA, 25 bp, Mus musculus
cattgtcacctaaatggcatagttc

SEQ ID NO: 18102 - DNA, 25 bp, Mus musculus
cattgtcacggagtgacgtcacaaa

SEQ ID NO: 18103 - DNA, 25 bp, Mus musculus
cattgtcactatcgaggctatgtgg

SEQ ID NO: 18104 - DNA, 25 bp, Mus musculus
cattgtccagacattttcacagtct

SEQ ID NO: 18105 - DNA, 25 bp, Mus musculus
cattgtccatctagaagggaagttt

SEQ ID NO: 18106 - DNA, 25 bp, Mus musculus
cattgtccgaagtaccctgattgtg

SEQ ID NO: 18107 - DNA, 25 bp, Mus musculus
cattgtcgcaattcacatactgagt

SEQ ID NO: 18108 - DNA, 25 bp, Mus musculus
cattgtctccgttacagtcagtttc

SEQ ID NO: 18109 - DNA, 25 bp, Mus musculus
cattgtctctgtgaacggcactaca

SEQ ID NO: 18110 - DNA, 25 bp, Mus musculus
cattgtctggaaggcctttagtccc

SEQ ID NO: 18111 - DNA, 25 bp, Mus musculus
cattgtcttccgacctctagaagcg

SEQ ID NO: 18112 - DNA, 25 bp, Mus musculus
cattgtcttggtacaaggatgagga

SEQ ID NO: 18113 - DNA, 25 bp, Mus musculus
cattgtgcacttggaagatctttga

SEQ ID NO: 18114 - DNA, 25 bp, Mus musculus
cattgtgcttcgtggtgccactcag

SEQ ID NO: 18115 - DNA, 25 bp, Mus musculus
cattgtgcttcttctgggccaaaaa

SEQ ID NO: 18116 - DNA, 25 bp, Mus musculus
cattgtggcaccgtataagatagag

SEQ ID NO: 18117 - DNA, 25 bp, Mus musculus
cattgtgggtttgtgcatggagata

SEQ ID NO: 18118 - DNA, 25 bp, Mus musculus
cattgtggtgggaggaaccaattat

SEQ ID NO: 18119 - DNA, 25 bp, Mus musculus
cattgtggtgtgagagcagccttac

SEQ ID NO: 18120 - DNA, 25 bp, Mus musculus
cattgtggttagcacaagaactgga

SEQ ID NO: 18121 - DNA, 25 bp, Mus musculus
cattgtgtaccttgtcaccagctcg

SEQ ID NO: 18122 - DNA, 25 bp, Mus musculus
cattgtgtcactcatgacctgcttg

SEQ ID NO: 18123 - DNA, 25 bp, Mus musculus
cattgtgtctgggtcctggaccggt

SEQ ID NO: 18124 - DNA, 25 bp, Mus musculus
cattgtgtctgtcatcaatagtact

SEQ ID NO: 18125 - DNA, 25 bp, Mus musculus
cattgtgtgatgtgagcctcaaaca

SEQ ID NO: 18126 - DNA, 25 bp, Mus musculus
cattgtgttcaacccactcttctgg

SEQ ID NO: 18127 - DNA, 25 bp, Mus musculus
cattgtgttcaaggaagttgggtac

SEQ ID NO: 18128 - DNA, 25 bp, Mus musculus
cattgttcaccttttagccttgggc

SEQ ID NO: 18129 - DNA, 25 bp, Mus musculus
cattgttcctctagaagggcaagag

SEQ ID NO: 18130 - DNA, 25 bp, Mus musculus
cattgttctaggtgctatcaaaggc

SEQ ID NO: 18131 - DNA, 25 bp, Mus musculus
cattgttctcctagacaaggccatg

SEQ ID NO: 18132 - DNA, 25 bp, Mus musculus
cattgttctctacctgtgtgacacc

SEQ ID NO: 18133 - DNA, 25 bp, Mus musculus
cattgttctgacttccctagcatgg

SEQ ID NO: 18134 - DNA, 25 bp, Mus musculus
cattgttgatttctgagaagaccgt

SEQ ID NO: 18135 - DNA, 25 bp, Mus musculus
cattgttgctggaggtcttattaca

SEQ ID NO: 18136 - DNA, 25 bp, Mus musculus
cattgtttaacccagcgctggcact

SEQ ID NO: 18137 - DNA, 25 bp, Mus musculus
cattgttttgaagaacacctggcca

SEQ ID NO: 18138 - DNA, 25 bp, Mus musculus
catttaaaacctggaggcactgggc

SEQ ID NO: 18139 - DNA, 25 bp, Mus musculus
catttaaaagatgcctcgaagaaga

SEQ ID NO: 18140 - DNA, 25 bp, Mus musculus
catttaaaagcaaggatccgtgctg

SEQ ID NO: 18141 - DNA, 25 bp, Mus musculus
catttaaatattagaacactgacag

SEQ ID NO: 18142 - DNA, 25 bp, Mus musculus
catttaacctacaaaaggcagcagc

SEQ ID NO: 18143 - DNA, 25 bp, Mus musculus
catttaatcagggaaagcacccagt

SEQ ID NO: 18144 - DNA, 25 bp, Mus musculus
catttaccggatgttgctacaacag

SEQ ID NO: 18145 - DNA, 25 bp, Mus musculus
catttactcagaaacctcaggacac

SEQ ID NO: 18146 - DNA, 25 bp, Mus musculus
catttagaggagaccctgagtgctg

SEQ ID NO: 18147 - DNA, 25 bp, Mus musculus
catttagtactgagtcaccacagaa

SEQ ID NO: 18148 - DNA, 25 bp, Mus musculus
catttagtctgaagaaggcacctga

SEQ ID NO: 18149 - DNA, 25 bp, Mus musculus
catttagtctgatgaaggcacctga

SEQ ID NO: 18150 - DNA, 25 bp, Mus musculus
catttagtttgaagctggttgctgt

SEQ ID NO: 18151 - DNA, 25 bp, Mus musculus
catttagtttgatgctggttgctgt

SEQ ID NO: 18152 - DNA, 25 bp, Mus musculus
catttatatggtgttcacaatcctg

SEQ ID NO: 18153 - DNA, 25 bp, Mus musculus
catttatgtgcccttaccggacgca

SEQ ID NO: 18154 - DNA, 25 bp, Mus musculus
catttattgaaactcgccaggatgg

SEQ ID NO: 18155 - DNA, 25 bp, Mus musculus
catttcaaacctttgtgggccagga

SEQ ID NO: 18156 - DNA, 25 bp, Mus musculus
catttcagaaggttgtaccttgaag

SEQ ID NO: 18157 - DNA, 25 bp, Mus musculus
catttcagaatagggcaggcctcca

SEQ ID NO: 18158 - DNA, 25 bp, Mus musculus
catttcagaccaatgccagaggagc

SEQ ID NO: 18159 - DNA, 25 bp, Mus musculus
catttcagagttcagtaaactggac

SEQ ID NO: 18160 - DNA, 25 bp, Mus musculus
catttcagagttgagtaaactggac

SEQ ID NO: 18161 - DNA, 25 bp, Mus musculus
catttcatcacgtcttggttggacg

SEQ ID NO: 18162 - DNA, 25 bp, Mus musculus
catttcatggaggagcagtcccagt

SEQ ID NO: 18163 - DNA, 25 bp, Mus musculus
catttccaaagcctcgttcacgagt

SEQ ID NO: 18164 - DNA, 25 bp, Mus musculus
catttccaaagtatctggacctgtt

SEQ ID NO: 18165 - DNA, 25 bp, Mus musculus
catttccaggaagtgttggcgaacc

SEQ ID NO: 18166 - DNA, 25 bp, Mus musculus
catttccccacaagaactgagagtt

SEQ ID NO: 18167 - DNA, 25 bp, Mus musculus
catttcctacacagtcaatgactcc

SEQ ID NO: 18168 - DNA, 25 bp, Mus musculus
catttccttcaaaatactgtatggt

SEQ ID NO: 18169 - DNA, 25 bp, Mus musculus
catttccttcaatatactgtatggt

SEQ ID NO: 18170 - DNA, 25 bp, Mus musculus
catttccttgtcgtttgacacctca

SEQ ID NO: 18171 - DNA, 25 bp, Mus musculus
catttcgagaaggaactgtggaaca

SEQ ID NO: 18172 - DNA, 25 bp, Mus musculus
catttcgagcaacagatcatggatc

SEQ ID NO: 18173 - DNA, 25 bp, Mus musculus
catttctactccgtatcggagcatg

SEQ ID NO: 18174 - DNA, 25 bp, Mus musculus
catttctcagcatggacagttggca

SEQ ID NO: 18175 - DNA, 25 bp, Mus musculus
catttctcgccacctgcagagtgta

SEQ ID NO: 18176 - DNA, 25 bp, Mus musculus
catttctcggttgtttaccactcgg

SEQ ID NO: 18177 - DNA, 25 bp, Mus musculus
catttctgaaatgtggcaaaacgac

SEQ ID NO: 18178 - DNA, 25 bp, Mus musculus
catttctgagggtctctttggctac

SEQ ID NO: 18179 - DNA, 25 bp, Mus musculus
catttctgccttcacatatgcatac

SEQ ID NO: 18180 - DNA, 25 bp, Mus musculus
catttctgtcaaaggaagagtcttt

SEQ ID NO: 18181 - DNA, 25 bp, Mus musculus
catttcttcagaacctagtagctca

SEQ ID NO: 18182 - DNA, 25 bp, Mus musculus
catttgaaaatagatggcatcgact

SEQ ID NO: 18183 - DNA, 25 bp, Mus musculus
catttgaccaagagcagatccttca

SEQ ID NO: 18184 - DNA, 25 bp, Mus musculus
catttgacttgcatgtcttctaaaa

SEQ ID NO: 18185 - DNA, 25 bp, Mus musculus
catttgatgatgaatggagaaggga

SEQ ID NO: 18186 - DNA, 25 bp, Mus musculus
catttgcacttcagggattgcaaga

SEQ ID NO: 18187 - DNA, 25 bp, Mus musculus
catttgcagaaggaaccggtgccga

SEQ ID NO: 18188 - DNA, 25 bp, Mus musculus
catttgcagtctagggcacgttaca

SEQ ID NO: 18189 - DNA, 25 bp, Mus musculus
catttgccgtgaatacattgtgggt

SEQ ID NO: 18190 - DNA, 25 bp, Mus musculus
catttgcgtggttttgaaactattc

SEQ ID NO: 18191 - DNA, 25 bp, Mus musculus
catttgctagctgtccttgccacgt

SEQ ID NO: 18192 - DNA, 25 bp, Mus musculus
catttgctcccaagacggactctga

SEQ ID NO: 18193 - DNA, 25 bp, Mus musculus
catttgctgaggacaagacctataa

SEQ ID NO: 18194 - DNA, 25 bp, Mus musculus
catttgctggcagtgattggaggac

SEQ ID NO: 18195 - DNA, 25 bp, Mus musculus
catttgctggccaccaggacagaca

SEQ ID NO: 18196 - DNA, 25 bp, Mus musculus
catttgctttctccgagggcaaaga

SEQ ID NO: 18197 - DNA, 25 bp, Mus musculus
catttggacagattcttcgaacgcc

SEQ ID NO: 18198 - DNA, 25 bp, Mus musculus
catttggaccaaaggcctgcgtgct

SEQ ID NO: 18199 - DNA, 25 bp, Mus musculus
catttggagaatgccagttttggaa

SEQ ID NO: 18200 - DNA, 25 bp, Mus musculus
catttggataggcttgtaagtgccc

SEQ ID NO: 18201 - DNA, 25 bp, Mus musculus
catttggattccatcagaaaagaca

SEQ ID NO: 18202 - DNA, 25 bp, Mus musculus
catttggcccatcgtgaagtcagtc

SEQ ID NO: 18203 - DNA, 25 bp, Mus musculus
catttggcccatggtgaagtcagtc

SEQ ID NO: 18204 - DNA, 25 bp, Mus musculus
catttggcttataaagactcgctta

SEQ ID NO: 18205 - DNA, 25 bp, Mus musculus
catttggctttacttacacacgtgg

SEQ ID NO: 18206 - DNA, 25 bp, Mus musculus
catttgggataaactgggagagaca

SEQ ID NO: 18207 - DNA, 25 bp, Mus musculus
catttgggattggaacaagacatgc

SEQ ID NO: 18208 - DNA, 25 bp, Mus musculus
catttgggctgtcagcttcgggccc

SEQ ID NO: 18209 - DNA, 25 bp, Mus musculus
catttggtcagttgggtgcatcatg

SEQ ID NO: 18210 - DNA, 25 bp, Mus musculus
catttggtctcgtggcaaaggcaga

SEQ ID NO: 18211 - DNA, 25 bp, Mus musculus
catttgtaaggatacatctcggcga

SEQ ID NO: 18212 - DNA, 25 bp, Mus musculus
catttgtattctagtacatgctgac

SEQ ID NO: 18213 - DNA, 25 bp, Mus musculus
catttgtattcttgtacatgctgac

SEQ ID NO: 18214 - DNA, 25 bp, Mus musculus
catttgtccctgtggccaagtagca

SEQ ID NO: 18215 - DNA, 25 bp, Mus musculus
catttgtctcagctgctggttgagc

SEQ ID NO: 18216 - DNA, 25 bp, Mus musculus
catttgtctcaggtgctggttgagc

SEQ ID NO: 18217 - DNA, 25 bp, Mus musculus
catttgtgagattgatgttgccctt

SEQ ID NO: 18218 - DNA, 25 bp, Mus musculus
catttgtgtggatgcagaatgtagc

SEQ ID NO: 18219 - DNA, 25 bp, Mus musculus
catttgttccctggtttgtggtgga

SEQ ID NO: 18220 - DNA, 25 bp, Mus musculus
catttgttctttgttggacttcaga

SEQ ID NO: 18221 - DNA, 25 bp, Mus musculus
catttgttggtaccccatgttggat

SEQ ID NO: 18222 - DNA, 25 bp, Mus musculus
catttgtttctgctgggagctgaca

SEQ ID NO: 18223 - DNA, 25 bp, Mus musculus
cattttacgggaacaaagtgggtct

SEQ ID NO: 18224 - DNA, 25 bp, Mus musculus
cattttacgggatcaaagtgggtct

SEQ ID NO: 18225 - DNA, 25 bp, Mus musculus
cattttagagcatctcgagcaacta

SEQ ID NO: 18226 - DNA, 25 bp, Mus musculus
cattttataatgaagcctggtccac

SEQ ID NO: 18227 - DNA, 25 bp, Mus musculus
cattttatctgggttctctgcctcc

SEQ ID NO: 18228 - DNA, 25 bp, Mus musculus
cattttattcgccattatctggcag

SEQ ID NO: 18229 - DNA, 25 bp, Mus musculus
cattttccagcatcgatttgactac

SEQ ID NO: 18230 - DNA, 25 bp, Mus musculus
cattttccattcttggaccgggcga

SEQ ID NO: 18231 - DNA, 25 bp, Mus musculus
cattttcctagtatctattacggag

SEQ ID NO: 18232 - DNA, 25 bp, Mus musculus
cattttcctttgcagaggcggctca

SEQ ID NO: 18233 - DNA, 25 bp, Mus musculus
cattttcgtatagatggtgcagtaa

SEQ ID NO: 18234 - DNA, 25 bp, Mus musculus
cattttctctcttgatgcaaacctc

SEQ ID NO: 18235 - DNA, 25 bp, Mus musculus
cattttctggcctagactgtctgcc

SEQ ID NO: 18236 - DNA, 25 bp, Mus musculus
cattttcttatgctctgaaccaagc

SEQ ID NO: 18237 - DNA, 25 bp, Mus musculus
cattttcttatggtctgaaccaagc

SEQ ID NO: 18238 - DNA, 25 bp, Mus musculus
cattttcttggactacttcatggca

SEQ ID NO: 18239 - DNA, 25 bp, Mus musculus
cattttctttggtgccaccatcttc

SEQ ID NO: 18240 - DNA, 25 bp, Mus musculus
cattttgatggcagagcccaagatg

SEQ ID NO: 18241 - DNA, 25 bp, Mus musculus
cattttgatgtactcttggtggata

SEQ ID NO: 18242 - DNA, 25 bp, Mus musculus
cattttgccataattagtcacagcc

SEQ ID NO: 18243 - DNA, 25 bp, Mus musculus
cattttgccatatttagtcacagcc

SEQ ID NO: 18244 - DNA, 25 bp, Mus musculus
cattttgctggcttgcgacgggctt

SEQ ID NO: 18245 - DNA, 25 bp, Mus musculus
cattttggaggaagccatcacggga

SEQ ID NO: 18246 - DNA, 25 bp, Mus musculus
cattttggcactccagtcataggaa

SEQ ID NO: 18247 - DNA, 25 bp, Mus musculus
cattttggttcaaaccctgcttttg

SEQ ID NO: 18248 - DNA, 25 bp, Mus musculus
cattttggttctgacctcgtccggg

SEQ ID NO: 18249 - DNA, 25 bp, Mus musculus
cattttgtctgagcatattggtgcc

SEQ ID NO: 18250 - DNA, 25 bp, Mus musculus
catttttagaatacttatacacaga

SEQ ID NO: 18251 - DNA, 25 bp, Mus musculus
catttttatcaccttctacatcctg

SEQ ID NO: 18252 - DNA, 25 bp, Mus musculus
catttttcagatttagccttcagaa

SEQ ID NO: 18253 - DNA, 25 bp, Mus musculus
catttttcctctctgcggtgtccag

SEQ ID NO: 18254 - DNA, 25 bp, Mus musculus
catttttctattgttctgaccgcca

SEQ ID NO: 18255 - DNA, 25 bp, Mus musculus
catttttctctgttcagactgagca

SEQ ID NO: 18256 - DNA, 25 bp, Mus musculus
catttttgctgtgactggtgtctac

SEQ ID NO: 18257 - DNA, 25 bp, Mus musculus
cattttttgaacactgtctgccagg

SEQ ID NO: 18258 - DNA, 25 bp, Mus musculus
ccaaaaaagacctcaacgagccata

SEQ ID NO: 18259 - DNA, 25 bp, Mus musculus
ccaaaaaggactcgcctcacaaaag

SEQ ID NO: 18260 - DNA, 25 bp, Mus musculus
ccaaaaaggagtgggaaacaatcag

SEQ ID NO: 18261 - DNA, 25 bp, Mus musculus
ccaaaaatacgctgacgcaggaaga

SEQ ID NO: 18262 - DNA, 25 bp, Mus musculus
ccaaaaatcagctttgggaagtgct

SEQ ID NO: 18263 - DNA, 25 bp, Mus musculus
ccaaaacaagtttccagtggcggat

SEQ ID NO: 18264 - DNA, 25 bp, Mus musculus
ccaaaaccgagagccttctaagaag

SEQ ID NO: 18265 - DNA, 25 bp, Mus musculus
ccaaaagaaccgacaatcagatgaa

SEQ ID NO: 18266 - DNA, 25 bp, Mus musculus
ccaaaagactggagttggcatcaat

SEQ ID NO: 18267 - DNA, 25 bp, Mus musculus
ccaaaagaggctacacagagatgtg

SEQ ID NO: 18268 - DNA, 25 bp, Mus musculus
ccaaaagatgaagcagcggcagcct

SEQ ID NO: 18269 - DNA, 25 bp, Mus musculus
ccaaaagcagtttgccttgaattct

SEQ ID NO: 18270 - DNA, 25 bp, Mus musculus
ccaaaatagaggaagcatgcgagat

SEQ ID NO: 18271 - DNA, 25 bp, Mus musculus
ccaaaatccggagaacgaagcggct

SEQ ID NO: 18272 - DNA, 25 bp, Mus musculus
ccaaaatgataactgcatccggtgt

SEQ ID NO: 18273 - DNA, 25 bp, Mus musculus
ccaaaatgatgatagagaattgacc

SEQ ID NO: 18274 - DNA, 25 bp, Mus musculus
ccaaaatgatgcaaatcaacctgac

SEQ ID NO: 18275 - DNA, 25 bp, Mus musculus
ccaaacaaataacgccaggttcttg

SEQ ID NO: 18276 - DNA, 25 bp, Mus musculus
ccaaacaaggtgatttatgggaaat

SEQ ID NO: 18277 - DNA, 25 bp, Mus musculus
ccaaacaagtttaagttcaccagtg

SEQ ID NO: 18278 - DNA, 25 bp, Mus musculus
ccaaacatgggaggcgtggaaagcc

SEQ ID NO: 18279 - DNA, 25 bp, Mus musculus
ccaaacattgttggctacctggaga

SEQ ID NO: 18280 - DNA, 25 bp, Mus musculus
ccaaaccaatattagtgagctgaaa

SEQ ID NO: 18281 - DNA, 25 bp, Mus musculus
ccaaaccttgcctacggaagtgaag

SEQ ID NO: 18282 - DNA, 25 bp, Mus musculus
ccaaacggcaagaaacctgctgcag

SEQ ID NO: 18283 - DNA, 25 bp, Mus musculus
ccaaacggttcatctgggagtacga

SEQ ID NO: 18284 - DNA, 25 bp, Mus musculus
ccaaactaactccatggtgaccctg

SEQ ID NO: 18285 - DNA, 25 bp, Mus musculus
ccaaactccaggatcccagtgtgcg

SEQ ID NO: 18286 - DNA, 25 bp, Mus musculus
ccaaactgggctacaaggtcttgat

SEQ ID NO: 18287 - DNA, 25 bp, Mus musculus
ccaaagaagccaagaaggccttcct

SEQ ID NO: 18288 - DNA, 25 bp, Mus musculus
ccaaagaattccatcagatatggta

SEQ ID NO: 18289 - DNA, 25 bp, Mus musculus
ccaaagaccttgaaatgtttgccag

SEQ ID NO: 18290 - DNA, 25 bp, Mus musculus
ccaaagacttgttctggcagttgta

SEQ ID NO: 18291 - DNA, 25 bp, Mus musculus
ccaaagagaggcactgtggagagct

SEQ ID NO: 18292 - DNA, 25 bp, Mus musculus
ccaaagagcgcagatgggtcgggtg

SEQ ID NO: 18293 - DNA, 25 bp, Mus musculus
ccaaagagggacattgtcaaggagc

SEQ ID NO: 18294 - DNA, 25 bp, Mus musculus
ccaaagagggtctcacggagcgctt

SEQ ID NO: 18295 - DNA, 25 bp, Mus musculus
ccaaagagtgcaacaaacgaacatt

SEQ ID NO: 18296 - DNA, 25 bp, Mus musculus
ccaaagatttatgtgcaccgcctca

SEQ ID NO: 18297 - DNA, 25 bp, Mus musculus
ccaaagcaatgagcgaggtgatggg

SEQ ID NO: 18298 - DNA, 25 bp, Mus musculus
ccaaagcatctgtgaagctcgttaa

SEQ ID NO: 18299 - DNA, 25 bp, Mus musculus
ccaaagcccaaggaagtggtggtgc

SEQ ID NO: 18300 - DNA, 25 bp, Mus musculus
ccaaagcccacatagagaaggtgac

SEQ ID NO: 18301 - DNA, 25 bp, Mus musculus
ccaaagccctggtggatgctggtgt

SEQ ID NO: 18302 - DNA, 25 bp, Mus musculus
ccaaagcttaattaacctcctactg

SEQ ID NO: 18303 - DNA, 25 bp, Mus musculus
ccaaaggaagaagctcaggacagag

SEQ ID NO: 18304 - DNA, 25 bp, Mus musculus
ccaaaggaattttaattaggacatg

SEQ ID NO: 18305 - DNA, 25 bp, Mus musculus
ccaaaggacatgacatttttacgct

SEQ ID NO: 18306 - DNA, 25 bp, Mus musculus
ccaaaggacgtatctgaggatacag

SEQ ID NO: 18307 - DNA, 25 bp, Mus musculus
ccaaaggaggctattagagagggac

SEQ ID NO: 18308 - DNA, 25 bp, Mus musculus
ccaaaggagttctcactggagagcc

SEQ ID NO: 18309 - DNA, 25 bp, Mus musculus
ccaaaggcaaaggtgcaagatacag

SEQ ID NO: 18310 - DNA, 25 bp, Mus musculus
ccaaaggtatacccaaggaggtcat

SEQ ID NO: 18311 - DNA, 25 bp, Mus musculus
ccaaagtacatgagtggctctaagt

SEQ ID NO: 18312 - DNA, 25 bp, Mus musculus
ccaaagtatctggacctgttattga

SEQ ID NO: 18313 - DNA, 25 bp, Mus musculus
ccaaagtccaagtccaagagagcaa

SEQ ID NO: 18314 - DNA, 25 bp, Mus musculus
ccaaagttgttacatcgtgttgtgg

SEQ ID NO: 18315 - DNA, 25 bp, Mus musculus
ccaaagtttaataggatatggccga

SEQ ID NO: 18316 - DNA, 25 bp, Mus musculus
ccaaatagctatagaggctgtgaac

SEQ ID NO: 18317 - DNA, 25 bp, Mus musculus
ccaaatatgaatgtagccagactgg

SEQ ID NO: 18318 - DNA, 25 bp, Mus musculus
ccaaatcatcagtgaagcaactaag

SEQ ID NO: 18319 - DNA, 25 bp, Mus musculus
ccaaatcatgcggtggtgcacggca

SEQ ID NO: 18320 - DNA, 25 bp, Mus musculus
ccaaatctgagctggagcatgctac

SEQ ID NO: 18321 - DNA, 25 bp, Mus musculus
ccaaatgaaagcagtcctgggtggg

SEQ ID NO: 18322 - DNA, 25 bp, Mus musculus
ccaaatgatctccagtgtgggttca

SEQ ID NO: 18323 - DNA, 25 bp, Mus musculus
ccaaatgcagagaagagctcatacc

SEQ ID NO: 18324 - DNA, 25 bp, Mus musculus
ccaaatgcctacaacacagccatgg

SEQ ID NO: 18325 - DNA, 25 bp, Mus musculus
ccaaatggtttggtgattgcttctc

SEQ ID NO: 18326 - DNA, 25 bp, Mus musculus
ccaaatgtagcggaactgaagaact

SEQ ID NO: 18327 - DNA, 25 bp, Mus musculus
ccaaattggttagtgaagtcctaga

SEQ ID NO: 18328 - DNA, 25 bp, Mus musculus
ccaaatttgattatgtggcacagca

SEQ ID NO: 18329 - DNA, 25 bp, Mus musculus
ccaaattttctggatgcttatatca

SEQ ID NO: 18330 - DNA, 25 bp, Mus musculus
ccaacaagatagagttcgaggaagt

SEQ ID NO: 18331 - DNA, 25 bp, Mus musculus
ccaacaagatagctgtgttccagtt

SEQ ID NO: 18332 - DNA, 25 bp, Mus musculus
ccaacaaggagagcctgccagaact

SEQ ID NO: 18333 - DNA, 25 bp, Mus musculus
ccaacaagtagaccagcgtgatctg

SEQ ID NO: 18334 - DNA, 25 bp, Mus musculus
ccaacacagattcgcttaagtttgc

SEQ ID NO: 18335 - DNA, 25 bp, Mus musculus
ccaacacagattggcttaagtttgc

SEQ ID NO: 18336 - DNA, 25 bp, Mus musculus
ccaacacagtcttgaaaaggagtga

SEQ ID NO: 18337 - DNA, 25 bp, Mus musculus
ccaacaccatgggtaagagatctga

SEQ ID NO: 18338 - DNA, 25 bp, Mus musculus
ccaacaccctggagactgtagccaa

SEQ ID NO: 18339 - DNA, 25 bp, Mus musculus
ccaacagaaactggccagattggaa

SEQ ID NO: 18340 - DNA, 25 bp, Mus musculus
ccaacagaagggtgggacactggta

SEQ ID NO: 18341 - DNA, 25 bp, Mus musculus
ccaacagagcagtaagcgcagcagc

SEQ ID NO: 18342 - DNA, 25 bp, Mus musculus
ccaacagcgacagtggagaagagct

SEQ ID NO: 18343 - DNA, 25 bp, Mus musculus
ccaacagcgagggtgagcaagagta

SEQ ID NO: 18344 - DNA, 25 bp, Mus musculus
ccaacaggagttcatggttacgcat

SEQ ID NO: 18345 - DNA, 25 bp, Mus musculus
ccaacagtactctgatcatcagcaa

SEQ ID NO: 18346 - DNA, 25 bp, Mus musculus
ccaacatcacaagagattaaatgag

SEQ ID NO: 18347 - DNA, 25 bp, Mus musculus
ccaacatgatcttcctaggagggat

SEQ ID NO: 18348 - DNA, 25 bp, Mus musculus
ccaacattcaatgttcagttagcag

SEQ ID NO: 18349 - DNA, 25 bp, Mus musculus
ccaacattgtactcagcgaggaact

SEQ ID NO: 18350 - DNA, 25 bp, Mus musculus
ccaacatttgacacacaaaggcagg

SEQ ID NO: 18351 - DNA, 25 bp, Mus musculus
ccaaccaaattctcagtctgtgaaa

SEQ ID NO: 18352 - DNA, 25 bp, Mus musculus
ccaaccaacctgtccaacaagataa

SEQ ID NO: 18353 - DNA, 25 bp, Mus musculus
ccaaccacacggctgacaatggcgt

SEQ ID NO: 18354 - DNA, 25 bp, Mus musculus
ccaaccaggagcagatagacaagat

SEQ ID NO: 18355 - DNA, 25 bp, Mus musculus
ccaaccccggcgaatggaggagtca

SEQ ID NO: 18356 - DNA, 25 bp, Mus musculus
ccaaccctactctggatgcctttga

SEQ ID NO: 18357 - DNA, 25 bp, Mus musculus
ccaaccctgggcctttcggagatgt

SEQ ID NO: 18358 - DNA, 25 bp, Mus musculus
ccaaccgatacaccaaccgtgtggt

SEQ ID NO: 18359 - DNA, 25 bp, Mus musculus
ccaaccgctgctactgacactatgt

SEQ ID NO: 18360 - DNA, 25 bp, Mus musculus
ccaacctcagcaagatggtgatgaa

SEQ ID NO: 18361 - DNA, 25 bp, Mus musculus
ccaacctggtagagagcatgtgcgc

SEQ ID NO: 18362 - DNA, 25 bp, Mus musculus
ccaacctgtctatgtcctcagaggg

SEQ ID NO: 18363 - DNA, 25 bp, Mus musculus
ccaacgaggatcatttggctgtcca

SEQ ID NO: 18364 - DNA, 25 bp, Mus musculus
ccaacgatgtcaatgttgcagctga

SEQ ID NO: 18365 - DNA, 25 bp, Mus musculus
ccaacgcctttcctgagtgcggtac

SEQ ID NO: 18366 - DNA, 25 bp, Mus musculus
ccaacgctgtactgcagattgacaa

SEQ ID NO: 18367 - DNA, 25 bp, Mus musculus
ccaacgctttcctagtgggatcaaa

SEQ ID NO: 18368 - DNA, 25 bp, Mus musculus
ccaacgggattccatagggagatac

SEQ ID NO: 18369 - DNA, 25 bp, Mus musculus
ccaacgggattcgatagggagatac

SEQ ID NO: 18370 - DNA, 25 bp, Mus musculus
ccaacgtgccaattcttatcttggg

SEQ ID NO: 18371 - DNA, 25 bp, Mus musculus
ccaacgtggagtcccagcttggtga

SEQ ID NO: 18372 - DNA, 25 bp, Mus musculus
ccaacgtggccgagactagcgatgg

SEQ ID NO: 18373 - DNA, 25 bp, Mus musculus
ccaacgtgggtgatcagcgtgctgc

SEQ ID NO: 18374 - DNA, 25 bp, Mus musculus
ccaactaagaagatagacttgtcag

SEQ ID NO: 18375 - DNA, 25 bp, Mus musculus
ccaactaagaagttagacttgtcag

SEQ ID NO: 18376 - DNA, 25 bp, Mus musculus
ccaactacagagatggtttcaaatg

SEQ ID NO: 18377 - DNA, 25 bp, Mus musculus
ccaactactacaacctggatggaga

SEQ ID NO: 18378 - DNA, 25 bp, Mus musculus
ccaactatgttgcagaatgtgatag

SEQ ID NO: 18379 - DNA, 25 bp, Mus musculus
ccaactcaagagtggcagacccttc

SEQ ID NO: 18380 - DNA, 25 bp, Mus musculus
ccaactccacacttgtgctgtgaag

SEQ ID NO: 18381 - DNA, 25 bp, Mus musculus
ccaactccaggctggacactctgtg

SEQ ID NO: 18382 - DNA, 25 bp, Mus musculus
ccaactcgggtcagcagtagtgcca

SEQ ID NO: 18383 - DNA, 25 bp, Mus musculus
ccaactcgtttgctgtcacgtgcct

SEQ ID NO: 18384 - DNA, 25 bp, Mus musculus
ccaactctcgtggaggctgcaagaa

SEQ ID NO: 18385 - DNA, 25 bp, Mus musculus
ccaactgaatatgagaggaacggga

SEQ ID NO: 18386 - DNA, 25 bp, Mus musculus
ccaactgctgaggtttgggatgtag

SEQ ID NO: 18387 - DNA, 25 bp, Mus musculus
ccaactgggccatcggcctgagcgt

SEQ ID NO: 18388 - DNA, 25 bp, Mus musculus
ccaactggtggatattgagctctcc

SEQ ID NO: 18389 - DNA, 25 bp, Mus musculus
ccaactgtgatctttacgagaagct

SEQ ID NO: 18390 - DNA, 25 bp, Mus musculus
ccaacttagcatttatacgagggca

SEQ ID NO: 18391 - DNA, 25 bp, Mus musculus
ccaacttaggtgaagatttctttgt

SEQ ID NO: 18392 - DNA, 25 bp, Mus musculus
ccaacttccttctaggagtggaatg

SEQ ID NO: 18393 - DNA, 25 bp, Mus musculus
ccaacttctttgctccgctgcttgg

SEQ ID NO: 18394 - DNA, 25 bp, Mus musculus
ccaacttgcagttctgcctgtattg

SEQ ID NO: 18395 - DNA, 25 bp, Mus musculus
ccaactttcctgttattgtagacag

SEQ ID NO: 18396 - DNA, 25 bp, Mus musculus
ccaactttctacagaacttccaggt

SEQ ID NO: 18397 - DNA, 25 bp, Mus musculus
ccaactttgagaacttatctgaaag

SEQ ID NO: 18398 - DNA, 25 bp, Mus musculus
ccaactttgtggaattgctggacag

SEQ ID NO: 18399 - DNA, 25 bp, Mus musculus
ccaagaaagagagggcaagaaggcc

SEQ ID NO: 18400 - DNA, 25 bp, Mus musculus
ccaagaaagccaaggaccctgatcc

SEQ ID NO: 18401 - DNA, 25 bp, Mus musculus
ccaagaaagtgggacaccagatgac

SEQ ID NO: 18402 - DNA, 25 bp, Mus musculus
ccaagaaatgttttgaaggtgaaag

SEQ ID NO: 18403 - DNA, 25 bp, Mus musculus
ccaagaaccagatacaaatgaatgt

SEQ ID NO: 18404 - DNA, 25 bp, Mus musculus
ccaagaacttaatgaagtagcaaga

SEQ ID NO: 18405 - DNA, 25 bp, Mus musculus
ccaagaagaaaacggtcacacgcgt

SEQ ID NO: 18406 - DNA, 25 bp, Mus musculus
ccaagaagaaaagggtcacacgcgt

SEQ ID NO: 18407 - DNA, 25 bp, Mus musculus
ccaagaagaaggtagctgagcaaac

SEQ ID NO: 18408 - DNA, 25 bp, Mus musculus
ccaagaagtgccgtggagcagctgt

SEQ ID NO: 18409 - DNA, 25 bp, Mus musculus
ccaagaagttggttgtggccacaga

SEQ ID NO: 18410 - DNA, 25 bp, Mus musculus
ccaagaatataggacagcaggcatt

SEQ ID NO: 18411 - DNA, 25 bp, Mus musculus
ccaagaatgggcagaagcgagccaa

SEQ ID NO: 18412 - DNA, 25 bp, Mus musculus
ccaagaattcagtgatgtagagagg

SEQ ID NO: 18413 - DNA, 25 bp, Mus musculus
ccaagacagaagcagcctggagccc

SEQ ID NO: 18414 - DNA, 25 bp, Mus musculus
ccaagacagtaaagatgcactgcag

SEQ ID NO: 18415 - DNA, 25 bp, Mus musculus
ccaagacatcacagagggaagctga

SEQ ID NO: 18416 - DNA, 25 bp, Mus musculus
ccaagacatgggtagggtagatcaa

SEQ ID NO: 18417 - DNA, 25 bp, Mus musculus
ccaagacatgtctagcccaacgcta

SEQ ID NO: 18418 - DNA, 25 bp, Mus musculus
ccaagaccgagagctcacatgctgg

SEQ ID NO: 18419 - DNA, 25 bp, Mus musculus
ccaagactttttccagcgctggaag

SEQ ID NO: 18420 - DNA, 25 bp, Mus musculus
ccaagagaagacgacggccatgatt

SEQ ID NO: 18421 - DNA, 25 bp, Mus musculus
ccaagagaatggcacttgctttgga

SEQ ID NO: 18422 - DNA, 25 bp, Mus musculus
ccaagagacagactagctgaagact

SEQ ID NO: 18423 - DNA, 25 bp, Mus musculus
ccaagagacgctgctgaccagaact

SEQ ID NO: 18424 - DNA, 25 bp, Mus musculus
ccaagagatgaagggtctcctcaca

SEQ ID NO: 18425 - DNA, 25 bp, Mus musculus
ccaagagctgagtcaaagtgtttca

SEQ ID NO: 18426 - DNA, 25 bp, Mus musculus
ccaagagctgatagacataaggaat

SEQ ID NO: 18427 - DNA, 25 bp, Mus musculus
ccaagagcttctgctctgtaagcag

SEQ ID NO: 18428 - DNA, 25 bp, Mus musculus
ccaagagtgtactgattccagttta

SEQ ID NO: 18429 - DNA, 25 bp, Mus musculus
ccaagagttcctccgagagtatgtg

SEQ ID NO: 18430 - DNA, 25 bp, Mus musculus
ccaagagttctggtgggagcaaaga

SEQ ID NO: 18431 - DNA, 25 bp, Mus musculus
ccaagataaactgaatcaggtttcc

SEQ ID NO: 18432 - DNA, 25 bp, Mus musculus
ccaagatccaggaatatgaatttac

SEQ ID NO: 18433 - DNA, 25 bp, Mus musculus
ccaagatcctcaggctggaaaactg

SEQ ID NO: 18434 - DNA, 25 bp, Mus musculus
ccaagatcctggagaatggagaaga

SEQ ID NO: 18435 - DNA, 25 bp, Mus musculus
ccaagatcgcactgctggaggaggc

SEQ ID NO: 18436 - DNA, 25 bp, Mus musculus
ccaagatctgcctcgaggacaagat

SEQ ID NO: 18437 - DNA, 25 bp, Mus musculus
ccaagatgacctggcagacgatgac

SEQ ID NO: 18438 - DNA, 25 bp, Mus musculus
ccaagatgactacaaaccatctgat

SEQ ID NO: 18439 - DNA, 25 bp, Mus musculus
ccaagatgactgagcgagcgctgga

SEQ ID NO: 18440 - DNA, 25 bp, Mus musculus
ccaagatggagtgcccattgctaca

SEQ ID NO: 18441 - DNA, 25 bp, Mus musculus
ccaagatggatgcaaagcaggagcc

SEQ ID NO: 18442 - DNA, 25 bp, Mus musculus
ccaagatgtcctgctgtttattgac

SEQ ID NO: 18443 - DNA, 25 bp, Mus musculus
ccaagcaaccgcagagaaaactacc

SEQ ID NO: 18444 - DNA, 25 bp, Mus musculus
ccaagcacaggctggtgctgctcga

SEQ ID NO: 18445 - DNA, 25 bp, Mus musculus
ccaagcacattgctgaagatgctga

SEQ ID NO: 18446 - DNA, 25 bp, Mus musculus
ccaagcagaatgtgaggaagaacct

SEQ ID NO: 18447 - DNA, 25 bp, Mus musculus
ccaagcaggatgtggaaaggctgaa

SEQ ID NO: 18448 - DNA, 25 bp, Mus musculus
ccaagcagtatgaaaagtctgaaaa

SEQ ID NO: 18449 - DNA, 25 bp, Mus musculus
ccaagcatggagatcctggtgatgc

SEQ ID NO: 18450 - DNA, 25 bp, Mus musculus
ccaagcatggagttcctggtgatgc

SEQ ID NO: 18451 - DNA, 25 bp, Mus musculus
ccaagccaagtgcaacgtgagcagt

SEQ ID NO: 18452 - DNA, 25 bp, Mus musculus
ccaagccaagttcccagttccctgg

SEQ ID NO: 18453 - DNA, 25 bp, Mus musculus
ccaagccagtgattgctgccattca

SEQ ID NO: 18454 - DNA, 25 bp, Mus musculus
ccaagcccattatttttgatggagc

SEQ ID NO: 18455 - DNA, 25 bp, Mus musculus
ccaagccctctgctttctagtgatg

SEQ ID NO: 18456 - DNA, 25 bp, Mus musculus
ccaagccgtcgcacagagcacaggg

SEQ ID NO: 18457 - DNA, 25 bp, Mus musculus
ccaagcctctggttgcggtagtaaa

SEQ ID NO: 18458 - DNA, 25 bp, Mus musculus
ccaagcctgagcttgcagtgagagc

SEQ ID NO: 18459 - DNA, 25 bp, Mus musculus
ccaagcgctggtacacgatgtgctg

SEQ ID NO: 18460 - DNA, 25 bp, Mus musculus
ccaagcgtgtcttgagatcacatga

SEQ ID NO: 18461 - DNA, 25 bp, Mus musculus
ccaagctgcccagtgggaagctgca

SEQ ID NO: 18462 - DNA, 25 bp, Mus musculus
ccaagctgcgtgaacaacacagaag

SEQ ID NO: 18463 - DNA, 25 bp, Mus musculus
ccaagcttcaagatgaaaggactgt

SEQ ID NO: 18464 - DNA, 25 bp, Mus musculus
ccaagctttggcagaatgggtcagc

SEQ ID NO: 18465 - DNA, 25 bp, Mus musculus
ccaaggaactgggaaagacctcgat

SEQ ID NO: 18466 - DNA, 25 bp, Mus musculus
ccaaggaagccaatgtcaagtgccc

SEQ ID NO: 18467 - DNA, 25 bp, Mus musculus
ccaaggaagtgctgccccagtactt

SEQ ID NO: 18468 - DNA, 25 bp, Mus musculus
ccaaggacactatacaaatttcgac

SEQ ID NO: 18469 - DNA, 25 bp, Mus musculus
ccaaggacagagcaaagtacgattc

SEQ ID NO: 18470 - DNA, 25 bp, Mus musculus
ccaaggacagcacttaccagacact

SEQ ID NO: 18471 - DNA, 25 bp, Mus musculus
ccaaggacctggcatcaagagatgt

SEQ ID NO: 18472 - DNA, 25 bp, Mus musculus
ccaaggactacgagaacgcgatcaa

SEQ ID NO: 18473 - DNA, 25 bp, Mus musculus
ccaaggagactgcaacaggacacct

SEQ ID NO: 18474 - DNA, 25 bp, Mus musculus
ccaaggagagcaaaaatgtggctgt

SEQ ID NO: 18475 - DNA, 25 bp, Mus musculus
ccaaggagaggcaccgaggcatgca

SEQ ID NO: 18476 - DNA, 25 bp, Mus musculus
ccaaggagaggctccgaggcatgca

SEQ ID NO: 18477 - DNA, 25 bp, Mus musculus
ccaaggagataacagatctgtttgc

SEQ ID NO: 18478 - DNA, 25 bp, Mus musculus
ccaaggagcgggtgcctgccaccaa

SEQ ID NO: 18479 - DNA, 25 bp, Mus musculus
ccaaggaggcagatgtgtcactcac

SEQ ID NO: 18480 - DNA, 25 bp, Mus musculus
ccaaggatgcatcccttcagccgag

SEQ ID NO: 18481 - DNA, 25 bp, Mus musculus
ccaaggatgtggttcggagaagaca

SEQ ID NO: 18482 - DNA, 25 bp, Mus musculus
ccaaggatttcaaagtgctttgcaa

SEQ ID NO: 18483 - DNA, 25 bp, Mus musculus
ccaaggcaccagcaacaatctatgc

SEQ ID NO: 18484 - DNA, 25 bp, Mus musculus
ccaaggcatcttcagctggcaagaa

SEQ ID NO: 18485 - DNA, 25 bp, Mus musculus
ccaaggccaaaaatacgctgacgca

SEQ ID NO: 18486 - DNA, 25 bp, Mus musculus
ccaaggccaactcagaggtggccca

SEQ ID NO: 18487 - DNA, 25 bp, Mus musculus
ccaaggcctggatcaatgcagccac

SEQ ID NO: 18488 - DNA, 25 bp, Mus musculus
ccaaggcgacctccaagatcctgga

SEQ ID NO: 18489 - DNA, 25 bp, Mus musculus
ccaaggctcatgcatctgacacttg

SEQ ID NO: 18490 - DNA, 25 bp, Mus musculus
ccaaggctgggcacagattttcctg

SEQ ID NO: 18491 - DNA, 25 bp, Mus musculus
ccaaggcttaccgatctgtctgtca

SEQ ID NO: 18492 - DNA, 25 bp, Mus musculus
ccaagggaatttgtgagctagaaaa

SEQ ID NO: 18493 - DNA, 25 bp, Mus musculus
ccaagggtgaaggttggctagccct

SEQ ID NO: 18494 - DNA, 25 bp, Mus musculus
ccaaggtatgaagttcctgacgtca

SEQ ID NO: 18495 - DNA, 25 bp, Mus musculus
ccaaggtccagatggcggccaacgt

SEQ ID NO: 18496 - DNA, 25 bp, Mus musculus
ccaaggtcgaaagccggaaagacat

SEQ ID NO: 18497 - DNA, 25 bp, Mus musculus
ccaaggtgaagatttggaaccagga

SEQ ID NO: 18498 - DNA, 25 bp, Mus musculus
ccaagtaattacgtcacagggaaga

SEQ ID NO: 18499 - DNA, 25 bp, Mus musculus
ccaagtacgatagcctgcaggacct

SEQ ID NO: 18500 - DNA, 25 bp, Mus musculus
ccaagtatgaagtggctgctcagca

SEQ ID NO: 18501 - DNA, 25 bp, Mus musculus
ccaagtcctagaaaaccacagcaag

SEQ ID NO: 18502 - DNA, 25 bp, Mus musculus
ccaagtcctcggtggctgtaccgta

SEQ ID NO: 18503 - DNA, 25 bp, Mus musculus
ccaagtcctttgaggcaccaataaa

SEQ ID NO: 18504 - DNA, 25 bp, Mus musculus
ccaagtcggagccaatgtgcagtca

SEQ ID NO: 18505 - DNA, 25 bp, Mus musculus
ccaagtctgtggcttccgatgagat

SEQ ID NO: 18506 - DNA, 25 bp, Mus musculus
ccaagtcttagaaaggtgatgcccc

SEQ ID NO: 18507 - DNA, 25 bp, Mus musculus
ccaagtgaacatctgagtaaccttt

SEQ ID NO: 18508 - DNA, 25 bp, Mus musculus
ccaagtgacttctcaaaatattgga

SEQ ID NO: 18509 - DNA, 25 bp, Mus musculus
ccaagtgcaagatggatatgatgtc

SEQ ID NO: 18510 - DNA, 25 bp, Mus musculus
ccaagtgcccagaacaatccctgga

SEQ ID NO: 18511 - DNA, 25 bp, Mus musculus
ccaagtggagtatgagattcttttc

SEQ ID NO: 18512 - DNA, 25 bp, Mus musculus
ccaagtgtttctccaggtggaggct

SEQ ID NO: 18513 - DNA, 25 bp, Mus musculus
ccaagtgtttgtctgatgagttcag

SEQ ID NO: 18514 - DNA, 25 bp, Mus musculus
ccaagttagttggagatgtggactt

SEQ ID NO: 18515 - DNA, 25 bp, Mus musculus
ccaagttcctagattaaagtcatgc

SEQ ID NO: 18516 - DNA, 25 bp, Mus musculus
ccaagttcgacagctggaagaacag

SEQ ID NO: 18517 - DNA, 25 bp, Mus musculus
ccaagttctccatcgctagtgacta

SEQ ID NO: 18518 - DNA, 25 bp, Mus musculus
ccaagttctgggatttcgtggacat

SEQ ID NO: 18519 - DNA, 25 bp, Mus musculus
ccaagtttgaggagtacggcccagt

SEQ ID NO: 18520 - DNA, 25 bp, Mus musculus
ccaagtttggataatgagtggaaag

SEQ ID NO: 18521 - DNA, 25 bp, Mus musculus
ccaataaacaggaagcagcctggac

SEQ ID NO: 18522 - DNA, 25 bp, Mus musculus
ccaatagtaaccagccagcttggca

SEQ ID NO: 18523 - DNA, 25 bp, Mus musculus
ccaatataccaaaacctaggcgaat

SEQ ID NO: 18524 - DNA, 25 bp, Mus musculus
ccaatatgaacctgttggatgaggt

SEQ ID NO: 18525 - DNA, 25 bp, Mus musculus
ccaatatgaagagaaggacaaagcc

SEQ ID NO: 18526 - DNA, 25 bp, Mus musculus
ccaatcaagtctctgtgtgcttgga

SEQ ID NO: 18527 - DNA, 25 bp, Mus musculus
ccaatcagatgggtggagcatgtta

SEQ ID NO: 18528 - DNA, 25 bp, Mus musculus
ccaatcagccaactcctcggaaagt

SEQ ID NO: 18529 - DNA, 25 bp, Mus musculus
ccaatccacattctgtacgttcctt

SEQ ID NO: 18530 - DNA, 25 bp, Mus musculus
ccaatccacattgtgtacgttcctt

SEQ ID NO: 18531 - DNA, 25 bp, Mus musculus
ccaatccatagtacctttgaggatg

SEQ ID NO: 18532 - DNA, 25 bp, Mus musculus
ccaatccatagttcctttgaggatg

SEQ ID NO: 18533 - DNA, 25 bp, Mus musculus
ccaatcgcaaactagaacggagggt

SEQ ID NO: 18534 - DNA, 25 bp, Mus musculus
ccaatcgggagtggaagcagtgact

SEQ ID NO: 18535 - DNA, 25 bp, Mus musculus
ccaatctgccgggatcacaagttgc

SEQ ID NO: 18536 - DNA, 25 bp, Mus musculus
ccaatgaaatttcccagaaggcagc

SEQ ID NO: 18537 - DNA, 25 bp, Mus musculus
ccaatgacatggaggaggacaacca

SEQ ID NO: 18538 - DNA, 25 bp, Mus musculus
ccaatgagaagggttacttcgcagt

SEQ ID NO: 18539 - DNA, 25 bp, Mus musculus
ccaatgagatgtcctggaaaatata

SEQ ID NO: 18540 - DNA, 25 bp, Mus musculus
ccaatgagatgtgctggaaaatata

SEQ ID NO: 18541 - DNA, 25 bp, Mus musculus
ccaatgaggaattcaggcaggtggt

SEQ ID NO: 18542 - DNA, 25 bp, Mus musculus
ccaatgaggatttgtgagtgagcaa

SEQ ID NO: 18543 - DNA, 25 bp, Mus musculus
ccaatgatccacttgtgccgactgc

SEQ ID NO: 18544 - DNA, 25 bp, Mus musculus
ccaatgatccctgatgcagagtgtt

SEQ ID NO: 18545 - DNA, 25 bp, Mus musculus
ccaatgatgatgagaagtgaccagg

SEQ ID NO: 18546 - DNA, 25 bp, Mus musculus
ccaatgatgggatgcccggaggccc

SEQ ID NO: 18547 - DNA, 25 bp, Mus musculus
ccaatgcagcaacaacttctgggta

SEQ ID NO: 18548 - DNA, 25 bp, Mus musculus
ccaatgcagccatcccaacgtagtg

SEQ ID NO: 18549 - DNA, 25 bp, Mus musculus
ccaatgcatggatcagaaactcagc

SEQ ID NO: 18550 - DNA, 25 bp, Mus musculus
ccaatggagagcagaaggactcgga

SEQ ID NO: 18551 - DNA, 25 bp, Mus musculus
ccaatggatcccgagattttctgga

SEQ ID NO: 18552 - DNA, 25 bp, Mus musculus
ccaatggcaggctgtgtcccgggat

SEQ ID NO: 18553 - DNA, 25 bp, Mus musculus
ccaatggccatgtggactatatcac

SEQ ID NO: 18554 - DNA, 25 bp, Mus musculus
ccaatggcctgatgtacatgttcac

SEQ ID NO: 18555 - DNA, 25 bp, Mus musculus
ccaatgtagatggagaagtggtgcc

SEQ ID NO: 18556 - DNA, 25 bp, Mus musculus
ccaatgtcagcaccacagatatctc

SEQ ID NO: 18557 - DNA, 25 bp, Mus musculus
ccaatgtgaccagcagtggaggaag

SEQ ID NO: 18558 - DNA, 25 bp, Mus musculus
ccaattcgttacgaggagaagtact

SEQ ID NO: 18559 - DNA, 25 bp, Mus musculus
ccaattctgaggcttgagtcgtccc

SEQ ID NO: 18560 - DNA, 25 bp, Mus musculus
ccaattgactttcaaacgaatagga

SEQ ID NO: 18561 - DNA, 25 bp, Mus musculus
ccaattgactttgaaacgaatagga

SEQ ID NO: 18562 - DNA, 25 bp, Mus musculus
ccaattgcaaatgtggctaggataa

SEQ ID NO: 18563 - DNA, 25 bp, Mus musculus
ccaattgggctctattcaactagca

SEQ ID NO: 18564 - DNA, 25 bp, Mus musculus
ccaattgtgttagcaggaaagacca

SEQ ID NO: 18565 - DNA, 25 bp, Mus musculus
ccaatttcaaaaggaccatgcttcg

SEQ ID NO: 18566 - DNA, 25 bp, Mus musculus
ccaatttcaagggagtcaaccatac

SEQ ID NO: 18567 - DNA, 25 bp, Mus musculus
ccacaaaaatttggaacttggattg

SEQ ID NO: 18568 - DNA, 25 bp, Mus musculus
ccacaaaggagggacatgtatcaac

SEQ ID NO: 18569 - DNA, 25 bp, Mus musculus
ccacaaatgctaaagaattgtcctc

SEQ ID NO: 18570 - DNA, 25 bp, Mus musculus
ccacaaatgttcttgcaaacccttg

SEQ ID NO: 18571 - DNA, 25 bp, Mus musculus
ccacaacagatctggtgcccatgcg

SEQ ID NO: 18572 - DNA, 25 bp, Mus musculus
ccacaactgcggaggctccctggtg

SEQ ID NO: 18573 - DNA, 25 bp, Mus musculus
ccacaacttgtgctaggaccccagt

SEQ ID NO: 18574 - DNA, 25 bp, Mus musculus
ccacaagaagagaaatatcctgttg

SEQ ID NO: 18575 - DNA, 25 bp, Mus musculus
ccacaaggaacatgactttctctgt

SEQ ID NO: 18576 - DNA, 25 bp, Mus musculus
ccacaaggttgtggataacaaaaag

SEQ ID NO: 18577 - DNA, 25 bp, Mus musculus
ccacaagtaaatgatgctgaagtag

SEQ ID NO: 18578 - DNA, 25 bp, Mus musculus
ccacaagttgccacctaccatagag

SEQ ID NO: 18579 - DNA, 25 bp, Mus musculus
ccacacaaaatcaagagcggagcgg

SEQ ID NO: 18580 - DNA, 25 bp, Mus musculus
ccacaccatagactggctgagggaa

SEQ ID NO: 18581 - DNA, 25 bp, Mus musculus
ccacacctgctgctgctatgtcaga

SEQ ID NO: 18582 - DNA, 25 bp, Mus musculus
ccacacgcgggtctgctgttaaaag

SEQ ID NO: 18583 - DNA, 25 bp, Mus musculus
ccacacggagatcccagaaggaatt

SEQ ID NO: 18584 - DNA, 25 bp, Mus musculus
ccacacttgtgctgaccagtgatca

SEQ ID NO: 18585 - DNA, 25 bp, Mus musculus
ccacagaaagtgattgagcaaaatg

SEQ ID NO: 18586 - DNA, 25 bp, Mus musculus
ccacagacatcctggaaaaagacca

SEQ ID NO: 18587 - DNA, 25 bp, Mus musculus
ccacagaccaggaggcttataaaca

SEQ ID NO: 18588 - DNA, 25 bp, Mus musculus
ccacagacgcttttgtgagctgctt

SEQ ID NO: 18589 - DNA, 25 bp, Mus musculus
ccacagagaaaatcccaggctcata

SEQ ID NO: 18590 - DNA, 25 bp, Mus musculus
ccacagagaagaatgtgattgcggc

SEQ ID NO: 18591 - DNA, 25 bp, Mus musculus
ccacagagactgaacggattgagga

SEQ ID NO: 18592 - DNA, 25 bp, Mus musculus
ccacagagcagttcaacgggcaggg

SEQ ID NO: 18593 - DNA, 25 bp, Mus musculus
ccacagagccatatcgcagagtggg

SEQ ID NO: 18594 - DNA, 25 bp, Mus musculus
ccacagagtgtgtttgccaacaacg

SEQ ID NO: 18595 - DNA, 25 bp, Mus musculus
ccacagagttcataggaggggtttc

SEQ ID NO: 18596 - DNA, 25 bp, Mus musculus
ccacagatgaatgcgaaagaggatt

SEQ ID NO: 18597 - DNA, 25 bp, Mus musculus
ccacagatgcagagactttgctgga

SEQ ID NO: 18598 - DNA, 25 bp, Mus musculus
ccacagcatgtatttttagaagaca

SEQ ID NO: 18599 - DNA, 25 bp, Mus musculus
ccacagccaaggagcgggtgcctgc

SEQ ID NO: 18600 - DNA, 25 bp, Mus musculus
ccacagccagcttgaaggagtctac

SEQ ID NO: 18601 - DNA, 25 bp, Mus musculus
ccacagcggctgtgaggccaagtct

SEQ ID NO: 18602 - DNA, 25 bp, Mus musculus
ccacagctcagggaaggatcgcatt

SEQ ID NO: 18603 - DNA, 25 bp, Mus musculus
ccacagctgtcaaaggaactcctcg

SEQ ID NO: 18604 - DNA, 25 bp, Mus musculus
ccacagctttctttggtcaatagtg

SEQ ID NO: 18605 - DNA, 25 bp, Mus musculus
ccacaggaaacttcgcagtgagcca

SEQ ID NO: 18606 - DNA, 25 bp, Mus musculus
ccacaggaagaagagtttggttgta

SEQ ID NO: 18607 - DNA, 25 bp, Mus musculus
ccacaggcaccggaagctgagaact

SEQ ID NO: 18608 - DNA, 25 bp, Mus musculus
ccacagggaccatgccagaagtgct

SEQ ID NO: 18609 - DNA, 25 bp, Mus musculus
ccacagggccatcttggtggcacga

SEQ ID NO: 18610 - DNA, 25 bp, Mus musculus
ccacagggcttgatgccatatggtc

SEQ ID NO: 18611 - DNA, 25 bp, Mus musculus
ccacaggtctattttccggagcaaa

SEQ ID NO: 18612 - DNA, 25 bp, Mus musculus
ccacaggttgtgtttaccatgaaga

SEQ ID NO: 18613 - DNA, 25 bp, Mus musculus
ccacaggtttttggcaaaagtaatg

SEQ ID NO: 18614 - DNA, 25 bp, Mus musculus
ccacagtaaaatggctcttgcccgg

SEQ ID NO: 18615 - DNA, 25 bp, Mus musculus
ccacagtaaacaaggtttgtgcttc

SEQ ID NO: 18616 - DNA, 25 bp, Mus musculus
ccacagtacatgtgtgaagccatgc

SEQ ID NO: 18617 - DNA, 25 bp, Mus musculus
ccacagtagtctgggacaaggtcac

SEQ ID NO: 18618 - DNA, 25 bp, Mus musculus
ccacagtgaggaccaaacgagacac

SEQ ID NO: 18619 - DNA, 25 bp, Mus musculus
ccacagtggatgtcagccagcccag

SEQ ID NO: 18620 - DNA, 25 bp, Mus musculus
ccacagtttcgaattcaaagcattg

SEQ ID NO: 18621 - DNA, 25 bp, Mus musculus
ccacatactggaatccgagtctggg

SEQ ID NO: 18622 - DNA, 25 bp, Mus musculus
ccacatcagtattgaggattcacga

SEQ ID NO: 18623 - DNA, 25 bp, Mus musculus
ccacatccacctcggaggaatgaaa

SEQ ID NO: 18624 - DNA, 25 bp, Mus musculus
ccacatcgacatgggcctggatggt

SEQ ID NO: 18625 - DNA, 25 bp, Mus musculus
ccacatctgcatagctgcttcagtg

SEQ ID NO: 18626 - DNA, 25 bp, Mus musculus
ccacatctgtgagatcaacggacag

SEQ ID NO: 18627 - DNA, 25 bp, Mus musculus
ccacatgcagcacattgcacggcag

SEQ ID NO: 18628 - DNA, 25 bp, Mus musculus
ccacatggaggactcatgtttacat

SEQ ID NO: 18629 - DNA, 25 bp, Mus musculus
ccacatgttcgtgctggagcaggag

SEQ ID NO: 18630 - DNA, 25 bp, Mus musculus
ccacattaagcgtctccgccagagg

SEQ ID NO: 18631 - DNA, 25 bp, Mus musculus
ccacattacagatgaccgtaccaag

SEQ ID NO: 18632 - DNA, 25 bp, Mus musculus
ccacattaggggagctgaagcagaa

SEQ ID NO: 18633 - DNA, 25 bp, Mus musculus
ccacattggtgagcgcatggccatg

SEQ ID NO: 18634 - DNA, 25 bp, Mus musculus
ccacattgtccagacattttcacag

SEQ ID NO: 18635 - DNA, 25 bp, Mus musculus
ccacattgttcctctagaagggcaa

SEQ ID NO: 18636 - DNA, 25 bp, Mus musculus
ccacatttggatcccttaagaccat

SEQ ID NO: 18637 - DNA, 25 bp, Mus musculus
ccacatttgtgcttatttagttctg

SEQ ID NO: 18638 - DNA, 25 bp, Mus musculus
ccaccaaagctgaggagggagatcg

SEQ ID NO: 18639 - DNA, 25 bp, Mus musculus
ccaccaaccagcacatttgaattct

SEQ ID NO: 18640 - DNA, 25 bp, Mus musculus
ccaccaagtcaagggcctggaggag

SEQ ID NO: 18641 - DNA, 25 bp, Mus musculus
ccaccaatatgcagggtttcaccaa

SEQ ID NO: 18642 - DNA, 25 bp, Mus musculus
ccaccaatggagattgctgccgatt

SEQ ID NO: 18643 - DNA, 25 bp, Mus musculus
ccaccacatgttcgtgctggagcag

SEQ ID NO: 18644 - DNA, 25 bp, Mus musculus
ccaccaccaagaagggatcgatcac

SEQ ID NO: 18645 - DNA, 25 bp, Mus musculus
ccaccacctcctatctggatttaaa

SEQ ID NO: 18646 - DNA, 25 bp, Mus musculus
ccaccaccttgtcgcgcgggtttat

SEQ ID NO: 18647 - DNA, 25 bp, Mus musculus
ccaccacgacagcaggcggatattt

SEQ ID NO: 18648 - DNA, 25 bp, Mus musculus
ccaccagcgtggtgatcacattcca

SEQ ID NO: 18649 - DNA, 25 bp, Mus musculus
ccaccaggaactagcctccgatggg

SEQ ID NO: 18650 - DNA, 25 bp, Mus musculus
ccaccaggctttgaagaagagcttt

SEQ ID NO: 18651 - DNA, 25 bp, Mus musculus
ccaccaggtcgctctggatatccag

SEQ ID NO: 18652 - DNA, 25 bp, Mus musculus
ccaccagtcacggaaatgtcacagt

SEQ ID NO: 18653 - DNA, 25 bp, Mus musculus
ccaccagtggtaaaaacagagatgg

SEQ ID NO: 18654 - DNA, 25 bp, Mus musculus
ccaccagttcttcaagacctctgga

SEQ ID NO: 18655 - DNA, 25 bp, Mus musculus
ccaccagttcttgaagacctctgga

SEQ ID NO: 18656 - DNA, 25 bp, Mus musculus
ccaccatgagaagggccagaagaag

SEQ ID NO: 18657 - DNA, 25 bp, Mus musculus
ccaccatgattgacgggagtggtgc

SEQ ID NO: 18658 - DNA, 25 bp, Mus musculus
ccaccatggagcctggcagcatgga

SEQ ID NO: 18659 - DNA, 25 bp, Mus musculus
ccaccatggtgacgctgtcagctca

SEQ ID NO: 18660 - DNA, 25 bp, Mus musculus
ccaccatttaaaacctggaggcact

SEQ ID NO: 18661 - DNA, 25 bp, Mus musculus
ccacccagagtggatatggcgcaag

SEQ ID NO: 18662 - DNA, 25 bp, Mus musculus
ccaccccagaaacgcaggaacaggt

SEQ ID NO: 18663 - DNA, 25 bp, Mus musculus
ccaccccagaaaggcaggaacaggt

SEQ ID NO: 18664 - DNA, 25 bp, Mus musculus
ccaccccagagatggatgaggatct

SEQ ID NO: 18665 - DNA, 25 bp, Mus musculus
ccaccctgaagatacactacatacg

SEQ ID NO: 18666 - DNA, 25 bp, Mus musculus
ccaccctgatttaagaaggatcctg

SEQ ID NO: 18667 - DNA, 25 bp, Mus musculus
ccaccgctttagaagggtctccatc

SEQ ID NO: 18668 - DNA, 25 bp, Mus musculus
ccaccgtggactgatcggagattac

SEQ ID NO: 18669 - DNA, 25 bp, Mus musculus
ccaccgttatccataacccagtgga

SEQ ID NO: 18670 - DNA, 25 bp, Mus musculus
ccaccgttcctgatgctgtgctcaa

SEQ ID NO: 18671 - DNA, 25 bp, Mus musculus
ccacctaacatgcagtgtagactct

SEQ ID NO: 18672 - DNA, 25 bp, Mus musculus
ccacctacggtctctgcagtctata

SEQ ID NO: 18673 - DNA, 25 bp, Mus musculus
ccacctactgcattaaaaaacttcg

SEQ ID NO: 18674 - DNA, 25 bp, Mus musculus
ccacctagagagaactgccagtgtc

SEQ ID NO: 18675 - DNA, 25 bp, Mus musculus
ccacctatctagagttttcatccct

SEQ ID NO: 18676 - DNA, 25 bp, Mus musculus
ccacctcacctcatcaaggagataa

SEQ ID NO: 18677 - DNA, 25 bp, Mus musculus
ccacctccaggtttcataatgcagg

SEQ ID NO: 18678 - DNA, 25 bp, Mus musculus
ccacctccatatttgccagcattgt

SEQ ID NO: 18679 - DNA, 25 bp, Mus musculus
ccacctcctatctggatttaaagat

SEQ ID NO: 18680 - DNA, 25 bp, Mus musculus
ccacctcctgtggtgaattacgaag

SEQ ID NO: 18681 - DNA, 25 bp, Mus musculus
ccacctcggaggaatgaaagctatt

SEQ ID NO: 18682 - DNA, 25 bp, Mus musculus
ccacctcttagctgaatggaagaaa

SEQ ID NO: 18683 - DNA, 25 bp, Mus musculus
ccacctgagcggttgttgcaaagct

SEQ ID NO: 18684 - DNA, 25 bp, Mus musculus
ccacctgcacagaggacctctaaaa

SEQ ID NO: 18685 - DNA, 25 bp, Mus musculus
ccacctggaagtcgtcaggttattc

SEQ ID NO: 18686 - DNA, 25 bp, Mus musculus
ccacctggaggttcagtataaagct

SEQ ID NO: 18687 - DNA, 25 bp, Mus musculus
ccacctggctgctcaagaagaccga

SEQ ID NO: 18688 - DNA, 25 bp, Mus musculus
ccaccttgatgacaccttgatgata

SEQ ID NO: 18689 - DNA, 25 bp, Mus musculus
ccaccttggaggagaatgacctgct

SEQ ID NO: 18690 - DNA, 25 bp, Mus musculus
ccacgaaatgactaatcaggagtct

SEQ ID NO: 18691 - DNA, 25 bp, Mus musculus
ccacgaccaggagcgttgtgagtga

SEQ ID NO: 18692 - DNA, 25 bp, Mus musculus
ccacgacggatcagacccttgaact

SEQ ID NO: 18693 - DNA, 25 bp, Mus musculus
ccacgactggatggtgttcgtgcgc

SEQ ID NO: 18694 - DNA, 25 bp, Mus musculus
ccacgagcggatgcagacagagaac

SEQ ID NO: 18695 - DNA, 25 bp, Mus musculus
ccacgaggtgttggagaactacttc

SEQ ID NO: 18696 - DNA, 25 bp, Mus musculus
ccacgatccacactagttatgggaa

SEQ ID NO: 18697 - DNA, 25 bp, Mus musculus
ccacgatccacgtgtacgagcagca

SEQ ID NO: 18698 - DNA, 25 bp, Mus musculus
ccacgatccctgtgatctctgggaa

SEQ ID NO: 18699 - DNA, 25 bp, Mus musculus
ccacgatccggaacaaggcagcgtg

SEQ ID NO: 18700 - DNA, 25 bp, Mus musculus
ccacgatgttgtggctatggcacga

SEQ ID NO: 18701 - DNA, 25 bp, Mus musculus
ccacgcaacgggaagaggtcaacaa

SEQ ID NO: 18702 - DNA, 25 bp, Mus musculus
ccacgcagactgaacttctaggatg

SEQ ID NO: 18703 - DNA, 25 bp, Mus musculus
ccacgcagctggcttgcagctgatg

SEQ ID NO: 18704 - DNA, 25 bp, Mus musculus
ccacgctgtatctgagaatggtgcc

SEQ ID NO: 18705 - DNA, 25 bp, Mus musculus
ccacgcttggttccagtacattacg

SEQ ID NO: 18706 - DNA, 25 bp, Mus musculus
ccacggacaaagagattgaggttct

SEQ ID NO: 18707 - DNA, 25 bp, Mus musculus
ccacggacaatgaatgtctatatag

SEQ ID NO: 18708 - DNA, 25 bp, Mus musculus
ccacggccactacccttgagtctat

SEQ ID NO: 18709 - DNA, 25 bp, Mus musculus
ccacgggtttaccatcaagagatca

SEQ ID NO: 18710 - DNA, 25 bp, Mus musculus
ccacggtcattaaaaagtgtgctga

SEQ ID NO: 18711 - DNA, 25 bp, Mus musculus
ccacggtgagcatctatagaccaga

SEQ ID NO: 18712 - DNA, 25 bp, Mus musculus
ccacggtggccaaaattcttagctt

SEQ ID NO: 18713 - DNA, 25 bp, Mus musculus
ccacgtacatgggagtgcaaaggcc

SEQ ID NO: 18714 - DNA, 25 bp, Mus musculus
ccacgtcactgccttactttgtgct

SEQ ID NO: 18715 - DNA, 25 bp, Mus musculus
ccacgttctcgctgcctgaggagga

SEQ ID NO: 18716 - DNA, 25 bp, Mus musculus
ccacgttgccttgattcctggcttg

SEQ ID NO: 18717 - DNA, 25 bp, Mus musculus
ccactaaagagttcatcgagagcct

SEQ ID NO: 18718 - DNA, 25 bp, Mus musculus
ccactaactgtatggaagtgatgac

SEQ ID NO: 18719 - DNA, 25 bp, Mus musculus
ccactacgaaggtttcctctggatg

SEQ ID NO: 18720 - DNA, 25 bp, Mus musculus
ccactatgctgtctattacagggtg

SEQ ID NO: 18721 - DNA, 25 bp, Mus musculus
ccactatggctgatttacgtgttgc

SEQ ID NO: 18722 - DNA, 25 bp, Mus musculus
ccactcagcagtgccagtatgaagt

SEQ ID NO: 18723 - DNA, 25 bp, Mus musculus
ccactcagtgaggatcagaaaagaa

SEQ ID NO: 18724 - DNA, 25 bp, Mus musculus
ccactccagggaagggtggccagaa

SEQ ID NO: 18725 - DNA, 25 bp, Mus musculus
ccactccccataaggatgagcttga

SEQ ID NO: 18726 - DNA, 25 bp, Mus musculus
ccactccccatatggatgagcttga

SEQ ID NO: 18727 - DNA, 25 bp, Mus musculus
ccactcctagtggttggcagcctcc

SEQ ID NO: 18728 - DNA, 25 bp, Mus musculus
ccactcctgaggtttggctctggca

SEQ ID NO: 18729 - DNA, 25 bp, Mus musculus
ccactcctggagtgaggatcgttct

SEQ ID NO: 18730 - DNA, 25 bp, Mus musculus
ccactcgataagtatgcctgtcatg

SEQ ID NO: 18731 - DNA, 25 bp, Mus musculus
ccactgaatagtaatcacacaggct

SEQ ID NO: 18732 - DNA, 25 bp, Mus musculus
ccactgacgggcaaacagtgtgtca

SEQ ID NO: 18733 - DNA, 25 bp, Mus musculus
ccactgagcaaagaaatggtgacat

SEQ ID NO: 18734 - DNA, 25 bp, Mus musculus
ccactgaggacagccttgtgtcaaa

SEQ ID NO: 18735 - DNA, 25 bp, Mus musculus
ccactgagtggaagatggaagtaga

SEQ ID NO: 18736 - DNA, 25 bp, Mus musculus
ccactgcagcctgggcatcaaggcc

SEQ ID NO: 18737 - DNA, 25 bp, Mus musculus
ccactgccggtggaatggccagcct

SEQ ID NO: 18738 - DNA, 25 bp, Mus musculus
ccactggacagggagaagattgtca

SEQ ID NO: 18739 - DNA, 25 bp, Mus musculus
ccactggacatggaagacctatctt

SEQ ID NO: 18740 - DNA, 25 bp, Mus musculus
ccactggctacccacagacggaagg

SEQ ID NO: 18741 - DNA, 25 bp, Mus musculus
ccactggcttggcatggcctgttag

SEQ ID NO: 18742 - DNA, 25 bp, Mus musculus
ccactggtcaaaaagctggataagg

SEQ ID NO: 18743 - DNA, 25 bp, Mus musculus
ccactggtgtgactgtggacttcca

SEQ ID NO: 18744 - DNA, 25 bp, Mus musculus
ccactgtcataagttcttcttggga

SEQ ID NO: 18745 - DNA, 25 bp, Mus musculus
ccactgtccatgagctttcccgaga

SEQ ID NO: 18746 - DNA, 25 bp, Mus musculus
ccactgtcctgaaattccctgatga

SEQ ID NO: 18747 - DNA, 25 bp, Mus musculus
ccactgtgatgtactgtcttgttca

SEQ ID NO: 18748 - DNA, 25 bp, Mus musculus
ccactgtgccctacctcttgggagt

SEQ ID NO: 18749 - DNA, 25 bp, Mus musculus
ccactgtggcagttgttgtttatga

SEQ ID NO: 18750 - DNA, 25 bp, Mus musculus
ccactgtggtgttgcatggatatga

SEQ ID NO: 18751 - DNA, 25 bp, Mus musculus
ccactgtgttgtactagagggagaa

SEQ ID NO: 18752 - DNA, 25 bp, Mus musculus
ccactgttacaatagcagtatgaag

SEQ ID NO: 18753 - DNA, 25 bp, Mus musculus
ccactgttgaagaaagcccactgtc

SEQ ID NO: 18754 - DNA, 25 bp, Mus musculus
ccactgttgctttggaaggacccag

SEQ ID NO: 18755 - DNA, 25 bp, Mus musculus
ccacttaggaagcatctagaggctg

SEQ ID NO: 18756 - DNA, 25 bp, Mus musculus
ccacttcactatgcatgtttctggg

SEQ ID NO: 18757 - DNA, 25 bp, Mus musculus
ccacttcagttctctcgatgttatg

SEQ ID NO: 18758 - DNA, 25 bp, Mus musculus
ccacttccgtgatgaggagctatcg

SEQ ID NO: 18759 - DNA, 25 bp, Mus musculus
ccacttctaatcctcatcatgacaa

SEQ ID NO: 18760 - DNA, 25 bp, Mus musculus
ccacttctatgtgcggaaatattca

SEQ ID NO: 18761 - DNA, 25 bp, Mus musculus
ccacttctgatggaggtgagtcgac

SEQ ID NO: 18762 - DNA, 25 bp, Mus musculus
ccacttctgtctgaggtacacaaag

SEQ ID NO: 18763 - DNA, 25 bp, Mus musculus
ccacttgcgggaagagcagactgct

SEQ ID NO: 18764 - DNA, 25 bp, Mus musculus
ccacttgcgggatgagcagactgct

SEQ ID NO: 18765 - DNA, 25 bp, Mus musculus
ccacttgtgccgactgccgtgttag

SEQ ID NO: 18766 - DNA, 25 bp, Mus musculus
ccactttagaaactggtgtagagga

SEQ ID NO: 18767 - DNA, 25 bp, Mus musculus
ccactttccctgcagctgagatctg

SEQ ID NO: 18768 - DNA, 25 bp, Mus musculus
ccactttccctggagctgagatctg

SEQ ID NO: 18769 - DNA, 25 bp, Mus musculus
ccagaaaaacagagtcgttgcgtta

SEQ ID NO: 18770 - DNA, 25 bp, Mus musculus
ccagaaaaagctgcttataagactc

SEQ ID NO: 18771 - DNA, 25 bp, Mus musculus
ccagaaaaccttgctcagaagcttc

SEQ ID NO: 18772 - DNA, 25 bp, Mus musculus
ccagaaaagtgaatcctgaaggtac

SEQ ID NO: 18773 - DNA, 25 bp, Mus musculus
ccagaaacggaatacagaggagcca

SEQ ID NO: 18774 - DNA, 25 bp, Mus musculus
ccagaaacttgcatctgaagataca

SEQ ID NO: 18775 - DNA, 25 bp, Mus musculus
ccagaaagaaaaggacttgtgcatt

SEQ ID NO: 18776 - DNA, 25 bp, Mus musculus
ccagaaagagcgatttatggctttg

SEQ ID NO: 18777 - DNA, 25 bp, Mus musculus
ccagaaagcggaggccgaaaagaga

SEQ ID NO: 18778 - DNA, 25 bp, Mus musculus
ccagaaatcagtgtgaaggagttta

SEQ ID NO: 18779 - DNA, 25 bp, Mus musculus
ccagaaatccgctgctgtgtggatg

SEQ ID NO: 18780 - DNA, 25 bp, Mus musculus
ccagaaatcctgcagaattctgaag

SEQ ID NO: 18781 - DNA, 25 bp, Mus musculus
ccagaaattacaacagaagatatca

SEQ ID NO: 18782 - DNA, 25 bp, Mus musculus
ccagaaattcacgtgagtacgccag

SEQ ID NO: 18783 - DNA, 25 bp, Mus musculus
ccagaacaatgagattcgggtttac

SEQ ID NO: 18784 - DNA, 25 bp, Mus musculus
ccagaacactccagaatatatggaa

SEQ ID NO: 18785 - DNA, 25 bp, Mus musculus
ccagaacagattatgcaagaaaaac

SEQ ID NO: 18786 - DNA, 25 bp, Mus musculus
ccagaacattgttgatgcgtatggt

SEQ ID NO: 18787 - DNA, 25 bp, Mus musculus
ccagaaccagagcagcgcactcttt

SEQ ID NO: 18788 - DNA, 25 bp, Mus musculus
ccagaacggcttctgtaactgcaaa

SEQ ID NO: 18789 - DNA, 25 bp, Mus musculus
ccagaacggcttgtgtaactgcaaa

SEQ ID NO: 18790 - DNA, 25 bp, Mus musculus
ccagaactgcgtagatgcgtacccc

SEQ ID NO: 18791 - DNA, 25 bp, Mus musculus
ccagaacttgtgaagcttggaagtt

SEQ ID NO: 18792 - DNA, 25 bp, Mus musculus
ccagaagatgcaatggactttggca

SEQ ID NO: 18793 - DNA, 25 bp, Mus musculus
ccagaagcagagctatggaatccca

SEQ ID NO: 18794 - DNA, 25 bp, Mus musculus
ccagaagcagatgaactgttgaata

SEQ ID NO: 18795 - DNA, 25 bp, Mus musculus
ccagaagccactcggagatttttca

SEQ ID NO: 18796 - DNA, 25 bp, Mus musculus
ccagaagctgaatacgatgaagtca

SEQ ID NO: 18797 - DNA, 25 bp, Mus musculus
ccagaagctggtcaagaacattgac

SEQ ID NO: 18798 - DNA, 25 bp, Mus musculus
ccagaaggcattagacttcctggag

SEQ ID NO: 18799 - DNA, 25 bp, Mus musculus
ccagaaggctgtcgaacccttgtat

SEQ ID NO: 18800 - DNA, 25 bp, Mus musculus
ccagaagggaaagtttgatggctgc

SEQ ID NO: 18801 - DNA, 25 bp, Mus musculus
ccagaagggaaatactgaacctgca

SEQ ID NO: 18802 - DNA, 25 bp, Mus musculus
ccagaaggtgtcgtctttgacttgc

SEQ ID NO: 18803 - DNA, 25 bp, Mus musculus
ccagaaggttggaaaacttgctgca

SEQ ID NO: 18804 - DNA, 25 bp, Mus musculus
ccagaagtaggtatttggtcccttg

SEQ ID NO: 18805 - DNA, 25 bp, Mus musculus
ccagaagtgtaagccatgtgcggac

SEQ ID NO: 18806 - DNA, 25 bp, Mus musculus
ccagaagtgtcgttggcgccagtgc

SEQ ID NO: 18807 - DNA, 25 bp, Mus musculus
ccagaagtttgctctcagtcaccaa

SEQ ID NO: 18808 - DNA, 25 bp, Mus musculus
ccagaatatatcagctgtttaaagc

SEQ ID NO: 18809 - DNA, 25 bp, Mus musculus
ccagaatgacaacaagcccaagttc

SEQ ID NO: 18810 - DNA, 25 bp, Mus musculus
ccagaatgacagctgcctacatctg

SEQ ID NO: 18811 - DNA, 25 bp, Mus musculus
ccagaatgcagacatcggcagaaag

SEQ ID NO: 18812 - DNA, 25 bp, Mus musculus
ccagaatgcttcatctttggagcaa

SEQ ID NO: 18813 - DNA, 25 bp, Mus musculus
ccagaatgcttcttctttggagcaa

SEQ ID NO: 18814 - DNA, 25 bp, Mus musculus
ccagaattaaacctcacacaagtca

SEQ ID NO: 18815 - DNA, 25 bp, Mus musculus
ccagaattaaacgtcacacaagtca

SEQ ID NO: 18816 - DNA, 25 bp, Mus musculus
ccagaattattccagcgtgtaggaa

SEQ ID NO: 18817 - DNA, 25 bp, Mus musculus
ccagaattctatgatgaagacgtca

SEQ ID NO: 18818 - DNA, 25 bp, Mus musculus
ccagaatttgctgatattgtattga

SEQ ID NO: 18819 - DNA, 25 bp, Mus musculus
ccagacaactggaaggaagggaact

SEQ ID NO: 18820 - DNA, 25 bp, Mus musculus
ccagacaccatctatgaggactgtg

SEQ ID NO: 18821 - DNA, 25 bp, Mus musculus
ccagacagaaggattgagataagca

SEQ ID NO: 18822 - DNA, 25 bp, Mus musculus
ccagacagtcccctgctaatggtca

SEQ ID NO: 18823 - DNA, 25 bp, Mus musculus
ccagacatagcccaaagagccaaga

SEQ ID NO: 18824 - DNA, 25 bp, Mus musculus
ccagacatgctgctcctgcggcatg

SEQ ID NO: 18825 - DNA, 25 bp, Mus musculus
ccagaccaaggagactgcaacagga

SEQ ID NO: 18826 - DNA, 25 bp, Mus musculus
ccagacccaagcctgagcttgcagt

SEQ ID NO: 18827 - DNA, 25 bp, Mus musculus
ccagacctaaaaccacagcaagtac

SEQ ID NO: 18828 - DNA, 25 bp, Mus musculus
ccagacctcttgattccattttgaa

SEQ ID NO: 18829 - DNA, 25 bp, Mus musculus
ccagacggaagagaagtataaaaag

SEQ ID NO: 18830 - DNA, 25 bp, Mus musculus
ccagacgggtcacactgctggaagc

SEQ ID NO: 18831 - DNA, 25 bp, Mus musculus
ccagactatcaaccctgtggctggg

SEQ ID NO: 18832 - DNA, 25 bp, Mus musculus
ccagactcagcctcaagggtcttct

SEQ ID NO: 18833 - DNA, 25 bp, Mus musculus
ccagactcatggtatcgtgatatca

SEQ ID NO: 18834 - DNA, 25 bp, Mus musculus
ccagactccgttcagtgagctccta

SEQ ID NO: 18835 - DNA, 25 bp, Mus musculus
ccagactggaatagttctaaattta

SEQ ID NO: 18836 - DNA, 25 bp, Mus musculus
ccagactttttgcagatcaaggaga

SEQ ID NO: 18837 - DNA, 25 bp, Mus musculus
ccagagaaagacctgtgtagtgtca

SEQ ID NO: 18838 - DNA, 25 bp, Mus musculus
ccagagaaatatccctctgctgttt

SEQ ID NO: 18839 - DNA, 25 bp, Mus musculus
ccagagaaatatgccgccttcacta

SEQ ID NO: 18840 - DNA, 25 bp, Mus musculus
ccagagaacagctttgacttcgtaa

SEQ ID NO: 18841 - DNA, 25 bp, Mus musculus
ccagagaacgccgagaggaacgaga

SEQ ID NO: 18842 - DNA, 25 bp, Mus musculus
ccagagaagaatcctgacgatttct

SEQ ID NO: 18843 - DNA, 25 bp, Mus musculus
ccagagaagagcatagaagggtcct

SEQ ID NO: 18844 - DNA, 25 bp, Mus musculus
ccagagaaggacgatgggatgctca

SEQ ID NO: 18845 - DNA, 25 bp, Mus musculus
ccagagaagggctattcgtttgtca

SEQ ID NO: 18846 - DNA, 25 bp, Mus musculus
ccagagaattgggatcggaaattgc

SEQ ID NO: 18847 - DNA, 25 bp, Mus musculus
ccagagacagctcaggacggtcata

SEQ ID NO: 18848 - DNA, 25 bp, Mus musculus
ccagagacggcgactatcgggacca

SEQ ID NO: 18849 - DNA, 25 bp, Mus musculus
ccagagatgagcgtgtgaacctgct

SEQ ID NO: 18850 - DNA, 25 bp, Mus musculus
ccagagatggtctgggcttctctgg

SEQ ID NO: 18851 - DNA, 25 bp, Mus musculus
ccagagcagcaggacggaaatcaag

SEQ ID NO: 18852 - DNA, 25 bp, Mus musculus
ccagagcccagaaattcacgtgagt

SEQ ID NO: 18853 - DNA, 25 bp, Mus musculus
ccagagcgaagcactttatgccttt

SEQ ID NO: 18854 - DNA, 25 bp, Mus musculus
ccagagctcagctgcctaggagatg

SEQ ID NO: 18855 - DNA, 25 bp, Mus musculus
ccagagcttttgaagttattccagg

SEQ ID NO: 18856 - DNA, 25 bp, Mus musculus
ccagaggaaaggttggaagacctgt

SEQ ID NO: 18857 - DNA, 25 bp, Mus musculus
ccagaggaagccattacccactgct

SEQ ID NO: 18858 - DNA, 25 bp, Mus musculus
ccagaggacggctccattgtgttca

SEQ ID NO: 18859 - DNA, 25 bp, Mus musculus
ccagaggacttttgtcaagattgga

SEQ ID NO: 18860 - DNA, 25 bp, Mus musculus
ccagaggagcaaacacctgtggtcc

SEQ ID NO: 18861 - DNA, 25 bp, Mus musculus
ccagaggatgtactatgtgttcata

SEQ ID NO: 18862 - DNA, 25 bp, Mus musculus
ccagaggatgttattcagttttcac

SEQ ID NO: 18863 - DNA, 25 bp, Mus musculus
ccagaggcttgatgaatggatacag

SEQ ID NO: 18864 - DNA, 25 bp, Mus musculus
ccagagggagctgtgaagcctccag

SEQ ID NO: 18865 - DNA, 25 bp, Mus musculus
ccagagggcatgagtgagatctacc

SEQ ID NO: 18866 - DNA, 25 bp, Mus musculus
ccagagggccttgtaccgccatgta

SEQ ID NO: 18867 - DNA, 25 bp, Mus musculus
ccagagggtgaatgggtatctttcc

SEQ ID NO: 18868 - DNA, 25 bp, Mus musculus
ccagaggtgaagtccccaatggagc

SEQ ID NO: 18869 - DNA, 25 bp, Mus musculus
ccagaggtggcttccgtggttgcac

SEQ ID NO: 18870 - DNA, 25 bp, Mus musculus
ccagaggtgggctaaaggctgtcca

SEQ ID NO: 18871 - DNA, 25 bp, Mus musculus
ccagagtagcatctacccaatggag

SEQ ID NO: 18872 - DNA, 25 bp, Mus musculus
ccagagtatggcctcagaacctacc

SEQ ID NO: 18873 - DNA, 25 bp, Mus musculus
ccagagtcacagaatagttggtaaa

SEQ ID NO: 18874 - DNA, 25 bp, Mus musculus
ccagagtcagatgagctgacggctg

SEQ ID NO: 18875 - DNA, 25 bp, Mus musculus
ccagagtccttggaggcgacggcta

SEQ ID NO: 18876 - DNA, 25 bp, Mus musculus
ccagagtgatggagttcaagctagc

SEQ ID NO: 18877 - DNA, 25 bp, Mus musculus
ccagagtgcagtttcgatggaaaat

SEQ ID NO: 18878 - DNA, 25 bp, Mus musculus
ccagagtggaaactgttggctcagt

SEQ ID NO: 18879 - DNA, 25 bp, Mus musculus
ccagagtggaatagctgggcccagc

SEQ ID NO: 18880 - DNA, 25 bp, Mus musculus
ccagagtgtgaacagcctgggacct

SEQ ID NO: 18881 - DNA, 25 bp, Mus musculus
ccagagttgctttggatatgaccac

SEQ ID NO: 18882 - DNA, 25 bp, Mus musculus
ccagagtttgccatgccagcatcag

SEQ ID NO: 18883 - DNA, 25 bp, Mus musculus
ccagataaacctgcaagtcccaagt

SEQ ID NO: 18884 - DNA, 25 bp, Mus musculus
ccagataagggcattagattgcttg

SEQ ID NO: 18885 - DNA, 25 bp, Mus musculus
ccagatactctagcctggtggtcat

SEQ ID NO: 18886 - DNA, 25 bp, Mus musculus
ccagatactggcagagcaaggctct

SEQ ID NO: 18887 - DNA, 25 bp, Mus musculus
ccagatactgtgcagcctgatgcca

SEQ ID NO: 18888 - DNA, 25 bp, Mus musculus
ccagatactgtggagcctgatgcca

SEQ ID NO: 18889 - DNA, 25 bp, Mus musculus
ccagatacttgttgaagtgctgaat

SEQ ID NO: 18890 - DNA, 25 bp, Mus musculus
ccagatatactgcatagagaacgct

SEQ ID NO: 18891 - DNA, 25 bp, Mus musculus
ccagatatgcaaagtaaacagggtg

SEQ ID NO: 18892 - DNA, 25 bp, Mus musculus
ccagatatgtacctccaagaaaagc

SEQ ID NO: 18893 - DNA, 25 bp, Mus musculus
ccagatatgtacgtccaagaaaagc

SEQ ID NO: 18894 - DNA, 25 bp, Mus musculus
ccagatcaaggagcccggcaagcag

SEQ ID NO: 18895 - DNA, 25 bp, Mus musculus
ccagatcacaaacgattatccagag

SEQ ID NO: 18896 - DNA, 25 bp, Mus musculus
ccagatcatcaactccaagtgggag

SEQ ID NO: 18897 - DNA, 25 bp, Mus musculus
ccagatcatctacgatgagaaccgg

SEQ ID NO: 18898 - DNA, 25 bp, Mus musculus
ccagatcatctgaacatatccagtt

SEQ ID NO: 18899 - DNA, 25 bp, Mus musculus
ccagatcatgagctccagcagacca

SEQ ID NO: 18900 - DNA, 25 bp, Mus musculus
ccagatcattttgtcttctgaggac

SEQ ID NO: 18901 - DNA, 25 bp, Mus musculus
ccagatccgagtcaccagaaccagg

SEQ ID NO: 18902 - DNA, 25 bp, Mus musculus
ccagatcctgaccaaacatttaaat

SEQ ID NO: 18903 - DNA, 25 bp, Mus musculus
ccagatcgaaggcaagaggtaacac

SEQ ID NO: 18904 - DNA, 25 bp, Mus musculus
ccagatctagagaaagcatcgtacc

SEQ ID NO: 18905 - DNA, 25 bp, Mus musculus
ccagatctccatctcctaaaagaag

SEQ ID NO: 18906 - DNA, 25 bp, Mus musculus
ccagatctctatggctcacagatgt

SEQ ID NO: 18907 - DNA, 25 bp, Mus musculus
ccagatcttcctgagtttgggccct

SEQ ID NO: 18908 - DNA, 25 bp, Mus musculus
ccagatgcccacaattgagagagta

SEQ ID NO: 18909 - DNA, 25 bp, Mus musculus
ccagatgcccactattgagagagta

SEQ ID NO: 18910 - DNA, 25 bp, Mus musculus
ccagatgccctcaaggtctcagttt

SEQ ID NO: 18911 - DNA, 25 bp, Mus musculus
ccagatggagctcggctcctgacta

SEQ ID NO: 18912 - DNA, 25 bp, Mus musculus
ccagatgggtccagcttcaacatga

SEQ ID NO: 18913 - DNA, 25 bp, Mus musculus
ccagatgtccactctccaagcttta

SEQ ID NO: 18914 - DNA, 25 bp, Mus musculus
ccagatgtctataattgagatgcca

SEQ ID NO: 18915 - DNA, 25 bp, Mus musculus
ccagatgtgagagctctgtgtcatc

SEQ ID NO: 18916 - DNA, 25 bp, Mus musculus
ccagatgtgtaaggcccatggcatt

SEQ ID NO: 18917 - DNA, 25 bp, Mus musculus
ccagattaaaaggaatagtcccatt

SEQ ID NO: 18918 - DNA, 25 bp, Mus musculus
ccagattcatgatgtagaagggcgg

SEQ ID NO: 18919 - DNA, 25 bp, Mus musculus
ccagattgcctcaaaggttgtgatg

SEQ ID NO: 18920 - DNA, 25 bp, Mus musculus
ccagattggctgcttgttgcgcctg

SEQ ID NO: 18921 - DNA, 25 bp, Mus musculus
ccagatttggaaaaggcctcgtcat

SEQ ID NO: 18922 - DNA, 25 bp, Mus musculus
ccagatttgttgtggacccgtccat

SEQ ID NO: 18923 - DNA, 25 bp, Mus musculus
ccagcaaactaaagtggccttcacc

SEQ ID NO: 18924 - DNA, 25 bp, Mus musculus
ccagcaaatcttggcgacaacacaa

SEQ ID NO: 18925 - DNA, 25 bp, Mus musculus
ccagcaacctcgaagtcaccatgta

SEQ ID NO: 18926 - DNA, 25 bp, Mus musculus
ccagcaacgtggattctctcttcta

SEQ ID NO: 18927 - DNA, 25 bp, Mus musculus
ccagcaagactagaagagcaggaag

SEQ ID NO: 18928 - DNA, 25 bp, Mus musculus
ccagcaaggcggtgcctgattccca

SEQ ID NO: 18929 - DNA, 25 bp, Mus musculus
ccagcaagttttccttaacacctgc

SEQ ID NO: 18930 - DNA, 25 bp, Mus musculus
ccagcacaagatgagaagacccagc

SEQ ID NO: 18931 - DNA, 25 bp, Mus musculus
ccagcacagcaaatgctccaaaatg

SEQ ID NO: 18932 - DNA, 25 bp, Mus musculus
ccagcacagcctcgtcgtggatatg

SEQ ID NO: 18933 - DNA, 25 bp, Mus musculus
ccagcaccatgctaagtgctgtggg

SEQ ID NO: 18934 - DNA, 25 bp, Mus musculus
ccagcaccctggagcacatcgtggg

SEQ ID NO: 18935 - DNA, 25 bp, Mus musculus
ccagcacgttcaatatttgatggtt

SEQ ID NO: 18936 - DNA, 25 bp, Mus musculus
ccagcactcagaagcgcatccgagt

SEQ ID NO: 18937 - DNA, 25 bp, Mus musculus
ccagcacttgctaagagcaggcctt

SEQ ID NO: 18938 - DNA, 25 bp, Mus musculus
ccagcagaaggttacgtaggcttca

SEQ ID NO: 18939 - DNA, 25 bp, Mus musculus
ccagcagaccatgtgttcgcgggat

SEQ ID NO: 18940 - DNA, 25 bp, Mus musculus
ccagcagatggctgataaaattctg

SEQ ID NO: 18941 - DNA, 25 bp, Mus musculus
ccagcagcaaaaagttgtcaacaag

SEQ ID NO: 18942 - DNA, 25 bp, Mus musculus
ccagcagcatcgttttcctctgtga

SEQ ID NO: 18943 - DNA, 25 bp, Mus musculus
ccagcagctctatgtgggaggccaa

SEQ ID NO: 18944 - DNA, 25 bp, Mus musculus
ccagcagctctgcagcaaggtgacg

SEQ ID NO: 18945 - DNA, 25 bp, Mus musculus
ccagcagctctggagcaaggtgacg

SEQ ID NO: 18946 - DNA, 25 bp, Mus musculus
ccagcagctggaccgaattgattca

SEQ ID NO: 18947 - DNA, 25 bp, Mus musculus
ccagcagctggcaatcatccagatt

SEQ ID NO: 18948 - DNA, 25 bp, Mus musculus
ccagcaggcactcagttcttaccag

SEQ ID NO: 18949 - DNA, 25 bp, Mus musculus
ccagcaggcctgcattgaggccaag

SEQ ID NO: 18950 - DNA, 25 bp, Mus musculus
ccagcaggctggttctgagaccacc

SEQ ID NO: 18951 - DNA, 25 bp, Mus musculus
ccagcagggctgtgctcagaacctg

SEQ ID NO: 18952 - DNA, 25 bp, Mus musculus
ccagcaggtaaagatgtgggcccag

SEQ ID NO: 18953 - DNA, 25 bp, Mus musculus
ccagcagtattccttcggaacaggg

SEQ ID NO: 18954 - DNA, 25 bp, Mus musculus
ccagcagtgccgtgagaacatcttt

SEQ ID NO: 18955 - DNA, 25 bp, Mus musculus
ccagcagttggtaaagaaagggaag

SEQ ID NO: 18956 - DNA, 25 bp, Mus musculus
ccagcagtttcggaagaatgatggc

SEQ ID NO: 18957 - DNA, 25 bp, Mus musculus
ccagcatacccagcaagcatggaat

SEQ ID NO: 18958 - DNA, 25 bp, Mus musculus
ccagcatatctggtttcttgacatg

SEQ ID NO: 18959 - DNA, 25 bp, Mus musculus
ccagcatctgctcgaggcattggca

SEQ ID NO: 18960 - DNA, 25 bp, Mus musculus
ccagcatctgtccagcttcatcaag

SEQ ID NO: 18961 - DNA, 25 bp, Mus musculus
ccagcatgaactgtggacaaacaga

SEQ ID NO: 18962 - DNA, 25 bp, Mus musculus
ccagcatgagtaccacagagactaa

SEQ ID NO: 18963 - DNA, 25 bp, Mus musculus
ccagcatgatgccagaggagatcga

SEQ ID NO: 18964 - DNA, 25 bp, Mus musculus
ccagcatggcggaccaggagctcca

SEQ ID NO: 18965 - DNA, 25 bp, Mus musculus
ccagcatggtctagatgggaaaaag

SEQ ID NO: 18966 - DNA, 25 bp, Mus musculus
ccagcatgtctacatttcttgaaaa

SEQ ID NO: 18967 - DNA, 25 bp, Mus musculus
ccagcatttcggaagcggagccatg

SEQ ID NO: 18968 - DNA, 25 bp, Mus musculus
ccagcattttgacggttttgtggtg

SEQ ID NO: 18969 - DNA, 25 bp, Mus musculus
ccagccaaagcccagattaagacat

SEQ ID NO: 18970 - DNA, 25 bp, Mus musculus
ccagccacacagctctatgtctgaa

SEQ ID NO: 18971 - DNA, 25 bp, Mus musculus
ccagccacagctggagagccagtat

SEQ ID NO: 18972 - DNA, 25 bp, Mus musculus
ccagccactatatcgaagagagtac

SEQ ID NO: 18973 - DNA, 25 bp, Mus musculus
ccagccagcaggcactcagttctta

SEQ ID NO: 18974 - DNA, 25 bp, Mus musculus
ccagccagctccgaaagcaaaagag

SEQ ID NO: 18975 - DNA, 25 bp, Mus musculus
ccagccaggtgcttactattcctca

SEQ ID NO: 18976 - DNA, 25 bp, Mus musculus
ccagccagtgaagcaggagaacctg

SEQ ID NO: 18977 - DNA, 25 bp, Mus musculus
ccagccatcatgtctatagagaaga

SEQ ID NO: 18978 - DNA, 25 bp, Mus musculus
ccagccattgactataatcgggttc

SEQ ID NO: 18979 - DNA, 25 bp, Mus musculus
ccagcccaagaaccaggaaagttct

SEQ ID NO: 18980 - DNA, 25 bp, Mus musculus
ccagcccatggaatgctgtgatcaa

SEQ ID NO: 18981 - DNA, 25 bp, Mus musculus
ccagccctggtactgctctggtgtc

SEQ ID NO: 18982 - DNA, 25 bp, Mus musculus
ccagccggtggaactcagcccggga

SEQ ID NO: 18983 - DNA, 25 bp, Mus musculus
ccagccggtggatctcagcccggga

SEQ ID NO: 18984 - DNA, 25 bp, Mus musculus
ccagccgtatcttagcgagagtgaa

SEQ ID NO: 18985 - DNA, 25 bp, Mus musculus
ccagccgtttgggaaatatgttagt

SEQ ID NO: 18986 - DNA, 25 bp, Mus musculus
ccagcctacgtgagtgcttcaatct

SEQ ID NO: 18987 - DNA, 25 bp, Mus musculus
ccagcctcagctcccagatgaagat

SEQ ID NO: 18988 - DNA, 25 bp, Mus musculus
ccagcctcgggtcatttcctttgaa

SEQ ID NO: 18989 - DNA, 25 bp, Mus musculus
ccagcctcgtgatgaggaatagcaa

SEQ ID NO: 18990 - DNA, 25 bp, Mus musculus
ccagcctgcagagcatggggtttct

SEQ ID NO: 18991 - DNA, 25 bp, Mus musculus
ccagcctgcaggaggccaatggaag

SEQ ID NO: 18992 - DNA, 25 bp, Mus musculus
ccagcctgtacctccttggagttct

SEQ ID NO: 18993 - DNA, 25 bp, Mus musculus
ccagcctgtactacccggagatgta

SEQ ID NO: 18994 - DNA, 25 bp, Mus musculus
ccagcctgtgccatgaacaaggagt

SEQ ID NO: 18995 - DNA, 25 bp, Mus musculus
ccagccttgtggatcgaaaccacag

SEQ ID NO: 18996 - DNA, 25 bp, Mus musculus
ccagcgaagatgctgtcaaaaaaca

SEQ ID NO: 18997 - DNA, 25 bp, Mus musculus
ccagcgaatcggcaggcttggtaca

SEQ ID NO: 18998 - DNA, 25 bp, Mus musculus
ccagcgaatcgggaggcttggtaca

SEQ ID NO: 18999 - DNA, 25 bp, Mus musculus
ccagcgacaacttagtcaggatgac

SEQ ID NO: 19000 - DNA, 25 bp, Mus musculus
ccagcgaggacatctggaagaaatt

SEQ ID NO: 19001 - DNA, 25 bp, Mus musculus
ccagcgatcagcttaaacaacctag

SEQ ID NO: 19002 - DNA, 25 bp, Mus musculus
ccagcgccaagaaagactccaggaa

SEQ ID NO: 19003 - DNA, 25 bp, Mus musculus
ccagcgcgagacctggtccttcgaa

SEQ ID NO: 19004 - DNA, 25 bp, Mus musculus
ccagcgctctgtttttggagagaga

SEQ ID NO: 19005 - DNA, 25 bp, Mus musculus
ccagcggaaggtgaaacctcagccg

SEQ ID NO: 19006 - DNA, 25 bp, Mus musculus
ccagcggcttagaggagttgctaga

SEQ ID NO: 19007 - DNA, 25 bp, Mus musculus
ccagcgggcggctgatggctctact

SEQ ID NO: 19008 - DNA, 25 bp, Mus musculus
ccagcgggtccctgctgacatgatc

SEQ ID NO: 19009 - DNA, 25 bp, Mus musculus
ccagcggtgtgctcgaacagacaag

SEQ ID NO: 19010 - DNA, 25 bp, Mus musculus
ccagcgtgatctgctccgacaagtg

SEQ ID NO: 19011 - DNA, 25 bp, Mus musculus
ccagcgtgggtaccaagaaccagag

SEQ ID NO: 19012 - DNA, 25 bp, Mus musculus
ccagcgtggtgatcacattccacaa

SEQ ID NO: 19013 - DNA, 25 bp, Mus musculus
ccagctaaacacagtggagttcctg

SEQ ID NO: 19014 - DNA, 25 bp, Mus musculus
ccagctaaccttgtaagatgaattg

SEQ ID NO: 19015 - DNA, 25 bp, Mus musculus
ccagctacattgatatttgaaggag

SEQ ID NO: 19016 - DNA, 25 bp, Mus musculus
ccagctagctgggacaagtttacag

SEQ ID NO: 19017 - DNA, 25 bp, Mus musculus
ccagctagctgtggatccggaggcc

SEQ ID NO: 19018 - DNA, 25 bp, Mus musculus
ccagctagcttcagtggacatacca

SEQ ID NO: 19019 - DNA, 25 bp, Mus musculus
ccagctcaggagctacttgatgaaa

SEQ ID NO: 19020 - DNA, 25 bp, Mus musculus
ccagctcagtccatgttgtggtact

SEQ ID NO: 19021 - DNA, 25 bp, Mus musculus
ccagctcatgctcatgggccttttg

SEQ ID NO: 19022 - DNA, 25 bp, Mus musculus
ccagctcatgctgatgggccttttg

SEQ ID NO: 19023 - DNA, 25 bp, Mus musculus
ccagctcatgtggagacagtggttt

SEQ ID NO: 19024 - DNA, 25 bp, Mus musculus
ccagctccaccgctctgaaagggat

SEQ ID NO: 19025 - DNA, 25 bp, Mus musculus
ccagctccaccggtctgaaagggat

SEQ ID NO: 19026 - DNA, 25 bp, Mus musculus
ccagctccgaaagcaaaagagggag

SEQ ID NO: 19027 - DNA, 25 bp, Mus musculus
ccagctcgggaatgattggcacaca

SEQ ID NO: 19028 - DNA, 25 bp, Mus musculus
ccagctctacctgaatgagaaggac

SEQ ID NO: 19029 - DNA, 25 bp, Mus musculus
ccagctctgatgctgctgtcacata

SEQ ID NO: 19030 - DNA, 25 bp, Mus musculus
ccagctctgctgtgaggaaaacgaa

SEQ ID NO: 19031 - DNA, 25 bp, Mus musculus
ccagctcttggaaggggctataaca

SEQ ID NO: 19032 - DNA, 25 bp, Mus musculus
ccagctcttggatggggctataaca

SEQ ID NO: 19033 - DNA, 25 bp, Mus musculus
ccagctgagccacctgaagcagtac

SEQ ID NO: 19034 - DNA, 25 bp, Mus musculus
ccagctgagccttatagcagatctt

SEQ ID NO: 19035 - DNA, 25 bp, Mus musculus
ccagctgaggtgtttcaaggagtaa

SEQ ID NO: 19036 - DNA, 25 bp, Mus musculus
ccagctgcagcaacggatgcacagg

SEQ ID NO: 19037 - DNA, 25 bp, Mus musculus
ccagctgctgattcacgcggccatg

SEQ ID NO: 19038 - DNA, 25 bp, Mus musculus
ccagctgctggaatcatataggtca

SEQ ID NO: 19039 - DNA, 25 bp, Mus musculus
ccagctggatatcagaatgtgctca

SEQ ID NO: 19040 - DNA, 25 bp, Mus musculus
ccagctggcagagaacagggaagtt

SEQ ID NO: 19041 - DNA, 25 bp, Mus musculus
ccagctggcccgaaagcagcttgaa

SEQ ID NO: 19042 - DNA, 25 bp, Mus musculus
ccagctggctactctgctggagagg

SEQ ID NO: 19043 - DNA, 25 bp, Mus musculus
ccagctgggagcaggtggataaaca

SEQ ID NO: 19044 - DNA, 25 bp, Mus musculus
ccagctggtggtgacattccgggaa

SEQ ID NO: 19045 - DNA, 25 bp, Mus musculus
ccagctgtatgagcaggcccgctgg

SEQ ID NO: 19046 - DNA, 25 bp, Mus musculus
ccagctgtgcgcaggaactcctgtt

SEQ ID NO: 19047 - DNA, 25 bp, Mus musculus
ccagctgtggatccactggactcca

SEQ ID NO: 19048 - DNA, 25 bp, Mus musculus
ccagcttacaaactgtggatctcag

SEQ ID NO: 19049 - DNA, 25 bp, Mus musculus
ccagcttacaaccagagaccctgag

SEQ ID NO: 19050 - DNA, 25 bp, Mus musculus
ccagcttacctgcagatcccagaag

SEQ ID NO: 19051 - DNA, 25 bp, Mus musculus
ccagcttcatctgggccaactagtt

SEQ ID NO: 19052 - DNA, 25 bp, Mus musculus
ccagcttcctcgtaagtgatcagag

SEQ ID NO: 19053 - DNA, 25 bp, Mus musculus
ccagcttcctgtgccattttaaata

SEQ ID NO: 19054 - DNA, 25 bp, Mus musculus
ccagcttgaaggagtctacagagaa

SEQ ID NO: 19055 - DNA, 25 bp, Mus musculus
ccagcttggcgaacagcggtcagag

SEQ ID NO: 19056 - DNA, 25 bp, Mus musculus
ccagcttgtggatacaggagggcac

SEQ ID NO: 19057 - DNA, 25 bp, Mus musculus
ccagctttgctacatgtcacaggcg

SEQ ID NO: 19058 - DNA, 25 bp, Mus musculus
ccagctttgtagctgagatacactg

SEQ ID NO: 19059 - DNA, 25 bp, Mus musculus
ccaggaaacagctgtgaatcccgtg

SEQ ID NO: 19060 - DNA, 25 bp, Mus musculus
ccaggaaaccagatttttggctatg

SEQ ID NO: 19061 - DNA, 25 bp, Mus musculus
ccaggaaagacagcatgatgagact

SEQ ID NO: 19062 - DNA, 25 bp, Mus musculus
ccaggaaagagtgggacctgaagcc

SEQ ID NO: 19063 - DNA, 25 bp, Mus musculus
ccaggaacaccggtctaggaagcag

SEQ ID NO: 19064 - DNA, 25 bp, Mus musculus
ccaggaaccctgctatctgctgaga

SEQ ID NO: 19065 - DNA, 25 bp, Mus musculus
ccaggaacttcgattggactgatag

SEQ ID NO: 19066 - DNA, 25 bp, Mus musculus
ccaggaagacctgttggagaattca

SEQ ID NO: 19067 - DNA, 25 bp, Mus musculus
ccaggaagatctctttgaccagatc

SEQ ID NO: 19068 - DNA, 25 bp, Mus musculus
ccaggaaggaattgctgaaatgatc

SEQ ID NO: 19069 - DNA, 25 bp, Mus musculus
ccaggaagtgtgcaagaactatgct

SEQ ID NO: 19070 - DNA, 25 bp, Mus musculus
ccaggaatcagcaaagacttaagag

SEQ ID NO: 19071 - DNA, 25 bp, Mus musculus
ccaggaatccccaggaacagactct

SEQ ID NO: 19072 - DNA, 25 bp, Mus musculus
ccaggaatggagacaccgctggatg

SEQ ID NO: 19073 - DNA, 25 bp, Mus musculus
ccaggaattgctgggtgatatcaca

SEQ ID NO: 19074 - DNA, 25 bp, Mus musculus
ccaggacaaagtaaaacgtgtatcg

SEQ ID NO: 19075 - DNA, 25 bp, Mus musculus
ccaggacacagaccgccaagtgtgg

SEQ ID NO: 19076 - DNA, 25 bp, Mus musculus
ccaggacatgactcaacggtgcaca

SEQ ID NO: 19077 - DNA, 25 bp, Mus musculus
ccaggaccgagtggagcagattgct

SEQ ID NO: 19078 - DNA, 25 bp, Mus musculus
ccaggacctgtgtgagctgcaaaag

SEQ ID NO: 19079 - DNA, 25 bp, Mus musculus
ccaggacgaacaatttgcagctaca

SEQ ID NO: 19080 - DNA, 25 bp, Mus musculus
ccaggactatcaacacggtatcttc

SEQ ID NO: 19081 - DNA, 25 bp, Mus musculus
ccaggactatcggaccgagcaaggg

SEQ ID NO: 19082 - DNA, 25 bp, Mus musculus
ccaggactgcctgggaaggtcttcc

SEQ ID NO: 19083 - DNA, 25 bp, Mus musculus
ccaggagaacggcaaggtgtggagc

SEQ ID NO: 19084 - DNA, 25 bp, Mus musculus
ccaggagacccgagggaagacaaag

SEQ ID NO: 19085 - DNA, 25 bp, Mus musculus
ccaggagagtgttgccaagatgata

SEQ ID NO: 19086 - DNA, 25 bp, Mus musculus
ccaggagattccaagaaggaagcac

SEQ ID NO: 19087 - DNA, 25 bp, Mus musculus
ccaggagcaaccatgaaacttggag

SEQ ID NO: 19088 - DNA, 25 bp, Mus musculus
ccaggagcggttccagagcatgcat

SEQ ID NO: 19089 - DNA, 25 bp, Mus musculus
ccaggagcttggaatattatcttta

SEQ ID NO: 19090 - DNA, 25 bp, Mus musculus
ccaggaggaatcagatagtgacact

SEQ ID NO: 19091 - DNA, 25 bp, Mus musculus
ccaggaggacacatgaaagagatcc

SEQ ID NO: 19092 - DNA, 25 bp, Mus musculus
ccaggaggacacttgaaagagatcc

SEQ ID NO: 19093 - DNA, 25 bp, Mus musculus
ccaggaggaccaagccgctgggcat

SEQ ID NO: 19094 - DNA, 25 bp, Mus musculus
ccaggaggcactgcccagctgtgat

SEQ ID NO: 19095 - DNA, 25 bp, Mus musculus
ccaggaggcttataaacaacaggct

SEQ ID NO: 19096 - DNA, 25 bp, Mus musculus
ccaggagggattagacccaggctct

SEQ ID NO: 19097 - DNA, 25 bp, Mus musculus
ccaggagggcaagcataaaagaatg

SEQ ID NO: 19098 - DNA, 25 bp, Mus musculus
ccaggagggctgtttccagtaagca

SEQ ID NO: 19099 - DNA, 25 bp, Mus musculus
ccaggaggtgatgaactccaagctg

SEQ ID NO: 19100 - DNA, 25 bp, Mus musculus
ccaggaggtgtagaggagtaattaa

SEQ ID NO: 19101 - DNA, 25 bp, Mus musculus
ccaggaggttttactatgacagata

SEQ ID NO: 19102 - DNA, 25 bp, Mus musculus
ccaggagtacaatgtgctgctagac

SEQ ID NO: 19103 - DNA, 25 bp, Mus musculus
ccaggagtcttatggaggtgctgct

SEQ ID NO: 19104 - DNA, 25 bp, Mus musculus
ccaggatataaatgagctttcttct

SEQ ID NO: 19105 - DNA, 25 bp, Mus musculus
ccaggatccagtccggctgtcgcgt

SEQ ID NO: 19106 - DNA, 25 bp, Mus musculus
ccaggatcctatgctgcagtgaggg

SEQ ID NO: 19107 - DNA, 25 bp, Mus musculus
ccaggatcctcttgatcaagctgac

SEQ ID NO: 19108 - DNA, 25 bp, Mus musculus
ccaggatcctgggaatgtgattgct

SEQ ID NO: 19109 - DNA, 25 bp, Mus musculus
ccaggatcgaaagcaagacagtcat

SEQ ID NO: 19110 - DNA, 25 bp, Mus musculus
ccaggatctgctggagaagggcctt

SEQ ID NO: 19111 - DNA, 25 bp, Mus musculus
ccaggatgatggaacattgctatat

SEQ ID NO: 19112 - DNA, 25 bp, Mus musculus
ccaggatggattttatggtgcagac

SEQ ID NO: 19113 - DNA, 25 bp, Mus musculus
ccaggatggcctcatgcttagtatg

SEQ ID NO: 19114 - DNA, 25 bp, Mus musculus
ccaggattcagaaggaggacttttg

SEQ ID NO: 19115 - DNA, 25 bp, Mus musculus
ccaggattcggcaaggaggctctgt

SEQ ID NO: 19116 - DNA, 25 bp, Mus musculus
ccaggattgttgacaagtgtaacca

SEQ ID NO: 19117 - DNA, 25 bp, Mus musculus
ccaggatttgggacaggacgctgat

SEQ ID NO: 19118 - DNA, 25 bp, Mus musculus
ccaggcacagaatagatcctgatgc

SEQ ID NO: 19119 - DNA, 25 bp, Mus musculus
ccaggcaggtggctagcatgaccaa

SEQ ID NO: 19120 - DNA, 25 bp, Mus musculus
ccaggcaggttgtatccctgaaaac

SEQ ID NO: 19121 - DNA, 25 bp, Mus musculus
ccaggccagcctgtttctaaaaaca

SEQ ID NO: 19122 - DNA, 25 bp, Mus musculus
ccaggccagctgtggtagctccgca

SEQ ID NO: 19123 - DNA, 25 bp, Mus musculus
ccaggccatccagcagatgactggg

SEQ ID NO: 19124 - DNA, 25 bp, Mus musculus
ccaggccccagatcttggagccaag

SEQ ID NO: 19125 - DNA, 25 bp, Mus musculus
ccaggccgtgcaggctgtccgtgat

SEQ ID NO: 19126 - DNA, 25 bp, Mus musculus
ccaggcctgatgatgggcagaacga

SEQ ID NO: 19127 - DNA, 25 bp, Mus musculus
ccaggcgctaaagcttcggtgtcag

SEQ ID NO: 19128 - DNA, 25 bp, Mus musculus
ccaggctaggactctcctttagaaa

SEQ ID NO: 19129 - DNA, 25 bp, Mus musculus
ccaggctcacggctgatgacttcag

SEQ ID NO: 19130 - DNA, 25 bp, Mus musculus
ccaggctcagaagacaggaaagggt

SEQ ID NO: 19131 - DNA, 25 bp, Mus musculus
ccaggctctgtgtgtgcggctgcca

SEQ ID NO: 19132 - DNA, 25 bp, Mus musculus
ccaggctgccaagaaaaagaccaca

SEQ ID NO: 19133 - DNA, 25 bp, Mus musculus
ccaggctggacactctgtgcccaga

SEQ ID NO: 19134 - DNA, 25 bp, Mus musculus
ccaggctggtgcaggcgacttttag

SEQ ID NO: 19135 - DNA, 25 bp, Mus musculus
ccaggctgtcattgaatggtctgta

SEQ ID NO: 19136 - DNA, 25 bp, Mus musculus
ccaggcttcctggagagtctacacg

SEQ ID NO: 19137 - DNA, 25 bp, Mus musculus
ccaggcttgcggaagctaacaagga

SEQ ID NO: 19138 - DNA, 25 bp, Mus musculus
ccaggcttggcacgtatggcagcaa

SEQ ID NO: 19139 - DNA, 25 bp, Mus musculus
ccaggcttgggaagtcgtggccaac

SEQ ID NO: 19140 - DNA, 25 bp, Mus musculus
ccaggcttgggatgtcgtggccaac

SEQ ID NO: 19141 - DNA, 25 bp, Mus musculus
ccagggaaaggtgtcttaaggcatc

SEQ ID NO: 19142 - DNA, 25 bp, Mus musculus
ccagggaactaaaagaggtgaagca

SEQ ID NO: 19143 - DNA, 25 bp, Mus musculus
ccagggaataacaaggagacagtgc

SEQ ID NO: 19144 - DNA, 25 bp, Mus musculus
ccagggaatactggagggaccgcct

SEQ ID NO: 19145 - DNA, 25 bp, Mus musculus
ccagggaattaaagaagaacaagaa

SEQ ID NO: 19146 - DNA, 25 bp, Mus musculus
ccagggaattaatgaagaacaagaa

SEQ ID NO: 19147 - DNA, 25 bp, Mus musculus
ccagggagaacgtatgcagattctc

SEQ ID NO: 19148 - DNA, 25 bp, Mus musculus
ccagggaggtcgagctgttctcccg

SEQ ID NO: 19149 - DNA, 25 bp, Mus musculus
ccagggaggtcgtgctgttctcccg

SEQ ID NO: 19150 - DNA, 25 bp, Mus musculus
ccagggagtagctacagaggacaga

SEQ ID NO: 19151 - DNA, 25 bp, Mus musculus
ccagggcaacaggtgtagcagatga

SEQ ID NO: 19152 - DNA, 25 bp, Mus musculus
ccagggcacgacatgagagaaggca

SEQ ID NO: 19153 - DNA, 25 bp, Mus musculus
ccagggcagaaattgagcaggcagc

SEQ ID NO: 19154 - DNA, 25 bp, Mus musculus
ccagggcaggagattacagttattc

SEQ ID NO: 19155 - DNA, 25 bp, Mus musculus
ccagggcagtcagggacgtgcctac

SEQ ID NO: 19156 - DNA, 25 bp, Mus musculus
ccagggccctacatctgtagtgaga

SEQ ID NO: 19157 - DNA, 25 bp, Mus musculus
ccagggcctccagcagatgatggac

SEQ ID NO: 19158 - DNA, 25 bp, Mus musculus
ccagggcctccatctggactggagc

SEQ ID NO: 19159 - DNA, 25 bp, Mus musculus
ccagggccttcagcttgtatgccaa

SEQ ID NO: 19160 - DNA, 25 bp, Mus musculus
ccagggcttcatgaaggaccaccat

SEQ ID NO: 19161 - DNA, 25 bp, Mus musculus
ccagggtcaacaagcagctgcatct

SEQ ID NO: 19162 - DNA, 25 bp, Mus musculus
ccagggtcaagtgggtccgtgccca

SEQ ID NO: 19163 - DNA, 25 bp, Mus musculus
ccagggtcatgttcccaggcaatta

SEQ ID NO: 19164 - DNA, 25 bp, Mus musculus
ccagggtctcacaggagattgtact

SEQ ID NO: 19165 - DNA, 25 bp, Mus musculus
ccagggtcttcagtgggtgcccaag

SEQ ID NO: 19166 - DNA, 25 bp, Mus musculus
ccagggtgaagcaggcgttatcgtt

SEQ ID NO: 19167 - DNA, 25 bp, Mus musculus
ccagggtgctacagcaagcacatcg

SEQ ID NO: 19168 - DNA, 25 bp, Mus musculus
ccagggttgtcttcatctacttcaa

SEQ ID NO: 19169 - DNA, 25 bp, Mus musculus
ccaggtaacttcatgtgcagcaacg

SEQ ID NO: 19170 - DNA, 25 bp, Mus musculus
ccaggtattgaaccatggcttaatc

SEQ ID NO: 19171 - DNA, 25 bp, Mus musculus
ccaggtcacccagcaagtcagttgt

SEQ ID NO: 19172 - DNA, 25 bp, Mus musculus
ccaggtcataggtttcatcagccag

SEQ ID NO: 19173 - DNA, 25 bp, Mus musculus
ccaggtcatgacttttaaggaggca

SEQ ID NO: 19174 - DNA, 25 bp, Mus musculus
ccaggtccggtactctgacttatga

SEQ ID NO: 19175 - DNA, 25 bp, Mus musculus
ccaggtctgggtcggaaactcaagt

SEQ ID NO: 19176 - DNA, 25 bp, Mus musculus
ccaggtcttcctgaaggcggcagat

SEQ ID NO: 19177 - DNA, 25 bp, Mus musculus
ccaggtctttatgtatggacacaaa

SEQ ID NO: 19178 - DNA, 25 bp, Mus musculus
ccaggtgaagctgacagtgtggtac

SEQ ID NO: 19179 - DNA, 25 bp, Mus musculus
ccaggtgacatagttttggccaaag

SEQ ID NO: 19180 - DNA, 25 bp, Mus musculus
ccaggtgcatccaatttttcaactt

SEQ ID NO: 19181 - DNA, 25 bp, Mus musculus
ccaggtgcgagtgcaaaggttctga

SEQ ID NO: 19182 - DNA, 25 bp, Mus musculus
ccaggtgctgatgagagcgcagctt

SEQ ID NO: 19183 - DNA, 25 bp, Mus musculus
ccaggtggacccagaaatggccgcc

SEQ ID NO: 19184 - DNA, 25 bp, Mus musculus
ccaggtggcagaaaaggtggcctcc

SEQ ID NO: 19185 - DNA, 25 bp, Mus musculus
ccaggtggttgcagctcttcagtgt

SEQ ID NO: 19186 - DNA, 25 bp, Mus musculus
ccaggtgtcagtacgaggccctggt

SEQ ID NO: 19187 - DNA, 25 bp, Mus musculus
ccaggttcgaaactgtcctcatttc

SEQ ID NO: 19188 - DNA, 25 bp, Mus musculus
ccaggttctgcgagatgtgctgtga

SEQ ID NO: 19189 - DNA, 25 bp, Mus musculus
ccaggttgtcagctctctggtacca

SEQ ID NO: 19190 - DNA, 25 bp, Mus musculus
ccaggttgtcaggtctctggtacca

SEQ ID NO: 19191 - DNA, 25 bp, Mus musculus
ccaggtttattgctgctggaagact

SEQ ID NO: 19192 - DNA, 25 bp, Mus musculus
ccaggtttgacaggcacaagccaga

SEQ ID NO: 19193 - DNA, 25 bp, Mus musculus
ccaggttttgatggagctagcttca

SEQ ID NO: 19194 - DNA, 25 bp, Mus musculus
ccagtaagcacccaatgagatggag

SEQ ID NO: 19195 - DNA, 25 bp, Mus musculus
ccagtaagtgctcccggaagccaga

SEQ ID NO: 19196 - DNA, 25 bp, Mus musculus
ccagtaatgttaaagtagagactca

SEQ ID NO: 19197 - DNA, 25 bp, Mus musculus
ccagtacctcggatcatgcggaaca

SEQ ID NO: 19198 - DNA, 25 bp, Mus musculus
ccagtagagctggattaaaacacag

SEQ ID NO: 19199 - DNA, 25 bp, Mus musculus
ccagtagtgtttactgctggcttaa

SEQ ID NO: 19200 - DNA, 25 bp, Mus musculus
ccagtatacattggagccttcagaa

SEQ ID NO: 19201 - DNA, 25 bp, Mus musculus
ccagtatgggatggccagctcctac

SEQ ID NO: 19202 - DNA, 25 bp, Mus musculus
ccagtatgggcacaaaaagaaggct

SEQ ID NO: 19203 - DNA, 25 bp, Mus musculus
ccagtatgtccccagaattgtgttt

SEQ ID NO: 19204 - DNA, 25 bp, Mus musculus
ccagtatgtggagtcatggagaaca

SEQ ID NO: 19205 - DNA, 25 bp, Mus musculus
ccagtattatcagaggcccattggg

SEQ ID NO: 19206 - DNA, 25 bp, Mus musculus
ccagtcaacaaagaataccgcaagg

SEQ ID NO: 19207 - DNA, 25 bp, Mus musculus
ccagtcagacttcagggcctttgct

SEQ ID NO: 19208 - DNA, 25 bp, Mus musculus
ccagtcaggaggctctgcctgtaaa

SEQ ID NO: 19209 - DNA, 25 bp, Mus musculus
ccagtcatggataatcaattatgca

SEQ ID NO: 19210 - DNA, 25 bp, Mus musculus
ccagtccaggagagtgttgccaaga

SEQ ID NO: 19211 - DNA, 25 bp, Mus musculus
ccagtcccaaaggaggctattagag

SEQ ID NO: 19212 - DNA, 25 bp, Mus musculus
ccagtcccttgagagaggtgttaat

SEQ ID NO: 19213 - DNA, 25 bp, Mus musculus
ccagtcgagatgaggtctgggaaaa

SEQ ID NO: 19214 - DNA, 25 bp, Mus musculus
ccagtcgtgtggtgtctttgtcaga

SEQ ID NO: 19215 - DNA, 25 bp, Mus musculus
ccagtctcacatgggacgcctggag

SEQ ID NO: 19216 - DNA, 25 bp, Mus musculus
ccagtctcacctgcttcagtgaagg

SEQ ID NO: 19217 - DNA, 25 bp, Mus musculus
ccagtctggtgctggaggattttga

SEQ ID NO: 19218 - DNA, 25 bp, Mus musculus
ccagtcttctgaggctgcatgtcta

SEQ ID NO: 19219 - DNA, 25 bp, Mus musculus
ccagtcttgcatgttcttggtgaag

SEQ ID NO: 19220 - DNA, 25 bp, Mus musculus
ccagtcttggcatcttcgaagtaag

SEQ ID NO: 19221 - DNA, 25 bp, Mus musculus
ccagtgaagaggtcattattcgaga

SEQ ID NO: 19222 - DNA, 25 bp, Mus musculus
ccagtgaccagttcctcttcttaat

SEQ ID NO: 19223 - DNA, 25 bp, Mus musculus
ccagtgacctgaggactatagagca

SEQ ID NO: 19224 - DNA, 25 bp, Mus musculus
ccagtgagaagtcaggtcctgccta

SEQ ID NO: 19225 - DNA, 25 bp, Mus musculus
ccagtgagaagtgaggtcctgccta

SEQ ID NO: 19226 - DNA, 25 bp, Mus musculus
ccagtgagctcaaggaggctatgga

SEQ ID NO: 19227 - DNA, 25 bp, Mus musculus
ccagtgagctgcctgcgtcccaaag

SEQ ID NO: 19228 - DNA, 25 bp, Mus musculus
ccagtgagggcgctgatcagaaaat

SEQ ID NO: 19229 - DNA, 25 bp, Mus musculus
ccagtgatggagcacgcgctgctca

SEQ ID NO: 19230 - DNA, 25 bp, Mus musculus
ccagtgcaagtaggatgtttagcaa

SEQ ID NO: 19231 - DNA, 25 bp, Mus musculus
ccagtgcagctgtgtcttccagatg

SEQ ID NO: 19232 - DNA, 25 bp, Mus musculus
ccagtgccaggaggttttactatga

SEQ ID NO: 19233 - DNA, 25 bp, Mus musculus
ccagtgcctatcacactttagtagg

SEQ ID NO: 19234 - DNA, 25 bp, Mus musculus
ccagtgcctggctccaagatccaga

SEQ ID NO: 19235 - DNA, 25 bp, Mus musculus
ccagtgctgcttggaaaatgggaaa

SEQ ID NO: 19236 - DNA, 25 bp, Mus musculus
ccagtgcttgctcgcgctaccattt

SEQ ID NO: 19237 - DNA, 25 bp, Mus musculus
ccagtggaggtgctgttccaacccc

SEQ ID NO: 19238 - DNA, 25 bp, Mus musculus
ccagtggcccagctgagtcactcag

SEQ ID NO: 19239 - DNA, 25 bp, Mus musculus
ccagtggctgcggtgttgctaatgc

SEQ ID NO: 19240 - DNA, 25 bp, Mus musculus
ccagtggctggccagcagacatgaa

SEQ ID NO: 19241 - DNA, 25 bp, Mus musculus
ccagtggctgttggcttcaccctgg

SEQ ID NO: 19242 - DNA, 25 bp, Mus musculus
ccagtgggcagagggctatctatca

SEQ ID NO: 19243 - DNA, 25 bp, Mus musculus
ccagtgtaacaaaatcagccttgaa

SEQ ID NO: 19244 - DNA, 25 bp, Mus musculus
ccagtgtaagaaataaacctgacag

SEQ ID NO: 19245 - DNA, 25 bp, Mus musculus
ccagtgtatggcaataaattgctac

SEQ ID NO: 19246 - DNA, 25 bp, Mus musculus
ccagtgtattctaaaaagggactgg

SEQ ID NO: 19247 - DNA, 25 bp, Mus musculus
ccagtgtcatcgcagagaagagccg

SEQ ID NO: 19248 - DNA, 25 bp, Mus musculus
ccagtgtccaggtttctgcccattg

SEQ ID NO: 19249 - DNA, 25 bp, Mus musculus
ccagtgtgcagaagttcttgaatca

SEQ ID NO: 19250 - DNA, 25 bp, Mus musculus
ccagtgtgggcaacctcgggatgcc

SEQ ID NO: 19251 - DNA, 25 bp, Mus musculus
ccagtgtgtccaggaatgcatgaca

SEQ ID NO: 19252 - DNA, 25 bp, Mus musculus
ccagtgtgtgaacctcaagctcctg

SEQ ID NO: 19253 - DNA, 25 bp, Mus musculus
ccagtgtgtgatcaatgctatgttt

SEQ ID NO: 19254 - DNA, 25 bp, Mus musculus
ccagtgtgtggcgatcactgaagag

SEQ ID NO: 19255 - DNA, 25 bp, Mus musculus
ccagtgttcggttccaagtggagaa

SEQ ID NO: 19256 - DNA, 25 bp, Mus musculus
ccagttactaagagaggaatacttt

SEQ ID NO: 19257 - DNA, 25 bp, Mus musculus
ccagttcaagcgttgggaagtggca

SEQ ID NO: 19258 - DNA, 25 bp, Mus musculus
ccagttcaggaccatcgaagatgac

SEQ ID NO: 19259 - DNA, 25 bp, Mus musculus
ccagttcagtaaagagaatggcttc

SEQ ID NO: 19260 - DNA, 25 bp, Mus musculus
ccagttccacagatccgaccagtta

SEQ ID NO: 19261 - DNA, 25 bp, Mus musculus
ccagttcggaaaacagtagtcacca

SEQ ID NO: 19262 - DNA, 25 bp, Mus musculus
ccagttctcaggattcagaccaaag

SEQ ID NO: 19263 - DNA, 25 bp, Mus musculus
ccagttctgactccgactatgagca

SEQ ID NO: 19264 - DNA, 25 bp, Mus musculus
ccagttctgcgctgtcaggaggagc

SEQ ID NO: 19265 - DNA, 25 bp, Mus musculus
ccagttgaaatgtgccctgagagaa

SEQ ID NO: 19266 - DNA, 25 bp, Mus musculus
ccagttgcagaagcggccaatggcc

SEQ ID NO: 19267 - DNA, 25 bp, Mus musculus
ccagttggaggatagtagttgtgac

SEQ ID NO: 19268 - DNA, 25 bp, Mus musculus
ccagttgtacttcacgcagccttca

SEQ ID NO: 19269 - DNA, 25 bp, Mus musculus
ccagtttagggcagatgaaagtttt

SEQ ID NO: 19270 - DNA, 25 bp, Mus musculus
ccagtttcccttgtgggaatccttg

SEQ ID NO: 19271 - DNA, 25 bp, Mus musculus
ccagtttctcagtctaccacttctg

SEQ ID NO: 19272 - DNA, 25 bp, Mus musculus
ccagtttctttgattccgatgagga

SEQ ID NO: 19273 - DNA, 25 bp, Mus musculus
ccagtttgaagaagatttttgaaca

SEQ ID NO: 19274 - DNA, 25 bp, Mus musculus
ccagttttaagctcccagaaaagtg

SEQ ID NO: 19275 - DNA, 25 bp, Mus musculus
ccagttttatcagtgtgagagtcag

SEQ ID NO: 19276 - DNA, 25 bp, Mus musculus
ccataaacagcaaggaggcggaaga

SEQ ID NO: 19277 - DNA, 25 bp, Mus musculus
ccataacccagtggacgggattaag

SEQ ID NO: 19278 - DNA, 25 bp, Mus musculus
ccataacggtggatgagtatagctc

SEQ ID NO: 19279 - DNA, 25 bp, Mus musculus
ccataagagtcagaagcgcgggtgc

SEQ ID NO: 19280 - DNA, 25 bp, Mus musculus
ccataagatcaagctggaggtgcca

SEQ ID NO: 19281 - DNA, 25 bp, Mus musculus
ccataatgcccgtgtgcgactttgg

SEQ ID NO: 19282 - DNA, 25 bp, Mus musculus
ccataattcctaaaatgaacactgg

SEQ ID NO: 19283 - DNA, 25 bp, Mus musculus
ccataattcctataatgaacactgg

SEQ ID NO: 19284 - DNA, 25 bp, Mus musculus
ccatagaagcctggcacgcagaggc

SEQ ID NO: 19285 - DNA, 25 bp, Mus musculus
ccatagacgtgctccacgggctcat

SEQ ID NO: 19286 - DNA, 25 bp, Mus musculus
ccatagagtagttaatgttgtgcca

SEQ ID NO: 19287 - DNA, 25 bp, Mus musculus
ccatagcaagaatgtgtgcccttaa

SEQ ID NO: 19288 - DNA, 25 bp, Mus musculus
ccatagcaagatttggttagtctgg

SEQ ID NO: 19289 - DNA, 25 bp, Mus musculus
ccataggagtggaatttggctcaaa

SEQ ID NO: 19290 - DNA, 25 bp, Mus musculus
ccataggagtggtatttggctcaaa

SEQ ID NO: 19291 - DNA, 25 bp, Mus musculus
ccataggtcaaagtttgaagtctcc

SEQ ID NO: 19292 - DNA, 25 bp, Mus musculus
ccatagtgatgcttcctggtacttg

SEQ ID NO: 19293 - DNA, 25 bp, Mus musculus
ccatagtgccttgcgatggcgggta

SEQ ID NO: 19294 - DNA, 25 bp, Mus musculus
ccatagttttctgacctggagtaaa

SEQ ID NO: 19295 - DNA, 25 bp, Mus musculus
ccatatatgtccaggctgacttgga

SEQ ID NO: 19296 - DNA, 25 bp, Mus musculus
ccatatcgtggaggacgatctctac

SEQ ID NO: 19297 - DNA, 25 bp, Mus musculus
ccatatctcggaacttgcgccggca

SEQ ID NO: 19298 - DNA, 25 bp, Mus musculus
ccatatgaacatccaaaagacttga

SEQ ID NO: 19299 - DNA, 25 bp, Mus musculus
ccatatgccaatgcagggacctgga

SEQ ID NO: 19300 - DNA, 25 bp, Mus musculus
ccatatgttgtttgattgcgttgta

SEQ ID NO: 19301 - DNA, 25 bp, Mus musculus
ccatattactagagttgtaactgaa

SEQ ID NO: 19302 - DNA, 25 bp, Mus musculus
ccatattgtctgtacgcctggagca

SEQ ID NO: 19303 - DNA, 25 bp, Mus musculus
ccatcaaacctgacgcccagagttt

SEQ ID NO: 19304 - DNA, 25 bp, Mus musculus
ccatcaaagtgctaagaaaaaacaa

SEQ ID NO: 19305 - DNA, 25 bp, Mus musculus
ccatcaactgtgtgcggtccctcag

SEQ ID NO: 19306 - DNA, 25 bp, Mus musculus
ccatcaagcagtgggaggagtcctg

SEQ ID NO: 19307 - DNA, 25 bp, Mus musculus
ccatcacaccagtgttctatcctgt

SEQ ID NO: 19308 - DNA, 25 bp, Mus musculus
ccatcacagcagaagttttcaagaa

SEQ ID NO: 19309 - DNA, 25 bp, Mus musculus
ccatcacagtgaagtttgcagccaa

SEQ ID NO: 19310 - DNA, 25 bp, Mus musculus
ccatcacctgtcattctcagataag

SEQ ID NO: 19311 - DNA, 25 bp, Mus musculus
ccatcacggagcaccgggagctgat

SEQ ID NO: 19312 - DNA, 25 bp, Mus musculus
ccatcacgggtggattcaggcaacc

SEQ ID NO: 19313 - DNA, 25 bp, Mus musculus
ccatcactgccctttgggagaagga

SEQ ID NO: 19314 - DNA, 25 bp, Mus musculus
ccatcagaacttcatgaggtatcgt

SEQ ID NO: 19315 - DNA, 25 bp, Mus musculus
ccatcagagttcagaggtcagctac

SEQ ID NO: 19316 - DNA, 25 bp, Mus musculus
ccatcagatatggtatttcttagaa

SEQ ID NO: 19317 - DNA, 25 bp, Mus musculus
ccatcagcagcctgcgtgagatcac

SEQ ID NO: 19318 - DNA, 25 bp, Mus musculus
ccatcagccccagcaagaggaaatt

SEQ ID NO: 19319 - DNA, 25 bp, Mus musculus
ccatcagggctcagaaacagggtga

SEQ ID NO: 19320 - DNA, 25 bp, Mus musculus
ccatcagtaatggaatcctacgcct

SEQ ID NO: 19321 - DNA, 25 bp, Mus musculus
ccatcagtgaagaccatgagctcca

SEQ ID NO: 19322 - DNA, 25 bp, Mus musculus
ccatcataaggagaagattctggga

SEQ ID NO: 19323 - DNA, 25 bp, Mus musculus
ccatcatagggtgggctagttatgc

SEQ ID NO: 19324 - DNA, 25 bp, Mus musculus
ccatcatcaatgctctcaaagccaa

SEQ ID NO: 19325 - DNA, 25 bp, Mus musculus
ccatcatcggctccgggatcttcat

SEQ ID NO: 19326 - DNA, 25 bp, Mus musculus
ccatcatctagagatggatggaagg

SEQ ID NO: 19327 - DNA, 25 bp, Mus musculus
ccatcatgattgtgaggagggccat

SEQ ID NO: 19328 - DNA, 25 bp, Mus musculus
ccatcatgccttgtagcctggacaa

SEQ ID NO: 19329 - DNA, 25 bp, Mus musculus
ccatcatggatcattagtctaaaga

SEQ ID NO: 19330 - DNA, 25 bp, Mus musculus
ccatcatggatctttagtctaaaga

SEQ ID NO: 19331 - DNA, 25 bp, Mus musculus
ccatcatggcagtggagtttgacgg

SEQ ID NO: 19332 - DNA, 25 bp, Mus musculus
ccatcatgggcaactataaccacag

SEQ ID NO: 19333 - DNA, 25 bp, Mus musculus
ccatcatgggtgtggtttccctgct

SEQ ID NO: 19334 - DNA, 25 bp, Mus musculus
ccatcatgttaaggatacctataaa

SEQ ID NO: 19335 - DNA, 25 bp, Mus musculus
ccatcattgaagtggatcaggacaa

SEQ ID NO: 19336 - DNA, 25 bp, Mus musculus
ccatccaatagctttgctcgaggag

SEQ ID NO: 19337 - DNA, 25 bp, Mus musculus
ccatccacaaatgcagagctgaggg

SEQ ID NO: 19338 - DNA, 25 bp, Mus musculus
ccatccacgtgctccaggagtctgg

SEQ ID NO: 19339 - DNA, 25 bp, Mus musculus
ccatccagatccctaggcagctggg

SEQ ID NO: 19340 - DNA, 25 bp, Mus musculus
ccatccaggagaatggaggagtgca

SEQ ID NO: 19341 - DNA, 25 bp, Mus musculus
ccatcccctggctggaggaccgggt

SEQ ID NO: 19342 - DNA, 25 bp, Mus musculus
ccatccgagtatggctgaaaagaga

SEQ ID NO: 19343 - DNA, 25 bp, Mus musculus
ccatccgattttcaagaagatagcg

SEQ ID NO: 19344 - DNA, 25 bp, Mus musculus
ccatccggataggtagcactgggct

SEQ ID NO: 19345 - DNA, 25 bp, Mus musculus
ccatcctccctttgttggtgggaag

SEQ ID NO: 19346 - DNA, 25 bp, Mus musculus
ccatcctgcgtgagaaagtttgtca

SEQ ID NO: 19347 - DNA, 25 bp, Mus musculus
ccatcctgcgtgtgaaagtttgtca

SEQ ID NO: 19348 - DNA, 25 bp, Mus musculus
ccatcctggaagatcagagattata

SEQ ID NO: 19349 - DNA, 25 bp, Mus musculus
ccatcctggtgaacaatgccgctgt

SEQ ID NO: 19350 - DNA, 25 bp, Mus musculus
ccatcctgttggagctgattgacaa

SEQ ID NO: 19351 - DNA, 25 bp, Mus musculus
ccatcgactggtcactcaagtataa

SEQ ID NO: 19352 - DNA, 25 bp, Mus musculus
ccatcgactttccagaagaaaagca

SEQ ID NO: 19353 - DNA, 25 bp, Mus musculus
ccatcgagagggtgccccatcttgg

SEQ ID NO: 19354 - DNA, 25 bp, Mus musculus
ccatcgaggtgcagcagatgaaggc

SEQ ID NO: 19355 - DNA, 25 bp, Mus musculus
ccatcgattgtgaaaggcagcgtga

SEQ ID NO: 19356 - DNA, 25 bp, Mus musculus
ccatcgattgtgtaaggcagcgtga

SEQ ID NO: 19357 - DNA, 25 bp, Mus musculus
ccatcgctcagaaaaaagtgagcta

SEQ ID NO: 19358 - DNA, 25 bp, Mus musculus
ccatcggctggagaagatcctgaag

SEQ ID NO: 19359 - DNA, 25 bp, Mus musculus
ccatcggcttggagcgctatgagga

SEQ ID NO: 19360 - DNA, 25 bp, Mus musculus
ccatcggtcagaggctacgcaaggg

SEQ ID NO: 19361 - DNA, 25 bp, Mus musculus
ccatcgtgacggagagccggtccct

SEQ ID NO: 19362 - DNA, 25 bp, Mus musculus
ccatcgtggatgtccccgttggcga

SEQ ID NO: 19363 - DNA, 25 bp, Mus musculus
ccatcgtgggactcagcagccttgg

SEQ ID NO: 19364 - DNA, 25 bp, Mus musculus
ccatctaggattccagagagaaaat

SEQ ID NO: 19365 - DNA, 25 bp, Mus musculus
ccatctatgtgtttggtggagacaa

SEQ ID NO: 19366 - DNA, 25 bp, Mus musculus
ccatctcagtggactgggaggagaa

SEQ ID NO: 19367 - DNA, 25 bp, Mus musculus
ccatctctgaccacaggagtggagg

SEQ ID NO: 19368 - DNA, 25 bp, Mus musculus
ccatctctggactataagtactaca

SEQ ID NO: 19369 - DNA, 25 bp, Mus musculus
ccatctgccactagaaaaaggccaa

SEQ ID NO: 19370 - DNA, 25 bp, Mus musculus
ccatctgcgaccaccggagggaaga

SEQ ID NO: 19371 - DNA, 25 bp, Mus musculus
ccatctgggagataaaattgttacc

SEQ ID NO: 19372 - DNA, 25 bp, Mus musculus
ccatctgttacacacactgcaggct

SEQ ID NO: 19373 - DNA, 25 bp, Mus musculus
ccatctgttacagacactgcaggct

SEQ ID NO: 19374 - DNA, 25 bp, Mus musculus
ccatctgtttcttcgggatcatctt

SEQ ID NO: 19375 - DNA, 25 bp, Mus musculus
ccatcttggacaactatgtgctgct

SEQ ID NO: 19376 - DNA, 25 bp, Mus musculus
ccatcttgggttggctgtctctgcc

SEQ ID NO: 19377 - DNA, 25 bp, Mus musculus
ccatctttccaccatagaaaaggac

SEQ ID NO: 19378 - DNA, 25 bp, Mus musculus
ccatctttgcttgggaaatccgaga

SEQ ID NO: 19379 - DNA, 25 bp, Mus musculus
ccatctttggaaatgcggttagtcg

SEQ ID NO: 19380 - DNA, 25 bp, Mus musculus
ccatctttggaagaagaaccttcag

SEQ ID NO: 19381 - DNA, 25 bp, Mus musculus
ccatctttgtggatgaggcccagga

SEQ ID NO: 19382 - DNA, 25 bp, Mus musculus
ccatcttttgccagaagagcaggtc

SEQ ID NO: 19383 - DNA, 25 bp, Mus musculus
ccatgaaacagaggacatgataaac

SEQ ID NO: 19384 - DNA, 25 bp, Mus musculus
ccatgaacacatagaaatccttaca

SEQ ID NO: 19385 - DNA, 25 bp, Mus musculus
ccatgaagtacagttggccatattg

SEQ ID NO: 19386 - DNA, 25 bp, Mus musculus
ccatgaatcagagactactgtctga

SEQ ID NO: 19387 - DNA, 25 bp, Mus musculus
ccatgaatgaggtatctgtcatcaa

SEQ ID NO: 19388 - DNA, 25 bp, Mus musculus
ccatgaatggcagtctattagaagg

SEQ ID NO: 19389 - DNA, 25 bp, Mus musculus
ccatgaccatacaggtaggcctttc

SEQ ID NO: 19390 - DNA, 25 bp, Mus musculus
ccatgacccaagatgactacaaacc

SEQ ID NO: 19391 - DNA, 25 bp, Mus musculus
ccatgacgtgaaggtattggcctcg

SEQ ID NO: 19392 - DNA, 25 bp, Mus musculus
ccatgagaacgtggtggtagtaacc

SEQ ID NO: 19393 - DNA, 25 bp, Mus musculus
ccatgagaatggaactgaggactca

SEQ ID NO: 19394 - DNA, 25 bp, Mus musculus
ccatgagaggtactactagatcttc

SEQ ID NO: 19395 - DNA, 25 bp, Mus musculus
ccatgagaggtagtactagatcttc

SEQ ID NO: 19396 - DNA, 25 bp, Mus musculus
ccatgagctgctggcttacctgtat

SEQ ID NO: 19397 - DNA, 25 bp, Mus musculus
ccatgagcttctgggaattttccct

SEQ ID NO: 19398 - DNA, 25 bp, Mus musculus
ccatgagcttgcagtgatccttggg

SEQ ID NO: 19399 - DNA, 25 bp, Mus musculus
ccatgagtgcaccaccctggagaag

SEQ ID NO: 19400 - DNA, 25 bp, Mus musculus
ccatgatggcccaatggagccagtt

SEQ ID NO: 19401 - DNA, 25 bp, Mus musculus
ccatgatgtcatccgtgccactaaa

SEQ ID NO: 19402 - DNA, 25 bp, Mus musculus
ccatgattgagaaggtgaccaggaa

SEQ ID NO: 19403 - DNA, 25 bp, Mus musculus
ccatgcacaagggagagcgggcttt

SEQ ID NO: 19404 - DNA, 25 bp, Mus musculus
ccatgcacacaaggtggccaagttc

SEQ ID NO: 19405 - DNA, 25 bp, Mus musculus
ccatgcactgctcaagatgatctac

SEQ ID NO: 19406 - DNA, 25 bp, Mus musculus
ccatgcactgctgaagatgatctac

SEQ ID NO: 19407 - DNA, 25 bp, Mus musculus
ccatgcagatgcaaaagtccaggtg

SEQ ID NO: 19408 - DNA, 25 bp, Mus musculus
ccatgcaggagctaattggcttcta

SEQ ID NO: 19409 - DNA, 25 bp, Mus musculus
ccatgcatatcttaaggaatggttg

SEQ ID NO: 19410 - DNA, 25 bp, Mus musculus
ccatgccagcgatgagggctccaga

SEQ ID NO: 19411 - DNA, 25 bp, Mus musculus
ccatgcccggcagtactgtacattt

SEQ ID NO: 19412 - DNA, 25 bp, Mus musculus
ccatgcctacccaacagaacttgtg

SEQ ID NO: 19413 - DNA, 25 bp, Mus musculus
ccatgcctaggtgcagggcagtctg

SEQ ID NO: 19414 - DNA, 25 bp, Mus musculus
ccatgcctcagttgactccacagat

SEQ ID NO: 19415 - DNA, 25 bp, Mus musculus
ccatgccttcctttgttcatgaaga

SEQ ID NO: 19416 - DNA, 25 bp, Mus musculus
ccatgccttttcaggagcgcagaag

SEQ ID NO: 19417 - DNA, 25 bp, Mus musculus
ccatgcgggctgtcttcacgcggct

SEQ ID NO: 19418 - DNA, 25 bp, Mus musculus
ccatgcgtctgagaattcctttgtt

SEQ ID NO: 19419 - DNA, 25 bp, Mus musculus
ccatgcgtgtctctgaatgtgaaag

SEQ ID NO: 19420 - DNA, 25 bp, Mus musculus
ccatgcgttacaaggccctggatcc

SEQ ID NO: 19421 - DNA, 25 bp, Mus musculus
ccatgctgcagacggccaaattctc

SEQ ID NO: 19422 - DNA, 25 bp, Mus musculus
ccatgctgcagctgaagggtcgagt

SEQ ID NO: 19423 - DNA, 25 bp, Mus musculus
ccatgctggatgagagcagcctcta

SEQ ID NO: 19424 - DNA, 25 bp, Mus musculus
ccatgctgttggctgtgaatgcaca

SEQ ID NO: 19425 - DNA, 25 bp, Mus musculus
ccatggaattattgcacaaagaaag

SEQ ID NO: 19426 - DNA, 25 bp, Mus musculus
ccatggaatttcatgaacacttgca

SEQ ID NO: 19427 - DNA, 25 bp, Mus musculus
ccatggacaagtatattctgctgcc

SEQ ID NO: 19428 - DNA, 25 bp, Mus musculus
ccatggacacacaacgctgcaaaat

SEQ ID NO: 19429 - DNA, 25 bp, Mus musculus
ccatggactcgccaggaatcacagt

SEQ ID NO: 19430 - DNA, 25 bp, Mus musculus
ccatggagaggttcggttcttacaa

SEQ ID NO: 19431 - DNA, 25 bp, Mus musculus
ccatggaggactttgatgatgaggc

SEQ ID NO: 19432 - DNA, 25 bp, Mus musculus
ccatggaggcactggccttagctga

SEQ ID NO: 19433 - DNA, 25 bp, Mus musculus
ccatggatcggatgaagaagatcaa

SEQ ID NO: 19434 - DNA, 25 bp, Mus musculus
ccatggcacagatatgaggaagatg

SEQ ID NO: 19435 - DNA, 25 bp, Mus musculus
ccatggcagagtggcagttttcagc

SEQ ID NO: 19436 - DNA, 25 bp, Mus musculus
ccatggcattggctatgaccttgag

SEQ ID NO: 19437 - DNA, 25 bp, Mus musculus
ccatggccagcccaagaaccaggaa

SEQ ID NO: 19438 - DNA, 25 bp, Mus musculus
ccatggcctatcacgtaattgaccg

SEQ ID NO: 19439 - DNA, 25 bp, Mus musculus
ccatggcctgtagaagaaatcctca

SEQ ID NO: 19440 - DNA, 25 bp, Mus musculus
ccatggctccatgggaggttacaac

SEQ ID NO: 19441 - DNA, 25 bp, Mus musculus
ccatggctctgctgcagagagctct

SEQ ID NO: 19442 - DNA, 25 bp, Mus musculus
ccatggctgagcaagagcgcttcct

SEQ ID NO: 19443 - DNA, 25 bp, Mus musculus
ccatggcttggatagaaaaggcaga

SEQ ID NO: 19444 - DNA, 25 bp, Mus musculus
ccatgggaaacaaggtgatgattta

SEQ ID NO: 19445 - DNA, 25 bp, Mus musculus
ccatgggaagtgttactgtggaaac

SEQ ID NO: 19446 - DNA, 25 bp, Mus musculus
ccatgggacatctttaaaatgcaga

SEQ ID NO: 19447 - DNA, 25 bp, Mus musculus
ccatgggcagtgagcctccccactt

SEQ ID NO: 19448 - DNA, 25 bp, Mus musculus
ccatgggccagtcccagcggtaact

SEQ ID NO: 19449 - DNA, 25 bp, Mus musculus
ccatgggtaagagatctgacctatc

SEQ ID NO: 19450 - DNA, 25 bp, Mus musculus
ccatgggtgccagaaaaggatcgga

SEQ ID NO: 19451 - DNA, 25 bp, Mus musculus
ccatggtagctgtccccctgtatga

SEQ ID NO: 19452 - DNA, 25 bp, Mus musculus
ccatggtcactagggctggtttgcc

SEQ ID NO: 19453 - DNA, 25 bp, Mus musculus
ccatggtcagctgtttgaaggctac

SEQ ID NO: 19454 - DNA, 25 bp, Mus musculus
ccatggtctgggtcctggacttgga

SEQ ID NO: 19455 - DNA, 25 bp, Mus musculus
ccatggtgacctgctggaatgcgca

SEQ ID NO: 19456 - DNA, 25 bp, Mus musculus
ccatggtggctgatattcaccgcac

SEQ ID NO: 19457 - DNA, 25 bp, Mus musculus
ccatggtgtggttgccggttctgca

SEQ ID NO: 19458 - DNA, 25 bp, Mus musculus
ccatggttttgaacagaagcgtagc

SEQ ID NO: 19459 - DNA, 25 bp, Mus musculus
ccatgtaatgctggaaaacttcgca

SEQ ID NO: 19460 - DNA, 25 bp, Mus musculus
ccatgtactcggtggagatcacggt

SEQ ID NO: 19461 - DNA, 25 bp, Mus musculus
ccatgtagagaagcaactctcatcc

SEQ ID NO: 19462 - DNA, 25 bp, Mus musculus
ccatgtattctcatactagactccc

SEQ ID NO: 19463 - DNA, 25 bp, Mus musculus
ccatgtcacagaccccagagtggtt

SEQ ID NO: 19464 - DNA, 25 bp, Mus musculus
ccatgtcagtggcaacagaacggtt

SEQ ID NO: 19465 - DNA, 25 bp, Mus musculus
ccatgtcatgattgacgtgcccaac

SEQ ID NO: 19466 - DNA, 25 bp, Mus musculus
ccatgtccagtcatccacagagcaa

SEQ ID NO: 19467 - DNA, 25 bp, Mus musculus
ccatgtccatgatcctttttgccag

SEQ ID NO: 19468 - DNA, 25 bp, Mus musculus
ccatgtcttaaatgataacaccgca

SEQ ID NO: 19469 - DNA, 25 bp, Mus musculus
ccatgtcttccattgatctagtcag

SEQ ID NO: 19470 - DNA, 25 bp, Mus musculus
ccatgtggttcctgaggactgaacc

SEQ ID NO: 19471 - DNA, 25 bp, Mus musculus
ccatgtgttggaggcactgtcccca

SEQ ID NO: 19472 - DNA, 25 bp, Mus musculus
ccatgtgtttgttggtgacctcagt

SEQ ID NO: 19473 - DNA, 25 bp, Mus musculus
ccatgttaaagcaccagtctcacag

SEQ ID NO: 19474 - DNA, 25 bp, Mus musculus
ccatgttagatgctgctctggtgca

SEQ ID NO: 19475 - DNA, 25 bp, Mus musculus
ccatgttgtggtttttatgctggga

SEQ ID NO: 19476 - DNA, 25 bp, Mus musculus
ccatgtttaacatttgcaaagagtg

SEQ ID NO: 19477 - DNA, 25 bp, Mus musculus
ccatgtttatccctaccttgctgaa

SEQ ID NO: 19478 - DNA, 25 bp, Mus musculus
ccatgtttcctgaaagactgggaac

SEQ ID NO: 19479 - DNA, 25 bp, Mus musculus
ccatgtttgaagaaaattatcctga

SEQ ID NO: 19480 - DNA, 25 bp, Mus musculus
ccatgttttcactggaagagttaca

SEQ ID NO: 19481 - DNA, 25 bp, Mus musculus
ccattaaaggccagcatgcttagca

SEQ ID NO: 19482 - DNA, 25 bp, Mus musculus
ccattaagggagtatactcatcctg

SEQ ID NO: 19483 - DNA, 25 bp, Mus musculus
ccattaatgaagcaatcgacgcgga

SEQ ID NO: 19484 - DNA, 25 bp, Mus musculus
ccattacagatgtcaccaggactca

SEQ ID NO: 19485 - DNA, 25 bp, Mus musculus
ccattactatccagtgccattgcca

SEQ ID NO: 19486 - DNA, 25 bp, Mus musculus
ccattactatcctgtgccattgcca

SEQ ID NO: 19487 - DNA, 25 bp, Mus musculus
ccattagacgcagcagtgagaagct

SEQ ID NO: 19488 - DNA, 25 bp, Mus musculus
ccattagaggacacactggttaaaa

SEQ ID NO: 19489 - DNA, 25 bp, Mus musculus
ccattataaaaatccctggagaaat

SEQ ID NO: 19490 - DNA, 25 bp, Mus musculus
ccattatcgatgtcattaacatgga

SEQ ID NO: 19491 - DNA, 25 bp, Mus musculus
ccattatctggcagaggttcagaag

SEQ ID NO: 19492 - DNA, 25 bp, Mus musculus
ccattatggactttcagacttctga

SEQ ID NO: 19493 - DNA, 25 bp, Mus musculus
ccattatgtggagaatggagactct

SEQ ID NO: 19494 - DNA, 25 bp, Mus musculus
ccattatgtttgtctgcctgtgctc

SEQ ID NO: 19495 - DNA, 25 bp, Mus musculus
ccattcaagctctaggacaggcgat

SEQ ID NO: 19496 - DNA, 25 bp, Mus musculus
ccattcattgacagccagcatgtca

SEQ ID NO: 19497 - DNA, 25 bp, Mus musculus
ccattcattgcagagagaatcttct

SEQ ID NO: 19498 - DNA, 25 bp, Mus musculus
ccattccaaggacttatcccaaagc

SEQ ID NO: 19499 - DNA, 25 bp, Mus musculus
ccattccataagtatgcctgccatg

SEQ ID NO: 19500 - DNA, 25 bp, Mus musculus
ccattcccactcctgaggtttggct

SEQ ID NO: 19501 - DNA, 25 bp, Mus musculus
ccattcccgttttaagaacagacat

SEQ ID NO: 19502 - DNA, 25 bp, Mus musculus
ccattccctgggagttacagcagcc

SEQ ID NO: 19503 - DNA, 25 bp, Mus musculus
ccattcctgccttttacaacaaaag

SEQ ID NO: 19504 - DNA, 25 bp, Mus musculus
ccattcctgtgggactttcatacag

SEQ ID NO: 19505 - DNA, 25 bp, Mus musculus
ccattcgggagtacctggatcagta

SEQ ID NO: 19506 - DNA, 25 bp, Mus musculus
ccattcgggagttcctggatcagta

SEQ ID NO: 19507 - DNA, 25 bp, Mus musculus
ccattctaaaggtgccaggaacaac

SEQ ID NO: 19508 - DNA, 25 bp, Mus musculus
ccattctcaagactcaaaagagtac

SEQ ID NO: 19509 - DNA, 25 bp, Mus musculus
ccattctgaggactacatcgacttc

SEQ ID NO: 19510 - DNA, 25 bp, Mus musculus
ccattcttctgcagcgtgacaaccg

SEQ ID NO: 19511 - DNA, 25 bp, Mus musculus
ccattcttctgctgcgtgacaaccg

SEQ ID NO: 19512 - DNA, 25 bp, Mus musculus
ccattcttgaagtggttgatagtca

SEQ ID NO: 19513 - DNA, 25 bp, Mus musculus
ccattgaaggagagccggagtccag

SEQ ID NO: 19514 - DNA, 25 bp, Mus musculus
ccattgagccttctgaggagccctt

SEQ ID NO: 19515 - DNA, 25 bp, Mus musculus
ccattgatcgatgattactctggaa

SEQ ID NO: 19516 - DNA, 25 bp, Mus musculus
ccattgatctagtcagtgcctctga

SEQ ID NO: 19517 - DNA, 25 bp, Mus musculus
ccattgatgaatcggaaaatgccga

SEQ ID NO: 19518 - DNA, 25 bp, Mus musculus
ccattgcagaccttttgggtggtcc

SEQ ID NO: 19519 - DNA, 25 bp, Mus musculus
ccattgcagtagagggacctggctg

SEQ ID NO: 19520 - DNA, 25 bp, Mus musculus
ccattgccaaagaggcctgctcttg

SEQ ID NO: 19521 - DNA, 25 bp, Mus musculus
ccattgcgccatttcactgcatgaa

SEQ ID NO: 19522 - DNA, 25 bp, Mus musculus
ccattgctagaaactcgggctgaag

SEQ ID NO: 19523 - DNA, 25 bp, Mus musculus
ccattggaaactgaacctgtgtgtg

SEQ ID NO: 19524 - DNA, 25 bp, Mus musculus
ccattggacaaagggccctgacatt

SEQ ID NO: 19525 - DNA, 25 bp, Mus musculus
ccattggccagcatgaggtggtgaa

SEQ ID NO: 19526 - DNA, 25 bp, Mus musculus
ccattggctctctgatggacgacta

SEQ ID NO: 19527 - DNA, 25 bp, Mus musculus
ccattgggaaagtcctgcttgctgt

SEQ ID NO: 19528 - DNA, 25 bp, Mus musculus
ccattggtccatgcgtgtctctgaa

SEQ ID NO: 19529 - DNA, 25 bp, Mus musculus
ccattggtgtcagcaaccagaggga

SEQ ID NO: 19530 - DNA, 25 bp, Mus musculus
ccattgtaccctgtgtgctggaagc

SEQ ID NO: 19531 - DNA, 25 bp, Mus musculus
ccattgtagccaagatggaagaccc

SEQ ID NO: 19532 - DNA, 25 bp, Mus musculus
ccattgtggagcatgattctggaat

SEQ ID NO: 19533 - DNA, 25 bp, Mus musculus
ccattgtgggaatgatagtagctga

SEQ ID NO: 19534 - DNA, 25 bp, Mus musculus
ccattgtgtgtgctgtgatagccca

SEQ ID NO: 19535 - DNA, 25 bp, Mus musculus
ccattgttgacaatctactctgcaa

SEQ ID NO: 19536 - DNA, 25 bp, Mus musculus
ccattgtttattgggtcacatacca

SEQ ID NO: 19537 - DNA, 25 bp, Mus musculus
ccattgtttgccagactggtgtgcc

SEQ ID NO: 19538 - DNA, 25 bp, Mus musculus
ccattgttttgaagaacacctggcc

SEQ ID NO: 19539 - DNA, 25 bp, Mus musculus
ccatttaaaacctggaggcactggg

SEQ ID NO: 19540 - DNA, 25 bp, Mus musculus
ccatttaactgggattcagaatttg

SEQ ID NO: 19541 - DNA, 25 bp, Mus musculus
ccatttagtttgatgctggttgctg

SEQ ID NO: 19542 - DNA, 25 bp, Mus musculus
ccatttagtttgttgctggttgctg

SEQ ID NO: 19543 - DNA, 25 bp, Mus musculus
ccatttatgcagaagcttggctttg

SEQ ID NO: 19544 - DNA, 25 bp, Mus musculus
ccatttcaaacccagtaacaggagc

SEQ ID NO: 19545 - DNA, 25 bp, Mus musculus
ccatttctgaaatcaagaccctttt

SEQ ID NO: 19546 - DNA, 25 bp, Mus musculus
ccatttgatagcctagaagaaagca

SEQ ID NO: 19547 - DNA, 25 bp, Mus musculus
ccatttgctcccaagacggactctg

SEQ ID NO: 19548 - DNA, 25 bp, Mus musculus
ccatttggagccatgaatattgtgc

SEQ ID NO: 19549 - DNA, 25 bp, Mus musculus
ccattttactggcactgatcagaga

SEQ ID NO: 19550 - DNA, 25 bp, Mus musculus
ccattttatatgcagtctgggctga

SEQ ID NO: 19551 - DNA, 25 bp, Mus musculus
ccattttgaccactgcttaagcttc

SEQ ID NO: 19552 - DNA, 25 bp, Mus musculus
ccattttgctgaccgtggaggtgac

SEQ ID NO: 19553 - DNA, 25 bp, Mus musculus
ccattttgtgggaagacgctgcctc

SEQ ID NO: 19554 - DNA, 25 bp, Mus musculus
ccatttttcaaagtcctggcgacga

SEQ ID NO: 19555 - DNA, 25 bp, Mus musculus
ccatttttcagatttagccttcaga

SEQ ID NO: 19556 - DNA, 25 bp, Mus musculus
ccatttttcctctctgcggtgtcca

SEQ ID NO: 19557 - DNA, 25 bp, Mus musculus
cccaaacaggagacattcacctttg

SEQ ID NO: 19558 - DNA, 25 bp, Mus musculus
cccaaaccaggtggcagaaaaggtg

SEQ ID NO: 19559 - DNA, 25 bp, Mus musculus
cccaaactgtgaagtggtagcagta

SEQ ID NO: 19560 - DNA, 25 bp, Mus musculus
cccaaactgtgatgtggtagcagta

SEQ ID NO: 19561 - DNA, 25 bp, Mus musculus
cccaaacttggtggtgtcggtgctg

SEQ ID NO: 19562 - DNA, 25 bp, Mus musculus
cccaaagagtggaaaggaggctgcc

SEQ ID NO: 19563 - DNA, 25 bp, Mus musculus
cccaaagatttacagttggaggaga

SEQ ID NO: 19564 - DNA, 25 bp, Mus musculus
cccaaagccagctggccttgcaggg

SEQ ID NO: 19565 - DNA, 25 bp, Mus musculus
cccaaaggagctatgctaacccatg

SEQ ID NO: 19566 - DNA, 25 bp, Mus musculus
cccaaaggtactgcggcattgctga

SEQ ID NO: 19567 - DNA, 25 bp, Mus musculus
cccaaatagacgagagccgagtgtc

SEQ ID NO: 19568 - DNA, 25 bp, Mus musculus
cccaaatccagagaggaactttgtc

SEQ ID NO: 19569 - DNA, 25 bp, Mus musculus
cccaaatgtcgtccatttggaaggg

SEQ ID NO: 19570 - DNA, 25 bp, Mus musculus
cccaaattggttagtgaagtcctag

SEQ ID NO: 19571 - DNA, 25 bp, Mus musculus
cccaacactgtgcttggaaagaatg

SEQ ID NO: 19572 - DNA, 25 bp, Mus musculus
cccaacagggcaactcctgacaagt

SEQ ID NO: 19573 - DNA, 25 bp, Mus musculus
cccaacagtactctgatcatcagca

SEQ ID NO: 19574 - DNA, 25 bp, Mus musculus
cccaacatagtagtttgaatgaaaa

SEQ ID NO: 19575 - DNA, 25 bp, Mus musculus
cccaacatttgacacacaaaggcag

SEQ ID NO: 19576 - DNA, 25 bp, Mus musculus
cccaactacttcatgtttctaaaga

SEQ ID NO: 19577 - DNA, 25 bp, Mus musculus
cccaactatgttgcagaatgtgata

SEQ ID NO: 19578 - DNA, 25 bp, Mus musculus
cccaactcagtatgaagagcgcatg

SEQ ID NO: 19579 - DNA, 25 bp, Mus musculus
cccaacttccttctaggagtggaat

SEQ ID NO: 19580 - DNA, 25 bp, Mus musculus
cccaagaatcatggactgttattat

SEQ ID NO: 19581 - DNA, 25 bp, Mus musculus
cccaagacagaattatggtacttca

SEQ ID NO: 19582 - DNA, 25 bp, Mus musculus
cccaagacgctgctggaaaacacag

SEQ ID NO: 19583 - DNA, 25 bp, Mus musculus
cccaagacttcctgcagaagaacaa

SEQ ID NO: 19584 - DNA, 25 bp, Mus musculus
cccaagagcagttgcctgagggaga

SEQ ID NO: 19585 - DNA, 25 bp, Mus musculus
cccaagagttcctgtttctcctgtg

SEQ ID NO: 19586 - DNA, 25 bp, Mus musculus
cccaagcaaatggattctcagttgt

SEQ ID NO: 19587 - DNA, 25 bp, Mus musculus
cccaagcaccgtatgcaatgatgag

SEQ ID NO: 19588 - DNA, 25 bp, Mus musculus
cccaagcaccgtttgcaatgatgag

SEQ ID NO: 19589 - DNA, 25 bp, Mus musculus
cccaagcagaggtactggctttgca

SEQ ID NO: 19590 - DNA, 25 bp, Mus musculus
cccaagcagtattgaagatatattt

SEQ ID NO: 19591 - DNA, 25 bp, Mus musculus
cccaagccaaggactctacgctttt

SEQ ID NO: 19592 - DNA, 25 bp, Mus musculus
cccaagccagtgattgctgccattc

SEQ ID NO: 19593 - DNA, 25 bp, Mus musculus
cccaagcctagaaaagtggagctgt

SEQ ID NO: 19594 - DNA, 25 bp, Mus musculus
cccaagcctctagcagatgatatca

SEQ ID NO: 19595 - DNA, 25 bp, Mus musculus
cccaagcctgagcttgcagtgagag

SEQ ID NO: 19596 - DNA, 25 bp, Mus musculus
cccaagcgcaagatgaggagacgtt

SEQ ID NO: 19597 - DNA, 25 bp, Mus musculus
cccaagctttgtgatggacggtggc

SEQ ID NO: 19598 - DNA, 25 bp, Mus musculus
cccaaggaccttgagaaagtagtct

SEQ ID NO: 19599 - DNA, 25 bp, Mus musculus
cccaaggaggacaaggaaaatcgca

SEQ ID NO: 19600 - DNA, 25 bp, Mus musculus
cccaaggcagaagacctatctgcat

SEQ ID NO: 19601 - DNA, 25 bp, Mus musculus
cccaaggcccacagctagagcgtgg

SEQ ID NO: 19602 - DNA, 25 bp, Mus musculus
cccaaggtgaattattgctttgagc

SEQ ID NO: 19603 - DNA, 25 bp, Mus musculus
cccaagtagcagtgactactcagcc

SEQ ID NO: 19604 - DNA, 25 bp, Mus musculus
cccaagtctgtgctggccaacacag

SEQ ID NO: 19605 - DNA, 25 bp, Mus musculus
cccaagtgggctttgcaggaggcca

SEQ ID NO: 19606 - DNA, 25 bp, Mus musculus
cccaagtgtcattctggctgaacag

SEQ ID NO: 19607 - DNA, 25 bp, Mus musculus
cccaagtgtgattggtgatcacggc

SEQ ID NO: 19608 - DNA, 25 bp, Mus musculus
cccaagttcctagattaaagtcatg

SEQ ID NO: 19609 - DNA, 25 bp, Mus musculus
cccaatccgaagtgcagccaatgtg

SEQ ID NO: 19610 - DNA, 25 bp, Mus musculus
cccaatcgggacctgactgtcctgg

SEQ ID NO: 19611 - DNA, 25 bp, Mus musculus
cccaatgatccacttgtgccgactg

SEQ ID NO: 19612 - DNA, 25 bp, Mus musculus
cccaatgatgggatgcccggaggcc

SEQ ID NO: 19613 - DNA, 25 bp, Mus musculus
cccaatgtgctgctcacaagttctg

SEQ ID NO: 19614 - DNA, 25 bp, Mus musculus
cccacaacagctcatctcgatttga

SEQ ID NO: 19615 - DNA, 25 bp, Mus musculus
cccacaaggagatacattcccagca

SEQ ID NO: 19616 - DNA, 25 bp, Mus musculus
cccacaagggaatgaggacatgtcc

SEQ ID NO: 19617 - DNA, 25 bp, Mus musculus
cccacactgtgccgccaaggagtag

SEQ ID NO: 19618 - DNA, 25 bp, Mus musculus
cccacactgtgcggccaaggagtag

SEQ ID NO: 19619 - DNA, 25 bp, Mus musculus
cccacagacgtaaaagtcaaagaag

SEQ ID NO: 19620 - DNA, 25 bp, Mus musculus
cccacagagaaaatcccaggctcat

SEQ ID NO: 19621 - DNA, 25 bp, Mus musculus
cccacagagagtcaagctggcatcc

SEQ ID NO: 19622 - DNA, 25 bp, Mus musculus
cccacagagattttgggccatcttc

SEQ ID NO: 19623 - DNA, 25 bp, Mus musculus
cccacagagcagttcaacgggcagg

SEQ ID NO: 19624 - DNA, 25 bp, Mus musculus
cccacagagttgaaaagagggtgtg

SEQ ID NO: 19625 - DNA, 25 bp, Mus musculus
cccacagccactggagaaaaagaag

SEQ ID NO: 19626 - DNA, 25 bp, Mus musculus
cccacagctagagcgtggcagagct

SEQ ID NO: 19627 - DNA, 25 bp, Mus musculus
cccacagcttggtaaaagttttgct

SEQ ID NO: 19628 - DNA, 25 bp, Mus musculus
cccacaggaaacttcgcagtgagcc

SEQ ID NO: 19629 - DNA, 25 bp, Mus musculus
cccacagggaagagagctgagtgct

SEQ ID NO: 19630 - DNA, 25 bp, Mus musculus
cccacagggaagtgagctgagtgct

SEQ ID NO: 19631 - DNA, 25 bp, Mus musculus
cccacagtcagattgctgtacttgt

SEQ ID NO: 19632 - DNA, 25 bp, Mus musculus
cccacatcatcgtggtcatcttggg

SEQ ID NO: 19633 - DNA, 25 bp, Mus musculus
cccacatcccttaagcagcagagga

SEQ ID NO: 19634 - DNA, 25 bp, Mus musculus
cccacatcccttcaggaatcattaa

SEQ ID NO: 19635 - DNA, 25 bp, Mus musculus
cccacattgatgtcattcattatcg

SEQ ID NO: 19636 - DNA, 25 bp, Mus musculus
cccacccttgagacgattcgctggt

SEQ ID NO: 19637 - DNA, 25 bp, Mus musculus
cccacctggaatggacatgataacg

SEQ ID NO: 19638 - DNA, 25 bp, Mus musculus
cccacctggtggcacaactctaaga

SEQ ID NO: 19639 - DNA, 25 bp, Mus musculus
cccaccttatagtgctgaggaaaca

SEQ ID NO: 19640 - DNA, 25 bp, Mus musculus
cccaccttgatgacaccttgatgat

SEQ ID NO: 19641 - DNA, 25 bp, Mus musculus
cccacgaactttgtatttaagaatg

SEQ ID NO: 19642 - DNA, 25 bp, Mus musculus
cccacgctgaacgaaagggacacgg

SEQ ID NO: 19643 - DNA, 25 bp, Mus musculus
cccacggagagtaactgtgaggtgc

SEQ ID NO: 19644 - DNA, 25 bp, Mus musculus
cccacggctgtgattcctaccgaag

SEQ ID NO: 19645 - DNA, 25 bp, Mus musculus
cccactaccattaacactggcagag

SEQ ID NO: 19646 - DNA, 25 bp, Mus musculus
cccactactgctccggaaattgcag

SEQ ID NO: 19647 - DNA, 25 bp, Mus musculus
cccactatacctgtctgggaaaaca

SEQ ID NO: 19648 - DNA, 25 bp, Mus musculus
cccactcaagaatagagcaatacgc

SEQ ID NO: 19649 - DNA, 25 bp, Mus musculus
cccactcatggccaagttggtggtc

SEQ ID NO: 19650 - DNA, 25 bp, Mus musculus
cccactccacactagagatggttgg

SEQ ID NO: 19651 - DNA, 25 bp, Mus musculus
cccactcggatgagaagagatacca

SEQ ID NO: 19652 - DNA, 25 bp, Mus musculus
cccactcggatgtgaagagatacca

SEQ ID NO: 19653 - DNA, 25 bp, Mus musculus
cccactgcggatcaaagctgcgaag

SEQ ID NO: 19654 - DNA, 25 bp, Mus musculus
cccactggatgtaattacctccttt

SEQ ID NO: 19655 - DNA, 25 bp, Mus musculus
cccactggatgttattacctccttt

SEQ ID NO: 19656 - DNA, 25 bp, Mus musculus
cccactgggaaccttcagttgaaga

SEQ ID NO: 19657 - DNA, 25 bp, Mus musculus
cccactgtcttagtgaggtggagca

SEQ ID NO: 19658 - DNA, 25 bp, Mus musculus
cccactgtgccgactgagctgatgg

SEQ ID NO: 19659 - DNA, 25 bp, Mus musculus
cccacttctgaagacttggcttggg

SEQ ID NO: 19660 - DNA, 25 bp, Mus musculus
cccacttgaagctaaaacctgagaa

SEQ ID NO: 19661 - DNA, 25 bp, Mus musculus
cccacttgagagtattgtattgtga

SEQ ID NO: 19662 - DNA, 25 bp, Mus musculus
cccacttgctgccaagggctataga

SEQ ID NO: 19663 - DNA, 25 bp, Mus musculus
cccactttgtggatgccgaacccag

SEQ ID NO: 19664 - DNA, 25 bp, Mus musculus
cccagaaatcaacgagaccacctta

SEQ ID NO: 19665 - DNA, 25 bp, Mus musculus
cccagaaattcacgtgagtacgcca

SEQ ID NO: 19666 - DNA, 25 bp, Mus musculus
cccagaaccaaatgtacaccctggt

SEQ ID NO: 19667 - DNA, 25 bp, Mus musculus
cccagaaccaagtgttgggaacaca

SEQ ID NO: 19668 - DNA, 25 bp, Mus musculus
cccagaagaatatgtgagcaggcca

SEQ ID NO: 19669 - DNA, 25 bp, Mus musculus
cccagaagagatagaacaggttatc

SEQ ID NO: 19670 - DNA, 25 bp, Mus musculus
cccagaagagtaatgacaagacagc

SEQ ID NO: 19671 - DNA, 25 bp, Mus musculus
cccagaagctggctgtgcgatttca

SEQ ID NO: 19672 - DNA, 25 bp, Mus musculus
cccagaaggtgtcgtctttgacttg

SEQ ID NO: 19673 - DNA, 25 bp, Mus musculus
cccagaaggtgttcgaggagatgaa

SEQ ID NO: 19674 - DNA, 25 bp, Mus musculus
cccagaatctagatgatggttcaca

SEQ ID NO: 19675 - DNA, 25 bp, Mus musculus
cccagaattgaagctagcttatgct

SEQ ID NO: 19676 - DNA, 25 bp, Mus musculus
cccagacaagtgctgttgccctgag

SEQ ID NO: 19677 - DNA, 25 bp, Mus musculus
cccagacaccatctatgaggactgt

SEQ ID NO: 19678 - DNA, 25 bp, Mus musculus
cccagacagacctttggagctacag

SEQ ID NO: 19679 - DNA, 25 bp, Mus musculus
cccagacattgatcctaatgccaag

SEQ ID NO: 19680 - DNA, 25 bp, Mus musculus
cccagaccgaatgccttcagaaaga

SEQ ID NO: 19681 - DNA, 25 bp, Mus musculus
cccagacctctgtgatgatgacgtg

SEQ ID NO: 19682 - DNA, 25 bp, Mus musculus
cccagacctgcaacaaagtgcgatg

SEQ ID NO: 19683 - DNA, 25 bp, Mus musculus
cccagacgagaagcagctaggcact

SEQ ID NO: 19684 - DNA, 25 bp, Mus musculus
cccagacgaggatttatccgaagca

SEQ ID NO: 19685 - DNA, 25 bp, Mus musculus
cccagacgtcctcgtgggagacact

SEQ ID NO: 19686 - DNA, 25 bp, Mus musculus
cccagactacagtaatactcaacaa

SEQ ID NO: 19687 - DNA, 25 bp, Mus musculus
cccagagaagaatcctgacgatttc

SEQ ID NO: 19688 - DNA, 25 bp, Mus musculus
cccagagagctgtgattggaggaag

SEQ ID NO: 19689 - DNA, 25 bp, Mus musculus
cccagagcaaggcttcagaagatat

SEQ ID NO: 19690 - DNA, 25 bp, Mus musculus
cccagagcagctgggcatgatcgag

SEQ ID NO: 19691 - DNA, 25 bp, Mus musculus
cccagagcagtggacagggccttga

SEQ ID NO: 19692 - DNA, 25 bp, Mus musculus
cccagagcataaatacggagaggca

SEQ ID NO: 19693 - DNA, 25 bp, Mus musculus
cccagagcccagaaattcacgtgag

SEQ ID NO: 19694 - DNA, 25 bp, Mus musculus
cccagagccccaaactgctgaaaag

SEQ ID NO: 19695 - DNA, 25 bp, Mus musculus
cccagagctggatcctgagcagaag

SEQ ID NO: 19696 - DNA, 25 bp, Mus musculus
cccagaggacatttaagctcgacta

SEQ ID NO: 19697 - DNA, 25 bp, Mus musculus
cccagaggatcgctgagagcaatca

SEQ ID NO: 19698 - DNA, 25 bp, Mus musculus
cccagagggaacacagatggctgta

SEQ ID NO: 19699 - DNA, 25 bp, Mus musculus
cccagagggaggacactgggatcca

SEQ ID NO: 19700 - DNA, 25 bp, Mus musculus
cccagagtccagtcgtggccagtgt

SEQ ID NO: 19701 - DNA, 25 bp, Mus musculus
cccagagtgaggctaagcaagacac

SEQ ID NO: 19702 - DNA, 25 bp, Mus musculus
cccagagtggatatggcgcaagaag

SEQ ID NO: 19703 - DNA, 25 bp, Mus musculus
cccagagtgggctctgctgtgggaa

SEQ ID NO: 19704 - DNA, 25 bp, Mus musculus
cccagatgcaagaacatatgaagat

SEQ ID NO: 19705 - DNA, 25 bp, Mus musculus
cccagatgccctcaaggtctcagtt

SEQ ID NO: 19706 - DNA, 25 bp, Mus musculus
cccagatgggtcgtcagcaatgagg

SEQ ID NO: 19707 - DNA, 25 bp, Mus musculus
cccagatgtctgtgagacaaattta

SEQ ID NO: 19708 - DNA, 25 bp, Mus musculus
cccagattgccatcgtgacggagag

SEQ ID NO: 19709 - DNA, 25 bp, Mus musculus
cccagattggcatctcggtggaatt

SEQ ID NO: 19710 - DNA, 25 bp, Mus musculus
cccagcaaagtgagatctagcctca

SEQ ID NO: 19711 - DNA, 25 bp, Mus musculus
cccagcaactagcagaagaagcaac

SEQ ID NO: 19712 - DNA, 25 bp, Mus musculus
cccagcaagttttccttaacacctg

SEQ ID NO: 19713 - DNA, 25 bp, Mus musculus
cccagcagaggagcacgcagctgaa

SEQ ID NO: 19714 - DNA, 25 bp, Mus musculus
cccagcagctggcaatcatccagat

SEQ ID NO: 19715 - DNA, 25 bp, Mus musculus
cccagcaggagcagttccataggca

SEQ ID NO: 19716 - DNA, 25 bp, Mus musculus
cccagcagggttctacgattacacc

SEQ ID NO: 19717 - DNA, 25 bp, Mus musculus
cccagcatgagtaccacagagacta

SEQ ID NO: 19718 - DNA, 25 bp, Mus musculus
cccagcattccagattacacaggag

SEQ ID NO: 19719 - DNA, 25 bp, Mus musculus
cccagccaagatgaggtgcagatca

SEQ ID NO: 19720 - DNA, 25 bp, Mus musculus
cccagccagcgtagacagttcagac

SEQ ID NO: 19721 - DNA, 25 bp, Mus musculus
cccagccagggcctggtttgtcagc

SEQ ID NO: 19722 - DNA, 25 bp, Mus musculus
cccagccagggcgtggtttgtcagc

SEQ ID NO: 19723 - DNA, 25 bp, Mus musculus
cccagccatttctgggtacagtggg

SEQ ID NO: 19724 - DNA, 25 bp, Mus musculus
cccagccccagaggagaatggcgag

SEQ ID NO: 19725 - DNA, 25 bp, Mus musculus
cccagccctgctttgcttgaggtga

SEQ ID NO: 19726 - DNA, 25 bp, Mus musculus
cccagccctgggtacagaagtgaca

SEQ ID NO: 19727 - DNA, 25 bp, Mus musculus
cccagccgggtgtactggatcgcca

SEQ ID NO: 19728 - DNA, 25 bp, Mus musculus
cccagcctgcaattctagctgcttg

SEQ ID NO: 19729 - DNA, 25 bp, Mus musculus
cccagcgaggacatctggaagaaat

SEQ ID NO: 19730 - DNA, 25 bp, Mus musculus
cccagcgagtgggacaagcgcttat

SEQ ID NO: 19731 - DNA, 25 bp, Mus musculus
cccagcggaacacactgtgggaact

SEQ ID NO: 19732 - DNA, 25 bp, Mus musculus
cccagcggtctctggttaaggcagt

SEQ ID NO: 19733 - DNA, 25 bp, Mus musculus
cccagctaatgcactccgagtcttg

SEQ ID NO: 19734 - DNA, 25 bp, Mus musculus
cccagctctctgtgcggtgtgatcg

SEQ ID NO: 19735 - DNA, 25 bp, Mus musculus
cccagctgaagcatgacaatctctc

SEQ ID NO: 19736 - DNA, 25 bp, Mus musculus
cccagctgctactctcagaggcagt

SEQ ID NO: 19737 - DNA, 25 bp, Mus musculus
cccagctggctactctgctggagag

SEQ ID NO: 19738 - DNA, 25 bp, Mus musculus
cccagcttcgggaagaccagcaagt

SEQ ID NO: 19739 - DNA, 25 bp, Mus musculus
cccaggaaaagtcgcaggtagctgt

SEQ ID NO: 19740 - DNA, 25 bp, Mus musculus
cccaggaaaagtggcaggtagctgt

SEQ ID NO: 19741 - DNA, 25 bp, Mus musculus
cccaggaagagggtacagacctgca

SEQ ID NO: 19742 - DNA, 25 bp, Mus musculus
cccaggaagatgtggacagctggaa

SEQ ID NO: 19743 - DNA, 25 bp, Mus musculus
cccaggaaggtcagggtcactggaa

SEQ ID NO: 19744 - DNA, 25 bp, Mus musculus
cccaggaagtctttaatgagctacc

SEQ ID NO: 19745 - DNA, 25 bp, Mus musculus
cccaggaatagaggcaaaaggagtt

SEQ ID NO: 19746 - DNA, 25 bp, Mus musculus
cccaggaatggagacaccgctggat

SEQ ID NO: 19747 - DNA, 25 bp, Mus musculus
cccaggaatggagctacctggtgac

SEQ ID NO: 19748 - DNA, 25 bp, Mus musculus
cccaggactggatttacagctagtt

SEQ ID NO: 19749 - DNA, 25 bp, Mus musculus
cccaggagctggaacgttgcttgac

SEQ ID NO: 19750 - DNA, 25 bp, Mus musculus
cccaggagcttggacttccagcgaa

SEQ ID NO: 19751 - DNA, 25 bp, Mus musculus
cccaggaggcctatgagatggctgt

SEQ ID NO: 19752 - DNA, 25 bp, Mus musculus
cccaggagttaaagtcactgtttga

SEQ ID NO: 19753 - DNA, 25 bp, Mus musculus
cccaggatcatttctggcaagagaa

SEQ ID NO: 19754 - DNA, 25 bp, Mus musculus
cccaggatctgctggagaagggcct

SEQ ID NO: 19755 - DNA, 25 bp, Mus musculus
cccaggatgggaacttcgatgaatt

SEQ ID NO: 19756 - DNA, 25 bp, Mus musculus
cccaggattgaaactgacagccaca

SEQ ID NO: 19757 - DNA, 25 bp, Mus musculus
cccaggattggaattacctgtgatg

SEQ ID NO: 19758 - DNA, 25 bp, Mus musculus
cccaggccccagtggctgcggtgtt

SEQ ID NO: 19759 - DNA, 25 bp, Mus musculus
cccaggctaatgaacagaggtatag

SEQ ID NO: 19760 - DNA, 25 bp, Mus musculus
cccaggctcggtaatcattgaaggc

SEQ ID NO: 19761 - DNA, 25 bp, Mus musculus
cccaggctctagctacagaggcttc

SEQ ID NO: 19762 - DNA, 25 bp, Mus musculus
cccagggaagtcctacggcattatg

SEQ ID NO: 19763 - DNA, 25 bp, Mus musculus
cccagggacatacctgtagacagcc

SEQ ID NO: 19764 - DNA, 25 bp, Mus musculus
cccagggagtagagacgaccgactg

SEQ ID NO: 19765 - DNA, 25 bp, Mus musculus
cccagggattgtggttgtaagcctt

SEQ ID NO: 19766 - DNA, 25 bp, Mus musculus
cccagggcacgctttccaaaatctt

SEQ ID NO: 19767 - DNA, 25 bp, Mus musculus
cccagggtctcctctgagaatcatc

SEQ ID NO: 19768 - DNA, 25 bp, Mus musculus
cccagggtgacattaagcagcaaaa

SEQ ID NO: 19769 - DNA, 25 bp, Mus musculus
cccaggtaattgagaaatttgaggc

SEQ ID NO: 19770 - DNA, 25 bp, Mus musculus
cccaggtacaaactgatggtcaaca

SEQ ID NO: 19771 - DNA, 25 bp, Mus musculus
cccaggtgaactgcttaaacaaagt

SEQ ID NO: 19772 - DNA, 25 bp, Mus musculus
cccaggtgaggattgataatgagcc

SEQ ID NO: 19773 - DNA, 25 bp, Mus musculus
cccaggtgagtgaggtggtccctct

SEQ ID NO: 19774 - DNA, 25 bp, Mus musculus
cccaggtggtggtgactctgtgcca

SEQ ID NO: 19775 - DNA, 25 bp, Mus musculus
cccaggttgaaagagtgtatggata

SEQ ID NO: 19776 - DNA, 25 bp, Mus musculus
cccaggttggggaagagaccttgct

SEQ ID NO: 19777 - DNA, 25 bp, Mus musculus
cccaggttggtcagggcattggaat

SEQ ID NO: 19778 - DNA, 25 bp, Mus musculus
cccagtacccctatggagagaagca

SEQ ID NO: 19779 - DNA, 25 bp, Mus musculus
cccagtacttgatgccccatgcttg

SEQ ID NO: 19780 - DNA, 25 bp, Mus musculus
cccagtagcactaatgtgtgagcaa

SEQ ID NO: 19781 - DNA, 25 bp, Mus musculus
cccagtcaagtaatgctgtagctga

SEQ ID NO: 19782 - DNA, 25 bp, Mus musculus
cccagtcaagtattgctgtagctga

SEQ ID NO: 19783 - DNA, 25 bp, Mus musculus
cccagtcatgactcagccagaggaa

SEQ ID NO: 19784 - DNA, 25 bp, Mus musculus
cccagtctgtgcgagaagtatttgc

SEQ ID NO: 19785 - DNA, 25 bp, Mus musculus
cccagtgaaaagacaactgtagcct

SEQ ID NO: 19786 - DNA, 25 bp, Mus musculus
cccagtgaaagcgtggaaagaagca

SEQ ID NO: 19787 - DNA, 25 bp, Mus musculus
cccagtgacaatggacctcttttca

SEQ ID NO: 19788 - DNA, 25 bp, Mus musculus
cccagtgaggacttggacttcttgg

SEQ ID NO: 19789 - DNA, 25 bp, Mus musculus
cccagtgagtacatggaggttcctc

SEQ ID NO: 19790 - DNA, 25 bp, Mus musculus
cccagtggaaagctaaccctgagac

SEQ ID NO: 19791 - DNA, 25 bp, Mus musculus
cccagtggataaggcccatcgcaat

SEQ ID NO: 19792 - DNA, 25 bp, Mus musculus
cccagtggcctaggactcattgtgt

SEQ ID NO: 19793 - DNA, 25 bp, Mus musculus
cccagtggcggagcaggtcaaactg

SEQ ID NO: 19794 - DNA, 25 bp, Mus musculus
cccagtggtcaacgttacatcccag

SEQ ID NO: 19795 - DNA, 25 bp, Mus musculus
cccagtggtcaaggttacatcccag

SEQ ID NO: 19796 - DNA, 25 bp, Mus musculus
cccagtgtatgagcctgtgaattac

SEQ ID NO: 19797 - DNA, 25 bp, Mus musculus
cccagtgtctactctggtggagttt

SEQ ID NO: 19798 - DNA, 25 bp, Mus musculus
cccagtgtgacattgaaggctaagt

SEQ ID NO: 19799 - DNA, 25 bp, Mus musculus
cccagtgttggaggttgaggaaaca

SEQ ID NO: 19800 - DNA, 25 bp, Mus musculus
cccagttccattgttgacaatctac

SEQ ID NO: 19801 - DNA, 25 bp, Mus musculus
cccataagaagagcaaaggacaact

SEQ ID NO: 19802 - DNA, 25 bp, Mus musculus
cccataatgcccgtgtgcgactttg

SEQ ID NO: 19803 - DNA, 25 bp, Mus musculus
cccatacctggatgttagataactg

SEQ ID NO: 19804 - DNA, 25 bp, Mus musculus
cccatagacagctgtgtgagttgct

SEQ ID NO: 19805 - DNA, 25 bp, Mus musculus
cccatagagaggattacaacagtac

SEQ ID NO: 19806 - DNA, 25 bp, Mus musculus
cccatatcaagcgtcatctgcaatg

SEQ ID NO: 19807 - DNA, 25 bp, Mus musculus
cccatatgaaggagaagcacccgga

SEQ ID NO: 19808 - DNA, 25 bp, Mus musculus
cccatatgcagcatcctgtgctggg

SEQ ID NO: 19809 - DNA, 25 bp, Mus musculus
cccatatgtggtttgtaatgcacca

SEQ ID NO: 19810 - DNA, 25 bp, Mus musculus
cccatcaacttgtagctgttctaga

SEQ ID NO: 19811 - DNA, 25 bp, Mus musculus
cccatcagcagcctgcgtgagatca

SEQ ID NO: 19812 - DNA, 25 bp, Mus musculus
cccatcatggcacctgcagaagcta

SEQ ID NO: 19813 - DNA, 25 bp, Mus musculus
cccatcgactttccagaagaaaagc

SEQ ID NO: 19814 - DNA, 25 bp, Mus musculus
cccatcgagggagctgggccctttg

SEQ ID NO: 19815 - DNA, 25 bp, Mus musculus
cccatctaggattccagagagaaaa

SEQ ID NO: 19816 - DNA, 25 bp, Mus musculus
cccatctcggtcactgtgggaggat

SEQ ID NO: 19817 - DNA, 25 bp, Mus musculus
cccatgaaaagccaaattagaaatc

SEQ ID NO: 19818 - DNA, 25 bp, Mus musculus
cccatgaattcacctttgattccag

SEQ ID NO: 19819 - DNA, 25 bp, Mus musculus
cccatgaccatacaggtaggccttt

SEQ ID NO: 19820 - DNA, 25 bp, Mus musculus
cccatgagactggtggattttccta

SEQ ID NO: 19821 - DNA, 25 bp, Mus musculus
cccatgagaggtactactagatctt

SEQ ID NO: 19822 - DNA, 25 bp, Mus musculus
cccatgagaggttctactagatctt

SEQ ID NO: 19823 - DNA, 25 bp, Mus musculus
cccatgaggccagataagggcatta

SEQ ID NO: 19824 - DNA, 25 bp, Mus musculus
cccatgaggctggaatcactgatat

SEQ ID NO: 19825 - DNA, 25 bp, Mus musculus
cccatgagggaagcccaggagacca

SEQ ID NO: 19826 - DNA, 25 bp, Mus musculus
cccatgagttgtgacaagtcaacac

SEQ ID NO: 19827 - DNA, 25 bp, Mus musculus
cccatgatatcagtgaagtgctctc

SEQ ID NO: 19828 - DNA, 25 bp, Mus musculus
cccatgatcgtgtgggccgcctcag

SEQ ID NO: 19829 - DNA, 25 bp, Mus musculus
cccatgattgatgagaataacgatg

SEQ ID NO: 19830 - DNA, 25 bp, Mus musculus
cccatgcagatgcaaaagtccaggt

SEQ ID NO: 19831 - DNA, 25 bp, Mus musculus
cccatgcctctgcaacgggtgcaga

SEQ ID NO: 19832 - DNA, 25 bp, Mus musculus
cccatgcctctggaacgggtgcaga

SEQ ID NO: 19833 - DNA, 25 bp, Mus musculus
cccatggaccagtttgctgtgcact

SEQ ID NO: 19834 - DNA, 25 bp, Mus musculus
cccatggaggctttgccaacttcga

SEQ ID NO: 19835 - DNA, 25 bp, Mus musculus
cccatggctgaacaagacaaacttt

SEQ ID NO: 19836 - DNA, 25 bp, Mus musculus
cccatggcttgtcgacctgtctgca

SEQ ID NO: 19837 - DNA, 25 bp, Mus musculus
cccatgggattgtagggtggcctca

SEQ ID NO: 19838 - DNA, 25 bp, Mus musculus
cccatggtaatatcggtttaagagc

SEQ ID NO: 19839 - DNA, 25 bp, Mus musculus
cccatggtaggcaggatgagtaccc

SEQ ID NO: 19840 - DNA, 25 bp, Mus musculus
cccatggtggcagctggattgatcc

SEQ ID NO: 19841 - DNA, 25 bp, Mus musculus
cccatgtaaagaacggtgaggtagg

SEQ ID NO: 19842 - DNA, 25 bp, Mus musculus
cccatgtcacagaccccagagtggt

SEQ ID NO: 19843 - DNA, 25 bp, Mus musculus
cccatgtgcatgcatgacaaccagg

SEQ ID NO: 19844 - DNA, 25 bp, Mus musculus
cccattaaagacagggcttatgaag

SEQ ID NO: 19845 - DNA, 25 bp, Mus musculus
cccattacgccattggagaggagtg

SEQ ID NO: 19846 - DNA, 25 bp, Mus musculus
cccattagaatatcagtttcaacag

SEQ ID NO: 19847 - DNA, 25 bp, Mus musculus
cccattagtgtgaggcagcgcttct

SEQ ID NO: 19848 - DNA, 25 bp, Mus musculus
cccattatttttgatggagcagcag

SEQ ID NO: 19849 - DNA, 25 bp, Mus musculus
cccattcgcctcataggcgagtttg

SEQ ID NO: 19850 - DNA, 25 bp, Mus musculus
cccattcgcctcttaggcgagtttg

SEQ ID NO: 19851 - DNA, 25 bp, Mus musculus
cccattgagcaacagggcaccggat

SEQ ID NO: 19852 - DNA, 25 bp, Mus musculus
cccattgaggtgaagacgaagaaag

SEQ ID NO: 19853 - DNA, 25 bp, Mus musculus
cccattgatcgatgattactctgga

SEQ ID NO: 19854 - DNA, 25 bp, Mus musculus
cccattgatgactgagtgtgcagca

SEQ ID NO: 19855 - DNA, 25 bp, Mus musculus
cccattggtcattgaaactgtcttc

SEQ ID NO: 19856 - DNA, 25 bp, Mus musculus
cccatttaagataggagacaaattc

SEQ ID NO: 19857 - DNA, 25 bp, Mus musculus
cccatttagaattacggcactacgg

SEQ ID NO: 19858 - DNA, 25 bp, Mus musculus
cccatttcaatacaagcaagtgagt

SEQ ID NO: 19859 - DNA, 25 bp, Mus musculus
cccatttccaaagtatctggacctg

SEQ ID NO: 19860 - DNA, 25 bp, Mus musculus
cccatttcctgcagacacatggata

SEQ ID NO: 19861 - DNA, 25 bp, Mus musculus
cccatttcctgctgacacatggata

SEQ ID NO: 19862 - DNA, 25 bp, Mus musculus
cccatttggcttataaagactcgct

SEQ ID NO: 19863 - DNA, 25 bp, Mus musculus
cccattttcaggtcgaaaccctctg

SEQ ID NO: 19864 - DNA, 25 bp, Mus musculus
cccattttcattgatgcagacttcc

SEQ ID NO: 19865 - DNA, 25 bp, Mus musculus
ccccaaaactaacgaagcagatgaa

SEQ ID NO: 19866 - DNA, 25 bp, Mus musculus
ccccaaagcatctgtgaagctcgtt

SEQ ID NO: 19867 - DNA, 25 bp, Mus musculus
ccccaaaggacatgacatttttacg

SEQ ID NO: 19868 - DNA, 25 bp, Mus musculus
ccccaaagtacagtggttgctactg

SEQ ID NO: 19869 - DNA, 25 bp, Mus musculus
ccccaaatacaggtgtacacataaa

SEQ ID NO: 19870 - DNA, 25 bp, Mus musculus
ccccaacagggaagaaatatgttag

SEQ ID NO: 19871 - DNA, 25 bp, Mus musculus
ccccaacatatgagctggcattaca

SEQ ID NO: 19872 - DNA, 25 bp, Mus musculus
ccccaacatgaaccgtgtgacagtg

SEQ ID NO: 19873 - DNA, 25 bp, Mus musculus
ccccaacgcaatgtgtgtttgtcaa

SEQ ID NO: 19874 - DNA, 25 bp, Mus musculus
ccccaacttgaaaaagactggatac

SEQ ID NO: 19875 - DNA, 25 bp, Mus musculus
ccccaacttgaataagactggatac

SEQ ID NO: 19876 - DNA, 25 bp, Mus musculus
ccccaacttgataaatgacacgatg

SEQ ID NO: 19877 - DNA, 25 bp, Mus musculus
ccccaagaagctccgtgtgaagaac

SEQ ID NO: 19878 - DNA, 25 bp, Mus musculus
ccccaagaagctgcgtgtgaagaac

SEQ ID NO: 19879 - DNA, 25 bp, Mus musculus
ccccaagcatctctgaaagaggaaa

SEQ ID NO: 19880 - DNA, 25 bp, Mus musculus
ccccaaggagaaaagtcacagctag

SEQ ID NO: 19881 - DNA, 25 bp, Mus musculus
ccccaaggagaatagtcacagctag

SEQ ID NO: 19882 - DNA, 25 bp, Mus musculus
ccccaaggataccatttccattgag

SEQ ID NO: 19883 - DNA, 25 bp, Mus musculus
ccccaaggccggagatttcgcttcg

SEQ ID NO: 19884 - DNA, 25 bp, Mus musculus
ccccaaggccggtgatttcgcttcg

SEQ ID NO: 19885 - DNA, 25 bp, Mus musculus
ccccaagttattttcgcaagatcca

SEQ ID NO: 19886 - DNA, 25 bp, Mus musculus
ccccaatatcctgaacttgagcggg

SEQ ID NO: 19887 - DNA, 25 bp, Mus musculus
ccccaatatctatgagctgaggaca

SEQ ID NO: 19888 - DNA, 25 bp, Mus musculus
ccccaatccatgttgctgtcttcat

SEQ ID NO: 19889 - DNA, 25 bp, Mus musculus
ccccaatgatgggatgcccggaggc

SEQ ID NO: 19890 - DNA, 25 bp, Mus musculus
ccccaatgattagagacccaagagc

SEQ ID NO: 19891 - DNA, 25 bp, Mus musculus
ccccaatgcccttcatggcagagac

SEQ ID NO: 19892 - DNA, 25 bp, Mus musculus
ccccaatggagtataagggtgaact

SEQ ID NO: 19893 - DNA, 25 bp, Mus musculus
ccccacagagcagcatgcaagaggt

SEQ ID NO: 19894 - DNA, 25 bp, Mus musculus
ccccacaggaaacttcgcagtgagc

SEQ ID NO: 19895 - DNA, 25 bp, Mus musculus
ccccacatcgacatgggcctggatg

SEQ ID NO: 19896 - DNA, 25 bp, Mus musculus
ccccaccaggaagcagaaggtagaa

SEQ ID NO: 19897 - DNA, 25 bp, Mus musculus
ccccacctgatgagccaagaagtgc

SEQ ID NO: 19898 - DNA, 25 bp, Mus musculus
ccccacctgtgctacgggttgatga

SEQ ID NO: 19899 - DNA, 25 bp, Mus musculus
ccccacggaggttgagccgggcaca

SEQ ID NO: 19900 - DNA, 25 bp, Mus musculus
ccccacgggttcatcttggtcattt

SEQ ID NO: 19901 - DNA, 25 bp, Mus musculus
ccccacggtctggaagaaggctgtg

SEQ ID NO: 19902 - DNA, 25 bp, Mus musculus
ccccactgtgcagcacaacacaatg

SEQ ID NO: 19903 - DNA, 25 bp, Mus musculus
ccccacttctacagtttcaggacaa

SEQ ID NO: 19904 - DNA, 25 bp, Mus musculus
ccccacttgggtggaagtcagcaca

SEQ ID NO: 19905 - DNA, 25 bp, Mus musculus
ccccagaagctggaggaacgactgg

SEQ ID NO: 19906 - DNA, 25 bp, Mus musculus
ccccagaaggaggtgtatttcatgg

SEQ ID NO: 19907 - DNA, 25 bp, Mus musculus
ccccagaaggtgtcgtctttgactt

SEQ ID NO: 19908 - DNA, 25 bp, Mus musculus
ccccagaagtggttagatcaaaatt

SEQ ID NO: 19909 - DNA, 25 bp, Mus musculus
ccccagaatggtgagaataaaccac

SEQ ID NO: 19910 - DNA, 25 bp, Mus musculus
ccccagacaccatctatgaggactg

SEQ ID NO: 19911 - DNA, 25 bp, Mus musculus
ccccagacagatgcacagtcaagat

SEQ ID NO: 19912 - DNA, 25 bp, Mus musculus
ccccagacgatgagagcaaagaagg

SEQ ID NO: 19913 - DNA, 25 bp, Mus musculus
ccccagaggagaatggcgaggaccc

SEQ ID NO: 19914 - DNA, 25 bp, Mus musculus
ccccagatgggtcgtcagcaatgag

SEQ ID NO: 19915 - DNA, 25 bp, Mus musculus
ccccagattacgagacggtcatgag

SEQ ID NO: 19916 - DNA, 25 bp, Mus musculus
ccccagcaaaaccaatgtgagtgga

SEQ ID NO: 19917 - DNA, 25 bp, Mus musculus
ccccagcagcaacaacgcatttttg

SEQ ID NO: 19918 - DNA, 25 bp, Mus musculus
ccccagcagtgatgttgaagatccc

SEQ ID NO: 19919 - DNA, 25 bp, Mus musculus
ccccagcatgagtaccacagagact

SEQ ID NO: 19920 - DNA, 25 bp, Mus musculus
ccccagcctgtcagccttaattggg

SEQ ID NO: 19921 - DNA, 25 bp, Mus musculus
ccccagctgagctggtccagtgttt

SEQ ID NO: 19922 - DNA, 25 bp, Mus musculus
ccccaggaaaccaggtcctggcagt

SEQ ID NO: 19923 - DNA, 25 bp, Mus musculus
ccccaggaagttctggacatgagga

SEQ ID NO: 19924 - DNA, 25 bp, Mus musculus
ccccaggaatctccgaagcatgaaa

SEQ ID NO: 19925 - DNA, 25 bp, Mus musculus
ccccaggatatggagatccacaagg

SEQ ID NO: 19926 - DNA, 25 bp, Mus musculus
ccccaggatccggttcttggtgata

SEQ ID NO: 19927 - DNA, 25 bp, Mus musculus
ccccaggattggaattacctgtgat

SEQ ID NO: 19928 - DNA, 25 bp, Mus musculus
ccccaggcttttctctttgatgtca

SEQ ID NO: 19929 - DNA, 25 bp, Mus musculus
ccccagggagtagagacgaccgact

SEQ ID NO: 19930 - DNA, 25 bp, Mus musculus
ccccagggctggactacactgttga

SEQ ID NO: 19931 - DNA, 25 bp, Mus musculus
ccccaggtgcatccaatttttcaac

SEQ ID NO: 19932 - DNA, 25 bp, Mus musculus
ccccaggtgtcctccagtgcagaag

SEQ ID NO: 19933 - DNA, 25 bp, Mus musculus
ccccaggttcgcctaatagtcttgg

SEQ ID NO: 19934 - DNA, 25 bp, Mus musculus
ccccagtcatcaaggatgtgatgga

SEQ ID NO: 19935 - DNA, 25 bp, Mus musculus
ccccagtcccaaaggaggctattag

SEQ ID NO: 19936 - DNA, 25 bp, Mus musculus
ccccagtgagtgagcatgttaccaa

SEQ ID NO: 19937 - DNA, 25 bp, Mus musculus
ccccatcatttaccggatgttgcta

SEQ ID NO: 19938 - DNA, 25 bp, Mus musculus
ccccatcctggagagggaaaatgaa

SEQ ID NO: 19939 - DNA, 25 bp, Mus musculus
ccccatctgtctgtatgagcaaggc

SEQ ID NO: 19940 - DNA, 25 bp, Mus musculus
ccccatggagcaactgtaaaacgaa

SEQ ID NO: 19941 - DNA, 25 bp, Mus musculus
ccccatggatctgtacttgagtgct

SEQ ID NO: 19942 - DNA, 25 bp, Mus musculus
ccccatggttgggaaggacattacg

SEQ ID NO: 19943 - DNA, 25 bp, Mus musculus
ccccattcattcagtggtggatctg

SEQ ID NO: 19944 - DNA, 25 bp, Mus musculus
ccccattggacaaagggccctgaca

SEQ ID NO: 19945 - DNA, 25 bp, Mus musculus
ccccgaaaatttgagactgctcctg

SEQ ID NO: 19946 - DNA, 25 bp, Mus musculus
ccccgaagatatgacagtgatgatg

SEQ ID NO: 19947 - DNA, 25 bp, Mus musculus
ccccgaaggagtcttcaccatagag

SEQ ID NO: 19948 - DNA, 25 bp, Mus musculus
ccccgactcgtaagagtgaatttgt

SEQ ID NO: 19949 - DNA, 25 bp, Mus musculus
ccccgagaggatcggctctggcatc

SEQ ID NO: 19950 - DNA, 25 bp, Mus musculus
ccccgagaggatgggctctggcatc

SEQ ID NO: 19951 - DNA, 25 bp, Mus musculus
ccccgagcgctggaggagtgttttt

SEQ ID NO: 19952 - DNA, 25 bp, Mus musculus
ccccgagcgggatgcactgcagaag

SEQ ID NO: 19953 - DNA, 25 bp, Mus musculus
ccccgagggtgtccaagagcttcct

SEQ ID NO: 19954 - DNA, 25 bp, Mus musculus
ccccgaggtacacttttgcaccaag

SEQ ID NO: 19955 - DNA, 25 bp, Mus musculus
ccccgagttgaatgtgagtagttct

SEQ ID NO: 19956 - DNA, 25 bp, Mus musculus
ccccgcacttggtagtaagccgtga

SEQ ID NO: 19957 - DNA, 25 bp, Mus musculus
ccccgcagagcctctttgtgtggaa

SEQ ID NO: 19958 - DNA, 25 bp, Mus musculus
ccccgcatggtggatatgagtgttc

SEQ ID NO: 19959 - DNA, 25 bp, Mus musculus
ccccggatcatcaagccacaaatgt

SEQ ID NO: 19960 - DNA, 25 bp, Mus musculus
ccccggcatcgactgtgagcggtat

SEQ ID NO: 19961 - DNA, 25 bp, Mus musculus
ccccgggaacacagcaagagtgcta

SEQ ID NO: 19962 - DNA, 25 bp, Mus musculus
ccccgggatgtgactgactgtctcc

SEQ ID NO: 19963 - DNA, 25 bp, Mus musculus
ccccgggctctgtgaggttattcga

SEQ ID NO: 19964 - DNA, 25 bp, Mus musculus
ccccggtgttttcatcctggatgct

SEQ ID NO: 19965 - DNA, 25 bp, Mus musculus
ccccgtcttgtaaaggtgacaggag

SEQ ID NO: 19966 - DNA, 25 bp, Mus musculus
ccccgtgcggcagaggcagctgttt

SEQ ID NO: 19967 - DNA, 25 bp, Mus musculus
ccccgtgcggtgaatctgaggagca

SEQ ID NO: 19968 - DNA, 25 bp, Mus musculus
ccccgtggcagagatggagaacctg

SEQ ID NO: 19969 - DNA, 25 bp, Mus musculus
cccctaaatttgcacatgaagcgat

SEQ ID NO: 19970 - DNA, 25 bp, Mus musculus
cccctaagggtgtgctcatgtacag

SEQ ID NO: 19971 - DNA, 25 bp, Mus musculus
cccctaatgtttggttctcttactg

SEQ ID NO: 19972 - DNA, 25 bp, Mus musculus
cccctacattagcagaccgtgaaca

SEQ ID NO: 19973 - DNA, 25 bp, Mus musculus
cccctactgggacaacattacagac

SEQ ID NO: 19974 - DNA, 25 bp, Mus musculus
cccctaggaagataataccagagaa

SEQ ID NO: 19975 - DNA, 25 bp, Mus musculus
cccctatattgaccccgattacgtg

SEQ ID NO: 19976 - DNA, 25 bp, Mus musculus
cccctatgagctgtggaacgagacc

SEQ ID NO: 19977 - DNA, 25 bp, Mus musculus
cccctattacgatgtgatgactacg

SEQ ID NO: 19978 - DNA, 25 bp, Mus musculus
cccctattactggagattcccaaga

SEQ ID NO: 19979 - DNA, 25 bp, Mus musculus
cccctattgagcatgctccagtgtg

SEQ ID NO: 19980 - DNA, 25 bp, Mus musculus
cccctattttccacggctgtgtgaa

SEQ ID NO: 19981 - DNA, 25 bp, Mus musculus
cccctcagaggatgatgacaaaaaa

SEQ ID NO: 19982 - DNA, 25 bp, Mus musculus
cccctctctgacacttgatttggat

SEQ ID NO: 19983 - DNA, 25 bp, Mus musculus
cccctctctgactgtacggaaacta

SEQ ID NO: 19984 - DNA, 25 bp, Mus musculus
cccctctggagaagataagtggcta

SEQ ID NO: 19985 - DNA, 25 bp, Mus musculus
cccctgaattttctggagcttgttg

SEQ ID NO: 19986 - DNA, 25 bp, Mus musculus
cccctgaattttgtggagcttgttg

SEQ ID NO: 19987 - DNA, 25 bp, Mus musculus
cccctgacagaggatcatggaccaa

SEQ ID NO: 19988 - DNA, 25 bp, Mus musculus
cccctgaggcccaagctggagaaac

SEQ ID NO: 19989 - DNA, 25 bp, Mus musculus
cccctgatccaagtttggataatga

SEQ ID NO: 19990 - DNA, 25 bp, Mus musculus
cccctgattgtggtgctatccataa

SEQ ID NO: 19991 - DNA, 25 bp, Mus musculus
cccctgcatcagcacaattgtggca

SEQ ID NO: 19992 - DNA, 25 bp, Mus musculus
cccctgcctaatgaaaattgtgcca

SEQ ID NO: 19993 - DNA, 25 bp, Mus musculus
cccctgcgcaagacataaggatgct

SEQ ID NO: 19994 - DNA, 25 bp, Mus musculus
cccctgctgttgagtgcacaagaaa

SEQ ID NO: 19995 - DNA, 25 bp, Mus musculus
cccctgcttctctctgtaaattgag

SEQ ID NO: 19996 - DNA, 25 bp, Mus musculus
cccctggctctactggagctgaact

SEQ ID NO: 19997 - DNA, 25 bp, Mus musculus
cccctgggaacaagccggagctgta

SEQ ID NO: 19998 - DNA, 25 bp, Mus musculus
cccctgggtggcctatcaccagtat

SEQ ID NO: 19999 - DNA, 25 bp, Mus musculus
cccctggtgaccattaatcgttctg

SEQ ID NO: 20000 - DNA, 25 bp, Mus musculus
cccctggtgacctttaatcgttctg

SEQ ID NO: 20001 - DNA, 25 bp, Mus musculus
cccctggtggagaactttgagcctc

SEQ ID NO: 20002 - DNA, 25 bp, Mus musculus
cccctggtgtggacctgagccgcat

SEQ ID NO: 20003 - DNA, 25 bp, Mus musculus
cccctgtacttgaggactaactcct

SEQ ID NO: 20004 - DNA, 25 bp, Mus musculus
cccctgtatgacacgctgggtacag

SEQ ID NO: 20005 - DNA, 25 bp, Mus musculus
cccctgtcaaggaggccttgaagtc

SEQ ID NO: 20006 - DNA, 25 bp, Mus musculus
cccctgtccatctctggactataag

SEQ ID NO: 20007 - DNA, 25 bp, Mus musculus
cccctgtttctttggattatagcag

SEQ ID NO: 20008 - DNA, 25 bp, Mus musculus
ccccttatcgcaaagaaaaccagac

SEQ ID NO: 20009 - DNA, 25 bp, Mus musculus
ccccttatcgcatagaaaaccagac

SEQ ID NO: 20010 - DNA, 25 bp, Mus musculus
ccccttcgaggaattggcatcctta

SEQ ID NO: 20011 - DNA, 25 bp, Mus musculus
ccccttctgccatgacgtgaaggta

SEQ ID NO: 20012 - DNA, 25 bp, Mus musculus
ccccttgatgccactggatgatgca

SEQ ID NO: 20013 - DNA, 25 bp, Mus musculus
ccccttgggcagtgagccgggacca

SEQ ID NO: 20014 - DNA, 25 bp, Mus musculus
cccctttctctaagctgaaggtgga

SEQ ID NO: 20015 - DNA, 25 bp, Mus musculus
cccgaaggaaattctgcagtctgtt

SEQ ID NO: 20016 - DNA, 25 bp, Mus musculus
cccgaaggagcggacacggtgtcca

SEQ ID NO: 20017 - DNA, 25 bp, Mus musculus
cccgaaggttcaggctcaaagctct

SEQ ID NO: 20018 - DNA, 25 bp, Mus musculus
cccgaagttgaggtgaccattgaag

SEQ ID NO: 20019 - DNA, 25 bp, Mus musculus
cccgacctgagtagtgagtggagaa

SEQ ID NO: 20020 - DNA, 25 bp, Mus musculus
cccgacgacaaggagcaaagcaaag

SEQ ID NO: 20021 - DNA, 25 bp, Mus musculus
cccgacgacttaaaatggatgctgt

SEQ ID NO: 20022 - DNA, 25 bp, Mus musculus
cccgactcggaaagcaatctggatc

SEQ ID NO: 20023 - DNA, 25 bp, Mus musculus
cccgactgagtgaggaggccagcca

SEQ ID NO: 20024 - DNA, 25 bp, Mus musculus
cccgagaagatcagaggtggagtcc

SEQ ID NO: 20025 - DNA, 25 bp, Mus musculus
cccgagaaggcaaggactccaagga

SEQ ID NO: 20026 - DNA, 25 bp, Mus musculus
cccgagagagtttgttgatttctcc

SEQ ID NO: 20027 - DNA, 25 bp, Mus musculus
cccgagagtacagtgacttctcata

SEQ ID NO: 20028 - DNA, 25 bp, Mus musculus
cccgagatgccaagggtatcagcca

SEQ ID NO: 20029 - DNA, 25 bp, Mus musculus
cccgagccttgggagcgagcgcttt

SEQ ID NO: 20030 - DNA, 25 bp, Mus musculus
cccgagctggagtatgggagtccct

SEQ ID NO: 20031 - DNA, 25 bp, Mus musculus
cccgaggaattcctggatccccagg

SEQ ID NO: 20032 - DNA, 25 bp, Mus musculus
cccgagggtgtccaagagcttcctg

SEQ ID NO: 20033 - DNA, 25 bp, Mus musculus
cccgaggtacacttttgcaccaagc

SEQ ID NO: 20034 - DNA, 25 bp, Mus musculus
cccgaggttctggatatttgacaag

SEQ ID NO: 20035 - DNA, 25 bp, Mus musculus
cccgagtatcgtttgagcagatcct

SEQ ID NO: 20036 - DNA, 25 bp, Mus musculus
cccgagtcaaacacagtagatggta

SEQ ID NO: 20037 - DNA, 25 bp, Mus musculus
cccgagtctttttgcgccgctgctg

SEQ ID NO: 20038 - DNA, 25 bp, Mus musculus
cccgagtggtgctaccggaaaccat

SEQ ID NO: 20039 - DNA, 25 bp, Mus musculus
cccgataatgagaacgagattctgc

SEQ ID NO: 20040 - DNA, 25 bp, Mus musculus
cccgatcttcaacgagactctgcgg

SEQ ID NO: 20041 - DNA, 25 bp, Mus musculus
cccgatggctcttgcgcagctggga

SEQ ID NO: 20042 - DNA, 25 bp, Mus musculus
cccgatggtagaatactgcataccg

SEQ ID NO: 20043 - DNA, 25 bp, Mus musculus
cccgatttctgaagatcccgagaat

SEQ ID NO: 20044 - DNA, 25 bp, Mus musculus
cccgcaaacaacttatcagtagtga

SEQ ID NO: 20045 - DNA, 25 bp, Mus musculus
cccgcaggctgcaaggagcaacagc

SEQ ID NO: 20046 - DNA, 25 bp, Mus musculus
cccgcatcatttgttggcagtacat

SEQ ID NO: 20047 - DNA, 25 bp, Mus musculus
cccgcatgaacgcaatgcatttgag

SEQ ID NO: 20048 - DNA, 25 bp, Mus musculus
cccgccagtcgccaatggaatgtac

SEQ ID NO: 20049 - DNA, 25 bp, Mus musculus
cccgccgcccagcagagttgtgttt

SEQ ID NO: 20050 - DNA, 25 bp, Mus musculus
cccgcctgactgatcttgagatgaa

SEQ ID NO: 20051 - DNA, 25 bp, Mus musculus
cccgcctgtcagcatccttagtgag

SEQ ID NO: 20052 - DNA, 25 bp, Mus musculus
cccgcgatagtattttcctcaagtc

SEQ ID NO: 20053 - DNA, 25 bp, Mus musculus
cccgcggcgcttagttaggactgga

SEQ ID NO: 20054 - DNA, 25 bp, Mus musculus
cccgctaagtctgtctcttttagaa

SEQ ID NO: 20055 - DNA, 25 bp, Mus musculus
cccgctgctcctctgtgatttacag

SEQ ID NO: 20056 - DNA, 25 bp, Mus musculus
cccgctgggacttactgacagagga

SEQ ID NO: 20057 - DNA, 25 bp, Mus musculus
cccggagactgctgaagagtccaaa

SEQ ID NO: 20058 - DNA, 25 bp, Mus musculus
cccggagatatgtacgcaagtttgt

SEQ ID NO: 20059 - DNA, 25 bp, Mus musculus
cccggagcagtagtgtgtgtagaaa

SEQ ID NO: 20060 - DNA, 25 bp, Mus musculus
cccggagtccgtagacctggagtgt

SEQ ID NO: 20061 - DNA, 25 bp, Mus musculus
cccggagtgcaacagcacgcaggat

SEQ ID NO: 20062 - DNA, 25 bp, Mus musculus
cccggataataaagaatttgctgaa

SEQ ID NO: 20063 - DNA, 25 bp, Mus musculus
cccggatatgccgacttatgaaaca

SEQ ID NO: 20064 - DNA, 25 bp, Mus musculus
cccggattatttggccactgtggat

SEQ ID NO: 20065 - DNA, 25 bp, Mus musculus
cccggcaactggaggaaccttcatc

SEQ ID NO: 20066 - DNA, 25 bp, Mus musculus
cccggcagaacagtgccaatacatt

SEQ ID NO: 20067 - DNA, 25 bp, Mus musculus
cccggcagacagcacgctgtgcatg

SEQ ID NO: 20068 - DNA, 25 bp, Mus musculus
cccggcattcactgtacttcattgg

SEQ ID NO: 20069 - DNA, 25 bp, Mus musculus
cccggcccgacgagaaggccataat

SEQ ID NO: 20070 - DNA, 25 bp, Mus musculus
cccggcctctactggcaggtgacat

SEQ ID NO: 20071 - DNA, 25 bp, Mus musculus
cccgggacaccatgcagatcattct

SEQ ID NO: 20072 - DNA, 25 bp, Mus musculus
cccgggaccgtcttggactggtgct

SEQ ID NO: 20073 - DNA, 25 bp, Mus musculus
cccgggagatcgacctcaacgagtg

SEQ ID NO: 20074 - DNA, 25 bp, Mus musculus
cccgggcatgtatgcccctggaggt

SEQ ID NO: 20075 - DNA, 25 bp, Mus musculus
cccgggccacaaatgttcttgcaaa

SEQ ID NO: 20076 - DNA, 25 bp, Mus musculus
cccgggccctggctagacagctgaa

SEQ ID NO: 20077 - DNA, 25 bp, Mus musculus
cccgggcggagtggatgtctacttt

SEQ ID NO: 20078 - DNA, 25 bp, Mus musculus
cccgggctggaagggcatcaactgc

SEQ ID NO: 20079 - DNA, 25 bp, Mus musculus
cccggtcacgtgtggagatcgagca

SEQ ID NO: 20080 - DNA, 25 bp, Mus musculus
cccggtcagtgccagccgtactatt

SEQ ID NO: 20081 - DNA, 25 bp, Mus musculus
cccggtgacaagagtgccgcgaaat

SEQ ID NO: 20082 - DNA, 25 bp, Mus musculus
cccggtggttcagatggctgaagat

SEQ ID NO: 20083 - DNA, 25 bp, Mus musculus
cccggtgtgcattcaaaactgcgta

SEQ ID NO: 20084 - DNA, 25 bp, Mus musculus
cccgtatgttatggcagatagttta

SEQ ID NO: 20085 - DNA, 25 bp, Mus musculus
cccgtccctcattcaatgaagagaa

SEQ ID NO: 20086 - DNA, 25 bp, Mus musculus
cccgtcgttatgactggtgaaggcc

SEQ ID NO: 20087 - DNA, 25 bp, Mus musculus
cccgtctaactgagcgtgctctgca

SEQ ID NO: 20088 - DNA, 25 bp, Mus musculus
cccgtgagtgtcaaggtgtatgaaa

SEQ ID NO: 20089 - DNA, 25 bp, Mus musculus
cccgtgagtgtctaggtgtatgaaa

SEQ ID NO: 20090 - DNA, 25 bp, Mus musculus
cccgtgattttgcaacggaagtacg

SEQ ID NO: 20091 - DNA, 25 bp, Mus musculus
cccgtgcagctggaagacggcagca

SEQ ID NO: 20092 - DNA, 25 bp, Mus musculus
cccgtgctcatatccctgggaaaag

SEQ ID NO: 20093 - DNA, 25 bp, Mus musculus
cccgtggaataccagacggtgcaga

SEQ ID NO: 20094 - DNA, 25 bp, Mus musculus
cccgtggagaagacggctcttgaga

SEQ ID NO: 20095 - DNA, 25 bp, Mus musculus
cccgtggatgcaggcaaagccgtga

SEQ ID NO: 20096 - DNA, 25 bp, Mus musculus
cccgtggtgtgaacgatgatggcca

SEQ ID NO: 20097 - DNA, 25 bp, Mus musculus
cccgtgtggacgctggccatgcctt

SEQ ID NO: 20098 - DNA, 25 bp, Mus musculus
cccgtgttcttggagaaggctgtgc

SEQ ID NO: 20099 - DNA, 25 bp, Mus musculus
cccgtgttggaatgtgcggcctcct

SEQ ID NO: 20100 - DNA, 25 bp, Mus musculus
cccgtgttgggctacctgattcttg

SEQ ID NO: 20101 - DNA, 25 bp, Mus musculus
cccgttacatatccttcagtggcat

SEQ ID NO: 20102 - DNA, 25 bp, Mus musculus
cccgttgccactgtcatcagatgag

SEQ ID NO: 20103 - DNA, 25 bp, Mus musculus
cccgttggatggtgcctcccacatt

SEQ ID NO: 20104 - DNA, 25 bp, Mus musculus
ccctaaaggaccagtctcactgcat

SEQ ID NO: 20105 - DNA, 25 bp, Mus musculus
ccctaaccagatcgcagtggtacag

SEQ ID NO: 20106 - DNA, 25 bp, Mus musculus
ccctaagatccatcaggaagtagaa

SEQ ID NO: 20107 - DNA, 25 bp, Mus musculus
ccctaagatgagtcctccgttccat

SEQ ID NO: 20108 - DNA, 25 bp, Mus musculus
ccctaaggcaggatgatagacacct

SEQ ID NO: 20109 - DNA, 25 bp, Mus musculus
ccctaatggttggagaaatggtgga

SEQ ID NO: 20110 - DNA, 25 bp, Mus musculus
ccctaatgtttggttctcttactgt

SEQ ID NO: 20111 - DNA, 25 bp, Mus musculus
ccctacaagtgagcagagtgagttc

SEQ ID NO: 20112 - DNA, 25 bp, Mus musculus
ccctacacagcgactccagcttggg

SEQ ID NO: 20113 - DNA, 25 bp, Mus musculus
ccctacacatgtagtgttttcctct

SEQ ID NO: 20114 - DNA, 25 bp, Mus musculus
ccctaccgagaaatcgacgccttgg

SEQ ID NO: 20115 - DNA, 25 bp, Mus musculus
ccctaccgtggacccagatgcaggt

SEQ ID NO: 20116 - DNA, 25 bp, Mus musculus
ccctacctgatgttgaagctctgag

SEQ ID NO: 20117 - DNA, 25 bp, Mus musculus
ccctacgggccttctggagactggc

SEQ ID NO: 20118 - DNA, 25 bp, Mus musculus
ccctagaaggcgtggctgaaaggat

SEQ ID NO: 20119 - DNA, 25 bp, Mus musculus
ccctagaagtcaggaggcatgaaac

SEQ ID NO: 20120 - DNA, 25 bp, Mus musculus
ccctagcgttctggattatgtcaat

SEQ ID NO: 20121 - DNA, 25 bp, Mus musculus
ccctagctactggtgtcagaacatg

SEQ ID NO: 20122 - DNA, 25 bp, Mus musculus
ccctaggcagcaccaaggagttcag

SEQ ID NO: 20123 - DNA, 25 bp, Mus musculus
ccctagggtatgcagcaattccact

SEQ ID NO: 20124 - DNA, 25 bp, Mus musculus
ccctagggtatggagcaattccact

SEQ ID NO: 20125 - DNA, 25 bp, Mus musculus
ccctaggtctgcagggtatagcaca

SEQ ID NO: 20126 - DNA, 25 bp, Mus musculus
ccctagtcatgaagctggcagtatg

SEQ ID NO: 20127 - DNA, 25 bp, Mus musculus
ccctagtggacctgcagtttcttca

SEQ ID NO: 20128 - DNA, 25 bp, Mus musculus
ccctagtggatgagagagctcccga

SEQ ID NO: 20129 - DNA, 25 bp, Mus musculus
ccctatacctaggtgatgtgtcaga

SEQ ID NO: 20130 - DNA, 25 bp, Mus musculus
ccctatcatgcagggtaacacagag

SEQ ID NO: 20131 - DNA, 25 bp, Mus musculus
ccctatggacgacgccagggagact

SEQ ID NO: 20132 - DNA, 25 bp, Mus musculus
ccctattacgatgtgatgactacgg

SEQ ID NO: 20133 - DNA, 25 bp, Mus musculus
ccctattctgaaaagtccattgtgt

SEQ ID NO: 20134 - DNA, 25 bp, Mus musculus
ccctatttgctggaaatcctcagct

SEQ ID NO: 20135 - DNA, 25 bp, Mus musculus
ccctcaaaggcttccgaaggtcagg

SEQ ID NO: 20136 - DNA, 25 bp, Mus musculus
ccctcaaatgacctggattccacaa

SEQ ID NO: 20137 - DNA, 25 bp, Mus musculus
ccctcaactgcatgagagaagaatg

SEQ ID NO: 20138 - DNA, 25 bp, Mus musculus
ccctcaagagtgtgagagttcctaa

SEQ ID NO: 20139 - DNA, 25 bp, Mus musculus
ccctcaatcctgagttcaatgagcg

SEQ ID NO: 20140 - DNA, 25 bp, Mus musculus
ccctcaatgtcaagagtgaaaaggt

SEQ ID NO: 20141 - DNA, 25 bp, Mus musculus
ccctcaccaaagaagactcgaaact

SEQ ID NO: 20142 - DNA, 25 bp, Mus musculus
ccctcactggatgacataaggaaca

SEQ ID NO: 20143 - DNA, 25 bp, Mus musculus
ccctcagactgaccttggattcttt

SEQ ID NO: 20144 - DNA, 25 bp, Mus musculus
ccctcagagacacacaggagtgcca

SEQ ID NO: 20145 - DNA, 25 bp, Mus musculus
ccctcagagacagacaggagtgcca

SEQ ID NO: 20146 - DNA, 25 bp, Mus musculus
ccctcagagtatcactacatgaaag

SEQ ID NO: 20147 - DNA, 25 bp, Mus musculus
ccctcagcagggaacagtttctcaa

SEQ ID NO: 20148 - DNA, 25 bp, Mus musculus
ccctcagcagtaagagccggagttc

SEQ ID NO: 20149 - DNA, 25 bp, Mus musculus
ccctcagcctcaaagtcagatgcag

SEQ ID NO: 20150 - DNA, 25 bp, Mus musculus
ccctcaggaagagacggccatgaca

SEQ ID NO: 20151 - DNA, 25 bp, Mus musculus
ccctcagggcaaaagatatctcgga

SEQ ID NO: 20152 - DNA, 25 bp, Mus musculus
ccctcagggtgttcgtgaatgccgg

SEQ ID NO: 20153 - DNA, 25 bp, Mus musculus
ccctcagtgagggacaggtgccctg

SEQ ID NO: 20154 - DNA, 25 bp, Mus musculus
ccctcatctgagaaggcagagttcc

SEQ ID NO: 20155 - DNA, 25 bp, Mus musculus
ccctcatgggtgaagtgtggcctca

SEQ ID NO: 20156 - DNA, 25 bp, Mus musculus
ccctcatggtcttaaggtctatggg

SEQ ID NO: 20157 - DNA, 25 bp, Mus musculus
ccctcatggttcaggccaatcctga

SEQ ID NO: 20158 - DNA, 25 bp, Mus musculus
ccctcattccaggacataatgcaaa

SEQ ID NO: 20159 - DNA, 25 bp, Mus musculus
ccctcattgtgtctgtcatcaatag

SEQ ID NO: 20160 - DNA, 25 bp, Mus musculus
ccctccactgtgatgtactgtcttg

SEQ ID NO: 20161 - DNA, 25 bp, Mus musculus
ccctccaggaggtgaaatggatcag

SEQ ID NO: 20162 - DNA, 25 bp, Mus musculus
ccctccatccttagctatagtcatt

SEQ ID NO: 20163 - DNA, 25 bp, Mus musculus
ccctccatcggaacagtgctgtgtg

SEQ ID NO: 20164 - DNA, 25 bp, Mus musculus
ccctccattcattgcaagatacttg

SEQ ID NO: 20165 - DNA, 25 bp, Mus musculus
ccctcccaagatgttgtttacacga

SEQ ID NO: 20166 - DNA, 25 bp, Mus musculus
ccctcccctgtatcgcttaattgag

SEQ ID NO: 20167 - DNA, 25 bp, Mus musculus
ccctccctgctgtggagcgagtgaa

SEQ ID NO: 20168 - DNA, 25 bp, Mus musculus
ccctccgtaggcaccgggttgtgct

SEQ ID NO: 20169 - DNA, 25 bp, Mus musculus
ccctccgtaggctccgggttgtgct

SEQ ID NO: 20170 - DNA, 25 bp, Mus musculus
ccctcctgcacgcaatggtggctta

SEQ ID NO: 20171 - DNA, 25 bp, Mus musculus
ccctcctgccagaaggcgaaggtct

SEQ ID NO: 20172 - DNA, 25 bp, Mus musculus
ccctcgagatgtggccaggatcgaa

SEQ ID NO: 20173 - DNA, 25 bp, Mus musculus
ccctcggtaatgctattgatggaaa

SEQ ID NO: 20174 - DNA, 25 bp, Mus musculus
ccctcgttagtgtggctgtcacaaa

SEQ ID NO: 20175 - DNA, 25 bp, Mus musculus
ccctcgttcgaagaggattaagaag

SEQ ID NO: 20176 - DNA, 25 bp, Mus musculus
ccctctatccctctgtaagtgctgt

SEQ ID NO: 20177 - DNA, 25 bp, Mus musculus
ccctctcggtggtgtttggaaccat

SEQ ID NO: 20178 - DNA, 25 bp, Mus musculus
ccctctgagaggagtcttaagagag

SEQ ID NO: 20179 - DNA, 25 bp, Mus musculus
ccctctgcaaggctttgaaaatgac

SEQ ID NO: 20180 - DNA, 25 bp, Mus musculus
ccctctgcacgagaacgaagttctt

SEQ ID NO: 20181 - DNA, 25 bp, Mus musculus
ccctctgctttctagtgatgccggg

SEQ ID NO: 20182 - DNA, 25 bp, Mus musculus
ccctctggcaagattgtggctcttg

SEQ ID NO: 20183 - DNA, 25 bp, Mus musculus
ccctctgggctcgacgggaggcaaa

SEQ ID NO: 20184 - DNA, 25 bp, Mus musculus
ccctcttcagtttggcgcccagtgg

SEQ ID NO: 20185 - DNA, 25 bp, Mus musculus
ccctcttcttagagcctgtgctgtg

SEQ ID NO: 20186 - DNA, 25 bp, Mus musculus
ccctcttgagatgctggaggcccag

SEQ ID NO: 20187 - DNA, 25 bp, Mus musculus
ccctcttggtaaagaacaacatctg

SEQ ID NO: 20188 - DNA, 25 bp, Mus musculus
ccctcttgtgcaggaccatggagca

SEQ ID NO: 20189 - DNA, 25 bp, Mus musculus
ccctctttggcacacttggaaactg

SEQ ID NO: 20190 - DNA, 25 bp, Mus musculus
ccctgaaaaccatggcacagatatg

SEQ ID NO: 20191 - DNA, 25 bp, Mus musculus
ccctgaagccggaggccgatgccag

SEQ ID NO: 20192 - DNA, 25 bp, Mus musculus
ccctgaagttggtgatattaaaatc

SEQ ID NO: 20193 - DNA, 25 bp, Mus musculus
ccctgacagaagctatgcactggca

SEQ ID NO: 20194 - DNA, 25 bp, Mus musculus
ccctgaccctgctgaccttgtgttt

SEQ ID NO: 20195 - DNA, 25 bp, Mus musculus
ccctgacgacatgggatcaaaaggc

SEQ ID NO: 20196 - DNA, 25 bp, Mus musculus
ccctgactgccagggagtcagagtc

SEQ ID NO: 20197 - DNA, 25 bp, Mus musculus
ccctgagacagctttcatctctgac

SEQ ID NO: 20198 - DNA, 25 bp, Mus musculus
ccctgagaccgttgaggtggacacg

SEQ ID NO: 20199 - DNA, 25 bp, Mus musculus
ccctgagagccccatggctttgttg

SEQ ID NO: 20200 - DNA, 25 bp, Mus musculus
ccctgagagtcaggaggagtccccg

SEQ ID NO: 20201 - DNA, 25 bp, Mus musculus
ccctgagcaccaacagagatgcaga

SEQ ID NO: 20202 - DNA, 25 bp, Mus musculus
ccctgagccgtaatgatcctgcaac

SEQ ID NO: 20203 - DNA, 25 bp, Mus musculus
ccctgaggcccaagctggagaaacg

SEQ ID NO: 20204 - DNA, 25 bp, Mus musculus
ccctgaggctgtcccgcctgaagga

SEQ ID NO: 20205 - DNA, 25 bp, Mus musculus
ccctgagtaacggtgcaaaatgttt

SEQ ID NO: 20206 - DNA, 25 bp, Mus musculus
ccctgagtatgaacggagatttgtg

SEQ ID NO: 20207 - DNA, 25 bp, Mus musculus
ccctgagtatgaagctgcagcaacc

SEQ ID NO: 20208 - DNA, 25 bp, Mus musculus
ccctgagtatgatcggagatttgtg

SEQ ID NO: 20209 - DNA, 25 bp, Mus musculus
ccctgagtcggccatcaaattcatg

SEQ ID NO: 20210 - DNA, 25 bp, Mus musculus
ccctgagtgcacacgagggaaagat

SEQ ID NO: 20211 - DNA, 25 bp, Mus musculus
ccctgatagggttgttatgaagatt

SEQ ID NO: 20212 - DNA, 25 bp, Mus musculus
ccctgatgaagatagactcataagc

SEQ ID NO: 20213 - DNA, 25 bp, Mus musculus
ccctgatgatcaggctcagaaaatt

SEQ ID NO: 20214 - DNA, 25 bp, Mus musculus
ccctgatgcagagtgtttgaggatc

SEQ ID NO: 20215 - DNA, 25 bp, Mus musculus
ccctgattatttcatgtactcgaca

SEQ ID NO: 20216 - DNA, 25 bp, Mus musculus
ccctgattatttgatgtactcgaca

SEQ ID NO: 20217 - DNA, 25 bp, Mus musculus
ccctgattctgatgatattaaggca

SEQ ID NO: 20218 - DNA, 25 bp, Mus musculus
ccctgattctggagagaatggagga

SEQ ID NO: 20219 - DNA, 25 bp, Mus musculus
ccctgattgcggattacggtcacga

SEQ ID NO: 20220 - DNA, 25 bp, Mus musculus
ccctgatttaagaaggatcctgaca

SEQ ID NO: 20221 - DNA, 25 bp, Mus musculus
ccctgatttctacgtggaaatgaaa

SEQ ID NO: 20222 - DNA, 25 bp, Mus musculus
ccctgatttgtctccagggtacctg

SEQ ID NO: 20223 - DNA, 25 bp, Mus musculus
ccctgcaggaggcacagaaaatctt

SEQ ID NO: 20224 - DNA, 25 bp, Mus musculus
ccctgcattgccttcggatgctgct

SEQ ID NO: 20225 - DNA, 25 bp, Mus musculus
ccctgccaaaaagagtgagcttatc

SEQ ID NO: 20226 - DNA, 25 bp, Mus musculus
ccctgccgcagatgggcagttctct

SEQ ID NO: 20227 - DNA, 25 bp, Mus musculus
ccctgccggtgctacagagtgagtt

SEQ ID NO: 20228 - DNA, 25 bp, Mus musculus
ccctgcctaccgcaaatgtactttt

SEQ ID NO: 20229 - DNA, 25 bp, Mus musculus
ccctgcctctccatttatgcagaag

SEQ ID NO: 20230 - DNA, 25 bp, Mus musculus
ccctgcggaagcgtttcctgctttt

SEQ ID NO: 20231 - DNA, 25 bp, Mus musculus
ccctgctatcaatggagcattgaag

SEQ ID NO: 20232 - DNA, 25 bp, Mus musculus
ccctgctatctgctgagaaacatga

SEQ ID NO: 20233 - DNA, 25 bp, Mus musculus
ccctgctcagtgttctgcgggacct

SEQ ID NO: 20234 - DNA, 25 bp, Mus musculus
ccctgctcttcagggaggtcagttt

SEQ ID NO: 20235 - DNA, 25 bp, Mus musculus
ccctgctgagaaatgaagtggccca

SEQ ID NO: 20236 - DNA, 25 bp, Mus musculus
ccctgctgatcatgaagctgacaga

SEQ ID NO: 20237 - DNA, 25 bp, Mus musculus
ccctgctgccggttcctggaaagaa

SEQ ID NO: 20238 - DNA, 25 bp, Mus musculus
ccctgctggactggatgctatgagt

SEQ ID NO: 20239 - DNA, 25 bp, Mus musculus
ccctgctggaggacaagtaccggcg

SEQ ID NO: 20240 - DNA, 25 bp, Mus musculus
ccctgctggagtacggtgctgatgc

SEQ ID NO: 20241 - DNA, 25 bp, Mus musculus
ccctgctgtctgactatgaagtatg

SEQ ID NO: 20242 - DNA, 25 bp, Mus musculus
ccctgctgtgattggcttctggcca

SEQ ID NO: 20243 - DNA, 25 bp, Mus musculus
ccctggaaaatcatctgcccggcat

SEQ ID NO: 20244 - DNA, 25 bp, Mus musculus
ccctggaacgggatgctgagacctt

SEQ ID NO: 20245 - DNA, 25 bp, Mus musculus
ccctggaagacatgctgcaggccct

SEQ ID NO: 20246 - DNA, 25 bp, Mus musculus
ccctggaagaccgtgtccatgagat

SEQ ID NO: 20247 - DNA, 25 bp, Mus musculus
ccctggaccgtgtcttccatattgg

SEQ ID NO: 20248 - DNA, 25 bp, Mus musculus
ccctggactggattggccggagaat

SEQ ID NO: 20249 - DNA, 25 bp, Mus musculus
ccctggacttcgtctcacaagatga

SEQ ID NO: 20250 - DNA, 25 bp, Mus musculus
ccctggagaacaaggtaaagagact

SEQ ID NO: 20251 - DNA, 25 bp, Mus musculus
ccctggagagagaagcgtctatagc

SEQ ID NO: 20252 - DNA, 25 bp, Mus musculus
ccctggagcagtgcagtgtgtgttc

SEQ ID NO: 20253 - DNA, 25 bp, Mus musculus
ccctggagctcgttagccgccagga

SEQ ID NO: 20254 - DNA, 25 bp, Mus musculus
ccctggagctgtgcatacggcggca

SEQ ID NO: 20255 - DNA, 25 bp, Mus musculus
ccctggagtctgtgacagctaagtg

SEQ ID NO: 20256 - DNA, 25 bp, Mus musculus
ccctggagtctgtgcggatcctgaa

SEQ ID NO: 20257 - DNA, 25 bp, Mus musculus
ccctggatagtctggtctggagctg

SEQ ID NO: 20258 - DNA, 25 bp, Mus musculus
ccctggatcatctcatcaaaggaag

SEQ ID NO: 20259 - DNA, 25 bp, Mus musculus
ccctggatgactactacctggagca

SEQ ID NO: 20260 - DNA, 25 bp, Mus musculus
ccctggcacaaatgaaagagtttga

SEQ ID NO: 20261 - DNA, 25 bp, Mus musculus
ccctggcagtctggatgctgagata

SEQ ID NO: 20262 - DNA, 25 bp, Mus musculus
ccctggccagagtcgtgggctactt

SEQ ID NO: 20263 - DNA, 25 bp, Mus musculus
ccctggccagcaagaaacctaaaag

SEQ ID NO: 20264 - DNA, 25 bp, Mus musculus
ccctggccatgcgtggtttagttga

SEQ ID NO: 20265 - DNA, 25 bp, Mus musculus
ccctggctaaagcagagccggagcc

SEQ ID NO: 20266 - DNA, 25 bp, Mus musculus
ccctggctacctttagtgtaaatat

SEQ ID NO: 20267 - DNA, 25 bp, Mus musculus
ccctggctgacattgggaagactgt

SEQ ID NO: 20268 - DNA, 25 bp, Mus musculus
ccctggctgtggtatggcaggccaa

SEQ ID NO: 20269 - DNA, 25 bp, Mus musculus
ccctggcttgcccagaggtagaatg

SEQ ID NO: 20270 - DNA, 25 bp, Mus musculus
ccctgggaacaagccggagctgtat

SEQ ID NO: 20271 - DNA, 25 bp, Mus musculus
ccctgggaacagcattcacacagca

SEQ ID NO: 20272 - DNA, 25 bp, Mus musculus
ccctgggaaggtgtgagagatgcca

SEQ ID NO: 20273 - DNA, 25 bp, Mus musculus
ccctgggagagcagcgttgttagca

SEQ ID NO: 20274 - DNA, 25 bp, Mus musculus
ccctgggaggcgtcaggttcctttg

SEQ ID NO: 20275 - DNA, 25 bp, Mus musculus
ccctgggcaccaagacatgggtagg

SEQ ID NO: 20276 - DNA, 25 bp, Mus musculus
ccctgggccctattgacttaaagca

SEQ ID NO: 20277 - DNA, 25 bp, Mus musculus
ccctggggcacctgcaatgctgtta

SEQ ID NO: 20278 - DNA, 25 bp, Mus musculus
ccctgggtcctgagtcgtgctctgt

SEQ ID NO: 20279 - DNA, 25 bp, Mus musculus
ccctgggtcgcttggaagaagccaa

SEQ ID NO: 20280 - DNA, 25 bp, Mus musculus
ccctggtaccagaaagcatgcaagt

SEQ ID NO: 20281 - DNA, 25 bp, Mus musculus
ccctggtcgtgaggcctatcctggt

SEQ ID NO: 20282 - DNA, 25 bp, Mus musculus
ccctggtgaatgcaccatataagcg

SEQ ID NO: 20283 - DNA, 25 bp, Mus musculus
ccctggtgaccaataatcgttctgc

SEQ ID NO: 20284 - DNA, 25 bp, Mus musculus
ccctggtgaccattaatcgttctgc

SEQ ID NO: 20285 - DNA, 25 bp, Mus musculus
ccctggtgcacgtggcttgctgctg

SEQ ID NO: 20286 - DNA, 25 bp, Mus musculus
ccctggtgcagatgttccgcagcga

SEQ ID NO: 20287 - DNA, 25 bp, Mus musculus
ccctggtggaaaggcggccatgctt

SEQ ID NO: 20288 - DNA, 25 bp, Mus musculus
ccctggtggctcaggtactgatgct

SEQ ID NO: 20289 - DNA, 25 bp, Mus musculus
ccctggttgaggacttgttcaagga

SEQ ID NO: 20290 - DNA, 25 bp, Mus musculus
ccctggttgataaacagtaaagctg

SEQ ID NO: 20291 - DNA, 25 bp, Mus musculus
ccctggttgcggtgtatagaatgac

SEQ ID NO: 20292 - DNA, 25 bp, Mus musculus
ccctggttgtggaatttgaggctcc

SEQ ID NO: 20293 - DNA, 25 bp, Mus musculus
ccctggtttttgctgtcatcccctt

SEQ ID NO: 20294 - DNA, 25 bp, Mus musculus
ccctgtaaggttgagaggcggatct

SEQ ID NO: 20295 - DNA, 25 bp, Mus musculus
ccctgtaccgaaagatgctaggcaa

SEQ ID NO: 20296 - DNA, 25 bp, Mus musculus
ccctgtagccctgcaaactttatgg

SEQ ID NO: 20297 - DNA, 25 bp, Mus musculus
ccctgtagtgcgctggctcaatgag

SEQ ID NO: 20298 - DNA, 25 bp, Mus musculus
ccctgtattggttgtgtgcatgcca

SEQ ID NO: 20299 - DNA, 25 bp, Mus musculus
ccctgtcactgagcttggaatctga

SEQ ID NO: 20300 - DNA, 25 bp, Mus musculus
ccctgtcagagttcttggtggagtg

SEQ ID NO: 20301 - DNA, 25 bp, Mus musculus
ccctgtcagcctcaaggcattacgt

SEQ ID NO: 20302 - DNA, 25 bp, Mus musculus
ccctgtccaccatgattgacgggag

SEQ ID NO: 20303 - DNA, 25 bp, Mus musculus
ccctgtccctggcagtagtaagcat

SEQ ID NO: 20304 - DNA, 25 bp, Mus musculus
ccctgtctccaggatatcttggcta

SEQ ID NO: 20305 - DNA, 25 bp, Mus musculus
ccctgtctgaaatgcgtggacctgg

SEQ ID NO: 20306 - DNA, 25 bp, Mus musculus
ccctgtctgagattgttcccgagca

SEQ ID NO: 20307 - DNA, 25 bp, Mus musculus
ccctgtctgtactggcgttgtgaaa

SEQ ID NO: 20308 - DNA, 25 bp, Mus musculus
ccctgtgaactgacgtttgtggctg

SEQ ID NO: 20309 - DNA, 25 bp, Mus musculus
ccctgtgaagcagtactatgtgatt

SEQ ID NO: 20310 - DNA, 25 bp, Mus musculus
ccctgtgatctctgggaatgtcagc

SEQ ID NO: 20311 - DNA, 25 bp, Mus musculus
ccctgtgctgaggattgttgaccct

SEQ ID NO: 20312 - DNA, 25 bp, Mus musculus
ccctgtgggagaccatggctcactg

SEQ ID NO: 20313 - DNA, 25 bp, Mus musculus
ccctgtgtacgtgccctgtgtgaag

SEQ ID NO: 20314 - DNA, 25 bp, Mus musculus
ccctgtgtgcacctccctttttgga

SEQ ID NO: 20315 - DNA, 25 bp, Mus musculus
ccctgttccagagcagatgtcttca

SEQ ID NO: 20316 - DNA, 25 bp, Mus musculus
ccctgttgcttgatagtgtgatccc

SEQ ID NO: 20317 - DNA, 25 bp, Mus musculus
ccctgttggacatctttatccatga

SEQ ID NO: 20318 - DNA, 25 bp, Mus musculus
ccctgttgtgatggagctcactgtc

SEQ ID NO: 20319 - DNA, 25 bp, Mus musculus
ccctgtttctttggattatagcagt

SEQ ID NO: 20320 - DNA, 25 bp, Mus musculus
cccttaagcagcagaggagcaccag

SEQ ID NO: 20321 - DNA, 25 bp, Mus musculus
cccttagcactgacctcagtagagc

SEQ ID NO: 20322 - DNA, 25 bp, Mus musculus
cccttagctgatgggcaggtgtctc

SEQ ID NO: 20323 - DNA, 25 bp, Mus musculus
cccttaggaatgacagcagtagcag

SEQ ID NO: 20324 - DNA, 25 bp, Mus musculus
cccttaggaatgtcagcagtagcag

SEQ ID NO: 20325 - DNA, 25 bp, Mus musculus
cccttaggccaacctcctgaagagg

SEQ ID NO: 20326 - DNA, 25 bp, Mus musculus
cccttagtttgagccgagaggagca

SEQ ID NO: 20327 - DNA, 25 bp, Mus musculus
cccttatctgagaagctgtgggcac

SEQ ID NO: 20328 - DNA, 25 bp, Mus musculus
cccttatgccgatgacaagcggaag

SEQ ID NO: 20329 - DNA, 25 bp, Mus musculus
cccttcaatgaaaaccgaaagaggt

SEQ ID NO: 20330 - DNA, 25 bp, Mus musculus
cccttcaatgaataccgaaagaggt

SEQ ID NO: 20331 - DNA, 25 bp, Mus musculus
cccttcagcagacgccggagagaga

SEQ ID NO: 20332 - DNA, 25 bp, Mus musculus
cccttcagcagagcagtggaagaca

SEQ ID NO: 20333 - DNA, 25 bp, Mus musculus
cccttcctgaactgcttcgtggagg

SEQ ID NO: 20334 - DNA, 25 bp, Mus musculus
cccttcgctgacctgattggttatg

SEQ ID NO: 20335 - DNA, 25 bp, Mus musculus
cccttcgtgactggctttgctgtca

SEQ ID NO: 20336 - DNA, 25 bp, Mus musculus
cccttctctaggcacttcggaggag

SEQ ID NO: 20337 - DNA, 25 bp, Mus musculus
cccttctgcctataagctgctgctg

SEQ ID NO: 20338 - DNA, 25 bp, Mus musculus
cccttctggagcaaggtctcatttc

SEQ ID NO: 20339 - DNA, 25 bp, Mus musculus
cccttctgtattattctgtgaggag

SEQ ID NO: 20340 - DNA, 25 bp, Mus musculus
cccttctgtgttttgcaaggagcta

SEQ ID NO: 20341 - DNA, 25 bp, Mus musculus
cccttgaatagaagacagaatgcca

SEQ ID NO: 20342 - DNA, 25 bp, Mus musculus
cccttgaccttactgatgagaaaaa

SEQ ID NO: 20343 - DNA, 25 bp, Mus musculus
cccttgatgacgcagtgtgtgtttg

SEQ ID NO: 20344 - DNA, 25 bp, Mus musculus
cccttgcacctggagtaaatctgac

SEQ ID NO: 20345 - DNA, 25 bp, Mus musculus
cccttgctgactagtggacacggaa

SEQ ID NO: 20346 - DNA, 25 bp, Mus musculus
cccttgctgcccaggaactgggcat

SEQ ID NO: 20347 - DNA, 25 bp, Mus musculus
cccttggagagctgactgcagcagg

SEQ ID NO: 20348 - DNA, 25 bp, Mus musculus
cccttggagctcatgatgtgagcaa

SEQ ID NO: 20349 - DNA, 25 bp, Mus musculus
cccttggagtgagatcaggaacatc

SEQ ID NO: 20350 - DNA, 25 bp, Mus musculus
cccttggatagcctgactctggaaa

SEQ ID NO: 20351 - DNA, 25 bp, Mus musculus
cccttggcagtttctgcatctaagg

SEQ ID NO: 20352 - DNA, 25 bp, Mus musculus
cccttggctcatatgtttgagaggc

SEQ ID NO: 20353 - DNA, 25 bp, Mus musculus
cccttggctctgctgatgagctttt

SEQ ID NO: 20354 - DNA, 25 bp, Mus musculus
cccttggtatgaccgcggcttctgt

SEQ ID NO: 20355 - DNA, 25 bp, Mus musculus
cccttggtgattagctgtgtcagct

SEQ ID NO: 20356 - DNA, 25 bp, Mus musculus
cccttgtagacccattcctgtgaaa

SEQ ID NO: 20357 - DNA, 25 bp, Mus musculus
cccttgtctatgaagccctcagctg

SEQ ID NO: 20358 - DNA, 25 bp, Mus musculus
cccttgtgagtcaggattatgtcaa

SEQ ID NO: 20359 - DNA, 25 bp, Mus musculus
cccttgtgtgtacagtagcaggctg

SEQ ID NO: 20360 - DNA, 25 bp, Mus musculus
cccttgttgactgggcacagcagta

SEQ ID NO: 20361 - DNA, 25 bp, Mus musculus
ccctttaaccatgcacacaaggtgg

SEQ ID NO: 20362 - DNA, 25 bp, Mus musculus
ccctttaccaagatgagacactaag

SEQ ID NO: 20363 - DNA, 25 bp, Mus musculus
ccctttaccaagttgagacactaag

SEQ ID NO: 20364 - DNA, 25 bp, Mus musculus
ccctttctctaagctgaaggtggag

SEQ ID NO: 20365 - DNA, 25 bp, Mus musculus
ccctttctgggctaagttagtagtg

SEQ ID NO: 20366 - DNA, 25 bp, Mus musculus
ccctttctgtggagacggagtcgca

SEQ ID NO: 20367 - DNA, 25 bp, Mus musculus
ccctttgatgccaagagcgacctca

SEQ ID NO: 20368 - DNA, 25 bp, Mus musculus
ccctttgctggagaagactgatcac

SEQ ID NO: 20369 - DNA, 25 bp, Mus musculus
ccctttgttggtgggaagtctgtgc

SEQ ID NO: 20370 - DNA, 25 bp, Mus musculus
cccttttcgactacgcagtgacggg

SEQ ID NO: 20371 - DNA, 25 bp, Mus musculus
cccttttctggatgctggaacctag

SEQ ID NO: 20372 - DNA, 25 bp, Mus musculus
cccttttgggacatcattcttctga

SEQ ID NO: 20373 - DNA, 25 bp, Mus musculus
cccttttgggcctttatcttgcatt

SEQ ID NO: 20374 - DNA, 25 bp, Mus musculus
ccctttttagcaatggctggcccag

SEQ ID NO: 20375 - DNA, 25 bp, Mus musculus
ccgaaaacaagatgcttcagagaag

SEQ ID NO: 20376 - DNA, 25 bp, Mus musculus
ccgaaaagaattagaaagtcgagct

SEQ ID NO: 20377 - DNA, 25 bp, Mus musculus
ccgaaaccacctcgaaggcagggag

SEQ ID NO: 20378 - DNA, 25 bp, Mus musculus
ccgaaactaatctggcaggaatgta

SEQ ID NO: 20379 - DNA, 25 bp, Mus musculus
ccgaaagcctatcagcatagtgaag

SEQ ID NO: 20380 - DNA, 25 bp, Mus musculus
ccgaaagcgtgtttgcaaatgtccc

SEQ ID NO: 20381 - DNA, 25 bp, Mus musculus
ccgaaagtccagaaatgagtggcaa

SEQ ID NO: 20382 - DNA, 25 bp, Mus musculus
ccgaaatggatggaacgtggaatat

SEQ ID NO: 20383 - DNA, 25 bp, Mus musculus
ccgaaatttcattaccagaagtaga

SEQ ID NO: 20384 - DNA, 25 bp, Mus musculus
ccgaacagtcggaggagacctggta

SEQ ID NO: 20385 - DNA, 25 bp, Mus musculus
ccgaacccagcacaagatgagaaga

SEQ ID NO: 20386 - DNA, 25 bp, Mus musculus
ccgaactgaacaaaccgatggaatc

SEQ ID NO: 20387 - DNA, 25 bp, Mus musculus
ccgaagacttcgttgacatggtaga

SEQ ID NO: 20388 - DNA, 25 bp, Mus musculus
ccgaagagtatatggtgtggaagac

SEQ ID NO: 20389 - DNA, 25 bp, Mus musculus
ccgaagatttttggaggtgagatca

SEQ ID NO: 20390 - DNA, 25 bp, Mus musculus
ccgaagcaagcccaaggtggttact

SEQ ID NO: 20391 - DNA, 25 bp, Mus musculus
ccgaagggaaggtcagagcgcacct

SEQ ID NO: 20392 - DNA, 25 bp, Mus musculus
ccgaagggaggagcactttcacttc

SEQ ID NO: 20393 - DNA, 25 bp, Mus musculus
ccgaagggcggaagtccttgccaag

SEQ ID NO: 20394 - DNA, 25 bp, Mus musculus
ccgaagtaccctgattgtggtggtt

SEQ ID NO: 20395 - DNA, 25 bp, Mus musculus
ccgaagtccagggagctcagaaaag

SEQ ID NO: 20396 - DNA, 25 bp, Mus musculus
ccgaagtgtcagtgacttggatccc

SEQ ID NO: 20397 - DNA, 25 bp, Mus musculus
ccgaatctccccttttgggacatca

SEQ ID NO: 20398 - DNA, 25 bp, Mus musculus
ccgaatctctgtgcgggagccgatg

SEQ ID NO: 20399 - DNA, 25 bp, Mus musculus
ccgaatgaagaccacgaccaagaag

SEQ ID NO: 20400 - DNA, 25 bp, Mus musculus
ccgaatgcacaagtgtcaagaccta

SEQ ID NO: 20401 - DNA, 25 bp, Mus musculus
ccgaatggccctgcggaaaacagga

SEQ ID NO: 20402 - DNA, 25 bp, Mus musculus
ccgaatggcttttttgcgaactgca

SEQ ID NO: 20403 - DNA, 25 bp, Mus musculus
ccgaattcctggactggttggttca

SEQ ID NO: 20404 - DNA, 25 bp, Mus musculus
ccgacaaagggataactcacaccac

SEQ ID NO: 20405 - DNA, 25 bp, Mus musculus
ccgacaaccacaagtttaagcagtt

SEQ ID NO: 20406 - DNA, 25 bp, Mus musculus
ccgacaaggaaatggaggtgcttca

SEQ ID NO: 20407 - DNA, 25 bp, Mus musculus
ccgacaatcagatgaaaacaaccta

SEQ ID NO: 20408 - DNA, 25 bp, Mus musculus
ccgacactgggtggcgatgctgaaa

SEQ ID NO: 20409 - DNA, 25 bp, Mus musculus
ccgacagccttgtctaccagatctt

SEQ ID NO: 20410 - DNA, 25 bp, Mus musculus
ccgacagctctgtccggatgacatc

SEQ ID NO: 20411 - DNA, 25 bp, Mus musculus
ccgacagtcccgtcgttatgactgg

SEQ ID NO: 20412 - DNA, 25 bp, Mus musculus
ccgacatcctgtccgtgagccagtt

SEQ ID NO: 20413 - DNA, 25 bp, Mus musculus
ccgaccaggtacagggcaccgtgga

SEQ ID NO: 20414 - DNA, 25 bp, Mus musculus
ccgacccagaggaggctacgaggtt

SEQ ID NO: 20415 - DNA, 25 bp, Mus musculus
ccgacctgagtagtgagtggagaaa

SEQ ID NO: 20416 - DNA, 25 bp, Mus musculus
ccgacgcaggcttcagtggctgctg

SEQ ID NO: 20417 - DNA, 25 bp, Mus musculus
ccgacgcaggtggtcacgtgcttga

SEQ ID NO: 20418 - DNA, 25 bp, Mus musculus
ccgacgccgggctgtcattctgaaa

SEQ ID NO: 20419 - DNA, 25 bp, Mus musculus
ccgacgtaagttggcgttccgctca

SEQ ID NO: 20420 - DNA, 25 bp, Mus musculus
ccgacgtttatgtgctatgtgccca

SEQ ID NO: 20421 - DNA, 25 bp, Mus musculus
ccgactacgtccctcgttagtgtgg

SEQ ID NO: 20422 - DNA, 25 bp, Mus musculus
ccgactactgttggttatctggtgt

SEQ ID NO: 20423 - DNA, 25 bp, Mus musculus
ccgactcgcttatgctggctgagca

SEQ ID NO: 20424 - DNA, 25 bp, Mus musculus
ccgacttggaggagccacctctaaa

SEQ ID NO: 20425 - DNA, 25 bp, Mus musculus
ccgagaaatcgacgccttggccgtg

SEQ ID NO: 20426 - DNA, 25 bp, Mus musculus
ccgagaagctcgttatccattgcaa

SEQ ID NO: 20427 - DNA, 25 bp, Mus musculus
ccgagacaacgaagctcttgcgcca

SEQ ID NO: 20428 - DNA, 25 bp, Mus musculus
ccgagactggccaggcttagagcct

SEQ ID NO: 20429 - DNA, 25 bp, Mus musculus
ccgagagagaagttatcagtgcccc

SEQ ID NO: 20430 - DNA, 25 bp, Mus musculus
ccgagagatggatgaacagatcaga

SEQ ID NO: 20431 - DNA, 25 bp, Mus musculus
ccgagagcaggtgaaggagctcttc

SEQ ID NO: 20432 - DNA, 25 bp, Mus musculus
ccgagatcttagtaagccagtggga

SEQ ID NO: 20433 - DNA, 25 bp, Mus musculus
ccgagattgcaaactatgaggcctg

SEQ ID NO: 20434 - DNA, 25 bp, Mus musculus
ccgagcagttggcaggctaaaaaga

SEQ ID NO: 20435 - DNA, 25 bp, Mus musculus
ccgagccacccgatgatgtcattgc

SEQ ID NO: 20436 - DNA, 25 bp, Mus musculus
ccgagccagggaaagcgtggagctg

SEQ ID NO: 20437 - DNA, 25 bp, Mus musculus
ccgagcctgctctgactccttggaa

SEQ ID NO: 20438 - DNA, 25 bp, Mus musculus
ccgagcgcgcagactttcgaggagc

SEQ ID NO: 20439 - DNA, 25 bp, Mus musculus
ccgagcgcgcagtctttcgaggagc

SEQ ID NO: 20440 - DNA, 25 bp, Mus musculus
ccgagcggctcagtgaattggagca

SEQ ID NO: 20441 - DNA, 25 bp, Mus musculus
ccgagcggctgctcagagaattagc

SEQ ID NO: 20442 - DNA, 25 bp, Mus musculus
ccgagcgtccttacttcagaacgaa

SEQ ID NO: 20443 - DNA, 25 bp, Mus musculus
ccgagctggaattcgcgcagatcct

SEQ ID NO: 20444 - DNA, 25 bp, Mus musculus
ccgagctggagtatgggagtcccta

SEQ ID NO: 20445 - DNA, 25 bp, Mus musculus
ccgagcttccagaaatcctgcagaa

SEQ ID NO: 20446 - DNA, 25 bp, Mus musculus
ccgaggaattcctggatccccaggg

SEQ ID NO: 20447 - DNA, 25 bp, Mus musculus
ccgaggagagactcagcccagagag

SEQ ID NO: 20448 - DNA, 25 bp, Mus musculus
ccgaggatacaagcagcagctggtc

SEQ ID NO: 20449 - DNA, 25 bp, Mus musculus
ccgaggatggacttgtacacacaaa

SEQ ID NO: 20450 - DNA, 25 bp, Mus musculus
ccgaggcatgcaccaagcagaggca

SEQ ID NO: 20451 - DNA, 25 bp, Mus musculus
ccgaggcatgcagcaagcagaggca

SEQ ID NO: 20452 - DNA, 25 bp, Mus musculus
ccgaggctcgagagatccggatgaa

SEQ ID NO: 20453 - DNA, 25 bp, Mus musculus
ccgagggcaccataagggaagagca

SEQ ID NO: 20454 - DNA, 25 bp, Mus musculus
ccgagggcacccttaatgagacaag

SEQ ID NO: 20455 - DNA, 25 bp, Mus musculus
ccgagggtgtccaagagcttcctga

SEQ ID NO: 20456 - DNA, 25 bp, Mus musculus
ccgaggtacacttttgcaccaagcg

SEQ ID NO: 20457 - DNA, 25 bp, Mus musculus
ccgaggtcacagtacctacctcaaa

SEQ ID NO: 20458 - DNA, 25 bp, Mus musculus
ccgaggtctctataaacaaggacaa

SEQ ID NO: 20459 - DNA, 25 bp, Mus musculus
ccgaggtgcagtcaaagccatagcc

SEQ ID NO: 20460 - DNA, 25 bp, Mus musculus
ccgagtaagaagacatacaaaagcc

SEQ ID NO: 20461 - DNA, 25 bp, Mus musculus
ccgagtatgagttgccagaggatcc

SEQ ID NO: 20462 - DNA, 25 bp, Mus musculus
ccgagtctggaaagtcaagtttgtg

SEQ ID NO: 20463 - DNA, 25 bp, Mus musculus
ccgagtgaatgtggccgaggtcctt

SEQ ID NO: 20464 - DNA, 25 bp, Mus musculus
ccgagttgaatgtgagtagttctga

SEQ ID NO: 20465 - DNA, 25 bp, Mus musculus
ccgagttgccattcttctagttaag

SEQ ID NO: 20466 - DNA, 25 bp, Mus musculus
ccgagtttgaagtgtgttgacctgg

SEQ ID NO: 20467 - DNA, 25 bp, Mus musculus
ccgatcaacagtgctaatcgagata

SEQ ID NO: 20468 - DNA, 25 bp, Mus musculus
ccgatcacatagcaagaatcccaaa

SEQ ID NO: 20469 - DNA, 25 bp, Mus musculus
ccgatcatggaagcttgacaacctg

SEQ ID NO: 20470 - DNA, 25 bp, Mus musculus
ccgatcgccaatggtgagctttgga

SEQ ID NO: 20471 - DNA, 25 bp, Mus musculus
ccgatctgtctgtcaaaaccaaaga

SEQ ID NO: 20472 - DNA, 25 bp, Mus musculus
ccgatgaatgtgaactgtttgggcc

SEQ ID NO: 20473 - DNA, 25 bp, Mus musculus
ccgatgaatgtgtactgtttgggcc

SEQ ID NO: 20474 - DNA, 25 bp, Mus musculus
ccgatgactgcggtggagatccagc

SEQ ID NO: 20475 - DNA, 25 bp, Mus musculus
ccgatgagatggaaatgcactttat

SEQ ID NO: 20476 - DNA, 25 bp, Mus musculus
ccgatgagcaagaagtgactctagt

SEQ ID NO: 20477 - DNA, 25 bp, Mus musculus
ccgatgaggatgattccaccagcag

SEQ ID NO: 20478 - DNA, 25 bp, Mus musculus
ccgatgccagcaagcagcggctgat

SEQ ID NO: 20479 - DNA, 25 bp, Mus musculus
ccgatgctgtgacctcgatctttaa

SEQ ID NO: 20480 - DNA, 25 bp, Mus musculus
ccgatggatatgaatgggaccccat

SEQ ID NO: 20481 - DNA, 25 bp, Mus musculus
ccgatggattcacctttcatgttga

SEQ ID NO: 20482 - DNA, 25 bp, Mus musculus
ccgatggattcctctcataaatgaa

SEQ ID NO: 20483 - DNA, 25 bp, Mus musculus
ccgatgggacccagacaagactgga

SEQ ID NO: 20484 - DNA, 25 bp, Mus musculus
ccgatgttgtcgacagtaggctcat

SEQ ID NO: 20485 - DNA, 25 bp, Mus musculus
ccgattctgtagttgggtggaccag

SEQ ID NO: 20486 - DNA, 25 bp, Mus musculus
ccgatttctagaggggaagcgtgct

SEQ ID NO: 20487 - DNA, 25 bp, Mus musculus
ccgcaagatctggtgctttggccct

SEQ ID NO: 20488 - DNA, 25 bp, Mus musculus
ccgcaaggtgaaacatgagtctcgt

SEQ ID NO: 20489 - DNA, 25 bp, Mus musculus
ccgcacacctggttcatgagttaag

SEQ ID NO: 20490 - DNA, 25 bp, Mus musculus
ccgcacactcttgataggttttgaa

SEQ ID NO: 20491 - DNA, 25 bp, Mus musculus
ccgcaccagagaggagatcaatgag

SEQ ID NO: 20492 - DNA, 25 bp, Mus musculus
ccgcactctggtatatggagggatc

SEQ ID NO: 20493 - DNA, 25 bp, Mus musculus
ccgcacttgagaagggctgcagctt

SEQ ID NO: 20494 - DNA, 25 bp, Mus musculus
ccgcaggaagctgaaaacgggttct

SEQ ID NO: 20495 - DNA, 25 bp, Mus musculus
ccgcaggattgcgaagttctctgac

SEQ ID NO: 20496 - DNA, 25 bp, Mus musculus
ccgcaggctgcaaggagcaacagcg

SEQ ID NO: 20497 - DNA, 25 bp, Mus musculus
ccgcatagccctggtatcagaagca

SEQ ID NO: 20498 - DNA, 25 bp, Mus musculus
ccgcatcagtcgcttggccagcttt

SEQ ID NO: 20499 - DNA, 25 bp, Mus musculus
ccgcatcatgaaagcacgaaaagtg

SEQ ID NO: 20500 - DNA, 25 bp, Mus musculus
ccgcatgacaaacgcaaagtggcca

SEQ ID NO: 20501 - DNA, 25 bp, Mus musculus
ccgcatgcctgcagcgtttagcctt

SEQ ID NO: 20502 - DNA, 25 bp, Mus musculus
ccgccaagactgatgcggaggccga

SEQ ID NO: 20503 - DNA, 25 bp, Mus musculus
ccgccacaagcctgggaagtttgaa

SEQ ID NO: 20504 - DNA, 25 bp, Mus musculus
ccgccactcgataagtatgcctgtc

SEQ ID NO: 20505 - DNA, 25 bp, Mus musculus
ccgccagcagattgacggccgtggt

SEQ ID NO: 20506 - DNA, 25 bp, Mus musculus
ccgccattaccgagaacaccagaag

SEQ ID NO: 20507 - DNA, 25 bp, Mus musculus
ccgccgaaagaccaggtatgatcgc

SEQ ID NO: 20508 - DNA, 25 bp, Mus musculus
ccgccgcgcatgcaactggcatata

SEQ ID NO: 20509 - DNA, 25 bp, Mus musculus
ccgccggaagcccaactatagcgag

SEQ ID NO: 20510 - DNA, 25 bp, Mus musculus
ccgccggaagccgaactatagcgag

SEQ ID NO: 20511 - DNA, 25 bp, Mus musculus
ccgccgggcctgcatcaattgagcg

SEQ ID NO: 20512 - DNA, 25 bp, Mus musculus
ccgcctattatctaaggaagaaatt

SEQ ID NO: 20513 - DNA, 25 bp, Mus musculus
ccgcctcactaactgttgtgaaatt

SEQ ID NO: 20514 - DNA, 25 bp, Mus musculus
ccgcctgcattgagctggagcagca

SEQ ID NO: 20515 - DNA, 25 bp, Mus musculus
ccgcctgcatttttctccgaaaggg

SEQ ID NO: 20516 - DNA, 25 bp, Mus musculus
ccgcctgggtggcaaaaggtatcca

SEQ ID NO: 20517 - DNA, 25 bp, Mus musculus
ccgccttcactaggatattgtgtag

SEQ ID NO: 20518 - DNA, 25 bp, Mus musculus
ccgccttgtccctggctggaccaag

SEQ ID NO: 20519 - DNA, 25 bp, Mus musculus
ccgcggacagagctactgatgccaa

SEQ ID NO: 20520 - DNA, 25 bp, Mus musculus
ccgcgggcatggagaacctcattag

SEQ ID NO: 20521 - DNA, 25 bp, Mus musculus
ccgctaaaaccctggaaatgctcca

SEQ ID NO: 20522 - DNA, 25 bp, Mus musculus
ccgctaatcaagaacttcttctgag

SEQ ID NO: 20523 - DNA, 25 bp, Mus musculus
ccgctagaagagattgttgacaact

SEQ ID NO: 20524 - DNA, 25 bp, Mus musculus
ccgctataatgaggatgatgcaaag

SEQ ID NO: 20525 - DNA, 25 bp, Mus musculus
ccgctccatgattctgtagccctag

SEQ ID NO: 20526 - DNA, 25 bp, Mus musculus
ccgctctgtggttcggacggccgaa

SEQ ID NO: 20527 - DNA, 25 bp, Mus musculus
ccgctcttggtgttatgtgaagacc

SEQ ID NO: 20528 - DNA, 25 bp, Mus musculus
ccgctgaaagtgaggttctgtacca

SEQ ID NO: 20529 - DNA, 25 bp, Mus musculus
ccgctgagacggaagacattgccat

SEQ ID NO: 20530 - DNA, 25 bp, Mus musculus
ccgctgcatcatgggacaggaacag

SEQ ID NO: 20531 - DNA, 25 bp, Mus musculus
ccgctgctactgacactatgtttct

SEQ ID NO: 20532 - DNA, 25 bp, Mus musculus
ccgctgctgatgtccagaggagtag

SEQ ID NO: 20533 - DNA, 25 bp, Mus musculus
ccgctggaactgttgcagcctctct

SEQ ID NO: 20534 - DNA, 25 bp, Mus musculus
ccgctggctgggaagagtcggagct

SEQ ID NO: 20535 - DNA, 25 bp, Mus musculus
ccgctgtcgagtgcggagggccaaa

SEQ ID NO: 20536 - DNA, 25 bp, Mus musculus
ccgctgtctcctccatcccattata

SEQ ID NO: 20537 - DNA, 25 bp, Mus musculus
ccgctgtgcggcttattaccctaga

SEQ ID NO: 20538 - DNA, 25 bp, Mus musculus
ccgctgttttagagacaagcactcc

SEQ ID NO: 20539 - DNA, 25 bp, Mus musculus
ccgcttataaatgcctttgctcctg

SEQ ID NO: 20540 - DNA, 25 bp, Mus musculus
ccgcttcaccaaatatcaatgtggg

SEQ ID NO: 20541 - DNA, 25 bp, Mus musculus
ccgcttccgctgcaatggatttgag

SEQ ID NO: 20542 - DNA, 25 bp, Mus musculus
ccgcttctctcctggaagctcttga

SEQ ID NO: 20543 - DNA, 25 bp, Mus musculus
ccgctttcattgctccctcttggaa

SEQ ID NO: 20544 - DNA, 25 bp, Mus musculus
ccgctttgaggaatatgagtggtgt

SEQ ID NO: 20545 - DNA, 25 bp, Mus musculus
ccggaaaatgtaatgcagagtaaag

SEQ ID NO: 20546 - DNA, 25 bp, Mus musculus
ccggaaacattgctgtgaatggtta

SEQ ID NO: 20547 - DNA, 25 bp, Mus musculus
ccggaaagacatgccaggaaagaca

SEQ ID NO: 20548 - DNA, 25 bp, Mus musculus
ccggaaagccagtgccacatgcagt

SEQ ID NO: 20549 - DNA, 25 bp, Mus musculus
ccggaaatggcagcgggctctaaat

SEQ ID NO: 20550 - DNA, 25 bp, Mus musculus
ccggaaattgcagtccctgagctgg

SEQ ID NO: 20551 - DNA, 25 bp, Mus musculus
ccggaacaaggcagcgtgaacacag

SEQ ID NO: 20552 - DNA, 25 bp, Mus musculus
ccggaaccgtgtgctaggctggtcc

SEQ ID NO: 20553 - DNA, 25 bp, Mus musculus
ccggaagaggcaatagatgccctga

SEQ ID NO: 20554 - DNA, 25 bp, Mus musculus
ccggaagaggcattagatgccctga

SEQ ID NO: 20555 - DNA, 25 bp, Mus musculus
ccggaagcaaaaggacattgacaaa

SEQ ID NO: 20556 - DNA, 25 bp, Mus musculus
ccggaagcagcttgtgaagaacgaa

SEQ ID NO: 20557 - DNA, 25 bp, Mus musculus
ccggaagcagtgagaggaacagctc

SEQ ID NO: 20558 - DNA, 25 bp, Mus musculus
ccggaagccagaaactttccctcag

SEQ ID NO: 20559 - DNA, 25 bp, Mus musculus
ccggaagccccaagtctgcagtgaa

SEQ ID NO: 20560 - DNA, 25 bp, Mus musculus
ccggaatgcccaggtatcactgtta

SEQ ID NO: 20561 - DNA, 25 bp, Mus musculus
ccggacacagagacgctgagctgag

SEQ ID NO: 20562 - DNA, 25 bp, Mus musculus
ccggaccctccaggaagagcgggat

SEQ ID NO: 20563 - DNA, 25 bp, Mus musculus
ccggacgttggtgagcaccaagcag

SEQ ID NO: 20564 - DNA, 25 bp, Mus musculus
ccggactgtgatagtacttggcgga

SEQ ID NO: 20565 - DNA, 25 bp, Mus musculus
ccggagacagcccagtaagtctacg

SEQ ID NO: 20566 - DNA, 25 bp, Mus musculus
ccggagactgcgtgtactggaagct

SEQ ID NO: 20567 - DNA, 25 bp, Mus musculus
ccggagacttcctcctctctggtgc

SEQ ID NO: 20568 - DNA, 25 bp, Mus musculus
ccggagccaaaattagcttggaatt

SEQ ID NO: 20569 - DNA, 25 bp, Mus musculus
ccggagctcctgaagcgcagcctgt

SEQ ID NO: 20570 - DNA, 25 bp, Mus musculus
ccggagctgcgggaagtattccaga

SEQ ID NO: 20571 - DNA, 25 bp, Mus musculus
ccggagctggctcgtctgtaccgca

SEQ ID NO: 20572 - DNA, 25 bp, Mus musculus
ccggaggatggacgatgactcctta

SEQ ID NO: 20573 - DNA, 25 bp, Mus musculus
ccggagggaccttctggagtacata

SEQ ID NO: 20574 - DNA, 25 bp, Mus musculus
ccggaggttttaccgagagcatgaa

SEQ ID NO: 20575 - DNA, 25 bp, Mus musculus
ccggagttactgtgcgctggacctt

SEQ ID NO: 20576 - DNA, 25 bp, Mus musculus
ccggataccaacattcaatgttcag

SEQ ID NO: 20577 - DNA, 25 bp, Mus musculus
ccggataccccgcttctactgggag

SEQ ID NO: 20578 - DNA, 25 bp, Mus musculus
ccggataggtagcactgggcttctt

SEQ ID NO: 20579 - DNA, 25 bp, Mus musculus
ccggatcactagaagaacctctacc

SEQ ID NO: 20580 - DNA, 25 bp, Mus musculus
ccggatcttccgtgtgacctcagtt

SEQ ID NO: 20581 - DNA, 25 bp, Mus musculus
ccggatgaagataggagacccaaag

SEQ ID NO: 20582 - DNA, 25 bp, Mus musculus
ccggatgctgctgctgaagggcttt

SEQ ID NO: 20583 - DNA, 25 bp, Mus musculus
ccggatggagctaaaggcggatcag

SEQ ID NO: 20584 - DNA, 25 bp, Mus musculus
ccggatgttgctacaacaggatctt

SEQ ID NO: 20585 - DNA, 25 bp, Mus musculus
ccggattatggaactggagagctgc

SEQ ID NO: 20586 - DNA, 25 bp, Mus musculus
ccggatttggcgttcgaggccattg

SEQ ID NO: 20587 - DNA, 25 bp, Mus musculus
ccggcaaaaggagtcatcaggactt

SEQ ID NO: 20588 - DNA, 25 bp, Mus musculus
ccggcaactggaggaaccttcatcg

SEQ ID NO: 20589 - DNA, 25 bp, Mus musculus
ccggcaagagtcagtatcttctggg

SEQ ID NO: 20590 - DNA, 25 bp, Mus musculus
ccggcagaagatcgtagagctagct

SEQ ID NO: 20591 - DNA, 25 bp, Mus musculus
ccggcagatggcactcagcctggag

SEQ ID NO: 20592 - DNA, 25 bp, Mus musculus
ccggcagcagcaagacgctggctgt

SEQ ID NO: 20593 - DNA, 25 bp, Mus musculus
ccggcagctccgacagcagatgctg

SEQ ID NO: 20594 - DNA, 25 bp, Mus musculus
ccggcaggcactcagctcttcatga

SEQ ID NO: 20595 - DNA, 25 bp, Mus musculus
ccggcatcctggcagccttgagtgc

SEQ ID NO: 20596 - DNA, 25 bp, Mus musculus
ccggccagcgcaaaaatctccggtg

SEQ ID NO: 20597 - DNA, 25 bp, Mus musculus
ccggccagcgcataaatctccggtg

SEQ ID NO: 20598 - DNA, 25 bp, Mus musculus
ccggccagtggctgccgcatggaac

SEQ ID NO: 20599 - DNA, 25 bp, Mus musculus
ccggcccaggtgcattgccaagctt

SEQ ID NO: 20600 - DNA, 25 bp, Mus musculus
ccggccgtgcgacatttcccgaatt

SEQ ID NO: 20601 - DNA, 25 bp, Mus musculus
ccggcctcgccctgtgttggacatt

SEQ ID NO: 20602 - DNA, 25 bp, Mus musculus
ccggcctctcagaaggtacttgact

SEQ ID NO: 20603 - DNA, 25 bp, Mus musculus
ccggcctctgtcagtgtttggtttg

SEQ ID NO: 20604 - DNA, 25 bp, Mus musculus
ccggcctgagctaagtcagctggac

SEQ ID NO: 20605 - DNA, 25 bp, Mus musculus
ccggcctgcctttgactcattgctg

SEQ ID NO: 20606 - DNA, 25 bp, Mus musculus
ccggcgacagtgtttgttttactct

SEQ ID NO: 20607 - DNA, 25 bp, Mus musculus
ccggcgacgcgtgctgtgctaagta

SEQ ID NO: 20608 - DNA, 25 bp, Mus musculus
ccggcggcgtgtgaatggcggcctc

SEQ ID NO: 20609 - DNA, 25 bp, Mus musculus
ccggcggtttcatggacatgtttgg

SEQ ID NO: 20610 - DNA, 25 bp, Mus musculus
ccggcgtgtgtacaagtccctctgt

SEQ ID NO: 20611 - DNA, 25 bp, Mus musculus
ccggctcaccagtctgcggatgcag

SEQ ID NO: 20612 - DNA, 25 bp, Mus musculus
ccggctcattgattatgagaaaatg

SEQ ID NO: 20613 - DNA, 25 bp, Mus musculus
ccggctccaagtaccgggcagctgg

SEQ ID NO: 20614 - DNA, 25 bp, Mus musculus
ccggctctgaaatcaggctcagcgg

SEQ ID NO: 20615 - DNA, 25 bp, Mus musculus
ccggctgctggaaaataagattggt

SEQ ID NO: 20616 - DNA, 25 bp, Mus musculus
ccggctgggagagcatgaatttgaa

SEQ ID NO: 20617 - DNA, 25 bp, Mus musculus
ccggcttcggcaagagctagatgaa

SEQ ID NO: 20618 - DNA, 25 bp, Mus musculus
ccgggaaagagacgtcacccaatag

SEQ ID NO: 20619 - DNA, 25 bp, Mus musculus
ccgggaagaaattccaatgagcaat

SEQ ID NO: 20620 - DNA, 25 bp, Mus musculus
ccgggaagccactgcgcatgtcgga

SEQ ID NO: 20621 - DNA, 25 bp, Mus musculus
ccgggacaatcaggggcgacttcag

SEQ ID NO: 20622 - DNA, 25 bp, Mus musculus
ccgggacaccatgcagatcattcta

SEQ ID NO: 20623 - DNA, 25 bp, Mus musculus
ccgggacacccacccttagctgact

SEQ ID NO: 20624 - DNA, 25 bp, Mus musculus
ccgggaccatgctgagcagcagcac

SEQ ID NO: 20625 - DNA, 25 bp, Mus musculus
ccgggactgtaaggaagcataccat

SEQ ID NO: 20626 - DNA, 25 bp, Mus musculus
ccgggagcaggagcctctaaaggct

SEQ ID NO: 20627 - DNA, 25 bp, Mus musculus
ccgggagcggaacatattgttcacc

SEQ ID NO: 20628 - DNA, 25 bp, Mus musculus
ccgggataccgacagacataggaag

SEQ ID NO: 20629 - DNA, 25 bp, Mus musculus
ccgggatatggtccgtgttctcatc

SEQ ID NO: 20630 - DNA, 25 bp, Mus musculus
ccgggatgtactgggtgaaacacag

SEQ ID NO: 20631 - DNA, 25 bp, Mus musculus
ccgggccagattaagtaacttagca

SEQ ID NO: 20632 - DNA, 25 bp, Mus musculus
ccgggccagatttagtaacttagca

SEQ ID NO: 20633 - DNA, 25 bp, Mus musculus
ccgggcctgcatcaattgagcgagt

SEQ ID NO: 20634 - DNA, 25 bp, Mus musculus
ccgggctcatcttgtactcacaaag

SEQ ID NO: 20635 - DNA, 25 bp, Mus musculus
ccgggctccgagactcagcgtaggc

SEQ ID NO: 20636 - DNA, 25 bp, Mus musculus
ccgggctctgtgaggttattcgagt

SEQ ID NO: 20637 - DNA, 25 bp, Mus musculus
ccgggctgtcattctgaaattcagt

SEQ ID NO: 20638 - DNA, 25 bp, Mus musculus
ccgggctttcatttttatgctgacc

SEQ ID NO: 20639 - DNA, 25 bp, Mus musculus
ccgggtagaaatgcttttggctgca

SEQ ID NO: 20640 - DNA, 25 bp, Mus musculus
ccgggtagttaaagacatggcaact

SEQ ID NO: 20641 - DNA, 25 bp, Mus musculus
ccgggtctgctgagtccgcagcact

SEQ ID NO: 20642 - DNA, 25 bp, Mus musculus
ccgggtgtgaatttcgactttctcg

SEQ ID NO: 20643 - DNA, 25 bp, Mus musculus
ccgggttcaagaatgcagagcttaa

SEQ ID NO: 20644 - DNA, 25 bp, Mus musculus
ccgggttcctggatcaggaagagct

SEQ ID NO: 20645 - DNA, 25 bp, Mus musculus
ccggtaagatcaagtgcctattgaa

SEQ ID NO: 20646 - DNA, 25 bp, Mus musculus
ccggtaagtgcgagcagcaccgtgt

SEQ ID NO: 20647 - DNA, 25 bp, Mus musculus
ccggtacccacacagaagcgatggt

SEQ ID NO: 20648 - DNA, 25 bp, Mus musculus
ccggtataaaatggtggtgcaagtg

SEQ ID NO: 20649 - DNA, 25 bp, Mus musculus
ccggtatctttacttccaccttcag

SEQ ID NO: 20650 - DNA, 25 bp, Mus musculus
ccggtcattctcacccagatagaga

SEQ ID NO: 20651 - DNA, 25 bp, Mus musculus
ccggtccaagatcacattcctctta

SEQ ID NO: 20652 - DNA, 25 bp, Mus musculus
ccggtgcatctgtcctgcaggttca

SEQ ID NO: 20653 - DNA, 25 bp, Mus musculus
ccggtgccactatgttcccaagaca

SEQ ID NO: 20654 - DNA, 25 bp, Mus musculus
ccggtgccatttgttccctggtttg

SEQ ID NO: 20655 - DNA, 25 bp, Mus musculus
ccggtgctatgctggctcaggagca

SEQ ID NO: 20656 - DNA, 25 bp, Mus musculus
ccggtggcacagtcttcttccttga

SEQ ID NO: 20657 - DNA, 25 bp, Mus musculus
ccggtggcctgcacacagaggcttc

SEQ ID NO: 20658 - DNA, 25 bp, Mus musculus
ccggtggcgatctttgggagaccaa

SEQ ID NO: 20659 - DNA, 25 bp, Mus musculus
ccggtggtgcccatgcagaggcaaa

SEQ ID NO: 20660 - DNA, 25 bp, Mus musculus
ccggtggtgcccttgcagaggcaaa

SEQ ID NO: 20661 - DNA, 25 bp, Mus musculus
ccggtgtccaatgtgctgtccttac

SEQ ID NO: 20662 - DNA, 25 bp, Mus musculus
ccggtgtgaaaaaggcaatacttga

SEQ ID NO: 20663 - DNA, 25 bp, Mus musculus
ccggttactgcaggaagctgtgaag

SEQ ID NO: 20664 - DNA, 25 bp, Mus musculus
ccggttataccaaagctgtgctgac

SEQ ID NO: 20665 - DNA, 25 bp, Mus musculus
ccggttgctacctgatgacatgaag

SEQ ID NO: 20666 - DNA, 25 bp, Mus musculus
ccgtaagaaggatgacaggattgaa

SEQ ID NO: 20667 - DNA, 25 bp, Mus musculus
ccgtaagaatgccagcaacatggag

SEQ ID NO: 20668 - DNA, 25 bp, Mus musculus
ccgtaagctggtcatcatcgagagc

SEQ ID NO: 20669 - DNA, 25 bp, Mus musculus
ccgtacagattgagaataccgttct

SEQ ID NO: 20670 - DNA, 25 bp, Mus musculus
ccgtagatttccagtggccccattg

SEQ ID NO: 20671 - DNA, 25 bp, Mus musculus
ccgtagctctgctgcaatgtgctta

SEQ ID NO: 20672 - DNA, 25 bp, Mus musculus
ccgtaggcaaggacaaggacaaagc

SEQ ID NO: 20673 - DNA, 25 bp, Mus musculus
ccgtaggcggtagcagtttgcacga

SEQ ID NO: 20674 - DNA, 25 bp, Mus musculus
ccgtcagcctgacagagttagatat

SEQ ID NO: 20675 - DNA, 25 bp, Mus musculus
ccgtcagctacatctggtgtctgta

SEQ ID NO: 20676 - DNA, 25 bp, Mus musculus
ccgtcagtcaggctgtgcttagtaa

SEQ ID NO: 20677 - DNA, 25 bp, Mus musculus
ccgtccaggccgaggcttacataaa

SEQ ID NO: 20678 - DNA, 25 bp, Mus musculus
ccgtcccaacgatgaggcctgcgtg

SEQ ID NO: 20679 - DNA, 25 bp, Mus musculus
ccgtcccaacttccttctaggagtg

SEQ ID NO: 20680 - DNA, 25 bp, Mus musculus
ccgtccctacatggcatattatgag

SEQ ID NO: 20681 - DNA, 25 bp, Mus musculus
ccgtcctgccaacatcgagtctata

SEQ ID NO: 20682 - DNA, 25 bp, Mus musculus
ccgtcgctcagtacagttgatggaa

SEQ ID NO: 20683 - DNA, 25 bp, Mus musculus
ccgtcgggaaatgacggatgtgatt

SEQ ID NO: 20684 - DNA, 25 bp, Mus musculus
ccgtcgtatcctgaacaaggctacg

SEQ ID NO: 20685 - DNA, 25 bp, Mus musculus
ccgtcgtcgtccctgtgaagaaaga

SEQ ID NO: 20686 - DNA, 25 bp, Mus musculus
ccgtcgtgggattgtgctgctgacc

SEQ ID NO: 20687 - DNA, 25 bp, Mus musculus
ccgtctaactgagcgtgctctgcaa

SEQ ID NO: 20688 - DNA, 25 bp, Mus musculus
ccgtctgaagacaatcctgaaacag

SEQ ID NO: 20689 - DNA, 25 bp, Mus musculus
ccgtctgacactggatcagggtagt

SEQ ID NO: 20690 - DNA, 25 bp, Mus musculus
ccgtcttcaaagaggtcaccagctc

SEQ ID NO: 20691 - DNA, 25 bp, Mus musculus
ccgtcttcaaagtggtcaccagctc

SEQ ID NO: 20692 - DNA, 25 bp, Mus musculus
ccgtcttcggaacaccctagtcatt

SEQ ID NO: 20693 - DNA, 25 bp, Mus musculus
ccgtcttttctccaaggcataccaa

SEQ ID NO: 20694 - DNA, 25 bp, Mus musculus
ccgtgaacctggtccaggatagaaa

SEQ ID NO: 20695 - DNA, 25 bp, Mus musculus
ccgtgaactaaatgcctttgaagaa

SEQ ID NO: 20696 - DNA, 25 bp, Mus musculus
ccgtgacgtcttacgaagatctggg

SEQ ID NO: 20697 - DNA, 25 bp, Mus musculus
ccgtgagcatccagtttcaggaaga

SEQ ID NO: 20698 - DNA, 25 bp, Mus musculus
ccgtgagtgtcaaggtgtatgaaag

SEQ ID NO: 20699 - DNA, 25 bp, Mus musculus
ccgtgagtgtcatggtgtatgaaag

SEQ ID NO: 20700 - DNA, 25 bp, Mus musculus
ccgtgatgccgtcaccaggaacatc

SEQ ID NO: 20701 - DNA, 25 bp, Mus musculus
ccgtgatgtggcatattcacctggg

SEQ ID NO: 20702 - DNA, 25 bp, Mus musculus
ccgtgcagaatatgtccggctggca

SEQ ID NO: 20703 - DNA, 25 bp, Mus musculus
ccgtgcagaccgctttgggccattt

SEQ ID NO: 20704 - DNA, 25 bp, Mus musculus
ccgtgcagctggaagacggcagcat

SEQ ID NO: 20705 - DNA, 25 bp, Mus musculus
ccgtgcaggcagcatcgtcttgaag

SEQ ID NO: 20706 - DNA, 25 bp, Mus musculus
ccgtgccaagcatagggcaagcgaa

SEQ ID NO: 20707 - DNA, 25 bp, Mus musculus
ccgtgccacaaaggagggacatgta

SEQ ID NO: 20708 - DNA, 25 bp, Mus musculus
ccgtgcggttccgtgtggatcgcaa

SEQ ID NO: 20709 - DNA, 25 bp, Mus musculus
ccgtgctttgacgaactcttctata

SEQ ID NO: 20710 - DNA, 25 bp, Mus musculus
ccgtggacccagatgcaggtggtca

SEQ ID NO: 20711 - DNA, 25 bp, Mus musculus
ccgtggacgacgtcaccaacgacta

SEQ ID NO: 20712 - DNA, 25 bp, Mus musculus
ccgtggagaagaaggcatactgcga

SEQ ID NO: 20713 - DNA, 25 bp, Mus musculus
ccgtggagcacgacaagttcattga

SEQ ID NO: 20714 - DNA, 25 bp, Mus musculus
ccgtggaggccacctaccggaacat

SEQ ID NO: 20715 - DNA, 25 bp, Mus musculus
ccgtggcagagatccatttcacata

SEQ ID NO: 20716 - DNA, 25 bp, Mus musculus
ccgtggcatctactgctgctgggag

SEQ ID NO: 20717 - DNA, 25 bp, Mus musculus
ccgtggctactttacctctctgtta

SEQ ID NO: 20718 - DNA, 25 bp, Mus musculus
ccgtggctgcttcactctggcttag

SEQ ID NO: 20719 - DNA, 25 bp, Mus musculus
ccgtgggaacaagatcgaaggatga

SEQ ID NO: 20720 - DNA, 25 bp, Mus musculus
ccgtggtgcgtgtggatggcagccc

SEQ ID NO: 20721 - DNA, 25 bp, Mus musculus
ccgtggtggatgactggattgaatt

SEQ ID NO: 20722 - DNA, 25 bp, Mus musculus
ccgtgtacgcggaggtggataccat

SEQ ID NO: 20723 - DNA, 25 bp, Mus musculus
ccgtgtagatgcagggaactcaacc

SEQ ID NO: 20724 - DNA, 25 bp, Mus musculus
ccgtgtcgaccagctaaagtatgat

SEQ ID NO: 20725 - DNA, 25 bp, Mus musculus
ccgtgtctggaataacgggtcctca

SEQ ID NO: 20726 - DNA, 25 bp, Mus musculus
ccgtgtgattgagctggagaagcat

SEQ ID NO: 20727 - DNA, 25 bp, Mus musculus
ccgtgtgctgcagttttgcctaaag

SEQ ID NO: 20728 - DNA, 25 bp, Mus musculus
ccgtgtgtcggatccccgtgttgga

SEQ ID NO: 20729 - DNA, 25 bp, Mus musculus
ccgtgttaggtattctaatgacatt

SEQ ID NO: 20730 - DNA, 25 bp, Mus musculus
ccgtgtttacgaggaaccctatgca

SEQ ID NO: 20731 - DNA, 25 bp, Mus musculus
ccgttacactgtgcgggccaagcgg

SEQ ID NO: 20732 - DNA, 25 bp, Mus musculus
ccgttctcgtgctgctgagataagt

SEQ ID NO: 20733 - DNA, 25 bp, Mus musculus
ccgttctgagctacacccggatcat

SEQ ID NO: 20734 - DNA, 25 bp, Mus musculus
ccgttgccgagagatggatgaacag

SEQ ID NO: 20735 - DNA, 25 bp, Mus musculus
ccgttgctagctaagaaacttctgg

SEQ ID NO: 20736 - DNA, 25 bp, Mus musculus
ccgttgtcagcacacagcgttcaca

SEQ ID NO: 20737 - DNA, 25 bp, Mus musculus
ccgttgtctatattacagttgtagc

SEQ ID NO: 20738 - DNA, 25 bp, Mus musculus
ccgtttgcagaacagtacacttatg

SEQ ID NO: 20739 - DNA, 25 bp, Mus musculus
ccgtttgctggaaggtgtgaggtca

SEQ ID NO: 20740 - DNA, 25 bp, Mus musculus
ccgtttttaagatcagtccagaaga

SEQ ID NO: 20741 - DNA, 25 bp, Mus musculus
cctaaaacaggacaacaaatatgcc

SEQ ID NO: 20742 - DNA, 25 bp, Mus musculus
cctaaaaccacagcaagtactggtg

SEQ ID NO: 20743 - DNA, 25 bp, Mus musculus
cctaaaatagactcagttctttgaa

SEQ ID NO: 20744 - DNA, 25 bp, Mus musculus
cctaaaatcgctgcatgtatgagaa

SEQ ID NO: 20745 - DNA, 25 bp, Mus musculus
cctaaaatgactgagctcttccaat

SEQ ID NO: 20746 - DNA, 25 bp, Mus musculus
cctaaacaatgcatttgaagtggct

SEQ ID NO: 20747 - DNA, 25 bp, Mus musculus
cctaaagagaacatgaggtgggacc

SEQ ID NO: 20748 - DNA, 25 bp, Mus musculus
cctaaaggcctagctatcagaataa

SEQ ID NO: 20749 - DNA, 25 bp, Mus musculus
cctaaagtgtaacgcctgtgactac

SEQ ID NO: 20750 - DNA, 25 bp, Mus musculus
cctaaatgaaggaagggccagctgt

SEQ ID NO: 20751 - DNA, 25 bp, Mus musculus
cctaaatggcatagttcacagggac

SEQ ID NO: 20752 - DNA, 25 bp, Mus musculus
cctaacaaaggtgtgctgtctgact

SEQ ID NO: 20753 - DNA, 25 bp, Mus musculus
cctaacagacttcacattcatggtg

SEQ ID NO: 20754 - DNA, 25 bp, Mus musculus
cctaacagctgaagaggtcatgaaa

SEQ ID NO: 20755 - DNA, 25 bp, Mus musculus
cctaacatgggaagagagcaagcag

SEQ ID NO: 20756 - DNA, 25 bp, Mus musculus
cctaaccagcgtgaaggagcgggtc

SEQ ID NO: 20757 - DNA, 25 bp, Mus musculus
cctaactaaaaggtggctcatgaga

SEQ ID NO: 20758 - DNA, 25 bp, Mus musculus
cctaactgatagcagctctacaaca

SEQ ID NO: 20759 - DNA, 25 bp, Mus musculus
cctaactttgaagagactttagaca

SEQ ID NO: 20760 - DNA, 25 bp, Mus musculus
cctaagaaccagtgtccaaccgaca

SEQ ID NO: 20761 - DNA, 25 bp, Mus musculus
cctaagaagtatcaatcctatcgga

SEQ ID NO: 20762 - DNA, 25 bp, Mus musculus
cctaagaatcgttcaattggagcag

SEQ ID NO: 20763 - DNA, 25 bp, Mus musculus
cctaagatgagtcctccgttccatc

SEQ ID NO: 20764 - DNA, 25 bp, Mus musculus
cctaagccttcatgaccctgtgtgg

SEQ ID NO: 20765 - DNA, 25 bp, Mus musculus
cctaagctacattccaagtttgagg

SEQ ID NO: 20766 - DNA, 25 bp, Mus musculus
cctaaggaagctctggtttcagacg

SEQ ID NO: 20767 - DNA, 25 bp, Mus musculus
cctaaggaatgggtaaggaaagctg

SEQ ID NO: 20768 - DNA, 25 bp, Mus musculus
cctaaggagaccctagaccagcaga

SEQ ID NO: 20769 - DNA, 25 bp, Mus musculus
cctaagtgaagacactcggaggaag

SEQ ID NO: 20770 - DNA, 25 bp, Mus musculus
cctaagttggttccagagtcacatt

SEQ ID NO: 20771 - DNA, 25 bp, Mus musculus
cctaatacagaggagagagctggca

SEQ ID NO: 20772 - DNA, 25 bp, Mus musculus
cctaatatcaacagcaatggcagca

SEQ ID NO: 20773 - DNA, 25 bp, Mus musculus
cctaatattacctaccaatgcatgg

SEQ ID NO: 20774 - DNA, 25 bp, Mus musculus
cctaatccatctgggagagaagaca

SEQ ID NO: 20775 - DNA, 25 bp, Mus musculus
cctaatcggcaagaaggagatgcgc

SEQ ID NO: 20776 - DNA, 25 bp, Mus musculus
cctaatgatggctcttactgccaag

SEQ ID NO: 20777 - DNA, 25 bp, Mus musculus
cctaatgcagtcactaaagcagccg

SEQ ID NO: 20778 - DNA, 25 bp, Mus musculus
cctaatgtgtcaggccatggctggg

SEQ ID NO: 20779 - DNA, 25 bp, Mus musculus
cctaattaacctgattttttgctga

SEQ ID NO: 20780 - DNA, 25 bp, Mus musculus
cctacaaacacagcggggagagcct

SEQ ID NO: 20781 - DNA, 25 bp, Mus musculus
cctacaaagctgtgattcagtacag

SEQ ID NO: 20782 - DNA, 25 bp, Mus musculus
cctacaagagaatcaaaagcaaccc

SEQ ID NO: 20783 - DNA, 25 bp, Mus musculus
cctacactgcactgaattatttcca

SEQ ID NO: 20784 - DNA, 25 bp, Mus musculus
cctacagaattctcgggtccggcag

SEQ ID NO: 20785 - DNA, 25 bp, Mus musculus
cctacagagatgatataatgtccgt

SEQ ID NO: 20786 - DNA, 25 bp, Mus musculus
cctacagattgatccagtttcactt

SEQ ID NO: 20787 - DNA, 25 bp, Mus musculus
cctacaggaacaccagggaagccag

SEQ ID NO: 20788 - DNA, 25 bp, Mus musculus
cctacagtaccatgtcactcaggag

SEQ ID NO: 20789 - DNA, 25 bp, Mus musculus
cctacataggagctttgggaattat

SEQ ID NO: 20790 - DNA, 25 bp, Mus musculus
cctacatccacgtgaagggctatga

SEQ ID NO: 20791 - DNA, 25 bp, Mus musculus
cctacatgcgggtgaagtatctttt

SEQ ID NO: 20792 - DNA, 25 bp, Mus musculus
cctaccaatgtgatgtgctctgtgc

SEQ ID NO: 20793 - DNA, 25 bp, Mus musculus
cctaccagtgggaagtgatcttacc

SEQ ID NO: 20794 - DNA, 25 bp, Mus musculus
cctacccgatgtgaagattgtcaag

SEQ ID NO: 20795 - DNA, 25 bp, Mus musculus
cctaccgagaacgagcctgatttgg

SEQ ID NO: 20796 - DNA, 25 bp, Mus musculus
cctaccgagtgctgctgggcgcaca

SEQ ID NO: 20797 - DNA, 25 bp, Mus musculus
cctacctctgcaagaggttcctggg

SEQ ID NO: 20798 - DNA, 25 bp, Mus musculus
cctacctctgtgagactggtcattg

SEQ ID NO: 20799 - DNA, 25 bp, Mus musculus
cctacctgtttcttagtaaatgaag

SEQ ID NO: 20800 - DNA, 25 bp, Mus musculus
cctacggcattatggagattgccat

SEQ ID NO: 20801 - DNA, 25 bp, Mus musculus
cctacggtctctgcagtctatagca

SEQ ID NO: 20802 - DNA, 25 bp, Mus musculus
cctacgtgagcaagctggattagct

SEQ ID NO: 20803 - DNA, 25 bp, Mus musculus
cctactaatccagatacttgttgaa

SEQ ID NO: 20804 - DNA, 25 bp, Mus musculus
cctactactatgaactctggtgtga

SEQ ID NO: 20805 - DNA, 25 bp, Mus musculus
cctactataaaggaggattcgagca

SEQ ID NO: 20806 - DNA, 25 bp, Mus musculus
cctactcggataccatctgtaaaaa

SEQ ID NO: 20807 - DNA, 25 bp, Mus musculus
cctactcggatagcatctgtaaaaa

SEQ ID NO: 20808 - DNA, 25 bp, Mus musculus
cctactctggatgcctttgacctgg

SEQ ID NO: 20809 - DNA, 25 bp, Mus musculus
cctactctgtagtgcgcaacgaaca

SEQ ID NO: 20810 - DNA, 25 bp, Mus musculus
cctactggcaggtgcacatggacca

SEQ ID NO: 20811 - DNA, 25 bp, Mus musculus
cctactggtgtcaggaggcttggat

SEQ ID NO: 20812 - DNA, 25 bp, Mus musculus
cctactgtcactacctggagtaaca

SEQ ID NO: 20813 - DNA, 25 bp, Mus musculus
cctactgtgcgcagagaggaatgca

SEQ ID NO: 20814 - DNA, 25 bp, Mus musculus
cctacttattctgtgggcacctgag

SEQ ID NO: 20815 - DNA, 25 bp, Mus musculus
cctacttcatgtcgcctgagctgag

SEQ ID NO: 20816 - DNA, 25 bp, Mus musculus
cctacttggatgactgtcaccggag

SEQ ID NO: 20817 - DNA, 25 bp, Mus musculus
cctagaaaagtggagctgtctgagt

SEQ ID NO: 20818 - DNA, 25 bp, Mus musculus
cctagaaaggaacctgggagaccat

SEQ ID NO: 20819 - DNA, 25 bp, Mus musculus
cctagaacacacagtatcagctgag

SEQ ID NO: 20820 - DNA, 25 bp, Mus musculus
cctagaagaggcgataattgcaaca

SEQ ID NO: 20821 - DNA, 25 bp, Mus musculus
cctagaagtttctgaggcccttctc

SEQ ID NO: 20822 - DNA, 25 bp, Mus musculus
cctagaatgggatttgcaggagttt

SEQ ID NO: 20823 - DNA, 25 bp, Mus musculus
cctagaccagcagaagcgcatctgt

SEQ ID NO: 20824 - DNA, 25 bp, Mus musculus
cctagagacttgcagctgagggact

SEQ ID NO: 20825 - DNA, 25 bp, Mus musculus
cctagagagaactgccagtgtcctc

SEQ ID NO: 20826 - DNA, 25 bp, Mus musculus
cctagagattatgctcggatatttc

SEQ ID NO: 20827 - DNA, 25 bp, Mus musculus
cctagagctcggatttctataagtg

SEQ ID NO: 20828 - DNA, 25 bp, Mus musculus
cctagaggaagccaaacagttattt

SEQ ID NO: 20829 - DNA, 25 bp, Mus musculus
cctagaggaggagctgaaaattgtt

SEQ ID NO: 20830 - DNA, 25 bp, Mus musculus
cctagaggcactcaaggaggatgct

SEQ ID NO: 20831 - DNA, 25 bp, Mus musculus
cctagaggcactgaaggaggatgct

SEQ ID NO: 20832 - DNA, 25 bp, Mus musculus
cctagagtgtgatatcagagaagcg

SEQ ID NO: 20833 - DNA, 25 bp, Mus musculus
cctagatgcccgagccaagaatgag

SEQ ID NO: 20834 - DNA, 25 bp, Mus musculus
cctagatgggatacatgctttgatg

SEQ ID NO: 20835 - DNA, 25 bp, Mus musculus
cctagcaagaggatgtgatgtatct

SEQ ID NO: 20836 - DNA, 25 bp, Mus musculus
cctagcaggagaacaagaagattgt

SEQ ID NO: 20837 - DNA, 25 bp, Mus musculus
cctagcatggaggactataccttga

SEQ ID NO: 20838 - DNA, 25 bp, Mus musculus
cctagcccattgagaccagttgctc

SEQ ID NO: 20839 - DNA, 25 bp, Mus musculus
cctagcgaggaacgtgcaatgcttg

SEQ ID NO: 20840 - DNA, 25 bp, Mus musculus
cctagcgaggaaggtgcaatgcttg

SEQ ID NO: 20841 - DNA, 25 bp, Mus musculus
cctagctacattcgagactccactg

SEQ ID NO: 20842 - DNA, 25 bp, Mus musculus
cctagctgttggtagtaagtccggg

SEQ ID NO: 20843 - DNA, 25 bp, Mus musculus
cctaggaaacgccagtcttctcagc

SEQ ID NO: 20844 - DNA, 25 bp, Mus musculus
cctaggagatgaggccttagctgcc

SEQ ID NO: 20845 - DNA, 25 bp, Mus musculus
cctaggaggaatgaccagacacagt

SEQ ID NO: 20846 - DNA, 25 bp, Mus musculus
cctaggcaatgcagactatgtcttc

SEQ ID NO: 20847 - DNA, 25 bp, Mus musculus
cctaggccagttccctgatatcaag

SEQ ID NO: 20848 - DNA, 25 bp, Mus musculus
cctaggctggctcactagagtcacc

SEQ ID NO: 20849 - DNA, 25 bp, Mus musculus
cctaggctggctgactagagtcacc

SEQ ID NO: 20850 - DNA, 25 bp, Mus musculus
cctaggtgatgtgtcagagagagta

SEQ ID NO: 20851 - DNA, 25 bp, Mus musculus
cctaggtgggcgacaggatgaaggc

SEQ ID NO: 20852 - DNA, 25 bp, Mus musculus
cctaggtgggcgtcaggatgaaggc

SEQ ID NO: 20853 - DNA, 25 bp, Mus musculus
cctagtatctattacggagagattt

SEQ ID NO: 20854 - DNA, 25 bp, Mus musculus
cctagtgcatcgatggagcctggca

SEQ ID NO: 20855 - DNA, 25 bp, Mus musculus
cctagtgtgataaaaagagctggca

SEQ ID NO: 20856 - DNA, 25 bp, Mus musculus
cctagttggcatagtgaggctcaca

SEQ ID NO: 20857 - DNA, 25 bp, Mus musculus
cctagttttctcacaaggaaagagc

SEQ ID NO: 20858 - DNA, 25 bp, Mus musculus
cctataattgaagatgcagttgaac

SEQ ID NO: 20859 - DNA, 25 bp, Mus musculus
cctatagagatcacatatcgagcga

SEQ ID NO: 20860 - DNA, 25 bp, Mus musculus
cctatagcgcggttagtggaagaaa

SEQ ID NO: 20861 - DNA, 25 bp, Mus musculus
cctatatcaacattagagaggaagt

SEQ ID NO: 20862 - DNA, 25 bp, Mus musculus
cctatcaatcaacgccaagcagact

SEQ ID NO: 20863 - DNA, 25 bp, Mus musculus
cctatcacgctcatcagtatgtggc

SEQ ID NO: 20864 - DNA, 25 bp, Mus musculus
cctatcatgaggacgtgggctatgg

SEQ ID NO: 20865 - DNA, 25 bp, Mus musculus
cctatcattgccgtgactcgaaatc

SEQ ID NO: 20866 - DNA, 25 bp, Mus musculus
cctatccaacccagtggcagggctg

SEQ ID NO: 20867 - DNA, 25 bp, Mus musculus
cctatcccaatgaggagaagcagca

SEQ ID NO: 20868 - DNA, 25 bp, Mus musculus
cctatccttccggtgcagacgggag

SEQ ID NO: 20869 - DNA, 25 bp, Mus musculus
cctatcggcacgttgaggagtgaac

SEQ ID NO: 20870 - DNA, 25 bp, Mus musculus
cctatctaagatccgggcccatgtg

SEQ ID NO: 20871 - DNA, 25 bp, Mus musculus
cctatctcaagaagaaccacaaaga

SEQ ID NO: 20872 - DNA, 25 bp, Mus musculus
cctatctcctgagattgagctcaca

SEQ ID NO: 20873 - DNA, 25 bp, Mus musculus
cctatctgccttgcatcatgactgt

SEQ ID NO: 20874 - DNA, 25 bp, Mus musculus
cctatgaaggtggtgtagacttgaa

SEQ ID NO: 20875 - DNA, 25 bp, Mus musculus
cctatgactattttaaaattgggca

SEQ ID NO: 20876 - DNA, 25 bp, Mus musculus
cctatgaggagctcctggacaaccg

SEQ ID NO: 20877 - DNA, 25 bp, Mus musculus
cctatgatcaacaaatatgggaaaa

SEQ ID NO: 20878 - DNA, 25 bp, Mus musculus
cctatgatctggaggccaacctggc

SEQ ID NO: 20879 - DNA, 25 bp, Mus musculus
cctatgatgggactacacctctgca

SEQ ID NO: 20880 - DNA, 25 bp, Mus musculus
cctatgcagttgtactcagatgaca

SEQ ID NO: 20881 - DNA, 25 bp, Mus musculus
cctatgccagacacagggctgcgag

SEQ ID NO: 20882 - DNA, 25 bp, Mus musculus
cctatgccaggttgagagggattga

SEQ ID NO: 20883 - DNA, 25 bp, Mus musculus
cctatgctaaggtgttggcgctgat

SEQ ID NO: 20884 - DNA, 25 bp, Mus musculus
cctatgctactattatggatgtgag

SEQ ID NO: 20885 - DNA, 25 bp, Mus musculus
cctatggagcagaacaaagagacct

SEQ ID NO: 20886 - DNA, 25 bp, Mus musculus
cctatggagttcagcaggttaagct

SEQ ID NO: 20887 - DNA, 25 bp, Mus musculus
cctatggatgttagagtaatgagta

SEQ ID NO: 20888 - DNA, 25 bp, Mus musculus
cctatggatgtttgagtaatgagta

SEQ ID NO: 20889 - DNA, 25 bp, Mus musculus
cctatggcaacctgggtaacaccca

SEQ ID NO: 20890 - DNA, 25 bp, Mus musculus
cctatggcggttctcaggtggctac

SEQ ID NO: 20891 - DNA, 25 bp, Mus musculus
cctatggtctagatattacttgtaa

SEQ ID NO: 20892 - DNA, 25 bp, Mus musculus
cctatggttttacatgctgcgggcc

SEQ ID NO: 20893 - DNA, 25 bp, Mus musculus
cctatgtcatggattctgaactggc

SEQ ID NO: 20894 - DNA, 25 bp, Mus musculus
cctatgtggctaaactgattgaatt

SEQ ID NO: 20895 - DNA, 25 bp, Mus musculus
cctatgttggcaccattactgagca

SEQ ID NO: 20896 - DNA, 25 bp, Mus musculus
cctatgtttcctaccgtgtgccaga

SEQ ID NO: 20897 - DNA, 25 bp, Mus musculus
cctatgtttccttccgtgtgccaga

SEQ ID NO: 20898 - DNA, 25 bp, Mus musculus
cctattaaacttatttgtaaatgca

SEQ ID NO: 20899 - DNA, 25 bp, Mus musculus
cctattaagttctgggactcctcga

SEQ ID NO: 20900 - DNA, 25 bp, Mus musculus
cctattacgatgtgatgactacggg

SEQ ID NO: 20901 - DNA, 25 bp, Mus musculus
cctattcctacacacaggtgggctc

SEQ ID NO: 20902 - DNA, 25 bp, Mus musculus
cctattgaacaagaagtcagatggc

SEQ ID NO: 20903 - DNA, 25 bp, Mus musculus
cctattgaaggcaaaaagtggccca

SEQ ID NO: 20904 - DNA, 25 bp, Mus musculus
cctattgacaatggagacatcacct

SEQ ID NO: 20905 - DNA, 25 bp, Mus musculus
cctattgacctaacccagcttgtga

SEQ ID NO: 20906 - DNA, 25 bp, Mus musculus
cctattgagaggcaaatggaggcac

SEQ ID NO: 20907 - DNA, 25 bp, Mus musculus
cctattggtgtaggtataccgacaa

SEQ ID NO: 20908 - DNA, 25 bp, Mus musculus
cctatttacctggattctttatgac

SEQ ID NO: 20909 - DNA, 25 bp, Mus musculus
cctatttccgaagctcctgttcatg

SEQ ID NO: 20910 - DNA, 25 bp, Mus musculus
cctatttctaggatccaacctggag

SEQ ID NO: 20911 - DNA, 25 bp, Mus musculus
cctatttgagttgttgtgcagcaca

SEQ ID NO: 20912 - DNA, 25 bp, Mus musculus
cctatttgtgaccagggaggtgaat

SEQ ID NO: 20913 - DNA, 25 bp, Mus musculus
cctattttcttcatcagggatgcca

SEQ ID NO: 20914 - DNA, 25 bp, Mus musculus
cctcaaacaaggtcagagcaggcag

SEQ ID NO: 20915 - DNA, 25 bp, Mus musculus
cctcaaagctgatttggacggcccg

SEQ ID NO: 20916 - DNA, 25 bp, Mus musculus
cctcaaaggttgtgatgtggtggtc

SEQ ID NO: 20917 - DNA, 25 bp, Mus musculus
cctcaaattaggcttcatgtcagca

SEQ ID NO: 20918 - DNA, 25 bp, Mus musculus
cctcaacaaagaagaactgactgga

SEQ ID NO: 20919 - DNA, 25 bp, Mus musculus
cctcaacagggagaaaatggctttg

SEQ ID NO: 20920 - DNA, 25 bp, Mus musculus
cctcaacgtgaatgacctagctgag

SEQ ID NO: 20921 - DNA, 25 bp, Mus musculus
cctcaactccaagcgtgagatcgtg

SEQ ID NO: 20922 - DNA, 25 bp, Mus musculus
cctcaagaacaagttatcgagtggg

SEQ ID NO: 20923 - DNA, 25 bp, Mus musculus
cctcaagagagggatacaccttcac

SEQ ID NO: 20924 - DNA, 25 bp, Mus musculus
cctcaaggattcaaccagggcctgg

SEQ ID NO: 20925 - DNA, 25 bp, Mus musculus
cctcaagtgcaaagcttcaagaatt

SEQ ID NO: 20926 - DNA, 25 bp, Mus musculus
cctcaagttgttggctcattgctta

SEQ ID NO: 20927 - DNA, 25 bp, Mus musculus
cctcacaaaggacagaaatctccac

SEQ ID NO: 20928 - DNA, 25 bp, Mus musculus
cctcacaatgatcgatttgtgctct

SEQ ID NO: 20929 - DNA, 25 bp, Mus musculus
cctcacactggcttggttcctggct

SEQ ID NO: 20930 - DNA, 25 bp, Mus musculus
cctcacaggattatacacaaaagtg

SEQ ID NO: 20931 - DNA, 25 bp, Mus musculus
cctcaccaagtcttatctgataatg

SEQ ID NO: 20932 - DNA, 25 bp, Mus musculus
cctcaccaggaattactacgtccgg

SEQ ID NO: 20933 - DNA, 25 bp, Mus musculus
cctcaccagggagctgaaaggtcca

SEQ ID NO: 20934 - DNA, 25 bp, Mus musculus
cctcaccgagtctggaaagtcaagt

SEQ ID NO: 20935 - DNA, 25 bp, Mus musculus
cctcacctcatcaaggagataatcc

SEQ ID NO: 20936 - DNA, 25 bp, Mus musculus
cctcacctggaacaatgagatcttg

SEQ ID NO: 20937 - DNA, 25 bp, Mus musculus
cctcaccttcagtgacttcaatgca

SEQ ID NO: 20938 - DNA, 25 bp, Mus musculus
cctcacgaaccgagttgaagatcct

SEQ ID NO: 20939 - DNA, 25 bp, Mus musculus
cctcacggacgtgatggagcagatc

SEQ ID NO: 20940 - DNA, 25 bp, Mus musculus
cctcacgggaacactgcagtaccaa

SEQ ID NO: 20941 - DNA, 25 bp, Mus musculus
cctcacgggtctccctggtacagag

SEQ ID NO: 20942 - DNA, 25 bp, Mus musculus
cctcacgtatcacgacatcggcatg

SEQ ID NO: 20943 - DNA, 25 bp, Mus musculus
cctcactaccgctgggaaagttgtt

SEQ ID NO: 20944 - DNA, 25 bp, Mus musculus
cctcactgctggacgacatgaccaa

SEQ ID NO: 20945 - DNA, 25 bp, Mus musculus
cctcactgctggtgctcactggtca

SEQ ID NO: 20946 - DNA, 25 bp, Mus musculus
cctcactgtggaccgcaatcggcta

SEQ ID NO: 20947 - DNA, 25 bp, Mus musculus
cctcacttgggaatcagtaaaccat

SEQ ID NO: 20948 - DNA, 25 bp, Mus musculus
cctcagaaaccttccacagttaaag

SEQ ID NO: 20949 - DNA, 25 bp, Mus musculus
cctcagaaccaggagcaaccatgaa

SEQ ID NO: 20950 - DNA, 25 bp, Mus musculus
cctcagaagaggaaaccaacctcag

SEQ ID NO: 20951 - DNA, 25 bp, Mus musculus
cctcagaagtcacatatatttggac

SEQ ID NO: 20952 - DNA, 25 bp, Mus musculus
cctcagaagtccttgaaggagctgc

SEQ ID NO: 20953 - DNA, 25 bp, Mus musculus
cctcagaatagtgctgcctaaggac

SEQ ID NO: 20954 - DNA, 25 bp, Mus musculus
cctcagaccagtagctagggatgct

SEQ ID NO: 20955 - DNA, 25 bp, Mus musculus
cctcagaccagttgctagggatgct

SEQ ID NO: 20956 - DNA, 25 bp, Mus musculus
cctcagaccctactttgatgtggag

SEQ ID NO: 20957 - DNA, 25 bp, Mus musculus
cctcagagagagaagactgtaataa

SEQ ID NO: 20958 - DNA, 25 bp, Mus musculus
cctcagagctgatgactaggctgca

SEQ ID NO: 20959 - DNA, 25 bp, Mus musculus
cctcagagggggctatgaatgcttc

SEQ ID NO: 20960 - DNA, 25 bp, Mus musculus
cctcagaggtagaagagatcctgga

SEQ ID NO: 20961 - DNA, 25 bp, Mus musculus
cctcagatgagtgcccggaaggcca

SEQ ID NO: 20962 - DNA, 25 bp, Mus musculus
cctcagcaagatggtgatgaaattc

SEQ ID NO: 20963 - DNA, 25 bp, Mus musculus
cctcagcaattgtgagcttcgctgt

SEQ ID NO: 20964 - DNA, 25 bp, Mus musculus
cctcagcagggaacagtttctcaag

SEQ ID NO: 20965 - DNA, 25 bp, Mus musculus
cctcagcattgacatagcgtttgcg

SEQ ID NO: 20966 - DNA, 25 bp, Mus musculus
cctcagcccagatggatggcccaga

SEQ ID NO: 20967 - DNA, 25 bp, Mus musculus
cctcagcgcagaagagggcactcag

SEQ ID NO: 20968 - DNA, 25 bp, Mus musculus
cctcagctacctcggtactgggagt

SEQ ID NO: 20969 - DNA, 25 bp, Mus musculus
cctcagctcgcaggtcctttggaag

SEQ ID NO: 20970 - DNA, 25 bp, Mus musculus
cctcagctctgttcaaatctggctc

SEQ ID NO: 20971 - DNA, 25 bp, Mus musculus
cctcagctggtactggaaggtcatg

SEQ ID NO: 20972 - DNA, 25 bp, Mus musculus
cctcagcttacggaaggatgggaaa

SEQ ID NO: 20973 - DNA, 25 bp, Mus musculus
cctcaggaatgagcgagatgtgctc

SEQ ID NO: 20974 - DNA, 25 bp, Mus musculus
cctcaggactctagagaagatggaa

SEQ ID NO: 20975 - DNA, 25 bp, Mus musculus
cctcaggactttgatgtggctaatg

SEQ ID NO: 20976 - DNA, 25 bp, Mus musculus
cctcaggagtaaaggtgttgctgag

SEQ ID NO: 20977 - DNA, 25 bp, Mus musculus
cctcaggccaccatttctgaaatca

SEQ ID NO: 20978 - DNA, 25 bp, Mus musculus
cctcaggcgtgcaaaaggaacgcat

SEQ ID NO: 20979 - DNA, 25 bp, Mus musculus
cctcagggcccagtgagtacatgga

SEQ ID NO: 20980 - DNA, 25 bp, Mus musculus
cctcaggggagaacccaggatgcag

SEQ ID NO: 20981 - DNA, 25 bp, Mus musculus
cctcagggtctgagaggcatcactg

SEQ ID NO: 20982 - DNA, 25 bp, Mus musculus
cctcaggtccattccagcaaatggg

SEQ ID NO: 20983 - DNA, 25 bp, Mus musculus
cctcaggttatctttgggacttaag

SEQ ID NO: 20984 - DNA, 25 bp, Mus musculus
cctcagtacaattcgtctctcattg

SEQ ID NO: 20985 - DNA, 25 bp, Mus musculus
cctcagtcagggagcattgcattcc

SEQ ID NO: 20986 - DNA, 25 bp, Mus musculus
cctcagtgagtttacatataagacc

SEQ ID NO: 20987 - DNA, 25 bp, Mus musculus
cctcagtgggcaccgctgtgtgaac

SEQ ID NO: 20988 - DNA, 25 bp, Mus musculus
cctcagtgggcagcgctgtgtgaac

SEQ ID NO: 20989 - DNA, 25 bp, Mus musculus
cctcagtgtccaaggctgcttccag

SEQ ID NO: 20990 - DNA, 25 bp, Mus musculus
cctcagtgtcctcatgatggagaag

SEQ ID NO: 20991 - DNA, 25 bp, Mus musculus
cctcagttacctttaatgggatttg

SEQ ID NO: 20992 - DNA, 25 bp, Mus musculus
cctcagttccggatattggtgtgtg

SEQ ID NO: 20993 - DNA, 25 bp, Mus musculus
cctcagttgagtaggtttctgctga

SEQ ID NO: 20994 - DNA, 25 bp, Mus musculus
cctcagttgagttggtttctgctga

SEQ ID NO: 20995 - DNA, 25 bp, Mus musculus
cctcagttgtaaagatccccatgga

SEQ ID NO: 20996 - DNA, 25 bp, Mus musculus
cctcataaaggatggcgggcaacag

SEQ ID NO: 20997 - DNA, 25 bp, Mus musculus
cctcatatgtgggagaaaatgcaga

SEQ ID NO: 20998 - DNA, 25 bp, Mus musculus
cctcatcaactgtgctgttggcatg

SEQ ID NO: 20999 - DNA, 25 bp, Mus musculus
cctcatcaagcccttcctaagtgaa

SEQ ID NO: 21000 - DNA, 25 bp, Mus musculus
cctcatcaaggagataatcctggtg

SEQ ID NO: 21001 - DNA, 25 bp, Mus musculus
cctcatcacagaagggtgtcgtgga

SEQ ID NO: 21002 - DNA, 25 bp, Mus musculus
cctcatcaggtcacgtgagcagctc

SEQ ID NO: 21003 - DNA, 25 bp, Mus musculus
cctcatcctctacagctccaacagt

SEQ ID NO: 21004 - DNA, 25 bp, Mus musculus
cctcatctggaggaaagagtgaagc

SEQ ID NO: 21005 - DNA, 25 bp, Mus musculus
cctcatcttggatatttgtgataag

SEQ ID NO: 21006 - DNA, 25 bp, Mus musculus
cctcatgaaggctgtggcgactgtg

SEQ ID NO: 21007 - DNA, 25 bp, Mus musculus
cctcatgagatagaaaacgtggaca

SEQ ID NO: 21008 - DNA, 25 bp, Mus musculus
cctcatgcagcccatggatagccat

SEQ ID NO: 21009 - DNA, 25 bp, Mus musculus
cctcatggaagagtcagccgagcag

SEQ ID NO: 21010 - DNA, 25 bp, Mus musculus
cctcatggaagggagaggaccctac

SEQ ID NO: 21011 - DNA, 25 bp, Mus musculus
cctcatggactgcatgaacaagcta

SEQ ID NO: 21012 - DNA, 25 bp, Mus musculus
cctcatggatgtggccggaaataag

SEQ ID NO: 21013 - DNA, 25 bp, Mus musculus
cctcatgggagtgggcaccctgatg

SEQ ID NO: 21014 - DNA, 25 bp, Mus musculus
cctcattatggtgtggatcaatgct

SEQ ID NO: 21015 - DNA, 25 bp, Mus musculus
cctcattgtcttggccggcttggga

SEQ ID NO: 21016 - DNA, 25 bp, Mus musculus
cctccaaagtgtcatgactgctgaa

SEQ ID NO: 21017 - DNA, 25 bp, Mus musculus
cctccaaagtttaataggatatggc

SEQ ID NO: 21018 - DNA, 25 bp, Mus musculus
cctccaaattgcctcagttacaaat

SEQ ID NO: 21019 - DNA, 25 bp, Mus musculus
cctccaacgtgtaagtaaagcttgg

SEQ ID NO: 21020 - DNA, 25 bp, Mus musculus
cctccaagtggatcgcaagactccg

SEQ ID NO: 21021 - DNA, 25 bp, Mus musculus
cctccaatgtacctgccgtggtggt

SEQ ID NO: 21022 - DNA, 25 bp, Mus musculus
cctccacagctcagggaaggatcgc

SEQ ID NO: 21023 - DNA, 25 bp, Mus musculus
cctccactgtgatgtactgtcttgt

SEQ ID NO: 21024 - DNA, 25 bp, Mus musculus
cctccagaggtgaagtccccaatgg

SEQ ID NO: 21025 - DNA, 25 bp, Mus musculus
cctccagagtgctaaagtccagagt

SEQ ID NO: 21026 - DNA, 25 bp, Mus musculus
cctccaggcatgcaataagcgaaag

SEQ ID NO: 21027 - DNA, 25 bp, Mus musculus
cctccagggtctacgggcactgtct

SEQ ID NO: 21028 - DNA, 25 bp, Mus musculus
cctccaggtttcataatgcagggca

SEQ ID NO: 21029 - DNA, 25 bp, Mus musculus
cctccatggagactgcgtggccctt

SEQ ID NO: 21030 - DNA, 25 bp, Mus musculus
cctccatgggtaactgcacaaacag

SEQ ID NO: 21031 - DNA, 25 bp, Mus musculus
cctcccaagatgttgtttacacgag

SEQ ID NO: 21032 - DNA, 25 bp, Mus musculus
cctccccagacaccggagaatgttt

SEQ ID NO: 21033 - DNA, 25 bp, Mus musculus
cctccccagacagcggagaatgttt

SEQ ID NO: 21034 - DNA, 25 bp, Mus musculus
cctccccagggatcttgagtgtgga

SEQ ID NO: 21035 - DNA, 25 bp, Mus musculus
cctcccctgtatcgcttaattgaga

SEQ ID NO: 21036 - DNA, 25 bp, Mus musculus
cctcccgggcagtctggagtggcta

SEQ ID NO: 21037 - DNA, 25 bp, Mus musculus
cctcccgttagcaaggctgggaagg

SEQ ID NO: 21038 - DNA, 25 bp, Mus musculus
cctccctaggacgttaggattgcag

SEQ ID NO: 21039 - DNA, 25 bp, Mus musculus
cctccctcatctgagaaggcagagt

SEQ ID NO: 21040 - DNA, 25 bp, Mus musculus
cctccctgatgctgctggcggtgct

SEQ ID NO: 21041 - DNA, 25 bp, Mus musculus
cctccctgctccagtaggaggagct

SEQ ID NO: 21042 - DNA, 25 bp, Mus musculus
cctccgaagccagaggatctgagcg

SEQ ID NO: 21043 - DNA, 25 bp, Mus musculus
cctccgaagtagctgggatcaccgt

SEQ ID NO: 21044 - DNA, 25 bp, Mus musculus
cctccgaggatgtgcagcgcagcgt

SEQ ID NO: 21045 - DNA, 25 bp, Mus musculus
cctccgatgaggaaggtagttcttc

SEQ ID NO: 21046 - DNA, 25 bp, Mus musculus
cctccgctccttcagttcggatagg

SEQ ID NO: 21047 - DNA, 25 bp, Mus musculus
cctccggtacatgaagcaggacttc

SEQ ID NO: 21048 - DNA, 25 bp, Mus musculus
cctccgttccatcccagtaatgtga

SEQ ID NO: 21049 - DNA, 25 bp, Mus musculus
cctcctactcggataccatctgtaa

SEQ ID NO: 21050 - DNA, 25 bp, Mus musculus
cctcctactcggttaccatctgtaa

SEQ ID NO: 21051 - DNA, 25 bp, Mus musculus
cctcctcagaagaatggtgggttct

SEQ ID NO: 21052 - DNA, 25 bp, Mus musculus
cctcctcagcagaggctgtataggg

SEQ ID NO: 21053 - DNA, 25 bp, Mus musculus
cctcctcctatactagaagatatca

SEQ ID NO: 21054 - DNA, 25 bp, Mus musculus
cctcctcctcaggtggcatgaaggt

SEQ ID NO: 21055 - DNA, 25 bp, Mus musculus
cctcctcctgggatgcaacaacgga

SEQ ID NO: 21056 - DNA, 25 bp, Mus musculus
cctcctccttgcaggtgggaatcct

SEQ ID NO: 21057 - DNA, 25 bp, Mus musculus
cctcctcgtctgcaactttgctaaa

SEQ ID NO: 21058 - DNA, 25 bp, Mus musculus
cctcctctctgaaggtgaccaatga

SEQ ID NO: 21059 - DNA, 25 bp, Mus musculus
cctcctctgaaaaagctctagctaa

SEQ ID NO: 21060 - DNA, 25 bp, Mus musculus
cctcctctttcaggtgctgagcatg

SEQ ID NO: 21061 - DNA, 25 bp, Mus musculus
cctcctgagggatacgcaagcgata

SEQ ID NO: 21062 - DNA, 25 bp, Mus musculus
cctcctgagtacgagttcttctggg

SEQ ID NO: 21063 - DNA, 25 bp, Mus musculus
cctcctgcatatgcccaagaggatt

SEQ ID NO: 21064 - DNA, 25 bp, Mus musculus
cctcctgccagaaggcgaaggtctc

SEQ ID NO: 21065 - DNA, 25 bp, Mus musculus
cctcctgccatcaaagtgctaagaa

SEQ ID NO: 21066 - DNA, 25 bp, Mus musculus
cctcctggacctaaaagtgaattct

SEQ ID NO: 21067 - DNA, 25 bp, Mus musculus
cctcctggagttccgggcatagatg

SEQ ID NO: 21068 - DNA, 25 bp, Mus musculus
cctcctgggaacacatcaaggccgt

SEQ ID NO: 21069 - DNA, 25 bp, Mus musculus
cctcctgggatgcaacaacggatca

SEQ ID NO: 21070 - DNA, 25 bp, Mus musculus
cctcctgggcatcacctacatgttg

SEQ ID NO: 21071 - DNA, 25 bp, Mus musculus
cctcctggtggatgtcttctctgac

SEQ ID NO: 21072 - DNA, 25 bp, Mus musculus
cctcctgtggagaaacagcaaagtg

SEQ ID NO: 21073 - DNA, 25 bp, Mus musculus
cctcctgttcgtaaagctggccaac

SEQ ID NO: 21074 - DNA, 25 bp, Mus musculus
cctccttctgcagcggaagatggag

SEQ ID NO: 21075 - DNA, 25 bp, Mus musculus
cctccttgactgtgtggtccggtgg

SEQ ID NO: 21076 - DNA, 25 bp, Mus musculus
cctccttgcaggtgggaatcctaga

SEQ ID NO: 21077 - DNA, 25 bp, Mus musculus
cctcctttgtctacaccatcaaggg

SEQ ID NO: 21078 - DNA, 25 bp, Mus musculus
cctcgaagcgaggaaatgcaaatat

SEQ ID NO: 21079 - DNA, 25 bp, Mus musculus
cctcgacagctagagtcattaattc

SEQ ID NO: 21080 - DNA, 25 bp, Mus musculus
cctcgagtacatagaagataatgct

SEQ ID NO: 21081 - DNA, 25 bp, Mus musculus
cctcgatatccccaagatgttggat

SEQ ID NO: 21082 - DNA, 25 bp, Mus musculus
cctcgatctacgatgcctaccggaa

SEQ ID NO: 21083 - DNA, 25 bp, Mus musculus
cctcgcccttatctgatggtagatc

SEQ ID NO: 21084 - DNA, 25 bp, Mus musculus
cctcgcgagcggagttgactaccga

SEQ ID NO: 21085 - DNA, 25 bp, Mus musculus
cctcgcgagcggtgttgactaccga

SEQ ID NO: 21086 - DNA, 25 bp, Mus musculus
cctcgctatcgggtggcttacaaga

SEQ ID NO: 21087 - DNA, 25 bp, Mus musculus
cctcgctccagtgccgagtgtgtgg

SEQ ID NO: 21088 - DNA, 25 bp, Mus musculus
cctcggaagatgcatcacctccata

SEQ ID NO: 21089 - DNA, 25 bp, Mus musculus
cctcggaagtctggaagtccaagat

SEQ ID NO: 21090 - DNA, 25 bp, Mus musculus
cctcggaatcggtgtggctgagtca

SEQ ID NO: 21091 - DNA, 25 bp, Mus musculus
cctcggacacaacgaaggctcgtga

SEQ ID NO: 21092 - DNA, 25 bp, Mus musculus
cctcggacacaaggaaggctcgtga

SEQ ID NO: 21093 - DNA, 25 bp, Mus musculus
cctcggacattaacagatctgtgga

SEQ ID NO: 21094 - DNA, 25 bp, Mus musculus
cctcggatgagtcctttgagcctta

SEQ ID NO: 21095 - DNA, 25 bp, Mus musculus
cctcggatggagagcctgagacaag

SEQ ID NO: 21096 - DNA, 25 bp, Mus musculus
cctcggatgttaggatgaaatcaga

SEQ ID NO: 21097 - DNA, 25 bp, Mus musculus
cctcggattaaattgtggaaagatg

SEQ ID NO: 21098 - DNA, 25 bp, Mus musculus
cctcgggagagaaaatgaatggctc

SEQ ID NO: 21099 - DNA, 25 bp, Mus musculus
cctcgggcctttgctcatagaaaca

SEQ ID NO: 21100 - DNA, 25 bp, Mus musculus
cctcggtgaccatgcccgacatgag

SEQ ID NO: 21101 - DNA, 25 bp, Mus musculus
cctcggttccagcattcgtactgga

SEQ ID NO: 21102 - DNA, 25 bp, Mus musculus
cctcgtcttcgtcttcagctggtgg

SEQ ID NO: 21103 - DNA, 25 bp, Mus musculus
cctcgtgatgaggaatagcaaggag

SEQ ID NO: 21104 - DNA, 25 bp, Mus musculus
cctctaaaggctgggcctttctgca

SEQ ID NO: 21105 - DNA, 25 bp, Mus musculus
cctctaagttactgtcttgcaaggt

SEQ ID NO: 21106 - DNA, 25 bp, Mus musculus
cctctactgctgtctagtgatagaa

SEQ ID NO: 21107 - DNA, 25 bp, Mus musculus
cctctagaacaagtaatcacggcaa

SEQ ID NO: 21108 - DNA, 25 bp, Mus musculus
cctctagagtaatcagaaagaagac

SEQ ID NO: 21109 - DNA, 25 bp, Mus musculus
cctctagatacactacttgtggatg

SEQ ID NO: 21110 - DNA, 25 bp, Mus musculus
cctctatagttgtacacaaggatga

SEQ ID NO: 21111 - DNA, 25 bp, Mus musculus
cctctatgaccagtgggaagacgtc

SEQ ID NO: 21112 - DNA, 25 bp, Mus musculus
cctctatttggaacataacctggag

SEQ ID NO: 21113 - DNA, 25 bp, Mus musculus
cctctcaaagtcttatgtgtggaca

SEQ ID NO: 21114 - DNA, 25 bp, Mus musculus
cctctcagaaaactatgaagttgct

SEQ ID NO: 21115 - DNA, 25 bp, Mus musculus
cctctcagctggcttcgaaactgct

SEQ ID NO: 21116 - DNA, 25 bp, Mus musculus
cctctccctcaatggtgcatgaggg

SEQ ID NO: 21117 - DNA, 25 bp, Mus musculus
cctctccgaagaggaacagaagaaa

SEQ ID NO: 21118 - DNA, 25 bp, Mus musculus
cctctcgcccatatgtttgagaccg

SEQ ID NO: 21119 - DNA, 25 bp, Mus musculus
cctctcggaattagttgtgtaaatt

SEQ ID NO: 21120 - DNA, 25 bp, Mus musculus
cctctctccctttagtggctcgtgg

SEQ ID NO: 21121 - DNA, 25 bp, Mus musculus
cctctcttaactattcctggccgaa

SEQ ID NO: 21122 - DNA, 25 bp, Mus musculus
cctctgaaaaagctctagctaacca

SEQ ID NO: 21123 - DNA, 25 bp, Mus musculus
cctctgaacatggtggtggccactc

SEQ ID NO: 21124 - DNA, 25 bp, Mus musculus
cctctgataaaatgcctaatgacca

SEQ ID NO: 21125 - DNA, 25 bp, Mus musculus
cctctgatgaccacggctctgagca

SEQ ID NO: 21126 - DNA, 25 bp, Mus musculus
cctctgcaaagctgagaagtgattg

SEQ ID NO: 21127 - DNA, 25 bp, Mus musculus
cctctgcacgtagctgctgatcttg

SEQ ID NO: 21128 - DNA, 25 bp, Mus musculus
cctctgcagagaatgagattcctga

SEQ ID NO: 21129 - DNA, 25 bp, Mus musculus
cctctgcatgtcatcgagtggctgc

SEQ ID NO: 21130 - DNA, 25 bp, Mus musculus
cctctgccttgcttggtgggaccag

SEQ ID NO: 21131 - DNA, 25 bp, Mus musculus
cctctgcgggcagtgttcaagggca

SEQ ID NO: 21132 - DNA, 25 bp, Mus musculus
cctctgctaaaactgtcttcgtaga

SEQ ID NO: 21133 - DNA, 25 bp, Mus musculus
cctctgctggaactgtcctgatggt

SEQ ID NO: 21134 - DNA, 25 bp, Mus musculus
cctctgctggaagtgtcctgatggt

SEQ ID NO: 21135 - DNA, 25 bp, Mus musculus
cctctggaaacctgcagtggaggcc

SEQ ID NO: 21136 - DNA, 25 bp, Mus musculus
cctctggaaagaagggtcctggctt

SEQ ID NO: 21137 - DNA, 25 bp, Mus musculus
cctctggaaagatgggtcctggctt

SEQ ID NO: 21138 - DNA, 25 bp, Mus musculus
cctctggaagaaccataggccctgg

SEQ ID NO: 21139 - DNA, 25 bp, Mus musculus
cctctggatcctcggctcacaaaaa

SEQ ID NO: 21140 - DNA, 25 bp, Mus musculus
cctctggatcgacagctgatagccc

SEQ ID NO: 21141 - DNA, 25 bp, Mus musculus
cctctggatcgagagctgatagccc

SEQ ID NO: 21142 - DNA, 25 bp, Mus musculus
cctctggccagatgcggcagctgtg

SEQ ID NO: 21143 - DNA, 25 bp, Mus musculus
cctctggccatgagataattgtgca

SEQ ID NO: 21144 - DNA, 25 bp, Mus musculus
cctctggcctcagatctggatcttt

SEQ ID NO: 21145 - DNA, 25 bp, Mus musculus
cctctgggactataacctttctgct

SEQ ID NO: 21146 - DNA, 25 bp, Mus musculus
cctctgggagaggtgtccgcagctt

SEQ ID NO: 21147 - DNA, 25 bp, Mus musculus
cctctgggcatttgctggatgtcca

SEQ ID NO: 21148 - DNA, 25 bp, Mus musculus
cctctggtctccctttgaatcgtta

SEQ ID NO: 21149 - DNA, 25 bp, Mus musculus
cctctgtatttactccaaactgatg

SEQ ID NO: 21150 - DNA, 25 bp, Mus musculus
cctctgtgaagctgcgactgctgtg

SEQ ID NO: 21151 - DNA, 25 bp, Mus musculus
cctctgtgaattaggccagaatccc

SEQ ID NO: 21152 - DNA, 25 bp, Mus musculus
cctctgtgaatttggccagaatccc

SEQ ID NO: 21153 - DNA, 25 bp, Mus musculus
cctctgtgaccggatcatcattggg

SEQ ID NO: 21154 - DNA, 25 bp, Mus musculus
cctctgtgtcttacatgataagcat

SEQ ID NO: 21155 - DNA, 25 bp, Mus musculus
cctctgtgtctttcatgataagcat

SEQ ID NO: 21156 - DNA, 25 bp, Mus musculus
cctctgttccagttgtacaacagac

SEQ ID NO: 21157 - DNA, 25 bp, Mus musculus
cctctgttgcttcatcccaggaaag

SEQ ID NO: 21158 - DNA, 25 bp, Mus musculus
cctcttaagggctcagaagactgtc

SEQ ID NO: 21159 - DNA, 25 bp, Mus musculus
cctcttacatatggcagggatcgta

SEQ ID NO: 21160 - DNA, 25 bp, Mus musculus
cctcttagggacacagccaacttgc

SEQ ID NO: 21161 - DNA, 25 bp, Mus musculus
cctcttagggttggctttgtgtgca

SEQ ID NO: 21162 - DNA, 25 bp, Mus musculus
cctcttataagtgtttagcagcagc

SEQ ID NO: 21163 - DNA, 25 bp, Mus musculus
cctcttccaccgagtgctctttgag

SEQ ID NO: 21164 - DNA, 25 bp, Mus musculus
cctcttccataagtcaggtgctttg

SEQ ID NO: 21165 - DNA, 25 bp, Mus musculus
cctcttccgtaatgcgggatgtgct

SEQ ID NO: 21166 - DNA, 25 bp, Mus musculus
cctcttcggtgatctttggtctgaa

SEQ ID NO: 21167 - DNA, 25 bp, Mus musculus
cctcttcgtcggcagtgacagcctg

SEQ ID NO: 21168 - DNA, 25 bp, Mus musculus
cctcttcttagagcctgtgctgtgg

SEQ ID NO: 21169 - DNA, 25 bp, Mus musculus
cctcttgatgttgctgcttatcttc

SEQ ID NO: 21170 - DNA, 25 bp, Mus musculus
cctcttgtgcaggaccatggagcac

SEQ ID NO: 21171 - DNA, 25 bp, Mus musculus
cctcttgtttactgttgccgggaga

SEQ ID NO: 21172 - DNA, 25 bp, Mus musculus
cctctttgaagaaatcgacagggat

SEQ ID NO: 21173 - DNA, 25 bp, Mus musculus
cctctttgcttcctgtgccccatct

SEQ ID NO: 21174 - DNA, 25 bp, Mus musculus
cctctttgcttcgtgtgccccatct

SEQ ID NO: 21175 - DNA, 25 bp, Mus musculus
cctctttgtggcaaaacatctgaaa

SEQ ID NO: 21176 - DNA, 25 bp, Mus musculus
cctctttgtgtggaaaacgacagca

SEQ ID NO: 21177 - DNA, 25 bp, Mus musculus
cctctttgtttatattgaagcagca

SEQ ID NO: 21178 - DNA, 25 bp, Mus musculus
cctgaaaaccctctgagaggagtct

SEQ ID NO: 21179 - DNA, 25 bp, Mus musculus
cctgaaaatcctgaggcttatctta

SEQ ID NO: 21180 - DNA, 25 bp, Mus musculus
cctgaaacacctacggcacctgaat

SEQ ID NO: 21181 - DNA, 25 bp, Mus musculus
cctgaaacactgaagcgtctgtttg

SEQ ID NO: 21182 - DNA, 25 bp, Mus musculus
cctgaaacatggtggctgtaataag

SEQ ID NO: 21183 - DNA, 25 bp, Mus musculus
cctgaaacttgaagaaggattacta

SEQ ID NO: 21184 - DNA, 25 bp, Mus musculus
cctgaaagatgaattcacatatgaa

SEQ ID NO: 21185 - DNA, 25 bp, Mus musculus
cctgaaaggatttatggcagccaag

SEQ ID NO: 21186 - DNA, 25 bp, Mus musculus
cctgaaaggtcaatgaagtcacatc

SEQ ID NO: 21187 - DNA, 25 bp, Mus musculus
cctgaaatcattcactgctgtctgt

SEQ ID NO: 21188 - DNA, 25 bp, Mus musculus
cctgaaattcctggtagtgtgggca

SEQ ID NO: 21189 - DNA, 25 bp, Mus musculus
cctgaaattcgtgcggcagattggc

SEQ ID NO: 21190 - DNA, 25 bp, Mus musculus
cctgaacaacgtgagcactggctgt

SEQ ID NO: 21191 - DNA, 25 bp, Mus musculus
cctgaacacctcactgggaaacatt

SEQ ID NO: 21192 - DNA, 25 bp, Mus musculus
cctgaacagatggaagacagcgtcc

SEQ ID NO: 21193 - DNA, 25 bp, Mus musculus
cctgaacctggctttggacagctgc

SEQ ID NO: 21194 - DNA, 25 bp, Mus musculus
cctgaacctgtggtacattctctta

SEQ ID NO: 21195 - DNA, 25 bp, Mus musculus
cctgaacgagatgcgggatcagtac

SEQ ID NO: 21196 - DNA, 25 bp, Mus musculus
cctgaacgatatcactcaggagtgt

SEQ ID NO: 21197 - DNA, 25 bp, Mus musculus
cctgaacggtggcacctgcttgacg

SEQ ID NO: 21198 - DNA, 25 bp, Mus musculus
cctgaactctgcaccaagtcctttt

SEQ ID NO: 21199 - DNA, 25 bp, Mus musculus
cctgaactttaagaggctacagtct

SEQ ID NO: 21200 - DNA, 25 bp, Mus musculus
cctgaagacattactgtggagtggc

SEQ ID NO: 21201 - DNA, 25 bp, Mus musculus
cctgaagagtgctatagaaaaactg

SEQ ID NO: 21202 - DNA, 25 bp, Mus musculus
cctgaagagttcacaaggctttgca

SEQ ID NO: 21203 - DNA, 25 bp, Mus musculus
cctgaagatcaaatgtgtggctaat

SEQ ID NO: 21204 - DNA, 25 bp, Mus musculus
cctgaagatgttaacagcgcagtct

SEQ ID NO: 21205 - DNA, 25 bp, Mus musculus
cctgaagatgtttacagcgcagtct

SEQ ID NO: 21206 - DNA, 25 bp, Mus musculus
cctgaagccagaaaacatcgttctg

SEQ ID NO: 21207 - DNA, 25 bp, Mus musculus
cctgaagccctttttgatagagttt

SEQ ID NO: 21208 - DNA, 25 bp, Mus musculus
cctgaagctggaaccttccaacaag

SEQ ID NO: 21209 - DNA, 25 bp, Mus musculus
cctgaagctggcatctggagaggac

SEQ ID NO: 21210 - DNA, 25 bp, Mus musculus
cctgaaggccgtccgggatcgcaaa

SEQ ID NO: 21211 - DNA, 25 bp, Mus musculus
cctgaaggcggcagatatgctgagt

SEQ ID NO: 21212 - DNA, 25 bp, Mus musculus
cctgaagggaatgatgggcgattta

SEQ ID NO: 21213 - DNA, 25 bp, Mus musculus
cctgaagggctaccgccagtactgg

SEQ ID NO: 21214 - DNA, 25 bp, Mus musculus
cctgaagtaagtactctgagttcct

SEQ ID NO: 21215 - DNA, 25 bp, Mus musculus
cctgaagtacagtggtgggctagtc

SEQ ID NO: 21216 - DNA, 25 bp, Mus musculus
cctgaagtgacccagcctggagact

SEQ ID NO: 21217 - DNA, 25 bp, Mus musculus
cctgaagtggatagagagggctaat

SEQ ID NO: 21218 - DNA, 25 bp, Mus musculus
cctgaagtggattttctgtcagaag

SEQ ID NO: 21219 - DNA, 25 bp, Mus musculus
cctgaataagcttccggtgaagaat

SEQ ID NO: 21220 - DNA, 25 bp, Mus musculus
cctgaatagccgatctggaagctga

SEQ ID NO: 21221 - DNA, 25 bp, Mus musculus
cctgaatagccgttctggaagctga

SEQ ID NO: 21222 - DNA, 25 bp, Mus musculus
cctgaatctcctaagcacacacttt

SEQ ID NO: 21223 - DNA, 25 bp, Mus musculus
cctgaatctccttagcacacacttt

SEQ ID NO: 21224 - DNA, 25 bp, Mus musculus
cctgaatggctgagagaatggccgc

SEQ ID NO: 21225 - DNA, 25 bp, Mus musculus
cctgaatggctgtgagaatggccgc

SEQ ID NO: 21226 - DNA, 25 bp, Mus musculus
cctgaatgtggcagacaggctagct

SEQ ID NO: 21227 - DNA, 25 bp, Mus musculus
cctgacaatactggtgttcttttat

SEQ ID NO: 21228 - DNA, 25 bp, Mus musculus
cctgacaatgatgagcagtttgttc

SEQ ID NO: 21229 - DNA, 25 bp, Mus musculus
cctgacaatggtggatgcagccaga

SEQ ID NO: 21230 - DNA, 25 bp, Mus musculus
cctgacacgcttcaagaaagagatg

SEQ ID NO: 21231 - DNA, 25 bp, Mus musculus
cctgacagaagctatgcactggcag

SEQ ID NO: 21232 - DNA, 25 bp, Mus musculus
cctgacatggtctgggacttctgga

SEQ ID NO: 21233 - DNA, 25 bp, Mus musculus
cctgacatttttccacaagtacaac

SEQ ID NO: 21234 - DNA, 25 bp, Mus musculus
cctgaccatgatggcccaatggagc

SEQ ID NO: 21235 - DNA, 25 bp, Mus musculus
cctgaccatgtgcatgaaggagtgc

SEQ ID NO: 21236 - DNA, 25 bp, Mus musculus
cctgaccctcaagattaacagtgag

SEQ ID NO: 21237 - DNA, 25 bp, Mus musculus
cctgaccgggaagaaattccaatga

SEQ ID NO: 21238 - DNA, 25 bp, Mus musculus
cctgacctatgaaggtggtgtagac

SEQ ID NO: 21239 - DNA, 25 bp, Mus musculus
cctgacctcgcttttgaagccacag

SEQ ID NO: 21240 - DNA, 25 bp, Mus musculus
cctgaccttcttcgagtatgatggc

SEQ ID NO: 21241 - DNA, 25 bp, Mus musculus
cctgaccttcttggagtatgatggc

SEQ ID NO: 21242 - DNA, 25 bp, Mus musculus
cctgacgcccagagtttgagtccca

SEQ ID NO: 21243 - DNA, 25 bp, Mus musculus
cctgacggttgtaagagtggaatca

SEQ ID NO: 21244 - DNA, 25 bp, Mus musculus
cctgactggagttaccctgatcttc

SEQ ID NO: 21245 - DNA, 25 bp, Mus musculus
cctgactgtaattgaagaagccagt

SEQ ID NO: 21246 - DNA, 25 bp, Mus musculus
cctgactgtctgcatatgggtgaac

SEQ ID NO: 21247 - DNA, 25 bp, Mus musculus
cctgactgtctggatatgggtgaac

SEQ ID NO: 21248 - DNA, 25 bp, Mus musculus
cctgactgtggttgtactggaggct

SEQ ID NO: 21249 - DNA, 25 bp, Mus musculus
cctgactttaccactgacgattatg

SEQ ID NO: 21250 - DNA, 25 bp, Mus musculus
cctgagaaacgtcttgtggcatggc

SEQ ID NO: 21251 - DNA, 25 bp, Mus musculus
cctgagaaagggaacaagagcccgt

SEQ ID NO: 21252 - DNA, 25 bp, Mus musculus
cctgagaactttgtgggtgctggaa

SEQ ID NO: 21253 - DNA, 25 bp, Mus musculus
cctgagaagcgggactcggttaggc

SEQ ID NO: 21254 - DNA, 25 bp, Mus musculus
cctgagaagggttgtggtccaaagc

SEQ ID NO: 21255 - DNA, 25 bp, Mus musculus
cctgagaataatgaacagtgtggtc

SEQ ID NO: 21256 - DNA, 25 bp, Mus musculus
cctgagaatatgacaggacggcatc

SEQ ID NO: 21257 - DNA, 25 bp, Mus musculus
cctgagaattaacaagcggatcctg

SEQ ID NO: 21258 - DNA, 25 bp, Mus musculus
cctgagacctgcagggtcctatttg

SEQ ID NO: 21259 - DNA, 25 bp, Mus musculus
cctgagacggttatggaaagaaagt

SEQ ID NO: 21260 - DNA, 25 bp, Mus musculus
cctgagactgctcgcacagaataaa

SEQ ID NO: 21261 - DNA, 25 bp, Mus musculus
cctgagactgctggcacagaataaa

SEQ ID NO: 21262 - DNA, 25 bp, Mus musculus
cctgagagccccatggctttgttgg

SEQ ID NO: 21263 - DNA, 25 bp, Mus musculus
cctgagagtaatatgaatgaagaaa

SEQ ID NO: 21264 - DNA, 25 bp, Mus musculus
cctgagagtctctgcagtatcgggc

SEQ ID NO: 21265 - DNA, 25 bp, Mus musculus
cctgagatcagagtgaaccatgagc

SEQ ID NO: 21266 - DNA, 25 bp, Mus musculus
cctgagatgcgcagcggaagaaaac

SEQ ID NO: 21267 - DNA, 25 bp, Mus musculus
cctgagatgcgctgcggaagaaaac

SEQ ID NO: 21268 - DNA, 25 bp, Mus musculus
cctgagattcctagggagaatcaaa

SEQ ID NO: 21269 - DNA, 25 bp, Mus musculus
cctgagattggagaaagagactccc

SEQ ID NO: 21270 - DNA, 25 bp, Mus musculus
cctgagcacagagtccgggtccgag

SEQ ID NO: 21271 - DNA, 25 bp, Mus musculus
cctgagcagataggcctggatgaga

SEQ ID NO: 21272 - DNA, 25 bp, Mus musculus
cctgagcagatcgagaaaatctggc

SEQ ID NO: 21273 - DNA, 25 bp, Mus musculus
cctgagccaagattcatgtatggga

SEQ ID NO: 21274 - DNA, 25 bp, Mus musculus
cctgagccgtaatgatcctgcaaca

SEQ ID NO: 21275 - DNA, 25 bp, Mus musculus
cctgagcctgccaaacctggagatc

SEQ ID NO: 21276 - DNA, 25 bp, Mus musculus
cctgagccttggaacatccttcgca

SEQ ID NO: 21277 - DNA, 25 bp, Mus musculus
cctgagcgctacacaagtcgtttta

SEQ ID NO: 21278 - DNA, 25 bp, Mus musculus
cctgagcgtgaagccatttttagaa

SEQ ID NO: 21279 - DNA, 25 bp, Mus musculus
cctgagctcctacctggttttcggg

SEQ ID NO: 21280 - DNA, 25 bp, Mus musculus
cctgagctctatgagttggtgaaca

SEQ ID NO: 21281 - DNA, 25 bp, Mus musculus
cctgagctgaagatgttcccagaac

SEQ ID NO: 21282 - DNA, 25 bp, Mus musculus
cctgagctgagaggcatcctattga

SEQ ID NO: 21283 - DNA, 25 bp, Mus musculus
cctgagctggtggttggtgataaac

SEQ ID NO: 21284 - DNA, 25 bp, Mus musculus
cctgagctttaattgtgccaacaac

SEQ ID NO: 21285 - DNA, 25 bp, Mus musculus
cctgagctttcgaatagtcagcggg

SEQ ID NO: 21286 - DNA, 25 bp, Mus musculus
cctgaggaacgacattggtgccact

SEQ ID NO: 21287 - DNA, 25 bp, Mus musculus
cctgaggaattggaccagggcatcg

SEQ ID NO: 21288 - DNA, 25 bp, Mus musculus
cctgaggacgcctgtcttacaagtg

SEQ ID NO: 21289 - DNA, 25 bp, Mus musculus
cctgaggactatagagcaaaaacag

SEQ ID NO: 21290 - DNA, 25 bp, Mus musculus
cctgaggatataatcgagtatgact

SEQ ID NO: 21291 - DNA, 25 bp, Mus musculus
cctgaggcccaagctggagaaacgg

SEQ ID NO: 21292 - DNA, 25 bp, Mus musculus
cctgaggccttcatttgtgtttctc

SEQ ID NO: 21293 - DNA, 25 bp, Mus musculus
cctgaggctgcagatggcaatagag

SEQ ID NO: 21294 - DNA, 25 bp, Mus musculus
cctgagggacacttggctggtttag

SEQ ID NO: 21295 - DNA, 25 bp, Mus musculus
cctgagggagaggacctcaatgaat

SEQ ID NO: 21296 - DNA, 25 bp, Mus musculus
cctgagggcagtggcaggaacacac

SEQ ID NO: 21297 - DNA, 25 bp, Mus musculus
cctgaggtctccaagacagagccgc

SEQ ID NO: 21298 - DNA, 25 bp, Mus musculus
cctgaggtttgcattgaagcaagaa

SEQ ID NO: 21299 - DNA, 25 bp, Mus musculus
cctgaggtttggctctggcaccaca

SEQ ID NO: 21300 - DNA, 25 bp, Mus musculus
cctgagtcactggtgccctattaca

SEQ ID NO: 21301 - DNA, 25 bp, Mus musculus
cctgagtcaggccaagacattcatg

SEQ ID NO: 21302 - DNA, 25 bp, Mus musculus
cctgagtcagtcatcagaaatatta

SEQ ID NO: 21303 - DNA, 25 bp, Mus musculus
cctgagtcccctaggtaccagaact

SEQ ID NO: 21304 - DNA, 25 bp, Mus musculus
cctgagtcgtgctctgttggtatag

SEQ ID NO: 21305 - DNA, 25 bp, Mus musculus
cctgagtgcatacaaaataagagtt

SEQ ID NO: 21306 - DNA, 25 bp, Mus musculus
cctgagtggtttcattattagaggc

SEQ ID NO: 21307 - DNA, 25 bp, Mus musculus
cctgagtgtaaagggaccttcggct

SEQ ID NO: 21308 - DNA, 25 bp, Mus musculus
cctgagtgtaggtgacaaacaagat

SEQ ID NO: 21309 - DNA, 25 bp, Mus musculus
cctgagtgtgactaacagagtaccc

SEQ ID NO: 21310 - DNA, 25 bp, Mus musculus
cctgagttccactgtgcatgaggcc

SEQ ID NO: 21311 - DNA, 25 bp, Mus musculus
cctgagttgtcaggagccctggaag

SEQ ID NO: 21312 - DNA, 25 bp, Mus musculus
cctgatagtcttgaagatgcatggg

SEQ ID NO: 21313 - DNA, 25 bp, Mus musculus
cctgatatctcaagaaacattcaag

SEQ ID NO: 21314 - DNA, 25 bp, Mus musculus
cctgatatgattgcagattcaaaca

SEQ ID NO: 21315 - DNA, 25 bp, Mus musculus
cctgatcacagggaaatgggagaaa

SEQ ID NO: 21316 - DNA, 25 bp, Mus musculus
cctgatcctgttcaagttgaaggct

SEQ ID NO: 21317 - DNA, 25 bp, Mus musculus
cctgatcgagaagctgctgacaaga

SEQ ID NO: 21318 - DNA, 25 bp, Mus musculus
cctgatgaagaatgccataaagaca

SEQ ID NO: 21319 - DNA, 25 bp, Mus musculus
cctgatgaagttgtagggccagaag

SEQ ID NO: 21320 - DNA, 25 bp, Mus musculus
cctgatgagcgaagaagcaaagcga

SEQ ID NO: 21321 - DNA, 25 bp, Mus musculus
cctgatgagtacattgagaaactgg

SEQ ID NO: 21322 - DNA, 25 bp, Mus musculus
cctgatgagtctctggacgacttca

SEQ ID NO: 21323 - DNA, 25 bp, Mus musculus
cctgatgagtgactgcaacaatttc

SEQ ID NO: 21324 - DNA, 25 bp, Mus musculus
cctgatgatcttgtacataattggt

SEQ ID NO: 21325 - DNA, 25 bp, Mus musculus
cctgatgcaggtgcttctgtcaggc

SEQ ID NO: 21326 - DNA, 25 bp, Mus musculus
cctgatgcagtagaggtgacaccca

SEQ ID NO: 21327 - DNA, 25 bp, Mus musculus
cctgatgccatcaagcccgtgggaa

SEQ ID NO: 21328 - DNA, 25 bp, Mus musculus
cctgatgccatctagcccgtgggaa

SEQ ID NO: 21329 - DNA, 25 bp, Mus musculus
cctgatgcttattgtaacttggctc

SEQ ID NO: 21330 - DNA, 25 bp, Mus musculus
cctgatggaggcaaattccaccccg

SEQ ID NO: 21331 - DNA, 25 bp, Mus musculus
cctgatggataaaatggaaaaggac

SEQ ID NO: 21332 - DNA, 25 bp, Mus musculus
cctgatggataatatggaaaaggac

SEQ ID NO: 21333 - DNA, 25 bp, Mus musculus
cctgatggatttcgtggagttccat

SEQ ID NO: 21334 - DNA, 25 bp, Mus musculus
cctgatggatttggtggagttccat

SEQ ID NO: 21335 - DNA, 25 bp, Mus musculus
cctgatggccagtatgtccccagaa

SEQ ID NO: 21336 - DNA, 25 bp, Mus musculus
cctgatgggaagacaattgaggctg

SEQ ID NO: 21337 - DNA, 25 bp, Mus musculus
cctgatgggaccacagtagagccac

SEQ ID NO: 21338 - DNA, 25 bp, Mus musculus
cctgatgggcaggaaaattgtttgt

SEQ ID NO: 21339 - DNA, 25 bp, Mus musculus
cctgatgggctcaggcctccgaaag

SEQ ID NO: 21340 - DNA, 25 bp, Mus musculus
cctgatgtgatgtctcctgctggag

SEQ ID NO: 21341 - DNA, 25 bp, Mus musculus
cctgatgttactacgcctcagcaag

SEQ ID NO: 21342 - DNA, 25 bp, Mus musculus
cctgatgttctagttcagtgtctta

SEQ ID NO: 21343 - DNA, 25 bp, Mus musculus
cctgattagcatgggatccaacgac

SEQ ID NO: 21344 - DNA, 25 bp, Mus musculus
cctgattatggatcgctggccagac

SEQ ID NO: 21345 - DNA, 25 bp, Mus musculus
cctgattctgatgatattaaggcaa

SEQ ID NO: 21346 - DNA, 25 bp, Mus musculus
cctgattggcggctattactgtgat

SEQ ID NO: 21347 - DNA, 25 bp, Mus musculus
cctgatttaagaaggatcctgacag

SEQ ID NO: 21348 - DNA, 25 bp, Mus musculus
cctgatttgagatcaattcttggag

SEQ ID NO: 21349 - DNA, 25 bp, Mus musculus
cctgatttggcccagtgttttttct

SEQ ID NO: 21350 - DNA, 25 bp, Mus musculus
cctgatttgtctccagggtacctgg

SEQ ID NO: 21351 - DNA, 25 bp, Mus musculus
cctgcaaaaagaaccgcatccgagt

SEQ ID NO: 21352 - DNA, 25 bp, Mus musculus
cctgcaaagaagaagtctggttcca

SEQ ID NO: 21353 - DNA, 25 bp, Mus musculus
cctgcaactgggacgaagctgatat

SEQ ID NO: 21354 - DNA, 25 bp, Mus musculus
cctgcaaggagcttgctcagactac

SEQ ID NO: 21355 - DNA, 25 bp, Mus musculus
cctgcaatacagtggatacagtttg

SEQ ID NO: 21356 - DNA, 25 bp, Mus musculus
cctgcacagggtacatcctatagaa

SEQ ID NO: 21357 - DNA, 25 bp, Mus musculus
cctgcacccagtactcatgtcggag

SEQ ID NO: 21358 - DNA, 25 bp, Mus musculus
cctgcactgacaccacagacagtta

SEQ ID NO: 21359 - DNA, 25 bp, Mus musculus
cctgcactgtatactatttttcaag

SEQ ID NO: 21360 - DNA, 25 bp, Mus musculus
cctgcacttcccctcggtggtagat

SEQ ID NO: 21361 - DNA, 25 bp, Mus musculus
cctgcagaaaatgaggttactagac

SEQ ID NO: 21362 - DNA, 25 bp, Mus musculus
cctgcagaagctatacctgaaggag

SEQ ID NO: 21363 - DNA, 25 bp, Mus musculus
cctgcagacaattgtccagcaccat

SEQ ID NO: 21364 - DNA, 25 bp, Mus musculus
cctgcagacccgaacaacatatttc

SEQ ID NO: 21365 - DNA, 25 bp, Mus musculus
cctgcagagaacatagaaatagcat

SEQ ID NO: 21366 - DNA, 25 bp, Mus musculus
cctgcagagtctgaggcgattcctg

SEQ ID NO: 21367 - DNA, 25 bp, Mus musculus
cctgcagatcccagaagagccaaga

SEQ ID NO: 21368 - DNA, 25 bp, Mus musculus
cctgcagcaagatgggctagaaaat

SEQ ID NO: 21369 - DNA, 25 bp, Mus musculus
cctgcagcatcaatccgtgccttaa

SEQ ID NO: 21370 - DNA, 25 bp, Mus musculus
cctgcagccagaagtcttagacaag

SEQ ID NO: 21371 - DNA, 25 bp, Mus musculus
cctgcagctggacacttgccactgt

SEQ ID NO: 21372 - DNA, 25 bp, Mus musculus
cctgcaggaggccaatggaagcaca

SEQ ID NO: 21373 - DNA, 25 bp, Mus musculus
cctgcaggcacaggattaggctcgg

SEQ ID NO: 21374 - DNA, 25 bp, Mus musculus
cctgcaggctcatgaggaacaattg

SEQ ID NO: 21375 - DNA, 25 bp, Mus musculus
cctgcagggtcctatttgactacca

SEQ ID NO: 21376 - DNA, 25 bp, Mus musculus
cctgcaggtgaacaaggacccagag

SEQ ID NO: 21377 - DNA, 25 bp, Mus musculus
cctgcaggttgcagaagtgtctaaa

SEQ ID NO: 21378 - DNA, 25 bp, Mus musculus
cctgcagtaccagccaaaaaggcta

SEQ ID NO: 21379 - DNA, 25 bp, Mus musculus
cctgcagtgatggtgacctgggcca

SEQ ID NO: 21380 - DNA, 25 bp, Mus musculus
cctgcagtgccatacctgagctctt

SEQ ID NO: 21381 - DNA, 25 bp, Mus musculus
cctgcagtgcgactagacttctata

SEQ ID NO: 21382 - DNA, 25 bp, Mus musculus
cctgcagtgcgagtagacttctata

SEQ ID NO: 21383 - DNA, 25 bp, Mus musculus
cctgcatagcaagctgtctgtgatc

SEQ ID NO: 21384 - DNA, 25 bp, Mus musculus
cctgcatcaagtgctgcctggaaga

SEQ ID NO: 21385 - DNA, 25 bp, Mus musculus
cctgcatcaattacaagttctaatg

SEQ ID NO: 21386 - DNA, 25 bp, Mus musculus
cctgcatcaattgagcgagttcaag

SEQ ID NO: 21387 - DNA, 25 bp, Mus musculus
cctgcatcaggattgagcaagggtg

SEQ ID NO: 21388 - DNA, 25 bp, Mus musculus
cctgcatgcaaatgtgagtggtggc

SEQ ID NO: 21389 - DNA, 25 bp, Mus musculus
cctgcatgcaagcaagcacttttgt

SEQ ID NO: 21390 - DNA, 25 bp, Mus musculus
cctgcatgttaatgggtttaacgga

SEQ ID NO: 21391 - DNA, 25 bp, Mus musculus
cctgcattaccagcgcgtgggagaa

SEQ ID NO: 21392 - DNA, 25 bp, Mus musculus
cctgcatttcatagacaaggcaaag

SEQ ID NO: 21393 - DNA, 25 bp, Mus musculus
cctgccaacatcctgtattagagga

SEQ ID NO: 21394 - DNA, 25 bp, Mus musculus
cctgccaacatcgagtctataaatt

SEQ ID NO: 21395 - DNA, 25 bp, Mus musculus
cctgccaagcacagctctggagtta

SEQ ID NO: 21396 - DNA, 25 bp, Mus musculus
cctgccaagtcagcaatcctgtaag

SEQ ID NO: 21397 - DNA, 25 bp, Mus musculus
cctgccagagagtccaggtggcacc

SEQ ID NO: 21398 - DNA, 25 bp, Mus musculus
cctgccagagtgtcccctgatgagt

SEQ ID NO: 21399 - DNA, 25 bp, Mus musculus
cctgccagatgctgacagggagcgt

SEQ ID NO: 21400 - DNA, 25 bp, Mus musculus
cctgccaggagtatactgtcacaga

SEQ ID NO: 21401 - DNA, 25 bp, Mus musculus
cctgccaggctcagagaaggacaat

SEQ ID NO: 21402 - DNA, 25 bp, Mus musculus
cctgccatattcagtaagaactgaa

SEQ ID NO: 21403 - DNA, 25 bp, Mus musculus
cctgccatcaaagtgctaagaaaaa

SEQ ID NO: 21404 - DNA, 25 bp, Mus musculus
cctgccatctggactcctatggttg

SEQ ID NO: 21405 - DNA, 25 bp, Mus musculus
cctgccccataaacattgaggaata

SEQ ID NO: 21406 - DNA, 25 bp, Mus musculus
cctgcccgggtggaaggtcgaatgt

SEQ ID NO: 21407 - DNA, 25 bp, Mus musculus
cctgcccttcggagcgagtgactgt

SEQ ID NO: 21408 - DNA, 25 bp, Mus musculus
cctgccgcaagtcccgtggagaatc

SEQ ID NO: 21409 - DNA, 25 bp, Mus musculus
cctgccgcagagagccaagttaaaa

SEQ ID NO: 21410 - DNA, 25 bp, Mus musculus
cctgccgctgcttcataggcactgt

SEQ ID NO: 21411 - DNA, 25 bp, Mus musculus
cctgccgggaagcacattatcacaa

SEQ ID NO: 21412 - DNA, 25 bp, Mus musculus
cctgcctccggaataagctgttgaa

SEQ ID NO: 21413 - DNA, 25 bp, Mus musculus
cctgcctgccagaagtgaaccatga

SEQ ID NO: 21414 - DNA, 25 bp, Mus musculus
cctgcctggaaagacgggtccactg

SEQ ID NO: 21415 - DNA, 25 bp, Mus musculus
cctgcctggacgagatgaacgtggt

SEQ ID NO: 21416 - DNA, 25 bp, Mus musculus
cctgcctgggtggtatcactgtgag

SEQ ID NO: 21417 - DNA, 25 bp, Mus musculus
cctgccttcgtgagcacagtgggca

SEQ ID NO: 21418 - DNA, 25 bp, Mus musculus
cctgccttgataaacttggtgacca

SEQ ID NO: 21419 - DNA, 25 bp, Mus musculus
cctgccttgtctcaaagagaagaga

SEQ ID NO: 21420 - DNA, 25 bp, Mus musculus
cctgcctttgccaatggattgctgg

SEQ ID NO: 21421 - DNA, 25 bp, Mus musculus
cctgcctttggactataaagaggga

SEQ ID NO: 21422 - DNA, 25 bp, Mus musculus
cctgcgaccacaccaaggggttgga

SEQ ID NO: 21423 - DNA, 25 bp, Mus musculus
cctgcgaccacagcaaggggttgga

SEQ ID NO: 21424 - DNA, 25 bp, Mus musculus
cctgcgactggctttgggttgtacc

SEQ ID NO: 21425 - DNA, 25 bp, Mus musculus
cctgcgagcaagttcagtggtgtca

SEQ ID NO: 21426 - DNA, 25 bp, Mus musculus
cctgcgcagctctgtggacacactt

SEQ ID NO: 21427 - DNA, 25 bp, Mus musculus
cctgcgcagtggaggtcacctattt

SEQ ID NO: 21428 - DNA, 25 bp, Mus musculus
cctgcgcccaggagttacaaatgaa

SEQ ID NO: 21429 - DNA, 25 bp, Mus musculus
cctgcgcttcctacaacttttcttt

SEQ ID NO: 21430 - DNA, 25 bp, Mus musculus
cctgcggaagaattagaggcatgtt

SEQ ID NO: 21431 - DNA, 25 bp, Mus musculus
cctgcggagttctacctccaggtgg

SEQ ID NO: 21432 - DNA, 25 bp, Mus musculus
cctgcggctgccctactctgtagtg

SEQ ID NO: 21433 - DNA, 25 bp, Mus musculus
cctgcggtcataatcaagcacatag

SEQ ID NO: 21434 - DNA, 25 bp, Mus musculus
cctgcggtcatattcaagcacatag

SEQ ID NO: 21435 - DNA, 25 bp, Mus musculus
cctgcggtggtcatgaatcggttca

SEQ ID NO: 21436 - DNA, 25 bp, Mus musculus
cctgcggttatgtaatgtggcagaa

SEQ ID NO: 21437 - DNA, 25 bp, Mus musculus
cctgcgtatgttccgaggttctctg

SEQ ID NO: 21438 - DNA, 25 bp, Mus musculus
cctgcgtctacagaggtctgtggtt

SEQ ID NO: 21439 - DNA, 25 bp, Mus musculus
cctgcgtgcagaggtggacacattc

SEQ ID NO: 21440 - DNA, 25 bp, Mus musculus
cctgcgttatgatgggacccacctc

SEQ ID NO: 21441 - DNA, 25 bp, Mus musculus
cctgctacaatcagtggctgggaac

SEQ ID NO: 21442 - DNA, 25 bp, Mus musculus
cctgctactgctggattagcaccag

SEQ ID NO: 21443 - DNA, 25 bp, Mus musculus
cctgctagactcatcagtggagagg

SEQ ID NO: 21444 - DNA, 25 bp, Mus musculus
cctgctatacattgaacccggtgct

SEQ ID NO: 21445 - DNA, 25 bp, Mus musculus
cctgctatctgctgagaaacatgac

SEQ ID NO: 21446 - DNA, 25 bp, Mus musculus
cctgctcacagaatcacagctaagg

SEQ ID NO: 21447 - DNA, 25 bp, Mus musculus
cctgctcacatgagaagtgatagga

SEQ ID NO: 21448 - DNA, 25 bp, Mus musculus
cctgctccaaggactgcacggtgaa

SEQ ID NO: 21449 - DNA, 25 bp, Mus musculus
cctgctccagtaggaggagctgaag

SEQ ID NO: 21450 - DNA, 25 bp, Mus musculus
cctgctcgagaacgacacgaaggga

SEQ ID NO: 21451 - DNA, 25 bp, Mus musculus
cctgctctctgccagaatggccgat

SEQ ID NO: 21452 - DNA, 25 bp, Mus musculus
cctgctctctgcgagaatggccgat

SEQ ID NO: 21453 - DNA, 25 bp, Mus musculus
cctgctcttccgcaatagacctgtt

SEQ ID NO: 21454 - DNA, 25 bp, Mus musculus
cctgctcttggcttctgtggtctgg

SEQ ID NO: 21455 - DNA, 25 bp, Mus musculus
cctgctcttttcaaagcttccagta

SEQ ID NO: 21456 - DNA, 25 bp, Mus musculus
cctgctgagagtactgtcgtcctgc

SEQ ID NO: 21457 - DNA, 25 bp, Mus musculus
cctgctgagatatcctgctgatcct

SEQ ID NO: 21458 - DNA, 25 bp, Mus musculus
cctgctgagatgtggtgaacagtct

SEQ ID NO: 21459 - DNA, 25 bp, Mus musculus
cctgctgagtactccctggatccag

SEQ ID NO: 21460 - DNA, 25 bp, Mus musculus
cctgctgatcatgaagctgacagag

SEQ ID NO: 21461 - DNA, 25 bp, Mus musculus
cctgctgcagctcagagagccgatg

SEQ ID NO: 21462 - DNA, 25 bp, Mus musculus
cctgctgcatctgagcctgtgatac

SEQ ID NO: 21463 - DNA, 25 bp, Mus musculus
cctgctgcatgtaccatcttaaaga

SEQ ID NO: 21464 - DNA, 25 bp, Mus musculus
cctgctgcggaatcatggcattgct

SEQ ID NO: 21465 - DNA, 25 bp, Mus musculus
cctgctgctgaagagcagctcttgg

SEQ ID NO: 21466 - DNA, 25 bp, Mus musculus
cctgctggaacttgggcccaagcct

SEQ ID NO: 21467 - DNA, 25 bp, Mus musculus
cctgctggactggatgctatgagtt

SEQ ID NO: 21468 - DNA, 25 bp, Mus musculus
cctgctggtcttgttcctgtaacct

SEQ ID NO: 21469 - DNA, 25 bp, Mus musculus
cctgctgtatccaaagtcacttcca

SEQ ID NO: 21470 - DNA, 25 bp, Mus musculus
cctgctgtcactagagtatgatttt

SEQ ID NO: 21471 - DNA, 25 bp, Mus musculus
cctgctgtccttcactgggagcact

SEQ ID NO: 21472 - DNA, 25 bp, Mus musculus
cctgctgtcgtttagttgatctatt

SEQ ID NO: 21473 - DNA, 25 bp, Mus musculus
cctgctgtggaatttggacaaatcc

SEQ ID NO: 21474 - DNA, 25 bp, Mus musculus
cctgctgttatggttctccttctta

SEQ ID NO: 21475 - DNA, 25 bp, Mus musculus
cctgcttacttagacatcttggaca

SEQ ID NO: 21476 - DNA, 25 bp, Mus musculus
cctgcttatcaccataatgggcatc

SEQ ID NO: 21477 - DNA, 25 bp, Mus musculus
cctgcttcaatgacctatgatgaca

SEQ ID NO: 21478 - DNA, 25 bp, Mus musculus
cctgcttcgagaatggctgccactc

SEQ ID NO: 21479 - DNA, 25 bp, Mus musculus
cctgcttctcaagtaggactgatga

SEQ ID NO: 21480 - DNA, 25 bp, Mus musculus
cctgcttctgaaacaaatgtcagaa

SEQ ID NO: 21481 - DNA, 25 bp, Mus musculus
cctgcttctgaatcaaatgtcagaa

SEQ ID NO: 21482 - DNA, 25 bp, Mus musculus
cctgcttgacaaggctgctctgtag

SEQ ID NO: 21483 - DNA, 25 bp, Mus musculus
cctgcttgctgtggaaaagtcacac

SEQ ID NO: 21484 - DNA, 25 bp, Mus musculus
cctgctttacatgatgctagtgatg

SEQ ID NO: 21485 - DNA, 25 bp, Mus musculus
cctgctttagccctcagtgctgtga

SEQ ID NO: 21486 - DNA, 25 bp, Mus musculus
cctgctttgcttgaggtgatcattc

SEQ ID NO: 21487 - DNA, 25 bp, Mus musculus
cctgcttttgattgaaagggacagc

SEQ ID NO: 21488 - DNA, 25 bp, Mus musculus
cctgcttttgcctgtacactggctt

SEQ ID NO: 21489 - DNA, 25 bp, Mus musculus
cctgctttttctcatcctcatcgga

SEQ ID NO: 21490 - DNA, 25 bp, Mus musculus
cctggaaaaagacgtccttatggag

SEQ ID NO: 21491 - DNA, 25 bp, Mus musculus
cctggaaaactgatggtagtacacc

SEQ ID NO: 21492 - DNA, 25 bp, Mus musculus
cctggaaaatcatctgcccggcatg

SEQ ID NO: 21493 - DNA, 25 bp, Mus musculus
cctggaaaattgactagtattaagt

SEQ ID NO: 21494 - DNA, 25 bp, Mus musculus
cctggaaacacctgcatggtttaga

SEQ ID NO: 21495 - DNA, 25 bp, Mus musculus
cctggaaacttggactactggacat

SEQ ID NO: 21496 - DNA, 25 bp, Mus musculus
cctggaaagaaaacatctaatagcc

SEQ ID NO: 21497 - DNA, 25 bp, Mus musculus
cctggaaagaaatcatctaatagcc

SEQ ID NO: 21498 - DNA, 25 bp, Mus musculus
cctggaaaggatagaagctaatgcc

SEQ ID NO: 21499 - DNA, 25 bp, Mus musculus
cctggaaatgtatcttattctgaga

SEQ ID NO: 21500 - DNA, 25 bp, Mus musculus
cctggaaatgtatgggatcaactat

SEQ ID NO: 21501 - DNA, 25 bp, Mus musculus
cctggaacaagtgatccggctggct

SEQ ID NO: 21502 - DNA, 25 bp, Mus musculus
cctggaacatgaactgagaagagaa

SEQ ID NO: 21503 - DNA, 25 bp, Mus musculus
cctggaaccaaagtgcagcattgcc

SEQ ID NO: 21504 - DNA, 25 bp, Mus musculus
cctggaactccgaggctgacttaga

SEQ ID NO: 21505 - DNA, 25 bp, Mus musculus
cctggaactggttctctagaccatg

SEQ ID NO: 21506 - DNA, 25 bp, Mus musculus
cctggaagaacaaggagtggagacc

SEQ ID NO: 21507 - DNA, 25 bp, Mus musculus
cctggaagatgtaaggcatgcactg

SEQ ID NO: 21508 - DNA, 25 bp, Mus musculus
cctggaagatgttaggcatgcactg

SEQ ID NO: 21509 - DNA, 25 bp, Mus musculus
cctggaagccaaagaccggattgga

SEQ ID NO: 21510 - DNA, 25 bp, Mus musculus
cctggaagccctggagaacaagact

SEQ ID NO: 21511 - DNA, 25 bp, Mus musculus
cctggaagtagatgtaagtgaaaaa

SEQ ID NO: 21512 - DNA, 25 bp, Mus musculus
cctggaagtgatctggagaccccag

SEQ ID NO: 21513 - DNA, 25 bp, Mus musculus
cctggaagtgcgagttcgagaagtt

SEQ ID NO: 21514 - DNA, 25 bp, Mus musculus
cctggaagtgcgtgttcgagaagtt

SEQ ID NO: 21515 - DNA, 25 bp, Mus musculus
cctggaatatataaatgtgttgtct

SEQ ID NO: 21516 - DNA, 25 bp, Mus musculus
cctggaatcctgcaggtacctggag

SEQ ID NO: 21517 - DNA, 25 bp, Mus musculus
cctggaatcgtatttgttgcagcca

SEQ ID NO: 21518 - DNA, 25 bp, Mus musculus
cctggaatgctctgggagacaccgt

SEQ ID NO: 21519 - DNA, 25 bp, Mus musculus
cctggaatgggagcaccgttgactg

SEQ ID NO: 21520 - DNA, 25 bp, Mus musculus
cctggaatgtcttcattatctgctt

SEQ ID NO: 21521 - DNA, 25 bp, Mus musculus
cctggaattggttgcatttagtact

SEQ ID NO: 21522 - DNA, 25 bp, Mus musculus
cctggaattgtgtcgccatttaaac

SEQ ID NO: 21523 - DNA, 25 bp, Mus musculus
cctggaatttgatgacctagatggg

SEQ ID NO: 21524 - DNA, 25 bp, Mus musculus
cctggacaacaacagcctgaaggtt

SEQ ID NO: 21525 - DNA, 25 bp, Mus musculus
cctggacagcagtagcattctagct

SEQ ID NO: 21526 - DNA, 25 bp, Mus musculus
cctggacagctaccgacgggatctt

SEQ ID NO: 21527 - DNA, 25 bp, Mus musculus
cctggacatgaagaacaccacatgc

SEQ ID NO: 21528 - DNA, 25 bp, Mus musculus
cctggacatggctgccaactggcag

SEQ ID NO: 21529 - DNA, 25 bp, Mus musculus
cctggaccactggtttgcactcagt

SEQ ID NO: 21530 - DNA, 25 bp, Mus musculus
cctggaccagtagagctggattaaa

SEQ ID NO: 21531 - DNA, 25 bp, Mus musculus
cctggaccattcatttttgcagata

SEQ ID NO: 21532 - DNA, 25 bp, Mus musculus
cctggaccatttttcagatttagcc

SEQ ID NO: 21533 - DNA, 25 bp, Mus musculus
cctggaccctgttcagagggagctc

SEQ ID NO: 21534 - DNA, 25 bp, Mus musculus
cctggacgactcttgggagaaggct

SEQ ID NO: 21535 - DNA, 25 bp, Mus musculus
cctggacgagccatcagtgaagacc

SEQ ID NO: 21536 - DNA, 25 bp, Mus musculus
cctggacgcctttgtttttagccat

SEQ ID NO: 21537 - DNA, 25 bp, Mus musculus
cctggactatttggccattggtgtc

SEQ ID NO: 21538 - DNA, 25 bp, Mus musculus
cctggactgcatttttggaaaaagg

SEQ ID NO: 21539 - DNA, 25 bp, Mus musculus
cctggactgcgatgtgattgtagct

SEQ ID NO: 21540 - DNA, 25 bp, Mus musculus
cctggactggaagtaggactgcacc

SEQ ID NO: 21541 - DNA, 25 bp, Mus musculus
cctggacttagaacagaggaatttg

SEQ ID NO: 21542 - DNA, 25 bp, Mus musculus
cctggacttcatcgccagcaaggga

SEQ ID NO: 21543 - DNA, 25 bp, Mus musculus
cctggacttgctggattccacctta

SEQ ID NO: 21544 - DNA, 25 bp, Mus musculus
cctggagaagagtgccgtactccaa

SEQ ID NO: 21545 - DNA, 25 bp, Mus musculus
cctggagaagcatcgggaatcagga

SEQ ID NO: 21546 - DNA, 25 bp, Mus musculus
cctggagaagctgaacatgcaagcc

SEQ ID NO: 21547 - DNA, 25 bp, Mus musculus
cctggagaaggagatcgagacctac

SEQ ID NO: 21548 - DNA, 25 bp, Mus musculus
cctggagaaggagggcgatttctcc

SEQ ID NO: 21549 - DNA, 25 bp, Mus musculus
cctggagaatgcaaaatcggcatca

SEQ ID NO: 21550 - DNA, 25 bp, Mus musculus
cctggagacagtgggtcagaagttc

SEQ ID NO: 21551 - DNA, 25 bp, Mus musculus
cctggagagagaagcgtctatagcc

SEQ ID NO: 21552 - DNA, 25 bp, Mus musculus
cctggagagcattgccgtggccaaa

SEQ ID NO: 21553 - DNA, 25 bp, Mus musculus
cctggagaggacaaagggataatgc

SEQ ID NO: 21554 - DNA, 25 bp, Mus musculus
cctggagaggtgttgatatgtgacc

SEQ ID NO: 21555 - DNA, 25 bp, Mus musculus
cctggagatgcgatggtgaaaatga

SEQ ID NO: 21556 - DNA, 25 bp, Mus musculus
cctggagcacctgcatagcaagctg

SEQ ID NO: 21557 - DNA, 25 bp, Mus musculus
cctggagcagcggaaggagtacgag

SEQ ID NO: 21558 - DNA, 25 bp, Mus musculus
cctggagcagctcaatgtcatcaat

SEQ ID NO: 21559 - DNA, 25 bp, Mus musculus
cctggagccatggataactttcacc

SEQ ID NO: 21560 - DNA, 25 bp, Mus musculus
cctggagcgatatgtggagacacaa

SEQ ID NO: 21561 - DNA, 25 bp, Mus musculus
cctggagcgtcagaaccaggagtac

SEQ ID NO: 21562 - DNA, 25 bp, Mus musculus
cctggagctgttttgccagattatc

SEQ ID NO: 21563 - DNA, 25 bp, Mus musculus
cctggaggacaagcaacatcttgaa

SEQ ID NO: 21564 - DNA, 25 bp, Mus musculus
cctggaggacctcaatatgctctac

SEQ ID NO: 21565 - DNA, 25 bp, Mus musculus
cctggaggagcggaggcaggtgcct

SEQ ID NO: 21566 - DNA, 25 bp, Mus musculus
cctggaggagggacgtctgacgctg

SEQ ID NO: 21567 - DNA, 25 bp, Mus musculus
cctggaggattacctacggctcaaa

SEQ ID NO: 21568 - DNA, 25 bp, Mus musculus
cctggaggatttcccgatggatgct

SEQ ID NO: 21569 - DNA, 25 bp, Mus musculus
cctggaggctgcatttcatggagga

SEQ ID NO: 21570 - DNA, 25 bp, Mus musculus
cctggaggtaggcaagcttcacacc

SEQ ID NO: 21571 - DNA, 25 bp, Mus musculus
cctggaggttcagtataaagctgac

SEQ ID NO: 21572 - DNA, 25 bp, Mus musculus
cctggagtaatatcgccaagctgca

SEQ ID NO: 21573 - DNA, 25 bp, Mus musculus
cctggagtgtcctttttggtgcagg

SEQ ID NO: 21574 - DNA, 25 bp, Mus musculus
cctggagtgtgtgagatactgcatc

SEQ ID NO: 21575 - DNA, 25 bp, Mus musculus
cctggataaacgtagaaggagtagc

SEQ ID NO: 21576 - DNA, 25 bp, Mus musculus
cctggataagatcatagaagaaggc

SEQ ID NO: 21577 - DNA, 25 bp, Mus musculus
cctggatagtgaccaccgtggactg

SEQ ID NO: 21578 - DNA, 25 bp, Mus musculus
cctggatgaaaatgctattgctcag

SEQ ID NO: 21579 - DNA, 25 bp, Mus musculus
cctggatgaaatcacctctgggaaa

SEQ ID NO: 21580 - DNA, 25 bp, Mus musculus
cctggatgacatccccttggacatg

SEQ ID NO: 21581 - DNA, 25 bp, Mus musculus
cctggatgccaggtctctgtgtgca

SEQ ID NO: 21582 - DNA, 25 bp, Mus musculus
cctggatgccccagaggcccagagt

SEQ ID NO: 21583 - DNA, 25 bp, Mus musculus
cctggatgctcacgaagagactggt

SEQ ID NO: 21584 - DNA, 25 bp, Mus musculus
cctggatggcaatgacgagaagtac

SEQ ID NO: 21585 - DNA, 25 bp, Mus musculus
cctggatggtgtggagatcattacc

SEQ ID NO: 21586 - DNA, 25 bp, Mus musculus
cctggatgtcacgagtatccgagat

SEQ ID NO: 21587 - DNA, 25 bp, Mus musculus
cctggattccctggaccattcattt

SEQ ID NO: 21588 - DNA, 25 bp, Mus musculus
cctggattgaatcaaatggaggaag

SEQ ID NO: 21589 - DNA, 25 bp, Mus musculus
cctggcaaatctatctgcagaggcg

SEQ ID NO: 21590 - DNA, 25 bp, Mus musculus
cctggcaatgccttagagaaggagg

SEQ ID NO: 21591 - DNA, 25 bp, Mus musculus
cctggcaattaaaggtgtccattct

SEQ ID NO: 21592 - DNA, 25 bp, Mus musculus
cctggcagacgatgacatcatgctg

SEQ ID NO: 21593 - DNA, 25 bp, Mus musculus
cctggcagaggaaaatttgaagaaa

SEQ ID NO: 21594 - DNA, 25 bp, Mus musculus
cctggcaggcgctccggccttaatg

SEQ ID NO: 21595 - DNA, 25 bp, Mus musculus
cctggcagggtcagctgcaagaaca

SEQ ID NO: 21596 - DNA, 25 bp, Mus musculus
cctggcagtagtaagcatcatggct

SEQ ID NO: 21597 - DNA, 25 bp, Mus musculus
cctggcagtgttaaaactgaacgag

SEQ ID NO: 21598 - DNA, 25 bp, Mus musculus
cctggcatactgcataaatggaagc

SEQ ID NO: 21599 - DNA, 25 bp, Mus musculus
cctggcattgccagcgcatgggcta

SEQ ID NO: 21600 - DNA, 25 bp, Mus musculus
cctggccacattcacaagaagggaa

SEQ ID NO: 21601 - DNA, 25 bp, Mus musculus
cctggccagcaatgacttcctggga

SEQ ID NO: 21602 - DNA, 25 bp, Mus musculus
cctggccagcacgagaattctcaag

SEQ ID NO: 21603 - DNA, 25 bp, Mus musculus
cctggccctggacgctgatgaagat

SEQ ID NO: 21604 - DNA, 25 bp, Mus musculus
cctggccctgggattccttgctcaa

SEQ ID NO: 21605 - DNA, 25 bp, Mus musculus
cctggccggattcatcactgcatga

SEQ ID NO: 21606 - DNA, 25 bp, Mus musculus
cctggcctatgagtactttgtcatt

SEQ ID NO: 21607 - DNA, 25 bp, Mus musculus
cctggcctccagcttcaagagacgt

SEQ ID NO: 21608 - DNA, 25 bp, Mus musculus
cctggcctggcagtatgggccttgt

SEQ ID NO: 21609 - DNA, 25 bp, Mus musculus
cctggcctgtggtactatctccagt

SEQ ID NO: 21610 - DNA, 25 bp, Mus musculus
cctggccttcatcgttttcacagaa

SEQ ID NO: 21611 - DNA, 25 bp, Mus musculus
cctggcgaggactctcctgcctatt

SEQ ID NO: 21612 - DNA, 25 bp, Mus musculus
cctggctaactacaagctacggttc

SEQ ID NO: 21613 - DNA, 25 bp, Mus musculus
cctggctaagctggaggaacaaaac

SEQ ID NO: 21614 - DNA, 25 bp, Mus musculus
cctggctattccagagcttgctctg

SEQ ID NO: 21615 - DNA, 25 bp, Mus musculus
cctggctctaatcattggcttgtcg

SEQ ID NO: 21616 - DNA, 25 bp, Mus musculus
cctggctctccactttggccgtgtt

SEQ ID NO: 21617 - DNA, 25 bp, Mus musculus
cctggctctgccatttaaagttgtg

SEQ ID NO: 21618 - DNA, 25 bp, Mus musculus
cctggctgaagctccagcttgcact

SEQ ID NO: 21619 - DNA, 25 bp, Mus musculus
cctggctgatgaaagcagttttgga

SEQ ID NO: 21620 - DNA, 25 bp, Mus musculus
cctggctgccgagtgggtgatcagc

SEQ ID NO: 21621 - DNA, 25 bp, Mus musculus
cctggctgctgtcacatgagttgtg

SEQ ID NO: 21622 - DNA, 25 bp, Mus musculus
cctggctggaaacaaatgtgacatg

SEQ ID NO: 21623 - DNA, 25 bp, Mus musculus
cctggctggccatcagcaaggtgtt

SEQ ID NO: 21624 - DNA, 25 bp, Mus musculus
cctggctggctgtatccatggcctc

SEQ ID NO: 21625 - DNA, 25 bp, Mus musculus
cctggctttgagctaggagctgaca

SEQ ID NO: 21626 - DNA, 25 bp, Mus musculus
cctggcttttccttcctggtgcctg

SEQ ID NO: 21627 - DNA, 25 bp, Mus musculus
cctgggaacacatcaaggccgttcg

SEQ ID NO: 21628 - DNA, 25 bp, Mus musculus
cctgggaatctccagaaggagtacc

SEQ ID NO: 21629 - DNA, 25 bp, Mus musculus
cctgggacataaagctggttgccgc

SEQ ID NO: 21630 - DNA, 25 bp, Mus musculus
cctgggaccgggatctgcaatctct

SEQ ID NO: 21631 - DNA, 25 bp, Mus musculus
cctgggaccgtcttgtggacgagac

SEQ ID NO: 21632 - DNA, 25 bp, Mus musculus
cctgggacctcctgggctaatcggc

SEQ ID NO: 21633 - DNA, 25 bp, Mus musculus
cctgggactgaatcggcctgtgctg

SEQ ID NO: 21634 - DNA, 25 bp, Mus musculus
cctgggacttgaattaaggttgatt

SEQ ID NO: 21635 - DNA, 25 bp, Mus musculus
cctgggagctgtcacaaggacgcat

SEQ ID NO: 21636 - DNA, 25 bp, Mus musculus
cctgggaggcgccagctgaaaatct

SEQ ID NO: 21637 - DNA, 25 bp, Mus musculus
cctgggagtagatattgtcatagat

SEQ ID NO: 21638 - DNA, 25 bp, Mus musculus
cctgggatgcaacaacggatcaata

SEQ ID NO: 21639 - DNA, 25 bp, Mus musculus
cctgggcagcacaatcagtgtcaag

SEQ ID NO: 21640 - DNA, 25 bp, Mus musculus
cctgggccatacacttgtggaatct

SEQ ID NO: 21641 - DNA, 25 bp, Mus musculus
cctgggccggtatgcctatgtccgt

SEQ ID NO: 21642 - DNA, 25 bp, Mus musculus
cctgggcgtgctgaaggttctagcc

SEQ ID NO: 21643 - DNA, 25 bp, Mus musculus
cctgggctaagccatatgattggta

SEQ ID NO: 21644 - DNA, 25 bp, Mus musculus
cctgggctctgcaacatctgcactt

SEQ ID NO: 21645 - DNA, 25 bp, Mus musculus
cctgggctggaacatttacgcttcg

SEQ ID NO: 21646 - DNA, 25 bp, Mus musculus
cctgggcttatgaagacaaagcccc

SEQ ID NO: 21647 - DNA, 25 bp, Mus musculus
cctgggcttatgtacattcgtgaca

SEQ ID NO: 21648 - DNA, 25 bp, Mus musculus
cctgggcttctgtggcctccagatt

SEQ ID NO: 21649 - DNA, 25 bp, Mus musculus
cctgggcttggtagagaaccagagt

SEQ ID NO: 21650 - DNA, 25 bp, Mus musculus
cctgggcttggttgagaaccagagt

SEQ ID NO: 21651 - DNA, 25 bp, Mus musculus
cctggggccttgagtacctgaggac

SEQ ID NO: 21652 - DNA, 25 bp, Mus musculus
cctgggtcgcttggaagaagccaag

SEQ ID NO: 21653 - DNA, 25 bp, Mus musculus
cctgggtctgtcctccatgtttggg

SEQ ID NO: 21654 - DNA, 25 bp, Mus musculus
cctgggtgccatgcaagagactgta

SEQ ID NO: 21655 - DNA, 25 bp, Mus musculus
cctgggtgctgtgatcctgggcttc

SEQ ID NO: 21656 - DNA, 25 bp, Mus musculus
cctgggtgctttttaatctttactg

SEQ ID NO: 21657 - DNA, 25 bp, Mus musculus
cctgggttaccttgtcagatggaac

SEQ ID NO: 21658 - DNA, 25 bp, Mus musculus
cctgggttcccaacaggacaaatag

SEQ ID NO: 21659 - DNA, 25 bp, Mus musculus
cctgggttgcccactggctgaagag

SEQ ID NO: 21660 - DNA, 25 bp, Mus musculus
cctggtaaagtacatagaccttgct

SEQ ID NO: 21661 - DNA, 25 bp, Mus musculus
cctggtaattccacctactgaagac

SEQ ID NO: 21662 - DNA, 25 bp, Mus musculus
cctggtacagtctctgaaggagtac

SEQ ID NO: 21663 - DNA, 25 bp, Mus musculus
cctggtactcattatgtagctccag

SEQ ID NO: 21664 - DNA, 25 bp, Mus musculus
cctggtcaagcctgagagagatgac

SEQ ID NO: 21665 - DNA, 25 bp, Mus musculus
cctggtcaccatgccagttgatgac

SEQ ID NO: 21666 - DNA, 25 bp, Mus musculus
cctggtcagaatagttaatttatga

SEQ ID NO: 21667 - DNA, 25 bp, Mus musculus
cctggtcaggattgtggtcactcga

SEQ ID NO: 21668 - DNA, 25 bp, Mus musculus
cctggtcatgcactacagaggagag

SEQ ID NO: 21669 - DNA, 25 bp, Mus musculus
cctggtcatggataacctggactca

SEQ ID NO: 21670 - DNA, 25 bp, Mus musculus
cctggtccgtcgagagtcagaactc

SEQ ID NO: 21671 - DNA, 25 bp, Mus musculus
cctggtcctaaagggattatgtgcc

SEQ ID NO: 21672 - DNA, 25 bp, Mus musculus
cctggtctcaatggcgcagtcaggg

SEQ ID NO: 21673 - DNA, 25 bp, Mus musculus
cctggtctcggataagctgaatgtc

SEQ ID NO: 21674 - DNA, 25 bp, Mus musculus
cctggtctgtggatgaagtgataca

SEQ ID NO: 21675 - DNA, 25 bp, Mus musculus
cctggtgaccataaatcgttctgct

SEQ ID NO: 21676 - DNA, 25 bp, Mus musculus
cctggtgaccattaatcgttctgct

SEQ ID NO: 21677 - DNA, 25 bp, Mus musculus
cctggtgatactgttgacaaccgca

SEQ ID NO: 21678 - DNA, 25 bp, Mus musculus
cctggtgcacaatggctgggacgac

SEQ ID NO: 21679 - DNA, 25 bp, Mus musculus
cctggtgcacctgctgattcggtac

SEQ ID NO: 21680 - DNA, 25 bp, Mus musculus
cctggtgcagagactcagcagaagt

SEQ ID NO: 21681 - DNA, 25 bp, Mus musculus
cctggtggaagatacctgtctgtgc

SEQ ID NO: 21682 - DNA, 25 bp, Mus musculus
cctggtggaccggagtctgagaaat

SEQ ID NO: 21683 - DNA, 25 bp, Mus musculus
cctggtggacctcaaatggcgcttc

SEQ ID NO: 21684 - DNA, 25 bp, Mus musculus
cctggtggactcagagaaggatgca

SEQ ID NO: 21685 - DNA, 25 bp, Mus musculus
cctggtggagaactttgagcctctc

SEQ ID NO: 21686 - DNA, 25 bp, Mus musculus
cctggtggcatctgttcctatagga

SEQ ID NO: 21687 - DNA, 25 bp, Mus musculus
cctggtggccaacaactgggttctg

SEQ ID NO: 21688 - DNA, 25 bp, Mus musculus
cctggtggctgacttcaggcagagg

SEQ ID NO: 21689 - DNA, 25 bp, Mus musculus
cctggtggtattaccagtatcagag

SEQ ID NO: 21690 - DNA, 25 bp, Mus musculus
cctggtggtcatctagccccaggaa

SEQ ID NO: 21691 - DNA, 25 bp, Mus musculus
cctggtggttatctgcatattaagt

SEQ ID NO: 21692 - DNA, 25 bp, Mus musculus
cctggtgtcaagatgctgagcctaa

SEQ ID NO: 21693 - DNA, 25 bp, Mus musculus
cctggtgtcttcgtcgcggcttgga

SEQ ID NO: 21694 - DNA, 25 bp, Mus musculus
cctggtgtgattcgcagaagtagaa

SEQ ID NO: 21695 - DNA, 25 bp, Mus musculus
cctggtgtgtgatcgaaagaacctg

SEQ ID NO: 21696 - DNA, 25 bp, Mus musculus
cctggtgttcaaatgcaagctattc

SEQ ID NO: 21697 - DNA, 25 bp, Mus musculus
cctggtgttctccagcggagcctct

SEQ ID NO: 21698 - DNA, 25 bp, Mus musculus
cctggtgtttggacatatggaaact

SEQ ID NO: 21699 - DNA, 25 bp, Mus musculus
cctggtgtttggtcatatggaaact

SEQ ID NO: 21700 - DNA, 25 bp, Mus musculus
cctggtgttttccatcataaggaga

SEQ ID NO: 21701 - DNA, 25 bp, Mus musculus
cctggttacagtgtgggacctccca

SEQ ID NO: 21702 - DNA, 25 bp, Mus musculus
cctggttaggcgcaaaaattttgtg

SEQ ID NO: 21703 - DNA, 25 bp, Mus musculus
cctggttctgcctcagctaccatat

SEQ ID NO: 21704 - DNA, 25 bp, Mus musculus
cctggttctggttattgttgcttcc

SEQ ID NO: 21705 - DNA, 25 bp, Mus musculus
cctggttggtatcccgggacttcag

SEQ ID NO: 21706 - DNA, 25 bp, Mus musculus
cctggtttgtacctgctatggagga

SEQ ID NO: 21707 - DNA, 25 bp, Mus musculus
cctggtttgtggtggagcagatatc

SEQ ID NO: 21708 - DNA, 25 bp, Mus musculus
cctgtaaaccccagcaccttaggag

SEQ ID NO: 21709 - DNA, 25 bp, Mus musculus
cctgtaacaaggagaaaggcatatg

SEQ ID NO: 21710 - DNA, 25 bp, Mus musculus
cctgtaaccacggacatcaactgga

SEQ ID NO: 21711 - DNA, 25 bp, Mus musculus
cctgtaagccggcacacttccagaa

SEQ ID NO: 21712 - DNA, 25 bp, Mus musculus
cctgtaagccgggacacttccagaa

SEQ ID NO: 21713 - DNA, 25 bp, Mus musculus
cctgtaataaagagggatccgaaca

SEQ ID NO: 21714 - DNA, 25 bp, Mus musculus
cctgtaatatgcctaagcctggtgt

SEQ ID NO: 21715 - DNA, 25 bp, Mus musculus
cctgtaatccacagctccagaggca

SEQ ID NO: 21716 - DNA, 25 bp, Mus musculus
cctgtaattctcagttggaaataga

SEQ ID NO: 21717 - DNA, 25 bp, Mus musculus
cctgtacagagagatcagtggactg

SEQ ID NO: 21718 - DNA, 25 bp, Mus musculus
cctgtacagttggaaacattgagta

SEQ ID NO: 21719 - DNA, 25 bp, Mus musculus
cctgtacggttgatggaaaggtcaa

SEQ ID NO: 21720 - DNA, 25 bp, Mus musculus
cctgtactcctggacagcagtagca

SEQ ID NO: 21721 - DNA, 25 bp, Mus musculus
cctgtactctattaaccagacgata

SEQ ID NO: 21722 - DNA, 25 bp, Mus musculus
cctgtacttgaggactaactccttt

SEQ ID NO: 21723 - DNA, 25 bp, Mus musculus
cctgtataacccagggactggcgca

SEQ ID NO: 21724 - DNA, 25 bp, Mus musculus
cctgtatcaaatatactttgggagc

SEQ ID NO: 21725 - DNA, 25 bp, Mus musculus
cctgtatctcggaatgggagcagaa

SEQ ID NO: 21726 - DNA, 25 bp, Mus musculus
cctgtatgacgacattgtgccttga

SEQ ID NO: 21727 - DNA, 25 bp, Mus musculus
cctgtattagaggagcttgtggctg

SEQ ID NO: 21728 - DNA, 25 bp, Mus musculus
cctgtattcagactgaacttcatcg

SEQ ID NO: 21729 - DNA, 25 bp, Mus musculus
cctgtattcagagtgaacttcatcg

SEQ ID NO: 21730 - DNA, 25 bp, Mus musculus
cctgtattcatcgtaatgctgtgga

SEQ ID NO: 21731 - DNA, 25 bp, Mus musculus
cctgtattggctgttgtcatagggc

SEQ ID NO: 21732 - DNA, 25 bp, Mus musculus
cctgtcaaacaaaactcagctgtga

SEQ ID NO: 21733 - DNA, 25 bp, Mus musculus
cctgtcaacaatcttggcagtttaa

SEQ ID NO: 21734 - DNA, 25 bp, Mus musculus
cctgtcacctgaggctatcgtgtga

SEQ ID NO: 21735 - DNA, 25 bp, Mus musculus
cctgtcataaactcattatcagtgg

SEQ ID NO: 21736 - DNA, 25 bp, Mus musculus
cctgtcatccataagagcggtaatc

SEQ ID NO: 21737 - DNA, 25 bp, Mus musculus
cctgtcatccattagagcggtaatc

SEQ ID NO: 21738 - DNA, 25 bp, Mus musculus
cctgtcatgattgtgatagagttca

SEQ ID NO: 21739 - DNA, 25 bp, Mus musculus
cctgtcatgcagtgtcccaaacaca

SEQ ID NO: 21740 - DNA, 25 bp, Mus musculus
cctgtcattctcagataagtatgag

SEQ ID NO: 21741 - DNA, 25 bp, Mus musculus
cctgtccaccatgattgacgggagt

SEQ ID NO: 21742 - DNA, 25 bp, Mus musculus
cctgtccagccttccttttggagga

SEQ ID NO: 21743 - DNA, 25 bp, Mus musculus
cctgtcccggatcactagaagaacc

SEQ ID NO: 21744 - DNA, 25 bp, Mus musculus
cctgtccctcagcagatttagctgg

SEQ ID NO: 21745 - DNA, 25 bp, Mus musculus
cctgtcctggtataaagacgatgag

SEQ ID NO: 21746 - DNA, 25 bp, Mus musculus
cctgtcctggtggaagatacctgtc

SEQ ID NO: 21747 - DNA, 25 bp, Mus musculus
cctgtccttattgtcttacttgaaa

SEQ ID NO: 21748 - DNA, 25 bp, Mus musculus
cctgtcgccaaagcaaggtatccat

SEQ ID NO: 21749 - DNA, 25 bp, Mus musculus
cctgtcgggaggtgaattcagatct

SEQ ID NO: 21750 - DNA, 25 bp, Mus musculus
cctgtctccaggatatcttggctaa

SEQ ID NO: 21751 - DNA, 25 bp, Mus musculus
cctgtctgatctggtatcagagatg

SEQ ID NO: 21752 - DNA, 25 bp, Mus musculus
cctgtctggtcttgagattggcgtt

SEQ ID NO: 21753 - DNA, 25 bp, Mus musculus
cctgtctgtgctttaacgcacttgg

SEQ ID NO: 21754 - DNA, 25 bp, Mus musculus
cctgtcttggtagtgaatggaagag

SEQ ID NO: 21755 - DNA, 25 bp, Mus musculus
cctgtgaaaatactcttaatacgtt

SEQ ID NO: 21756 - DNA, 25 bp, Mus musculus
cctgtgacatgagtgctgaggaccg

SEQ ID NO: 21757 - DNA, 25 bp, Mus musculus
cctgtgcaacatgtcaagaaatccg

SEQ ID NO: 21758 - DNA, 25 bp, Mus musculus
cctgtgcagacagctcaaaaaagcc

SEQ ID NO: 21759 - DNA, 25 bp, Mus musculus
cctgtgcagctggaattctctctaa

SEQ ID NO: 21760 - DNA, 25 bp, Mus musculus
cctgtgccagatgtgagagctctgt

SEQ ID NO: 21761 - DNA, 25 bp, Mus musculus
cctgtgccatgaacaaggagtcccc

SEQ ID NO: 21762 - DNA, 25 bp, Mus musculus
cctgtgcctagctgaggaatcctga

SEQ ID NO: 21763 - DNA, 25 bp, Mus musculus
cctgtgcctcctgaacgctgagatt

SEQ ID NO: 21764 - DNA, 25 bp, Mus musculus
cctgtgcggacgtccacttttccta

SEQ ID NO: 21765 - DNA, 25 bp, Mus musculus
cctgtgctgagtgcttcatggctgt

SEQ ID NO: 21766 - DNA, 25 bp, Mus musculus
cctgtggaagaagaatgaagttgct

SEQ ID NO: 21767 - DNA, 25 bp, Mus musculus
cctgtggaagcgttatccaggacag

SEQ ID NO: 21768 - DNA, 25 bp, Mus musculus
cctgtggaattatgactaagccaag

SEQ ID NO: 21769 - DNA, 25 bp, Mus musculus
cctgtggacatgcttttgcggagta

SEQ ID NO: 21770 - DNA, 25 bp, Mus musculus
cctgtggacttggagatcagcagag

SEQ ID NO: 21771 - DNA, 25 bp, Mus musculus
cctgtggagagctcctggcgtctga

SEQ ID NO: 21772 - DNA, 25 bp, Mus musculus
cctgtggatggcagctgggaaacca

SEQ ID NO: 21773 - DNA, 25 bp, Mus musculus
cctgtggcatgtgggactctcagcc

SEQ ID NO: 21774 - DNA, 25 bp, Mus musculus
cctgtggccgtcttcctgggagtcc

SEQ ID NO: 21775 - DNA, 25 bp, Mus musculus
cctgtggctgccttgcctgtaactc

SEQ ID NO: 21776 - DNA, 25 bp, Mus musculus
cctgtgggcagaggcatctaagaag

SEQ ID NO: 21777 - DNA, 25 bp, Mus musculus
cctgtgggtctctagagtctggaga

SEQ ID NO: 21778 - DNA, 25 bp, Mus musculus
cctgtggtatcaaggctgaagtggt

SEQ ID NO: 21779 - DNA, 25 bp, Mus musculus
cctgtggtggacaccacacaaggca

SEQ ID NO: 21780 - DNA, 25 bp, Mus musculus
cctgtggttcctggcttgtcggctg

SEQ ID NO: 21781 - DNA, 25 bp, Mus musculus
cctgtgtaagctgtgcagcgtgcac

SEQ ID NO: 21782 - DNA, 25 bp, Mus musculus
cctgtgtacttgcatcttagtggaa

SEQ ID NO: 21783 - DNA, 25 bp, Mus musculus
cctgtgtatactctatatttgggca

SEQ ID NO: 21784 - DNA, 25 bp, Mus musculus
cctgtgtatgttgtgcccagcttca

SEQ ID NO: 21785 - DNA, 25 bp, Mus musculus
cctgtgtcaccctcgggtgaaggtg

SEQ ID NO: 21786 - DNA, 25 bp, Mus musculus
cctgtgtcaggccagcttgtgcacc

SEQ ID NO: 21787 - DNA, 25 bp, Mus musculus
cctgtgtcgctgtgagaatattgag

SEQ ID NO: 21788 - DNA, 25 bp, Mus musculus
cctgtgtcgtcaattgggaatgctg

SEQ ID NO: 21789 - DNA, 25 bp, Mus musculus
cctgtgtctggtttatgcagttggt

SEQ ID NO: 21790 - DNA, 25 bp, Mus musculus
cctgtgtgacttctctggattctgc

SEQ ID NO: 21791 - DNA, 25 bp, Mus musculus
cctgtgtgccactgaaaatcgtgcc

SEQ ID NO: 21792 - DNA, 25 bp, Mus musculus
cctgtgtgtgattctgctcatcctg

SEQ ID NO: 21793 - DNA, 25 bp, Mus musculus
cctgtgtgttttcaagaggctcgta

SEQ ID NO: 21794 - DNA, 25 bp, Mus musculus
cctgtgtgttttgaagaggctcgta

SEQ ID NO: 21795 - DNA, 25 bp, Mus musculus
cctgtgttacattgcccctgctttg

SEQ ID NO: 21796 - DNA, 25 bp, Mus musculus
cctgtgttcagtcctacaaccacaa

SEQ ID NO: 21797 - DNA, 25 bp, Mus musculus
cctgtgttctcagtcaccggtggaa

SEQ ID NO: 21798 - DNA, 25 bp, Mus musculus
cctgtgttggacattcttcgggaca

SEQ ID NO: 21799 - DNA, 25 bp, Mus musculus
cctgtgtttgccaatgggaacatcc

SEQ ID NO: 21800 - DNA, 25 bp, Mus musculus
cctgtgttttcagaaagttgcagca

SEQ ID NO: 21801 - DNA, 25 bp, Mus musculus
cctgttaacaccacgactctggctg

SEQ ID NO: 21802 - DNA, 25 bp, Mus musculus
cctgttacagaagtgaaaactgata

SEQ ID NO: 21803 - DNA, 25 bp, Mus musculus
cctgttcaagttgaaggcttgggag

SEQ ID NO: 21804 - DNA, 25 bp, Mus musculus
cctgttcagagtaaagtgtgccacc

SEQ ID NO: 21805 - DNA, 25 bp, Mus musculus
cctgttcattggaccgaaagcagag

SEQ ID NO: 21806 - DNA, 25 bp, Mus musculus
cctgttcccgtctaactgagcgtgc

SEQ ID NO: 21807 - DNA, 25 bp, Mus musculus
cctgttcctggccattggcctctgg

SEQ ID NO: 21808 - DNA, 25 bp, Mus musculus
cctgttctctgcagggatgggtgac

SEQ ID NO: 21809 - DNA, 25 bp, Mus musculus
cctgttctggtggaacttatatgct

SEQ ID NO: 21810 - DNA, 25 bp, Mus musculus
cctgttctgtctgataaacatctac

SEQ ID NO: 21811 - DNA, 25 bp, Mus musculus
cctgttcttggctgggcttctgctg

SEQ ID NO: 21812 - DNA, 25 bp, Mus musculus
cctgttgactcctgggtctagcttg

SEQ ID NO: 21813 - DNA, 25 bp, Mus musculus
cctgttgagcacagatggcaaggag

SEQ ID NO: 21814 - DNA, 25 bp, Mus musculus
cctgttgatgaagaacagactccaa

SEQ ID NO: 21815 - DNA, 25 bp, Mus musculus
cctgttgcagccagctcccttagga

SEQ ID NO: 21816 - DNA, 25 bp, Mus musculus
cctgttgcagcctgctcccttagga

SEQ ID NO: 21817 - DNA, 25 bp, Mus musculus
cctgttgcccatcttgatagacaag

SEQ ID NO: 21818 - DNA, 25 bp, Mus musculus
cctgttggatcaaaagcgtccagat

SEQ ID NO: 21819 - DNA, 25 bp, Mus musculus
cctgttgggaacagatgtctggcag

SEQ ID NO: 21820 - DNA, 25 bp, Mus musculus
cctgttgggatcatcctaaaatgac

SEQ ID NO: 21821 - DNA, 25 bp, Mus musculus
cctgttgggtgctgaccgcggctca

SEQ ID NO: 21822 - DNA, 25 bp, Mus musculus
cctgttgttactatccgtgccagaa

SEQ ID NO: 21823 - DNA, 25 bp, Mus musculus
cctgttgttactttccgtgccagaa

SEQ ID NO: 21824 - DNA, 25 bp, Mus musculus
cctgtttagcacctcagtgctcggg

SEQ ID NO: 21825 - DNA, 25 bp, Mus musculus
cctgtttatcttcaactgggcatgc

SEQ ID NO: 21826 - DNA, 25 bp, Mus musculus
cctgtttatgaaatccaaggtgtgc

SEQ ID NO: 21827 - DNA, 25 bp, Mus musculus
cctgtttccggacaagagtgcctgg

SEQ ID NO: 21828 - DNA, 25 bp, Mus musculus
cctgtttctagggaacaacacaatt

SEQ ID NO: 21829 - DNA, 25 bp, Mus musculus
cctgtttctccgtggcgctggctgt

SEQ ID NO: 21830 - DNA, 25 bp, Mus musculus
cctgtttctgactcctgagattaaa

SEQ ID NO: 21831 - DNA, 25 bp, Mus musculus
cctgtttctttggattatagcagtg

SEQ ID NO: 21832 - DNA, 25 bp, Mus musculus
cctgtttgagggttcaggactgtat

SEQ ID NO: 21833 - DNA, 25 bp, Mus musculus
cctgttttcagctgttcgtgaagac

SEQ ID NO: 21834 - DNA, 25 bp, Mus musculus
cctgttttgagacacgccgttgaag

SEQ ID NO: 21835 - DNA, 25 bp, Mus musculus
ccttaaaacttcgagcgtggacgct

SEQ ID NO: 21836 - DNA, 25 bp, Mus musculus
ccttaaaagggaacttgagatgagc

SEQ ID NO: 21837 - DNA, 25 bp, Mus musculus
ccttaaacttttgcctgatgattaa

SEQ ID NO: 21838 - DNA, 25 bp, Mus musculus
ccttaaatttagagcattcgcagcc

SEQ ID NO: 21839 - DNA, 25 bp, Mus musculus
ccttaacgaggagcatagccatagt

SEQ ID NO: 21840 - DNA, 25 bp, Mus musculus
ccttaaggagctaggtgatgactcc

SEQ ID NO: 21841 - DNA, 25 bp, Mus musculus
ccttaagtatgtccctgccggctca

SEQ ID NO: 21842 - DNA, 25 bp, Mus musculus
ccttaagtcactggacatcaactgc

SEQ ID NO: 21843 - DNA, 25 bp, Mus musculus
ccttacaacaggaaacactatcgtg

SEQ ID NO: 21844 - DNA, 25 bp, Mus musculus
ccttacaagaggagaagttaagact

SEQ ID NO: 21845 - DNA, 25 bp, Mus musculus
ccttacaatctaaggaagaagatga

SEQ ID NO: 21846 - DNA, 25 bp, Mus musculus
ccttacaatttgaactttagagtca

SEQ ID NO: 21847 - DNA, 25 bp, Mus musculus
ccttaccaaaggacgtatctgagga

SEQ ID NO: 21848 - DNA, 25 bp, Mus musculus
ccttaccccagtgaagagaccaaag

SEQ ID NO: 21849 - DNA, 25 bp, Mus musculus
ccttaccttcatggacgactcagag

SEQ ID NO: 21850 - DNA, 25 bp, Mus musculus
ccttacgctctcctactcagaaaga

SEQ ID NO: 21851 - DNA, 25 bp, Mus musculus
ccttacggaagctgccctcttacag

SEQ ID NO: 21852 - DNA, 25 bp, Mus musculus
ccttacggaggttctctcgtggtga

SEQ ID NO: 21853 - DNA, 25 bp, Mus musculus
ccttactcagcacatgaaataagca

SEQ ID NO: 21854 - DNA, 25 bp, Mus musculus
ccttactctgatggccgggctttat

SEQ ID NO: 21855 - DNA, 25 bp, Mus musculus
ccttagaaaaggacattcgctactc

SEQ ID NO: 21856 - DNA, 25 bp, Mus musculus
ccttagaagatttgcggagttttat

SEQ ID NO: 21857 - DNA, 25 bp, Mus musculus
ccttagaaggaagccctaaacatct

SEQ ID NO: 21858 - DNA, 25 bp, Mus musculus
ccttagagagttgggtggatgttat

SEQ ID NO: 21859 - DNA, 25 bp, Mus musculus
ccttagattttcagcaggaccggga

SEQ ID NO: 21860 - DNA, 25 bp, Mus musculus
ccttagcaagcttccctgtttcagg

SEQ ID NO: 21861 - DNA, 25 bp, Mus musculus
ccttagcggcaggagaagccggtca

SEQ ID NO: 21862 - DNA, 25 bp, Mus musculus
ccttagctggcctgatagacatctc

SEQ ID NO: 21863 - DNA, 25 bp, Mus musculus
ccttagctggtttgggaggttcact

SEQ ID NO: 21864 - DNA, 25 bp, Mus musculus
ccttaggattctatgtctggctgcc

SEQ ID NO: 21865 - DNA, 25 bp, Mus musculus
ccttaggcataggagctgtggaaga

SEQ ID NO: 21866 - DNA, 25 bp, Mus musculus
ccttaggcttggtgggaatcatcac

SEQ ID NO: 21867 - DNA, 25 bp, Mus musculus
ccttaggtggactcctgggcaacgt

SEQ ID NO: 21868 - DNA, 25 bp, Mus musculus
ccttagtatcaaggcggctcccaga

SEQ ID NO: 21869 - DNA, 25 bp, Mus musculus
ccttatagtgctgaggaaacatggg

SEQ ID NO: 21870 - DNA, 25 bp, Mus musculus
ccttatcagagccttgggcccctgg

SEQ ID NO: 21871 - DNA, 25 bp, Mus musculus
ccttatcattgttgtggtggtgacg

SEQ ID NO: 21872 - DNA, 25 bp, Mus musculus
ccttatcccaggactgttctgtgga

SEQ ID NO: 21873 - DNA, 25 bp, Mus musculus
ccttatctccatgggttacaacatg

SEQ ID NO: 21874 - DNA, 25 bp, Mus musculus
ccttatctgatggtagatcctgcct

SEQ ID NO: 21875 - DNA, 25 bp, Mus musculus
ccttatgaacccatcgtctgcatct

SEQ ID NO: 21876 - DNA, 25 bp, Mus musculus
ccttatgaacccttcgtctgcatct

SEQ ID NO: 21877 - DNA, 25 bp, Mus musculus
ccttatgaatggagtaacgagttgg

SEQ ID NO: 21878 - DNA, 25 bp, Mus musculus
ccttatgagcctcccaggagatcag

SEQ ID NO: 21879 - DNA, 25 bp, Mus musculus
ccttatgaggatgactgtatctgta

SEQ ID NO: 21880 - DNA, 25 bp, Mus musculus
ccttatgcacttgatgttccaaaca

SEQ ID NO: 21881 - DNA, 25 bp, Mus musculus
ccttatggagaccaaaggctgaagc

SEQ ID NO: 21882 - DNA, 25 bp, Mus musculus
ccttatggagttatcaccggccttg

SEQ ID NO: 21883 - DNA, 25 bp, Mus musculus
ccttatgggccataatcaaactacg

SEQ ID NO: 21884 - DNA, 25 bp, Mus musculus
ccttatgtccccctttattgagcat

SEQ ID NO: 21885 - DNA, 25 bp, Mus musculus
ccttatgtctggaggagactgtgtg

SEQ ID NO: 21886 - DNA, 25 bp, Mus musculus
ccttatgtgcagatggtcctcaaca

SEQ ID NO: 21887 - DNA, 25 bp, Mus musculus
ccttattaccggacaaagcttcgag

SEQ ID NO: 21888 - DNA, 25 bp, Mus musculus
ccttattaggtggaatagtcattcc

SEQ ID NO: 21889 - DNA, 25 bp, Mus musculus
ccttattgacagaaccatcaagatg

SEQ ID NO: 21890 - DNA, 25 bp, Mus musculus
ccttattggaacatgggaaggagcc

SEQ ID NO: 21891 - DNA, 25 bp, Mus musculus
ccttattgtataactttatcagaca

SEQ ID NO: 21892 - DNA, 25 bp, Mus musculus
ccttcaaatgccatcgatccaacgg

SEQ ID NO: 21893 - DNA, 25 bp, Mus musculus
ccttcaacttcaccgcgattggagg

SEQ ID NO: 21894 - DNA, 25 bp, Mus musculus
ccttcaaggtcctggcaggagacaa

SEQ ID NO: 21895 - DNA, 25 bp, Mus musculus
ccttcaagttggttaatgcagatgg

SEQ ID NO: 21896 - DNA, 25 bp, Mus musculus
ccttcacagatttggagtctgcctt

SEQ ID NO: 21897 - DNA, 25 bp, Mus musculus
ccttcacctgaacttacctcagaag

SEQ ID NO: 21898 - DNA, 25 bp, Mus musculus
ccttcacgaagtatttggtggacca

SEQ ID NO: 21899 - DNA, 25 bp, Mus musculus
ccttcactgggagcactcaggtggg

SEQ ID NO: 21900 - DNA, 25 bp, Mus musculus
ccttcactgggtggcctgacaaggc

SEQ ID NO: 21901 - DNA, 25 bp, Mus musculus
ccttcagaaaccagtgaggaccccg

SEQ ID NO: 21902 - DNA, 25 bp, Mus musculus
ccttcagaaagaagatggctcctga

SEQ ID NO: 21903 - DNA, 25 bp, Mus musculus
ccttcagagtctatgcagcacccaa

SEQ ID NO: 21904 - DNA, 25 bp, Mus musculus
ccttcagatagaagtgaaggtcaca

SEQ ID NO: 21905 - DNA, 25 bp, Mus musculus
ccttcagcactgataagaatctatt

SEQ ID NO: 21906 - DNA, 25 bp, Mus musculus
ccttcagcataaagagaatcttgac

SEQ ID NO: 21907 - DNA, 25 bp, Mus musculus
ccttcagcctgatgaagacagtata

SEQ ID NO: 21908 - DNA, 25 bp, Mus musculus
ccttcagctataagagagctagaca

SEQ ID NO: 21909 - DNA, 25 bp, Mus musculus
ccttcagctctacatcagagtgtgc

SEQ ID NO: 21910 - DNA, 25 bp, Mus musculus
ccttcagctgaagcctgggcaggtg

SEQ ID NO: 21911 - DNA, 25 bp, Mus musculus
ccttcaggaacgaaaaatagcagca

SEQ ID NO: 21912 - DNA, 25 bp, Mus musculus
ccttcaggagaattatattgaggcc

SEQ ID NO: 21913 - DNA, 25 bp, Mus musculus
ccttcaggagtcgtggctcgtggct

SEQ ID NO: 21914 - DNA, 25 bp, Mus musculus
ccttcaggatgtagagaaaatgatc

SEQ ID NO: 21915 - DNA, 25 bp, Mus musculus
ccttcaggctgacgaatgtggcatc

SEQ ID NO: 21916 - DNA, 25 bp, Mus musculus
ccttcaggctgaggaatgtggcatc

SEQ ID NO: 21917 - DNA, 25 bp, Mus musculus
ccttcaggcttttgaaaagttcaca

SEQ ID NO: 21918 - DNA, 25 bp, Mus musculus
ccttcagtgcagcatggagctacac

SEQ ID NO: 21919 - DNA, 25 bp, Mus musculus
ccttcagtgccttttgtctctgctg

SEQ ID NO: 21920 - DNA, 25 bp, Mus musculus
ccttcagtttagttgaggataccac

SEQ ID NO: 21921 - DNA, 25 bp, Mus musculus
ccttcatagccaccgtcggcataga

SEQ ID NO: 21922 - DNA, 25 bp, Mus musculus
ccttcatagtaatggcagagaagcg

SEQ ID NO: 21923 - DNA, 25 bp, Mus musculus
ccttcatcatgttggcccgactggc

SEQ ID NO: 21924 - DNA, 25 bp, Mus musculus
ccttcatccatcaggtgggcgggca

SEQ ID NO: 21925 - DNA, 25 bp, Mus musculus
ccttcatccattcagcctgaaggag

SEQ ID NO: 21926 - DNA, 25 bp, Mus musculus
ccttcatccattgagcctgaaggag

SEQ ID NO: 21927 - DNA, 25 bp, Mus musculus
ccttcatcggctagaagagggcccc

SEQ ID NO: 21928 - DNA, 25 bp, Mus musculus
ccttcatcgttttcacagaagctgt

SEQ ID NO: 21929 - DNA, 25 bp, Mus musculus
ccttcatcttccaagtgctgaagtt

SEQ ID NO: 21930 - DNA, 25 bp, Mus musculus
ccttcatggaaggaagtggacactc

SEQ ID NO: 21931 - DNA, 25 bp, Mus musculus
ccttcatgtcacgagagcgtgagct

SEQ ID NO: 21932 - DNA, 25 bp, Mus musculus
ccttcatgtctttggactgactatc

SEQ ID NO: 21933 - DNA, 25 bp, Mus musculus
ccttccaagagtttgtagcctttga

SEQ ID NO: 21934 - DNA, 25 bp, Mus musculus
ccttccagatgagatcattcaggaa

SEQ ID NO: 21935 - DNA, 25 bp, Mus musculus
ccttccagcgaggaatattctgtaa

SEQ ID NO: 21936 - DNA, 25 bp, Mus musculus
ccttccagcttcagcaaagagaggg

SEQ ID NO: 21937 - DNA, 25 bp, Mus musculus
ccttccaggtgctaatggagctgga

SEQ ID NO: 21938 - DNA, 25 bp, Mus musculus
ccttccagtaccataatgacttcat

SEQ ID NO: 21939 - DNA, 25 bp, Mus musculus
ccttccagtggaagctggcggatga

SEQ ID NO: 21940 - DNA, 25 bp, Mus musculus
ccttccagtgtgtgtgcaaccaggg

SEQ ID NO: 21941 - DNA, 25 bp, Mus musculus
ccttcccggaagaaagatggcggcg

SEQ ID NO: 21942 - DNA, 25 bp, Mus musculus
ccttcccgggagacatcagtagatg

SEQ ID NO: 21943 - DNA, 25 bp, Mus musculus
ccttcccgtcagcacagttcgtgag

SEQ ID NO: 21944 - DNA, 25 bp, Mus musculus
ccttccctgtgaactgacgtttgtg

SEQ ID NO: 21945 - DNA, 25 bp, Mus musculus
ccttccgaagaatcagcatggtaga

SEQ ID NO: 21946 - DNA, 25 bp, Mus musculus
ccttccgcgacgtggccgttgactt

SEQ ID NO: 21947 - DNA, 25 bp, Mus musculus
ccttccgtgcgctggctcgcatggt

SEQ ID NO: 21948 - DNA, 25 bp, Mus musculus
ccttccgtggaacaggcgtccgtgt

SEQ ID NO: 21949 - DNA, 25 bp, Mus musculus
ccttccgtggaagaggcgtccgtgt

SEQ ID NO: 21950 - DNA, 25 bp, Mus musculus
ccttcctaactgatagcagctctac

SEQ ID NO: 21951 - DNA, 25 bp, Mus musculus
ccttcctgatccgagagagcgagag

SEQ ID NO: 21952 - DNA, 25 bp, Mus musculus
ccttcctgggcagacaagttcttca

SEQ ID NO: 21953 - DNA, 25 bp, Mus musculus
ccttcctgtgccattgcgccagtga

SEQ ID NO: 21954 - DNA, 25 bp, Mus musculus
ccttcctgtgcctttgcgccagtga

SEQ ID NO: 21955 - DNA, 25 bp, Mus musculus
ccttcgacctcccaaaagcagtttg

SEQ ID NO: 21956 - DNA, 25 bp, Mus musculus
ccttcgagagagtcaccccagtact

SEQ ID NO: 21957 - DNA, 25 bp, Mus musculus
ccttcgatccggagtgaacctggag

SEQ ID NO: 21958 - DNA, 25 bp, Mus musculus
ccttcgccggactgatgtacctgtt

SEQ ID NO: 21959 - DNA, 25 bp, Mus musculus
ccttcgcgtgcaaggctctgaccga

SEQ ID NO: 21960 - DNA, 25 bp, Mus musculus
ccttcgctgacctgattggttatgt

SEQ ID NO: 21961 - DNA, 25 bp, Mus musculus
ccttcgctgcgatgcctgtataacc

SEQ ID NO: 21962 - DNA, 25 bp, Mus musculus
ccttcgggaaaaacagcagattacg

SEQ ID NO: 21963 - DNA, 25 bp, Mus musculus
ccttcgtctctcagggagaggtgtc

SEQ ID NO: 21964 - DNA, 25 bp, Mus musculus
ccttcgtgaaggatatcaagcccgg

SEQ ID NO: 21965 - DNA, 25 bp, Mus musculus
ccttcgttccaaattgccagaatta

SEQ ID NO: 21966 - DNA, 25 bp, Mus musculus
ccttctaacaggattattttgggag

SEQ ID NO: 21967 - DNA, 25 bp, Mus musculus
ccttctagatcgacttctgcagtat

SEQ ID NO: 21968 - DNA, 25 bp, Mus musculus
ccttctagggacagtcaacagcccg

SEQ ID NO: 21969 - DNA, 25 bp, Mus musculus
ccttctagtcctgtgggtggagcag

SEQ ID NO: 21970 - DNA, 25 bp, Mus musculus
ccttctatgaggaaaggctaacgtg

SEQ ID NO: 21971 - DNA, 25 bp, Mus musculus
ccttctatttacatcctgatggata

SEQ ID NO: 21972 - DNA, 25 bp, Mus musculus
ccttctatttacttcctgatggata

SEQ ID NO: 21973 - DNA, 25 bp, Mus musculus
ccttctcaaagtagcatgcacaatg

SEQ ID NO: 21974 - DNA, 25 bp, Mus musculus
ccttctcacaatcttatccatggga

SEQ ID NO: 21975 - DNA, 25 bp, Mus musculus
ccttctcacaatgttatccatggga

SEQ ID NO: 21976 - DNA, 25 bp, Mus musculus
ccttctcagtgtggtacacctgtgc

SEQ ID NO: 21977 - DNA, 25 bp, Mus musculus
ccttctcatactagaccaagacgga

SEQ ID NO: 21978 - DNA, 25 bp, Mus musculus
ccttctcatcattcattgagcgcag

SEQ ID NO: 21979 - DNA, 25 bp, Mus musculus
ccttctcccttcgacagagtgtgtg

SEQ ID NO: 21980 - DNA, 25 bp, Mus musculus
ccttctccgggaacagagtagggtg

SEQ ID NO: 21981 - DNA, 25 bp, Mus musculus
ccttctccgtggaggccttaatggg

SEQ ID NO: 21982 - DNA, 25 bp, Mus musculus
ccttctcgtgtcctgtctgatgtta

SEQ ID NO: 21983 - DNA, 25 bp, Mus musculus
ccttctctcagtaagctgcctttca

SEQ ID NO: 21984 - DNA, 25 bp, Mus musculus
ccttctctccgtggagcttgaagct

SEQ ID NO: 21985 - DNA, 25 bp, Mus musculus
ccttctctgagaaagtccagtaaat

SEQ ID NO: 21986 - DNA, 25 bp, Mus musculus
ccttctctgtacgtgtttgagtgtg

SEQ ID NO: 21987 - DNA, 25 bp, Mus musculus
ccttctctgtggtgcgcaggtgtgt

SEQ ID NO: 21988 - DNA, 25 bp, Mus musculus
ccttctgaaactgatggtgttgatg

SEQ ID NO: 21989 - DNA, 25 bp, Mus musculus
ccttctgaccatgaagaaagacgag

SEQ ID NO: 21990 - DNA, 25 bp, Mus musculus
ccttctgagagcagagaggtgatct

SEQ ID NO: 21991 - DNA, 25 bp, Mus musculus
ccttctgcagcggaagatggagaac

SEQ ID NO: 21992 - DNA, 25 bp, Mus musculus
ccttctgcggaagatgcgggtatca

SEQ ID NO: 21993 - DNA, 25 bp, Mus musculus
ccttctggacattcgaatactatca

SEQ ID NO: 21994 - DNA, 25 bp, Mus musculus
ccttctggagaagtcccgggtgatc

SEQ ID NO: 21995 - DNA, 25 bp, Mus musculus
ccttctggataaacaaggagtctgt

SEQ ID NO: 21996 - DNA, 25 bp, Mus musculus
ccttctgggatttccttctttgcct

SEQ ID NO: 21997 - DNA, 25 bp, Mus musculus
ccttctgggcaacagatcattgaaa

SEQ ID NO: 21998 - DNA, 25 bp, Mus musculus
ccttctggtgttcgagggaattcct

SEQ ID NO: 21999 - DNA, 25 bp, Mus musculus
ccttctgtactggaaaatcggattc

SEQ ID NO: 22000 - DNA, 25 bp, Mus musculus
ccttctgtgttagcgttcctcagct

SEQ ID NO: 22001 - DNA, 25 bp, Mus musculus
ccttctgttctgatggcttctaact

SEQ ID NO: 22002 - DNA, 25 bp, Mus musculus
ccttctgttgataaagatggagctt

SEQ ID NO: 22003 - DNA, 25 bp, Mus musculus
ccttcttagaactggtcgcctatta

SEQ ID NO: 22004 - DNA, 25 bp, Mus musculus
ccttcttcatgagtggccagagcct

SEQ ID NO: 22005 - DNA, 25 bp, Mus musculus
ccttcttgcgctgttgcagtgagcg

SEQ ID NO: 22006 - DNA, 25 bp, Mus musculus
ccttcttggagtgagaaagacactg

SEQ ID NO: 22007 - DNA, 25 bp, Mus musculus
ccttcttggcttgagtaaactggca

SEQ ID NO: 22008 - DNA, 25 bp, Mus musculus
ccttcttgtgctatgaagtgactag

SEQ ID NO: 22009 - DNA, 25 bp, Mus musculus
ccttctttcatagcccttggtgctg

SEQ ID NO: 22010 - DNA, 25 bp, Mus musculus
ccttcttttggagacgtgctagaga

SEQ ID NO: 22011 - DNA, 25 bp, Mus musculus
ccttgaaaatcgctgggcgaattgc

SEQ ID NO: 22012 - DNA, 25 bp, Mus musculus
ccttgaaagcattaatggctgcaga

SEQ ID NO: 22013 - DNA, 25 bp, Mus musculus
ccttgaagaaggaaccactgctttc

SEQ ID NO: 22014 - DNA, 25 bp, Mus musculus
ccttgaagatctgcatgatccggag

SEQ ID NO: 22015 - DNA, 25 bp, Mus musculus
ccttgaagatggctttctgacagtc

SEQ ID NO: 22016 - DNA, 25 bp, Mus musculus
ccttgaatcgcaggacttggaaagc

SEQ ID NO: 22017 - DNA, 25 bp, Mus musculus
ccttgacccaaattttctggatgct

SEQ ID NO: 22018 - DNA, 25 bp, Mus musculus
ccttgaccccagaagaggccactgt

SEQ ID NO: 22019 - DNA, 25 bp, Mus musculus
ccttgaccccagtagaggccactgt

SEQ ID NO: 22020 - DNA, 25 bp, Mus musculus
ccttgactcctgtctgcggctgtga

SEQ ID NO: 22021 - DNA, 25 bp, Mus musculus
ccttgactgtggcagagcagaaaca

SEQ ID NO: 22022 - DNA, 25 bp, Mus musculus
ccttgagaacatcaagaggaaagtg

SEQ ID NO: 22023 - DNA, 25 bp, Mus musculus
ccttgagacccagagcggatccttt

SEQ ID NO: 22024 - DNA, 25 bp, Mus musculus
ccttgagagaggtgttaatgaggac

SEQ ID NO: 22025 - DNA, 25 bp, Mus musculus
ccttgagcaaaaagcctacccatct

SEQ ID NO: 22026 - DNA, 25 bp, Mus musculus
ccttgagcctccctgagttgtcagg

SEQ ID NO: 22027 - DNA, 25 bp, Mus musculus
ccttgagcttccgaagcggagtctt

SEQ ID NO: 22028 - DNA, 25 bp, Mus musculus
ccttgaggcaaaggtccgaggcatc

SEQ ID NO: 22029 - DNA, 25 bp, Mus musculus
ccttgagggccgtaagcaacttgct

SEQ ID NO: 22030 - DNA, 25 bp, Mus musculus
ccttgagtatggtggacctgggcac

SEQ ID NO: 22031 - DNA, 25 bp, Mus musculus
ccttgatcaagacgagctggacctg

SEQ ID NO: 22032 - DNA, 25 bp, Mus musculus
ccttgatcccagcaacgtggattct

SEQ ID NO: 22033 - DNA, 25 bp, Mus musculus
ccttgatgtttctgccaagagcaga

SEQ ID NO: 22034 - DNA, 25 bp, Mus musculus
ccttgattgcttcgtcctgaaccct

SEQ ID NO: 22035 - DNA, 25 bp, Mus musculus
ccttgattggcatgtggcaaacaca

SEQ ID NO: 22036 - DNA, 25 bp, Mus musculus
ccttgattggcctcaacagggagaa

SEQ ID NO: 22037 - DNA, 25 bp, Mus musculus
ccttgcagcagaatagagagatgct

SEQ ID NO: 22038 - DNA, 25 bp, Mus musculus
ccttgcagggcctaggggacctgaa

SEQ ID NO: 22039 - DNA, 25 bp, Mus musculus
ccttgcctagatacctggctgtagt

SEQ ID NO: 22040 - DNA, 25 bp, Mus musculus
ccttgcctgagacggttatggaaag

SEQ ID NO: 22041 - DNA, 25 bp, Mus musculus
ccttgcctgctatgccatggtcctg

SEQ ID NO: 22042 - DNA, 25 bp, Mus musculus
ccttgcctgctggaagtctgttttg

SEQ ID NO: 22043 - DNA, 25 bp, Mus musculus
ccttgctattggagatcctcgtgga

SEQ ID NO: 22044 - DNA, 25 bp, Mus musculus
ccttgctcacacagaggtgactctg

SEQ ID NO: 22045 - DNA, 25 bp, Mus musculus
ccttgctggcctgctccagtttggg

SEQ ID NO: 22046 - DNA, 25 bp, Mus musculus
ccttgctggtcattcccctggagat

SEQ ID NO: 22047 - DNA, 25 bp, Mus musculus
ccttgcttgcttactcgagatcgcc

SEQ ID NO: 22048 - DNA, 25 bp, Mus musculus
ccttgctttgggacatcatacgcct

SEQ ID NO: 22049 - DNA, 25 bp, Mus musculus
ccttggaagaattatgaacttaaca

SEQ ID NO: 22050 - DNA, 25 bp, Mus musculus
ccttggaagtacctggattcagaag

SEQ ID NO: 22051 - DNA, 25 bp, Mus musculus
ccttggacagctagtgtgcatgtgc

SEQ ID NO: 22052 - DNA, 25 bp, Mus musculus
ccttggaccggagcagttgccagat

SEQ ID NO: 22053 - DNA, 25 bp, Mus musculus
ccttggactgaggatcccagacttt

SEQ ID NO: 22054 - DNA, 25 bp, Mus musculus
ccttggagacggtacattacagaat

SEQ ID NO: 22055 - DNA, 25 bp, Mus musculus
ccttggagtgatgcaggttcagaac

SEQ ID NO: 22056 - DNA, 25 bp, Mus musculus
ccttggagtggagctttgtgcagcc

SEQ ID NO: 22057 - DNA, 25 bp, Mus musculus
ccttggatcattggtatgcagtact

SEQ ID NO: 22058 - DNA, 25 bp, Mus musculus
ccttggatcggctgacctggcttat

SEQ ID NO: 22059 - DNA, 25 bp, Mus musculus
ccttggatctgggaggcatgttcag

SEQ ID NO: 22060 - DNA, 25 bp, Mus musculus
ccttggatgaagatgagttggatga

SEQ ID NO: 22061 - DNA, 25 bp, Mus musculus
ccttggcagatagaaacgtctgggc

SEQ ID NO: 22062 - DNA, 25 bp, Mus musculus
ccttggccaccattgtgacaatcgt

SEQ ID NO: 22063 - DNA, 25 bp, Mus musculus
ccttggccaccattttgggcatcta

SEQ ID NO: 22064 - DNA, 25 bp, Mus musculus
ccttggctcccttctcaggatgatc

SEQ ID NO: 22065 - DNA, 25 bp, Mus musculus
ccttggctctcaggacaaagttgtg

SEQ ID NO: 22066 - DNA, 25 bp, Mus musculus
ccttggctggctgcctgcttctgga

SEQ ID NO: 22067 - DNA, 25 bp, Mus musculus
ccttggctgtcgaagagcttggctt

SEQ ID NO: 22068 - DNA, 25 bp, Mus musculus
ccttggctgtgaagaggactttgcc

SEQ ID NO: 22069 - DNA, 25 bp, Mus musculus
ccttggcttccagcagcttgtcaga

SEQ ID NO: 22070 - DNA, 25 bp, Mus musculus
ccttgggaaccagatgtgacattcg

SEQ ID NO: 22071 - DNA, 25 bp, Mus musculus
ccttgggacactttggaacttgcac

SEQ ID NO: 22072 - DNA, 25 bp, Mus musculus
ccttgggagcgagcgctttgagacc

SEQ ID NO: 22073 - DNA, 25 bp, Mus musculus
ccttgggatacactcttagaatacg

SEQ ID NO: 22074 - DNA, 25 bp, Mus musculus
ccttgggatcatatccgtctgcaga

SEQ ID NO: 22075 - DNA, 25 bp, Mus musculus
ccttgggattttggctcaaaagtca

SEQ ID NO: 22076 - DNA, 25 bp, Mus musculus
ccttgggtagccttggcccattgca

SEQ ID NO: 22077 - DNA, 25 bp, Mus musculus
ccttgggtgaaagagcagagagata

SEQ ID NO: 22078 - DNA, 25 bp, Mus musculus
ccttgggtggccttctttgccagca

SEQ ID NO: 22079 - DNA, 25 bp, Mus musculus
ccttggtgaaccgaaatggatggaa

SEQ ID NO: 22080 - DNA, 25 bp, Mus musculus
ccttggtgaatacgaggagtacatc

SEQ ID NO: 22081 - DNA, 25 bp, Mus musculus
ccttggtggactcaagcgaagtgac

SEQ ID NO: 22082 - DNA, 25 bp, Mus musculus
ccttggtgggaaatcacgaggcaaa

SEQ ID NO: 22083 - DNA, 25 bp, Mus musculus
ccttggttacatctcggtggttgac

SEQ ID NO: 22084 - DNA, 25 bp, Mus musculus
ccttgtaactgtctggccctggatc

SEQ ID NO: 22085 - DNA, 25 bp, Mus musculus
ccttgtaagataaaagcacgaaaga

SEQ ID NO: 22086 - DNA, 25 bp, Mus musculus
ccttgtacagtcagggtggccatgg

SEQ ID NO: 22087 - DNA, 25 bp, Mus musculus
ccttgtacagtctgggtggccatgg

SEQ ID NO: 22088 - DNA, 25 bp, Mus musculus
ccttgtaccgccatgtaatgctgga

SEQ ID NO: 22089 - DNA, 25 bp, Mus musculus
ccttgtagtctttggcagagcctgt

SEQ ID NO: 22090 - DNA, 25 bp, Mus musculus
ccttgtatgtggtggatcttaagaa

SEQ ID NO: 22091 - DNA, 25 bp, Mus musculus
ccttgtcactggagaaggccaggaa

SEQ ID NO: 22092 - DNA, 25 bp, Mus musculus
ccttgtcattaccagaatatgaacc

SEQ ID NO: 22093 - DNA, 25 bp, Mus musculus
ccttgtccactatcgtatgtccggg

SEQ ID NO: 22094 - DNA, 25 bp, Mus musculus
ccttgtcccagcagctcggcagtgg

SEQ ID NO: 22095 - DNA, 25 bp, Mus musculus
ccttgtccggcagccggaatggcga

SEQ ID NO: 22096 - DNA, 25 bp, Mus musculus
ccttgtctcaaagagaagagaacaa

SEQ ID NO: 22097 - DNA, 25 bp, Mus musculus
ccttgtgaatatgaatgggtatacc

SEQ ID NO: 22098 - DNA, 25 bp, Mus musculus
ccttgtgagtcaggattatgtcaat

SEQ ID NO: 22099 - DNA, 25 bp, Mus musculus
ccttgtgatcccagccatctggtga

SEQ ID NO: 22100 - DNA, 25 bp, Mus musculus
ccttgtgatcttcaagcaggcagaa

SEQ ID NO: 22101 - DNA, 25 bp, Mus musculus
ccttgtgatcttgaagcaggcagaa

SEQ ID NO: 22102 - DNA, 25 bp, Mus musculus
ccttgtggagcagggcaccatcctg

SEQ ID NO: 22103 - DNA, 25 bp, Mus musculus
ccttgtggcgcacccagtgtaactg

SEQ ID NO: 22104 - DNA, 25 bp, Mus musculus
ccttgtggtcctaactcagtctgca

SEQ ID NO: 22105 - DNA, 25 bp, Mus musculus
ccttgtggtgttcaacaccgtggac

SEQ ID NO: 22106 - DNA, 25 bp, Mus musculus
ccttgtgtctgcacgacctgtggaa

SEQ ID NO: 22107 - DNA, 25 bp, Mus musculus
ccttgtgtctgctcgacctgtggaa

SEQ ID NO: 22108 - DNA, 25 bp, Mus musculus
ccttgttagctttggtctcttcatg

SEQ ID NO: 22109 - DNA, 25 bp, Mus musculus
ccttgttccctgcagatgagctcta

SEQ ID NO: 22110 - DNA, 25 bp, Mus musculus
ccttgttgagcctttcctgcgtcta

SEQ ID NO: 22111 - DNA, 25 bp, Mus musculus
ccttgtttaaatggtggaatatgca

SEQ ID NO: 22112 - DNA, 25 bp, Mus musculus
ccttgtttatggtggcgttccagct

SEQ ID NO: 22113 - DNA, 25 bp, Mus musculus
ccttgttttcagatagaagctttgc

SEQ ID NO: 22114 - DNA, 25 bp, Mus musculus
ccttgtttttcgtgggtgtgctgat

SEQ ID NO: 22115 - DNA, 25 bp, Mus musculus
cctttaatcttcgtagaaagtctga

SEQ ID NO: 22116 - DNA, 25 bp, Mus musculus
cctttaatgggatttgtggccagag

SEQ ID NO: 22117 - DNA, 25 bp, Mus musculus
cctttactctttgatgatcttccgc

SEQ ID NO: 22118 - DNA, 25 bp, Mus musculus
cctttagaaagctctttaggcacaa

SEQ ID NO: 22119 - DNA, 25 bp, Mus musculus
cctttagcagcaagtggcattttgt

SEQ ID NO: 22120 - DNA, 25 bp, Mus musculus
cctttagcagcatgtggcattttgt

SEQ ID NO: 22121 - DNA, 25 bp, Mus musculus
cctttatatgttggatgcactgaga

SEQ ID NO: 22122 - DNA, 25 bp, Mus musculus
cctttatgaccctgaggccaaacag

SEQ ID NO: 22123 - DNA, 25 bp, Mus musculus
cctttatggaggaaatggagacact

SEQ ID NO: 22124 - DNA, 25 bp, Mus musculus
cctttatttggctgcaaatatgact

SEQ ID NO: 22125 - DNA, 25 bp, Mus musculus
cctttcaagtacctaagtcctggca

SEQ ID NO: 22126 - DNA, 25 bp, Mus musculus
cctttcacaagtttgtggctcctga

SEQ ID NO: 22127 - DNA, 25 bp, Mus musculus
cctttcagatgcagcgactaagcag

SEQ ID NO: 22128 - DNA, 25 bp, Mus musculus
cctttcaggtttccacacgtacctg

SEQ ID NO: 22129 - DNA, 25 bp, Mus musculus
cctttcagtacttctcagaaacgat

SEQ ID NO: 22130 - DNA, 25 bp, Mus musculus
cctttcagtggaatgtatttgaaca

SEQ ID NO: 22131 - DNA, 25 bp, Mus musculus
cctttcatcatcctgaccctggtga

SEQ ID NO: 22132 - DNA, 25 bp, Mus musculus
cctttcatgaactcaaatctgatag

SEQ ID NO: 22133 - DNA, 25 bp, Mus musculus
cctttcatttcaagtacgactgaag

SEQ ID NO: 22134 - DNA, 25 bp, Mus musculus
cctttcccacgagaagagtgcagaa

SEQ ID NO: 22135 - DNA, 25 bp, Mus musculus
cctttcccagacgttgagttaatcg

SEQ ID NO: 22136 - DNA, 25 bp, Mus musculus
cctttcccgggttatagaggatgat

SEQ ID NO: 22137 - DNA, 25 bp, Mus musculus
cctttccggagtgtcacagtacaag

SEQ ID NO: 22138 - DNA, 25 bp, Mus musculus
cctttccgtgctcgctctatatctg

SEQ ID NO: 22139 - DNA, 25 bp, Mus musculus
cctttcctcacaaaaagtagtggtg

SEQ ID NO: 22140 - DNA, 25 bp, Mus musculus
cctttcctgcgtctacagaggtctg

SEQ ID NO: 22141 - DNA, 25 bp, Mus musculus
cctttccttgagcaagttccagtta

SEQ ID NO: 22142 - DNA, 25 bp, Mus musculus
cctttcgagaccctactatcgacga

SEQ ID NO: 22143 - DNA, 25 bp, Mus musculus
cctttcgagccctttgaggagcaga

SEQ ID NO: 22144 - DNA, 25 bp, Mus musculus
cctttctacaatatcagaatctgca

SEQ ID NO: 22145 - DNA, 25 bp, Mus musculus
cctttctaccgagagcgctttggaa

SEQ ID NO: 22146 - DNA, 25 bp, Mus musculus
cctttctcatcagttaagtacaaga

SEQ ID NO: 22147 - DNA, 25 bp, Mus musculus
cctttctctaagctgaaggtggaga

SEQ ID NO: 22148 - DNA, 25 bp, Mus musculus
cctttctgaagggaggagcctttct

SEQ ID NO: 22149 - DNA, 25 bp, Mus musculus
cctttctgctctatgcaagcttcca

SEQ ID NO: 22150 - DNA, 25 bp, Mus musculus
cctttctgctgctggtagggattta

SEQ ID NO: 22151 - DNA, 25 bp, Mus musculus
cctttctgggagaggtgtgatggct

SEQ ID NO: 22152 - DNA, 25 bp, Mus musculus
cctttcttcagaacagcgttttcca

SEQ ID NO: 22153 - DNA, 25 bp, Mus musculus
cctttgaagaagttcttgttgaact

SEQ ID NO: 22154 - DNA, 25 bp, Mus musculus
cctttgaagaccctgatagtgccgt

SEQ ID NO: 22155 - DNA, 25 bp, Mus musculus
cctttgaagatggtcagcccgtgca

SEQ ID NO: 22156 - DNA, 25 bp, Mus musculus
cctttgacctggtggaccggagtct

SEQ ID NO: 22157 - DNA, 25 bp, Mus musculus
cctttgacgacgcagtggaagaacg

SEQ ID NO: 22158 - DNA, 25 bp, Mus musculus
cctttgagagcgacccgggagcctg

SEQ ID NO: 22159 - DNA, 25 bp, Mus musculus
cctttgagagcgtcccgggagcctg

SEQ ID NO: 22160 - DNA, 25 bp, Mus musculus
cctttgaggatgaatgtgggactta

SEQ ID NO: 22161 - DNA, 25 bp, Mus musculus
cctttgaggatgtatgtgggactta

SEQ ID NO: 22162 - DNA, 25 bp, Mus musculus
cctttgagtaatggacaaatgggcc

SEQ ID NO: 22163 - DNA, 25 bp, Mus musculus
cctttgatcacccagaacttgtgaa

SEQ ID NO: 22164 - DNA, 25 bp, Mus musculus
cctttgatccagaacttgcagcaac

SEQ ID NO: 22165 - DNA, 25 bp, Mus musculus
cctttgattggtgcgctacagtatg

SEQ ID NO: 22166 - DNA, 25 bp, Mus musculus
cctttgcaaggaatgtgtagagcct

SEQ ID NO: 22167 - DNA, 25 bp, Mus musculus
cctttgccatgatgagccaccacga

SEQ ID NO: 22168 - DNA, 25 bp, Mus musculus
cctttgcccaccttatagtgctgag

SEQ ID NO: 22169 - DNA, 25 bp, Mus musculus
cctttgcgattgtacatgccagatc

SEQ ID NO: 22170 - DNA, 25 bp, Mus musculus
cctttgcggaagtctgcaatgaccc

SEQ ID NO: 22171 - DNA, 25 bp, Mus musculus
cctttgcggcacatcagatatagga

SEQ ID NO: 22172 - DNA, 25 bp, Mus musculus
cctttgctgcaggaggctacatgcc

SEQ ID NO: 22173 - DNA, 25 bp, Mus musculus
cctttggaaaagtgtgtcagtagtt

SEQ ID NO: 22174 - DNA, 25 bp, Mus musculus
cctttggaagaatattgggacaggg

SEQ ID NO: 22175 - DNA, 25 bp, Mus musculus
cctttggagaatggacggagatccc

SEQ ID NO: 22176 - DNA, 25 bp, Mus musculus
cctttggagctgacagatgtgagct

SEQ ID NO: 22177 - DNA, 25 bp, Mus musculus
cctttggaggatcggctcttcccac

SEQ ID NO: 22178 - DNA, 25 bp, Mus musculus
cctttggagtactatctgatcccct

SEQ ID NO: 22179 - DNA, 25 bp, Mus musculus
cctttggatacctagtgctgctgtc

SEQ ID NO: 22180 - DNA, 25 bp, Mus musculus
cctttggcaaaggagacagcggcct

SEQ ID NO: 22181 - DNA, 25 bp, Mus musculus
cctttggcaccgcatctatgagtat

SEQ ID NO: 22182 - DNA, 25 bp, Mus musculus
cctttggctctatttggggaggtgc

SEQ ID NO: 22183 - DNA, 25 bp, Mus musculus
cctttgggcgtctcatggtggaaaa

SEQ ID NO: 22184 - DNA, 25 bp, Mus musculus
cctttgggggcagtaacattgagcc

SEQ ID NO: 22185 - DNA, 25 bp, Mus musculus
cctttggtatcagtcaatcaggaaa

SEQ ID NO: 22186 - DNA, 25 bp, Mus musculus
cctttggtgctcagaggacattctg

SEQ ID NO: 22187 - DNA, 25 bp, Mus musculus
cctttggtgtacatgaggaaagcac

SEQ ID NO: 22188 - DNA, 25 bp, Mus musculus
cctttggttgctacatgaagtcagc

SEQ ID NO: 22189 - DNA, 25 bp, Mus musculus
cctttgtacacatggagcgggcaga

SEQ ID NO: 22190 - DNA, 25 bp, Mus musculus
cctttgtcctggagtgtcctttttg

SEQ ID NO: 22191 - DNA, 25 bp, Mus musculus
cctttgtgacacctggaaaactgat

SEQ ID NO: 22192 - DNA, 25 bp, Mus musculus
cctttgtggagactgcaatgggttt

SEQ ID NO: 22193 - DNA, 25 bp, Mus musculus
cctttgtggatgatgtgcgctgctc

SEQ ID NO: 22194 - DNA, 25 bp, Mus musculus
cctttgttgtcagcaggacagaggt

SEQ ID NO: 22195 - DNA, 25 bp, Mus musculus
ccttttaaagagactggcccacaga

SEQ ID NO: 22196 - DNA, 25 bp, Mus musculus
ccttttaaattagcctgccaggaga

SEQ ID NO: 22197 - DNA, 25 bp, Mus musculus
ccttttagaggagacgatggaatat

SEQ ID NO: 22198 - DNA, 25 bp, Mus musculus
ccttttagtctagacagcgttgcaa

SEQ ID NO: 22199 - DNA, 25 bp, Mus musculus
ccttttatgaggtagattgtgatgt

SEQ ID NO: 22200 - DNA, 25 bp, Mus musculus
ccttttcacagagagctgcagcatc

SEQ ID NO: 22201 - DNA, 25 bp, Mus musculus
ccttttcctcaagggagcaacggtg

SEQ ID NO: 22202 - DNA, 25 bp, Mus musculus
ccttttctgtgttacagtgccctgg

SEQ ID NO: 22203 - DNA, 25 bp, Mus musculus
ccttttctttgaagaatgctctgaa

SEQ ID NO: 22204 - DNA, 25 bp, Mus musculus
ccttttgcggctctggaccagcagc

SEQ ID NO: 22205 - DNA, 25 bp, Mus musculus
ccttttgctcgatatctggccatga

SEQ ID NO: 22206 - DNA, 25 bp, Mus musculus
ccttttggacggaagtccctgcagc

SEQ ID NO: 22207 - DNA, 25 bp, Mus musculus
ccttttggatgatttagataccgtt

SEQ ID NO: 22208 - DNA, 25 bp, Mus musculus
ccttttgggcttctggtgagcactg

SEQ ID NO: 22209 - DNA, 25 bp, Mus musculus
cctttttatctcatggatggaggag

SEQ ID NO: 22210 - DNA, 25 bp, Mus musculus
cctttttgatcgttatgatgaggaa

SEQ ID NO: 22211 - DNA, 25 bp, Mus musculus
cctttttggagacacttctgataca

SEQ ID NO: 22212 - DNA, 25 bp, Mus musculus
cgaaaaatagcagcagaaatgatgt

SEQ ID NO: 22213 - DNA, 25 bp, Mus musculus
cgaaaactggatgaactagattgct

SEQ ID NO: 22214 - DNA, 25 bp, Mus musculus
cgaaaagaagcacggtcaccactga

SEQ ID NO: 22215 - DNA, 25 bp, Mus musculus
cgaaaagagatcaccaaacactggg

SEQ ID NO: 22216 - DNA, 25 bp, Mus musculus
cgaaacaatgaatcagaaaagccca

SEQ ID NO: 22217 - DNA, 25 bp, Mus musculus
cgaaaccacctcgaaggcagggagg

SEQ ID NO: 22218 - DNA, 25 bp, Mus musculus
cgaaaccttttatctgttgcatata

SEQ ID NO: 22219 - DNA, 25 bp, Mus musculus
cgaaacttccaggactttgactgtc

SEQ ID NO: 22220 - DNA, 25 bp, Mus musculus
cgaaagaaagcccaggcctacctgt

SEQ ID NO: 22221 - DNA, 25 bp, Mus musculus
cgaaagaagccagcctttctcgttc

SEQ ID NO: 22222 - DNA, 25 bp, Mus musculus
cgaaagaaggctctgcagtggcacc

SEQ ID NO: 22223 - DNA, 25 bp, Mus musculus
cgaaagcgtaatcacagaagaaatg

SEQ ID NO: 22224 - DNA, 25 bp, Mus musculus
cgaaagcgtgtttgcaaatgtccca

SEQ ID NO: 22225 - DNA, 25 bp, Mus musculus
cgaaagggctatgagcttcatggct

SEQ ID NO: 22226 - DNA, 25 bp, Mus musculus
cgaaaggtccagtcaatgggagtct

SEQ ID NO: 22227 - DNA, 25 bp, Mus musculus
cgaaagtgcgggatcaacttgggca

SEQ ID NO: 22228 - DNA, 25 bp, Mus musculus
cgaaagtggctttggcgactgcagc

SEQ ID NO: 22229 - DNA, 25 bp, Mus musculus
cgaaatatgcagaacgcagaaataa

SEQ ID NO: 22230 - DNA, 25 bp, Mus musculus
cgaaatccagaactgtctcaacaat

SEQ ID NO: 22231 - DNA, 25 bp, Mus musculus
cgaaatccatcaaaaaatatagcct

SEQ ID NO: 22232 - DNA, 25 bp, Mus musculus
cgaaatgactgcgattggtgaacaa

SEQ ID NO: 22233 - DNA, 25 bp, Mus musculus
cgaaatgggccagactttccaagat

SEQ ID NO: 22234 - DNA, 25 bp, Mus musculus
cgaaattacttcaagaaagaagagc

SEQ ID NO: 22235 - DNA, 25 bp, Mus musculus
cgaaattgcccattcttgctgaagc

SEQ ID NO: 22236 - DNA, 25 bp, Mus musculus
cgaacacctgaagaatgctaacaag

SEQ ID NO: 22237 - DNA, 25 bp, Mus musculus
cgaacacgtttgtggcagagctaaa

SEQ ID NO: 22238 - DNA, 25 bp, Mus musculus
cgaacaggaggataagaaggcaaac

SEQ ID NO: 22239 - DNA, 25 bp, Mus musculus
cgaacagtgggagaagttcggcata

SEQ ID NO: 22240 - DNA, 25 bp, Mus musculus
cgaacattctcagacgaatctaata

SEQ ID NO: 22241 - DNA, 25 bp, Mus musculus
cgaaccaggaggaccaagccgctgg

SEQ ID NO: 22242 - DNA, 25 bp, Mus musculus
cgaaccgatcacaagtgctgctggt

SEQ ID NO: 22243 - DNA, 25 bp, Mus musculus
cgaacgggtcgtacctgctgaggat

SEQ ID NO: 22244 - DNA, 25 bp, Mus musculus
cgaacgttgtgactggtccgccaaa

SEQ ID NO: 22245 - DNA, 25 bp, Mus musculus
cgaactcaggaatctgctcaactgc

SEQ ID NO: 22246 - DNA, 25 bp, Mus musculus
cgaactgacacttgactgggccggt

SEQ ID NO: 22247 - DNA, 25 bp, Mus musculus
cgaacttacagagatgaaacggact

SEQ ID NO: 22248 - DNA, 25 bp, Mus musculus
cgaactttgaagaggtcgcttttga

SEQ ID NO: 22249 - DNA, 25 bp, Mus musculus
cgaagaaaacgtcaagaacagaaga

SEQ ID NO: 22250 - DNA, 25 bp, Mus musculus
cgaagaacaagctccgggtgaaggt

SEQ ID NO: 22251 - DNA, 25 bp, Mus musculus
cgaagaagaactcgagaatttgagg

SEQ ID NO: 22252 - DNA, 25 bp, Mus musculus
cgaagaagcaaagcgaggaactccc

SEQ ID NO: 22253 - DNA, 25 bp, Mus musculus
cgaagaagcaggcatcggagacacc

SEQ ID NO: 22254 - DNA, 25 bp, Mus musculus
cgaagaaggtgaaggcgactatctg

SEQ ID NO: 22255 - DNA, 25 bp, Mus musculus
cgaagacatcaaagcagcgtttgca

SEQ ID NO: 22256 - DNA, 25 bp, Mus musculus
cgaagacttatccagaacgacgtag

SEQ ID NO: 22257 - DNA, 25 bp, Mus musculus
cgaagagccaagtcattggacagga

SEQ ID NO: 22258 - DNA, 25 bp, Mus musculus
cgaagagcttggctttgagcgattt

SEQ ID NO: 22259 - DNA, 25 bp, Mus musculus
cgaagaggaagcacgcagagccgct

SEQ ID NO: 22260 - DNA, 25 bp, Mus musculus
cgaagaggacgctctactgtgacta

SEQ ID NO: 22261 - DNA, 25 bp, Mus musculus
cgaagatatgactccaggaccacaa

SEQ ID NO: 22262 - DNA, 25 bp, Mus musculus
cgaagatcttttacagtctgatggg

SEQ ID NO: 22263 - DNA, 25 bp, Mus musculus
cgaagatctttttcagtctgatggg

SEQ ID NO: 22264 - DNA, 25 bp, Mus musculus
cgaagatgagagtgataagaaacag

SEQ ID NO: 22265 - DNA, 25 bp, Mus musculus
cgaagatgcaggtcattaggaacta

SEQ ID NO: 22266 - DNA, 25 bp, Mus musculus
cgaagattatttgccagggtttcac

SEQ ID NO: 22267 - DNA, 25 bp, Mus musculus
cgaagcccgctgctcctctgtgatt

SEQ ID NO: 22268 - DNA, 25 bp, Mus musculus
cgaagccgcacaccggatcctagaa

SEQ ID NO: 22269 - DNA, 25 bp, Mus musculus
cgaagccgtgaaatacagcgtaact

SEQ ID NO: 22270 - DNA, 25 bp, Mus musculus
cgaagcggcctgtgacctgtgagca

SEQ ID NO: 22271 - DNA, 25 bp, Mus musculus
cgaagctattgtgggcatgggatcc

SEQ ID NO: 22272 - DNA, 25 bp, Mus musculus
cgaagctcctgttcatggagagttc

SEQ ID NO: 22273 - DNA, 25 bp, Mus musculus
cgaagctgacgcaaagctttcttct

SEQ ID NO: 22274 - DNA, 25 bp, Mus musculus
cgaagctgcgccagcgcacgtgcat

SEQ ID NO: 22275 - DNA, 25 bp, Mus musculus
cgaaggaagcttctggcactgatgt

SEQ ID NO: 22276 - DNA, 25 bp, Mus musculus
cgaaggagccacacgacctcatgtt

SEQ ID NO: 22277 - DNA, 25 bp, Mus musculus
cgaaggaggtgaaggactccctggg

SEQ ID NO: 22278 - DNA, 25 bp, Mus musculus
cgaaggagtatcagatgtggaaagc

SEQ ID NO: 22279 - DNA, 25 bp, Mus musculus
cgaaggctgcaaaaagcattatgtc

SEQ ID NO: 22280 - DNA, 25 bp, Mus musculus
cgaaggctggaagggatcgatcaca

SEQ ID NO: 22281 - DNA, 25 bp, Mus musculus
cgaagggaggagcactttcacttcc

SEQ ID NO: 22282 - DNA, 25 bp, Mus musculus
cgaaggtcatgaacatctttctcaa

SEQ ID NO: 22283 - DNA, 25 bp, Mus musculus
cgaaggtttcctctggatgctgcca

SEQ ID NO: 22284 - DNA, 25 bp, Mus musculus
cgaagtatgtatggccggagctccc

SEQ ID NO: 22285 - DNA, 25 bp, Mus musculus
cgaagtgaggagatgtgtttatccc

SEQ ID NO: 22286 - DNA, 25 bp, Mus musculus
cgaagtgcaccaccattgaacctca

SEQ ID NO: 22287 - DNA, 25 bp, Mus musculus
cgaagtgcgaacttacttccatgag

SEQ ID NO: 22288 - DNA, 25 bp, Mus musculus
cgaagtggaggtggttctgtgggca

SEQ ID NO: 22289 - DNA, 25 bp, Mus musculus
cgaagtggccagattttgagctgcc

SEQ ID NO: 22290 - DNA, 25 bp, Mus musculus
cgaagtggttactgactgctgtgcc

SEQ ID NO: 22291 - DNA, 25 bp, Mus musculus
cgaagtgtaacacgttctgtggcag

SEQ ID NO: 22292 - DNA, 25 bp, Mus musculus
cgaataaatttacagctggcttcca

SEQ ID NO: 22293 - DNA, 25 bp, Mus musculus
cgaatagagaaggaggaattggacc

SEQ ID NO: 22294 - DNA, 25 bp, Mus musculus
cgaataggatgtccgagacccaact

SEQ ID NO: 22295 - DNA, 25 bp, Mus musculus
cgaatcatcagggtctggaatcctt

SEQ ID NO: 22296 - DNA, 25 bp, Mus musculus
cgaatcatggctaatcggaagccct

SEQ ID NO: 22297 - DNA, 25 bp, Mus musculus
cgaatcccagccaaaccaggaaaat

SEQ ID NO: 22298 - DNA, 25 bp, Mus musculus
cgaatcccagcctaaccaggaaaat

SEQ ID NO: 22299 - DNA, 25 bp, Mus musculus
cgaatctgcgagaagggtagacttt

SEQ ID NO: 22300 - DNA, 25 bp, Mus musculus
cgaatgcagacgtacgaggtggatc

SEQ ID NO: 22301 - DNA, 25 bp, Mus musculus
cgaatgcctgaagacttggatgaaa

SEQ ID NO: 22302 - DNA, 25 bp, Mus musculus
cgaatgtcccaacactaatgaagga

SEQ ID NO: 22303 - DNA, 25 bp, Mus musculus
cgaatgtcttcaaagtgactcacct

SEQ ID NO: 22304 - DNA, 25 bp, Mus musculus
cgaatgtgcatctatcagatggatt

SEQ ID NO: 22305 - DNA, 25 bp, Mus musculus
cgaattagcaaaaagagcggagcag

SEQ ID NO: 22306 - DNA, 25 bp, Mus musculus
cgaattatgagaccaactgatgtac

SEQ ID NO: 22307 - DNA, 25 bp, Mus musculus
cgaattcgagtctttgataccagaa

SEQ ID NO: 22308 - DNA, 25 bp, Mus musculus
cgaattctggacatcagcaatgtgg

SEQ ID NO: 22309 - DNA, 25 bp, Mus musculus
cgaattctggcctggatctatgcct

SEQ ID NO: 22310 - DNA, 25 bp, Mus musculus
cgaattgctagtcgcttactgaaag

SEQ ID NO: 22311 - DNA, 25 bp, Mus musculus
cgaatttgctctaggaatctaaaga

SEQ ID NO: 22312 - DNA, 25 bp, Mus musculus
cgacaaagccgttgttgagtgggat

SEQ ID NO: 22313 - DNA, 25 bp, Mus musculus
cgacaaagggataactcacaccacg

SEQ ID NO: 22314 - DNA, 25 bp, Mus musculus
cgacaaatcagaaccaattgggcca

SEQ ID NO: 22315 - DNA, 25 bp, Mus musculus
cgacaactttgccttggagtggagc

SEQ ID NO: 22316 - DNA, 25 bp, Mus musculus
cgacaaggaactcctgccctgtgtg

SEQ ID NO: 22317 - DNA, 25 bp, Mus musculus
cgacaagtagaggagaaaattccta

SEQ ID NO: 22318 - DNA, 25 bp, Mus musculus
cgacacaaggctgataatgctgtga

SEQ ID NO: 22319 - DNA, 25 bp, Mus musculus
cgacacacgcccatcgagagggtgc

SEQ ID NO: 22320 - DNA, 25 bp, Mus musculus
cgacaccaggatggtgccagtaggt

SEQ ID NO: 22321 - DNA, 25 bp, Mus musculus
cgacaccgtggccaacatgcagttg

SEQ ID NO: 22322 - DNA, 25 bp, Mus musculus
cgacagaacctatagcagagtggca

SEQ ID NO: 22323 - DNA, 25 bp, Mus musculus
cgacagaatgaagcaattcgtggaa

SEQ ID NO: 22324 - DNA, 25 bp, Mus musculus
cgacagagataagcctcgaagcagc

SEQ ID NO: 22325 - DNA, 25 bp, Mus musculus
cgacagcacagagatggtgaagatc

SEQ ID NO: 22326 - DNA, 25 bp, Mus musculus
cgacagctatttgagaagaagcagc

SEQ ID NO: 22327 - DNA, 25 bp, Mus musculus
cgacagctcagtgaagtcttcattc

SEQ ID NO: 22328 - DNA, 25 bp, Mus musculus
cgacagttcctacccagactcttga

SEQ ID NO: 22329 - DNA, 25 bp, Mus musculus
cgacagttcctagccagactcttga

SEQ ID NO: 22330 - DNA, 25 bp, Mus musculus
cgacatagaattcaccgagagcaag

SEQ ID NO: 22331 - DNA, 25 bp, Mus musculus
cgacatcagtcagcagaacagtaaa

SEQ ID NO: 22332 - DNA, 25 bp, Mus musculus
cgacatggcctttgaagccatcgtg

SEQ ID NO: 22333 - DNA, 25 bp, Mus musculus
cgacatgggcacaatgcaggaaagg

SEQ ID NO: 22334 - DNA, 25 bp, Mus musculus
cgacattgtgccttgattgccagag

SEQ ID NO: 22335 - DNA, 25 bp, Mus musculus
cgaccaagaaccagatacaaatgaa

SEQ ID NO: 22336 - DNA, 25 bp, Mus musculus
cgaccagggcctagccttttgcttc

SEQ ID NO: 22337 - DNA, 25 bp, Mus musculus
cgacccatacgtgaagctgtccttg

SEQ ID NO: 22338 - DNA, 25 bp, Mus musculus
cgacccgagagtacccgtcagaaca

SEQ ID NO: 22339 - DNA, 25 bp, Mus musculus
cgaccctagggtatggagcaattcc

SEQ ID NO: 22340 - DNA, 25 bp, Mus musculus
cgaccctagggtttggagcaattcc

SEQ ID NO: 22341 - DNA, 25 bp, Mus musculus
cgaccctttgacagcggcctcaaaa

SEQ ID NO: 22342 - DNA, 25 bp, Mus musculus
cgaccgtctttgtctcatgagaacc

SEQ ID NO: 22343 - DNA, 25 bp, Mus musculus
cgaccgttgttatgggcaactggag

SEQ ID NO: 22344 - DNA, 25 bp, Mus musculus
cgacctacaactcagcgcatgacta

SEQ ID NO: 22345 - DNA, 25 bp, Mus musculus
cgacctacaactgagcgcatgacta

SEQ ID NO: 22346 - DNA, 25 bp, Mus musculus
cgacctagacagagacttttggaat

SEQ ID NO: 22347 - DNA, 25 bp, Mus musculus
cgacctggactgcatttttggaaaa

SEQ ID NO: 22348 - DNA, 25 bp, Mus musculus
cgacctgtgcggacgtccacttttc

SEQ ID NO: 22349 - DNA, 25 bp, Mus musculus
cgaccttgcctctgtgtattgcttt

SEQ ID NO: 22350 - DNA, 25 bp, Mus musculus
cgacgaagagatggagcaaccggcc

SEQ ID NO: 22351 - DNA, 25 bp, Mus musculus
cgacgaatatcagcgcacatgggta

SEQ ID NO: 22352 - DNA, 25 bp, Mus musculus
cgacgacagaagcaatatcctcatt

SEQ ID NO: 22353 - DNA, 25 bp, Mus musculus
cgacgagatggacaataagatgacc

SEQ ID NO: 22354 - DNA, 25 bp, Mus musculus
cgacgagatggagaataagatgacc

SEQ ID NO: 22355 - DNA, 25 bp, Mus musculus
cgacgagcctgtgagaattccccgt

SEQ ID NO: 22356 - DNA, 25 bp, Mus musculus
cgacgatgactcctcctcggaggag

SEQ ID NO: 22357 - DNA, 25 bp, Mus musculus
cgacgccacatgatcatccattcag

SEQ ID NO: 22358 - DNA, 25 bp, Mus musculus
cgacggcacagcagcagactaactt

SEQ ID NO: 22359 - DNA, 25 bp, Mus musculus
cgacgggcctaaaggtgaagcacct

SEQ ID NO: 22360 - DNA, 25 bp, Mus musculus
cgacgtcgacgtaatgttctgagaa

SEQ ID NO: 22361 - DNA, 25 bp, Mus musculus
cgacgtggccgttgacttctctccg

SEQ ID NO: 22362 - DNA, 25 bp, Mus musculus
cgacgttggctttccaagttcatga

SEQ ID NO: 22363 - DNA, 25 bp, Mus musculus
cgactacctaggacgctctggccaa

SEQ ID NO: 22364 - DNA, 25 bp, Mus musculus
cgactacctaggtcgctctggccaa

SEQ ID NO: 22365 - DNA, 25 bp, Mus musculus
cgactatccagggttcaagatatca

SEQ ID NO: 22366 - DNA, 25 bp, Mus musculus
cgactcatcatcagtttatcactaa

SEQ ID NO: 22367 - DNA, 25 bp, Mus musculus
cgactccatgcagcagaagctagct

SEQ ID NO: 22368 - DNA, 25 bp, Mus musculus
cgactcgcttatgctggctgagcat

SEQ ID NO: 22369 - DNA, 25 bp, Mus musculus
cgactctccgtccttggcgtcagag

SEQ ID NO: 22370 - DNA, 25 bp, Mus musculus
cgactctggaggcacagtacataaa

SEQ ID NO: 22371 - DNA, 25 bp, Mus musculus
cgactgatctcgacgtggagcgaga

SEQ ID NO: 22372 - DNA, 25 bp, Mus musculus
cgactggagcggctggtgcatgagt

SEQ ID NO: 22373 - DNA, 25 bp, Mus musculus
cgactgtgaaatgccaagcattaga

SEQ ID NO: 22374 - DNA, 25 bp, Mus musculus
cgacttaagcgcgagcaagaagagg

SEQ ID NO: 22375 - DNA, 25 bp, Mus musculus
cgacttatgaaacatccaaacattg

SEQ ID NO: 22376 - DNA, 25 bp, Mus musculus
cgacttctcctgtgccctctttggg

SEQ ID NO: 22377 - DNA, 25 bp, Mus musculus
cgacttcttggtgagcatctataca

SEQ ID NO: 22378 - DNA, 25 bp, Mus musculus
cgacttgaagagattatgagaagaa

SEQ ID NO: 22379 - DNA, 25 bp, Mus musculus
cgacttggaggagccacctctaaag

SEQ ID NO: 22380 - DNA, 25 bp, Mus musculus
cgagaaatctatggccagacagaaa

SEQ ID NO: 22381 - DNA, 25 bp, Mus musculus
cgagaaatgttcatgaagaatgccc

SEQ ID NO: 22382 - DNA, 25 bp, Mus musculus
cgagaaccgaatgcacaagtgtcaa

SEQ ID NO: 22383 - DNA, 25 bp, Mus musculus
cgagaactagttcttatgaagtgtg

SEQ ID NO: 22384 - DNA, 25 bp, Mus musculus
cgagaactcttgcagtcgtttatgt

SEQ ID NO: 22385 - DNA, 25 bp, Mus musculus
cgagaagaagaagctgtactgcatc

SEQ ID NO: 22386 - DNA, 25 bp, Mus musculus
cgagaagagtcagaacgtcagcatg

SEQ ID NO: 22387 - DNA, 25 bp, Mus musculus
cgagaagcgtatcatcacagtcccc

SEQ ID NO: 22388 - DNA, 25 bp, Mus musculus
cgagaagctactacagaggtgcagc

SEQ ID NO: 22389 - DNA, 25 bp, Mus musculus
cgagaagctacttcagaggtgcagc

SEQ ID NO: 22390 - DNA, 25 bp, Mus musculus
cgagaagcttggagaatatggattc

SEQ ID NO: 22391 - DNA, 25 bp, Mus musculus
cgagaagtatttgcccggcagctga

SEQ ID NO: 22392 - DNA, 25 bp, Mus musculus
cgagacacagtgaaaggctacttcc

SEQ ID NO: 22393 - DNA, 25 bp, Mus musculus
cgagacagtctgagcaatgccacgc

SEQ ID NO: 22394 - DNA, 25 bp, Mus musculus
cgagacatcggcgaagagaacagag

SEQ ID NO: 22395 - DNA, 25 bp, Mus musculus
cgagaccaggtgtcagtacgaggcc

SEQ ID NO: 22396 - DNA, 25 bp, Mus musculus
cgagaccccagcaaaagtaccattt

SEQ ID NO: 22397 - DNA, 25 bp, Mus musculus
cgagaccgtgtgcagaagaaaactt

SEQ ID NO: 22398 - DNA, 25 bp, Mus musculus
cgagacggccgtttgttgctattaa

SEQ ID NO: 22399 - DNA, 25 bp, Mus musculus
cgagactttgttaggagccacctgg

SEQ ID NO: 22400 - DNA, 25 bp, Mus musculus
cgagagaagcatttccagaaagaag

SEQ ID NO: 22401 - DNA, 25 bp, Mus musculus
cgagagacagaacccaaggatgaca

SEQ ID NO: 22402 - DNA, 25 bp, Mus musculus
cgagagatggatgaacagatcagac

SEQ ID NO: 22403 - DNA, 25 bp, Mus musculus
cgagagcaggtgaaggagctcttca

SEQ ID NO: 22404 - DNA, 25 bp, Mus musculus
cgagagccctagactgcagcagctc

SEQ ID NO: 22405 - DNA, 25 bp, Mus musculus
cgagagccttctaagaagcatggga

SEQ ID NO: 22406 - DNA, 25 bp, Mus musculus
cgagagcgccccagagaagcgcctg

SEQ ID NO: 22407 - DNA, 25 bp, Mus musculus
cgagagcgcccctgagaagcgcctg

SEQ ID NO: 22408 - DNA, 25 bp, Mus musculus
cgagagctatgttgccagtggctga

SEQ ID NO: 22409 - DNA, 25 bp, Mus musculus
cgagaggaacgagaaaaacagctag

SEQ ID NO: 22410 - DNA, 25 bp, Mus musculus
cgagaggcccggatatgccgactta

SEQ ID NO: 22411 - DNA, 25 bp, Mus musculus
cgagaggctagtcttattttaggtg

SEQ ID NO: 22412 - DNA, 25 bp, Mus musculus
cgagagtgccatatcgtagtgctta

SEQ ID NO: 22413 - DNA, 25 bp, Mus musculus
cgagagtttgggaatcgatctccca

SEQ ID NO: 22414 - DNA, 25 bp, Mus musculus
cgagagtttgggtatcgatctccca

SEQ ID NO: 22415 - DNA, 25 bp, Mus musculus
cgagataccactgcagccatgaagc

SEQ ID NO: 22416 - DNA, 25 bp, Mus musculus
cgagatcaaagcactggcgggctgt

SEQ ID NO: 22417 - DNA, 25 bp, Mus musculus
cgagatcagtctactcacaccagct

SEQ ID NO: 22418 - DNA, 25 bp, Mus musculus
cgagatcagtcttctcacaccagct

SEQ ID NO: 22419 - DNA, 25 bp, Mus musculus
cgagatccccgtggaataccagacg

SEQ ID NO: 22420 - DNA, 25 bp, Mus musculus
cgagatcctcgactacctctgtgag

SEQ ID NO: 22421 - DNA, 25 bp, Mus musculus
cgagatcctggaggtgttccaccca

SEQ ID NO: 22422 - DNA, 25 bp, Mus musculus
cgagatctatgccagagcggcgaac

SEQ ID NO: 22423 - DNA, 25 bp, Mus musculus
cgagatgaccagtatacattagaac

SEQ ID NO: 22424 - DNA, 25 bp, Mus musculus
cgagatgagaacagaagcacggcga

SEQ ID NO: 22425 - DNA, 25 bp, Mus musculus
cgagatgaggagactgttaagacaa

SEQ ID NO: 22426 - DNA, 25 bp, Mus musculus
cgagatgcccgcagaatggtgtccc

SEQ ID NO: 22427 - DNA, 25 bp, Mus musculus
cgagatggaataccaggaatgcccg

SEQ ID NO: 22428 - DNA, 25 bp, Mus musculus
cgagatggatgtgaatatcgggcac

SEQ ID NO: 22429 - DNA, 25 bp, Mus musculus
cgagattcatctcatgagagagcag

SEQ ID NO: 22430 - DNA, 25 bp, Mus musculus
cgagcaagactaaaacacaagattg

SEQ ID NO: 22431 - DNA, 25 bp, Mus musculus
cgagcaatggaagagtttcctggga

SEQ ID NO: 22432 - DNA, 25 bp, Mus musculus
cgagcactgtgtgaacacgccaggt

SEQ ID NO: 22433 - DNA, 25 bp, Mus musculus
cgagcagatttcctctgcagagaat

SEQ ID NO: 22434 - DNA, 25 bp, Mus musculus
cgagcataagattgtcatagctgat

SEQ ID NO: 22435 - DNA, 25 bp, Mus musculus
cgagcatgttgttttgattgcggac

SEQ ID NO: 22436 - DNA, 25 bp, Mus musculus
cgagccaaaaaactctccaggtttg

SEQ ID NO: 22437 - DNA, 25 bp, Mus musculus
cgagccaacctaacaaaggctgcag

SEQ ID NO: 22438 - DNA, 25 bp, Mus musculus
cgagccacagctaacatgatcagca

SEQ ID NO: 22439 - DNA, 25 bp, Mus musculus
cgagccatgaagtgccaaggataag

SEQ ID NO: 22440 - DNA, 25 bp, Mus musculus
cgagcccacccaaaaggcttggtct

SEQ ID NO: 22441 - DNA, 25 bp, Mus musculus
cgagccccaggaagagtcaacataa

SEQ ID NO: 22442 - DNA, 25 bp, Mus musculus
cgagcccgcatgaacgcaatgcatt

SEQ ID NO: 22443 - DNA, 25 bp, Mus musculus
cgagcctgatttggcccagtgtttt

SEQ ID NO: 22444 - DNA, 25 bp, Mus musculus
cgagcctgcacagctctgtattatc

SEQ ID NO: 22445 - DNA, 25 bp, Mus musculus
cgagccttggaagtacctggattca

SEQ ID NO: 22446 - DNA, 25 bp, Mus musculus
cgagcgacataacccagagcatcgt

SEQ ID NO: 22447 - DNA, 25 bp, Mus musculus
cgagcgacataagccagagcatcgt

SEQ ID NO: 22448 - DNA, 25 bp, Mus musculus
cgagcgcactctcgtggaggctcac

SEQ ID NO: 22449 - DNA, 25 bp, Mus musculus
cgagcgctctctccctgaagaggaa

SEQ ID NO: 22450 - DNA, 25 bp, Mus musculus
cgagcgctttgagacctgccgcgtt

SEQ ID NO: 22451 - DNA, 25 bp, Mus musculus
cgagctaaccaacatagagctgttg

SEQ ID NO: 22452 - DNA, 25 bp, Mus musculus
cgagctacagctcactcaggacaga

SEQ ID NO: 22453 - DNA, 25 bp, Mus musculus
cgagctacagtacatgaccctgaga

SEQ ID NO: 22454 - DNA, 25 bp, Mus musculus
cgagctctggagcacctgcttctcg

SEQ ID NO: 22455 - DNA, 25 bp, Mus musculus
cgagctcttcaccaagcacttctgg

SEQ ID NO: 22456 - DNA, 25 bp, Mus musculus
cgagctgctgatgagctgcttccga

SEQ ID NO: 22457 - DNA, 25 bp, Mus musculus
cgagctggaagagatatttttgcac

SEQ ID NO: 22458 - DNA, 25 bp, Mus musculus
cgagctggagtatgggagtccctac

SEQ ID NO: 22459 - DNA, 25 bp, Mus musculus
cgagctggccccaatatctatgagc

SEQ ID NO: 22460 - DNA, 25 bp, Mus musculus
cgagctggtggcctctaactaggac

SEQ ID NO: 22461 - DNA, 25 bp, Mus musculus
cgagcttccagaaatcctgcagaat

SEQ ID NO: 22462 - DNA, 25 bp, Mus musculus
cgagcttgcagaaatcccagaaggc

SEQ ID NO: 22463 - DNA, 25 bp, Mus musculus
cgaggaaatgcaaatatggtgaagc

SEQ ID NO: 22464 - DNA, 25 bp, Mus musculus
cgaggaattcctggatccccagggc

SEQ ID NO: 22465 - DNA, 25 bp, Mus musculus
cgaggaattgctgccagcgtccact

SEQ ID NO: 22466 - DNA, 25 bp, Mus musculus
cgaggacatctggaagaaattcgag

SEQ ID NO: 22467 - DNA, 25 bp, Mus musculus
cgaggacttggttttgatgccacgt

SEQ ID NO: 22468 - DNA, 25 bp, Mus musculus
cgaggagaacatcaagaacaatttt

SEQ ID NO: 22469 - DNA, 25 bp, Mus musculus
cgaggagaagtactgactctttata

SEQ ID NO: 22470 - DNA, 25 bp, Mus musculus
cgaggagatgcagcgcatgctcagc

SEQ ID NO: 22471 - DNA, 25 bp, Mus musculus
cgaggagccctacgaagaggccacc

SEQ ID NO: 22472 - DNA, 25 bp, Mus musculus
cgaggagctggaccacgctctcaac

SEQ ID NO: 22473 - DNA, 25 bp, Mus musculus
cgaggagtttgataagatgatgcag

SEQ ID NO: 22474 - DNA, 25 bp, Mus musculus
cgaggatcatttggctgtccataaa

SEQ ID NO: 22475 - DNA, 25 bp, Mus musculus
cgaggatgtggctgtgcatcttaca

SEQ ID NO: 22476 - DNA, 25 bp, Mus musculus
cgaggcacacagtcggctgtgaaca

SEQ ID NO: 22477 - DNA, 25 bp, Mus musculus
cgaggcagccgggatgacacttctc

SEQ ID NO: 22478 - DNA, 25 bp, Mus musculus
cgaggcccgctaattgttaccagct

SEQ ID NO: 22479 - DNA, 25 bp, Mus musculus
cgaggcccgctatttgttaccagct

SEQ ID NO: 22480 - DNA, 25 bp, Mus musculus
cgaggcgtttctcactcatgacgct

SEQ ID NO: 22481 - DNA, 25 bp, Mus musculus
cgaggctacggaatactttggagac

SEQ ID NO: 22482 - DNA, 25 bp, Mus musculus
cgaggctcactcactttcccacagt

SEQ ID NO: 22483 - DNA, 25 bp, Mus musculus
cgaggctctacttcctggagactgg

SEQ ID NO: 22484 - DNA, 25 bp, Mus musculus
cgaggctgtagctgagatctgcaca

SEQ ID NO: 22485 - DNA, 25 bp, Mus musculus
cgaggcttgtgacctgctcatggaa

SEQ ID NO: 22486 - DNA, 25 bp, Mus musculus
cgagggagaaattgcacggtaccgt

SEQ ID NO: 22487 - DNA, 25 bp, Mus musculus
cgagggcagctcatgcgcattgagt

SEQ ID NO: 22488 - DNA, 25 bp, Mus musculus
cgagggcccttggtgaactcagcga

SEQ ID NO: 22489 - DNA, 25 bp, Mus musculus
cgagggcgaccgatgctaccccgat

SEQ ID NO: 22490 - DNA, 25 bp, Mus musculus
cgagggctgcaagggattcttccgc

SEQ ID NO: 22491 - DNA, 25 bp, Mus musculus
cgagggcttgctggccatctttaag

SEQ ID NO: 22492 - DNA, 25 bp, Mus musculus
cgaggtacacttttgcaccaagcgc

SEQ ID NO: 22493 - DNA, 25 bp, Mus musculus
cgaggtcgtccctgtcgtacacaaa

SEQ ID NO: 22494 - DNA, 25 bp, Mus musculus
cgaggtcttgccgtgagcccttgtg

SEQ ID NO: 22495 - DNA, 25 bp, Mus musculus
cgaggtgcagatcaacaacgaggac

SEQ ID NO: 22496 - DNA, 25 bp, Mus musculus
cgaggtggcagctttttgtcaatcc

SEQ ID NO: 22497 - DNA, 25 bp, Mus musculus
cgaggttttgcatacgacgggaaga

SEQ ID NO: 22498 - DNA, 25 bp, Mus musculus
cgagtaatagtacaattcagaggtg

SEQ ID NO: 22499 - DNA, 25 bp, Mus musculus
cgagtaatagtagaattcagaggtg

SEQ ID NO: 22500 - DNA, 25 bp, Mus musculus
cgagtactcccgcaaagtggacttt

SEQ ID NO: 22501 - DNA, 25 bp, Mus musculus
cgagtagcgatgaggagctcctaga

SEQ ID NO: 22502 - DNA, 25 bp, Mus musculus
cgagtatacaactacccagaaggcc

SEQ ID NO: 22503 - DNA, 25 bp, Mus musculus
cgagtatgaagaggacttagagttt

SEQ ID NO: 22504 - DNA, 25 bp, Mus musculus
cgagtcctggccataaagggccgcg

SEQ ID NO: 22505 - DNA, 25 bp, Mus musculus
cgagtccttcgggagattgtgcaca

SEQ ID NO: 22506 - DNA, 25 bp, Mus musculus
cgagtgaaggctatggattgtaccc

SEQ ID NO: 22507 - DNA, 25 bp, Mus musculus
cgagtgaggaagtggaatttgaacc

SEQ ID NO: 22508 - DNA, 25 bp, Mus musculus
cgagtgataacagtagatgggaaca

SEQ ID NO: 22509 - DNA, 25 bp, Mus musculus
cgagtgcagttcacactttcctgca

SEQ ID NO: 22510 - DNA, 25 bp, Mus musculus
cgagtggattcttgttcctatgacc

SEQ ID NO: 22511 - DNA, 25 bp, Mus musculus
cgagtgggacaagcgcttatctaca

SEQ ID NO: 22512 - DNA, 25 bp, Mus musculus
cgagtgttcacagggcttccagcta

SEQ ID NO: 22513 - DNA, 25 bp, Mus musculus
cgagttaccaatcacaacccagagt

SEQ ID NO: 22514 - DNA, 25 bp, Mus musculus
cgagttaccaatgacaacccagagt

SEQ ID NO: 22515 - DNA, 25 bp, Mus musculus
cgagttcaagtacttccaaagaatg

SEQ ID NO: 22516 - DNA, 25 bp, Mus musculus
cgagttccagattcttcttgatgcc

SEQ ID NO: 22517 - DNA, 25 bp, Mus musculus
cgagttccagcatacacccagttct

SEQ ID NO: 22518 - DNA, 25 bp, Mus musculus
cgagttcgctgtggctaatgacaca

SEQ ID NO: 22519 - DNA, 25 bp, Mus musculus
cgagttctggtgaaggccttaggca

SEQ ID NO: 22520 - DNA, 25 bp, Mus musculus
cgagttgaagatcctatacgcgtgg

SEQ ID NO: 22521 - DNA, 25 bp, Mus musculus
cgagttgtatcagcgctatcggcat

SEQ ID NO: 22522 - DNA, 25 bp, Mus musculus
cgagtttgcccagagatcagaacaa

SEQ ID NO: 22523 - DNA, 25 bp, Mus musculus
cgagtttgcgcggaataccagtgac

SEQ ID NO: 22524 - DNA, 25 bp, Mus musculus
cgagtttgtctgtgaccggtcagca

SEQ ID NO: 22525 - DNA, 25 bp, Mus musculus
cgataactataattcggaagatgga

SEQ ID NO: 22526 - DNA, 25 bp, Mus musculus
cgataatcagaaagtggcccttctg

SEQ ID NO: 22527 - DNA, 25 bp, Mus musculus
cgatagatgtttcccacttgaagct

SEQ ID NO: 22528 - DNA, 25 bp, Mus musculus
cgatagcaggctttttgttgccata

SEQ ID NO: 22529 - DNA, 25 bp, Mus musculus
cgatagccgcactgaaatggatgga

SEQ ID NO: 22530 - DNA, 25 bp, Mus musculus
cgatagccggcctgctgatagtggt

SEQ ID NO: 22531 - DNA, 25 bp, Mus musculus
cgatagcggcagttgatgacgagat

SEQ ID NO: 22532 - DNA, 25 bp, Mus musculus
cgataggccttatgaggattcctca

SEQ ID NO: 22533 - DNA, 25 bp, Mus musculus
cgatatagacatggaaatacctggt

SEQ ID NO: 22534 - DNA, 25 bp, Mus musculus
cgatatgtccaacccaaactgtgtg

SEQ ID NO: 22535 - DNA, 25 bp, Mus musculus
cgatcaacagtgctaatcgagatat

SEQ ID NO: 22536 - DNA, 25 bp, Mus musculus
cgatcaactatcgagggcctggagt

SEQ ID NO: 22537 - DNA, 25 bp, Mus musculus
cgatcacatagcaagaatcccaaaa

SEQ ID NO: 22538 - DNA, 25 bp, Mus musculus
cgatcacattcctgaccattggcta

SEQ ID NO: 22539 - DNA, 25 bp, Mus musculus
cgatccaacggtaccaacacttcgg

SEQ ID NO: 22540 - DNA, 25 bp, Mus musculus
cgatccacactagttatgggaatcc

SEQ ID NO: 22541 - DNA, 25 bp, Mus musculus
cgatccacgcagagctctcaaagct

SEQ ID NO: 22542 - DNA, 25 bp, Mus musculus
cgatccaggatgcttaactagagcc

SEQ ID NO: 22543 - DNA, 25 bp, Mus musculus
cgatccccaggattggaattacctg

SEQ ID NO: 22544 - DNA, 25 bp, Mus musculus
cgatccgtaaggctcagaaccttct

SEQ ID NO: 22545 - DNA, 25 bp, Mus musculus
cgatcgccaatggtgagctttggag

SEQ ID NO: 22546 - DNA, 25 bp, Mus musculus
cgatcgctggacctgttgctctgca

SEQ ID NO: 22547 - DNA, 25 bp, Mus musculus
cgatctccgaggtgacttttcgaca

SEQ ID NO: 22548 - DNA, 25 bp, Mus musculus
cgatctctgcatgatgctctttgtg

SEQ ID NO: 22549 - DNA, 25 bp, Mus musculus
cgatcttagtaactacgatgaagac

SEQ ID NO: 22550 - DNA, 25 bp, Mus musculus
cgatgaaactgcacgggccttgtct

SEQ ID NO: 22551 - DNA, 25 bp, Mus musculus
cgatgaagagttcctgaaacaggct

SEQ ID NO: 22552 - DNA, 25 bp, Mus musculus
cgatgaaggcactgtatatggtatt

SEQ ID NO: 22553 - DNA, 25 bp, Mus musculus
cgatgacaagcggaaggtgcccttt

SEQ ID NO: 22554 - DNA, 25 bp, Mus musculus
cgatgacacagatgacgatgaccct

SEQ ID NO: 22555 - DNA, 25 bp, Mus musculus
cgatgacgtgaatgaggacacagta

SEQ ID NO: 22556 - DNA, 25 bp, Mus musculus
cgatgactgcggtggagatccagct

SEQ ID NO: 22557 - DNA, 25 bp, Mus musculus
cgatgagggcattgcgaagcacagt

SEQ ID NO: 22558 - DNA, 25 bp, Mus musculus
cgatgagtcattcgccatgattaga

SEQ ID NO: 22559 - DNA, 25 bp, Mus musculus
cgatgatgaagatggtgttgctgaa

SEQ ID NO: 22560 - DNA, 25 bp, Mus musculus
cgatgatgagagagactgcattgct

SEQ ID NO: 22561 - DNA, 25 bp, Mus musculus
cgatgcaactaagttaaggccaaag

SEQ ID NO: 22562 - DNA, 25 bp, Mus musculus
cgatgcagcaacacggagggctcgt

SEQ ID NO: 22563 - DNA, 25 bp, Mus musculus
cgatgcagcaactcggagggctcgt

SEQ ID NO: 22564 - DNA, 25 bp, Mus musculus
cgatgccagttcttgcctaatgagg

SEQ ID NO: 22565 - DNA, 25 bp, Mus musculus
cgatgccatctatgagcaggagagc

SEQ ID NO: 22566 - DNA, 25 bp, Mus musculus
cgatgcctctcagcgggagaatgct

SEQ ID NO: 22567 - DNA, 25 bp, Mus musculus
cgatgctacgggaagcatatcacta

SEQ ID NO: 22568 - DNA, 25 bp, Mus musculus
cgatgctgtcaacacttacaatggg

SEQ ID NO: 22569 - DNA, 25 bp, Mus musculus
cgatggaatcaaagcttccctttta

SEQ ID NO: 22570 - DNA, 25 bp, Mus musculus
cgatggataaatgaagcccaagaag

SEQ ID NO: 22571 - DNA, 25 bp, Mus musculus
cgatgggataatgagacagacgtct

SEQ ID NO: 22572 - DNA, 25 bp, Mus musculus
cgatggtcagaataactgtcaagac

SEQ ID NO: 22573 - DNA, 25 bp, Mus musculus
cgatggtgagatgaacagattttgc

SEQ ID NO: 22574 - DNA, 25 bp, Mus musculus
cgatgtcatggcagagttagctaaa

SEQ ID NO: 22575 - DNA, 25 bp, Mus musculus
cgatgtcccatttaagataggagac

SEQ ID NO: 22576 - DNA, 25 bp, Mus musculus
cgatgtgcccttggatcaactgcca

SEQ ID NO: 22577 - DNA, 25 bp, Mus musculus
cgatgtgtgtgctatctgtctggag

SEQ ID NO: 22578 - DNA, 25 bp, Mus musculus
cgatgttatgacaaaccctggttga

SEQ ID NO: 22579 - DNA, 25 bp, Mus musculus
cgatgttcacaaatacagcgtggag

SEQ ID NO: 22580 - DNA, 25 bp, Mus musculus
cgatgttcacagattcagctcccag

SEQ ID NO: 22581 - DNA, 25 bp, Mus musculus
cgatgttcttttcccgcacatgcct

SEQ ID NO: 22582 - DNA, 25 bp, Mus musculus
cgatgttggcatcaagctgtcagga

SEQ ID NO: 22583 - DNA, 25 bp, Mus musculus
cgattagcaggattgaagggcagct

SEQ ID NO: 22584 - DNA, 25 bp, Mus musculus
cgattagctaacagaactattgtgg

SEQ ID NO: 22585 - DNA, 25 bp, Mus musculus
cgattatacacagaggcctgggaca

SEQ ID NO: 22586 - DNA, 25 bp, Mus musculus
cgattcctggcctcccaagtgtgat

SEQ ID NO: 22587 - DNA, 25 bp, Mus musculus
cgattgagaagattgtctaccaaat

SEQ ID NO: 22588 - DNA, 25 bp, Mus musculus
cgattggccagcctctggctctagc

SEQ ID NO: 22589 - DNA, 25 bp, Mus musculus
cgattgtagtgagatttctgaccaa

SEQ ID NO: 22590 - DNA, 25 bp, Mus musculus
cgattgtgactgtcatcctgaattt

SEQ ID NO: 22591 - DNA, 25 bp, Mus musculus
cgatttaccagtgacttctgggtgc

SEQ ID NO: 22592 - DNA, 25 bp, Mus musculus
cgatttccgcaaagagtgaagaacc

SEQ ID NO: 22593 - DNA, 25 bp, Mus musculus
cgatttccgcaatgagtgaagaacc

SEQ ID NO: 22594 - DNA, 25 bp, Mus musculus
cgatttcgccatctttggaaaaaag

SEQ ID NO: 22595 - DNA, 25 bp, Mus musculus
cgatttgactgcaactccatctcca

SEQ ID NO: 22596 - DNA, 25 bp, Mus musculus
cgattttaaatccaatgggcacatt

SEQ ID NO: 22597 - DNA, 25 bp, Mus musculus
cgcaaacaacttatcagtagtgact

SEQ ID NO: 22598 - DNA, 25 bp, Mus musculus
cgcaaagactggaaccctgatgagc

SEQ ID NO: 22599 - DNA, 25 bp, Mus musculus
cgcaaagagagacaaaaccagatca

SEQ ID NO: 22600 - DNA, 25 bp, Mus musculus
cgcaaagagtgaagaaccaagggac

SEQ ID NO: 22601 - DNA, 25 bp, Mus musculus
cgcaaagagtgatgaaccaagggac

SEQ ID NO: 22602 - DNA, 25 bp, Mus musculus
cgcaaagcgctggataagatagctg

SEQ ID NO: 22603 - DNA, 25 bp, Mus musculus
cgcaaaggaaattgctgaaggtttc

SEQ ID NO: 22604 - DNA, 25 bp, Mus musculus
cgcaaaggagatcgcacagcaacta

SEQ ID NO: 22605 - DNA, 25 bp, Mus musculus
cgcaacacgggcgagatcaaagcac

SEQ ID NO: 22606 - DNA, 25 bp, Mus musculus
cgcaacagcttctgagtctccaggg

SEQ ID NO: 22607 - DNA, 25 bp, Mus musculus
cgcaacgggaagaggtcaacaagtt

SEQ ID NO: 22608 - DNA, 25 bp, Mus musculus
cgcaagatgaggagacgttcgagct

SEQ ID NO: 22609 - DNA, 25 bp, Mus musculus
cgcaagttctgggtcttgaaaggag

SEQ ID NO: 22610 - DNA, 25 bp, Mus musculus
cgcaatccacgtgggctagagcata

SEQ ID NO: 22611 - DNA, 25 bp, Mus musculus
cgcaatctggcagaatgcctacaga

SEQ ID NO: 22612 - DNA, 25 bp, Mus musculus
cgcaattcacatactgagtttttag

SEQ ID NO: 22613 - DNA, 25 bp, Mus musculus
cgcacaagagtggttcgaagaagtc

SEQ ID NO: 22614 - DNA, 25 bp, Mus musculus
cgcacaaggtggtcttggcagcctg

SEQ ID NO: 22615 - DNA, 25 bp, Mus musculus
cgcacacaggcgcacaatggtgtta

SEQ ID NO: 22616 - DNA, 25 bp, Mus musculus
cgcacaccggatcctagaaggcctg

SEQ ID NO: 22617 - DNA, 25 bp, Mus musculus
cgcacacgtgaggaagcttctgtga

SEQ ID NO: 22618 - DNA, 25 bp, Mus musculus
cgcacacgtttctatggtgcaaaaa

SEQ ID NO: 22619 - DNA, 25 bp, Mus musculus
cgcacactggcctctatctgctgtg

SEQ ID NO: 22620 - DNA, 25 bp, Mus musculus
cgcacagcaatcaaaattcgaaggc

SEQ ID NO: 22621 - DNA, 25 bp, Mus musculus
cgcacagcaggcagcaatgaacata

SEQ ID NO: 22622 - DNA, 25 bp, Mus musculus
cgcacagctgcttccagtactctat

SEQ ID NO: 22623 - DNA, 25 bp, Mus musculus
cgcacagtatctgaaagagaggaag

SEQ ID NO: 22624 - DNA, 25 bp, Mus musculus
cgcacagtggtattgatgagtagac

SEQ ID NO: 22625 - DNA, 25 bp, Mus musculus
cgcacatttgcatggattttaaaag

SEQ ID NO: 22626 - DNA, 25 bp, Mus musculus
cgcaccgtgccctggagaagagaat

SEQ ID NO: 22627 - DNA, 25 bp, Mus musculus
cgcacggcagctgacattggaacaa

SEQ ID NO: 22628 - DNA, 25 bp, Mus musculus
cgcacggtttgactatattggagac

SEQ ID NO: 22629 - DNA, 25 bp, Mus musculus
cgcacggtttgagtatattggagac

SEQ ID NO: 22630 - DNA, 25 bp, Mus musculus
cgcacttggtagtaagccgtgagag

SEQ ID NO: 22631 - DNA, 25 bp, Mus musculus
cgcactttgcgctaacccagagagt

SEQ ID NO: 22632 - DNA, 25 bp, Mus musculus
cgcagaagaaggacactgccgtcct

SEQ ID NO: 22633 - DNA, 25 bp, Mus musculus
cgcagaagaaggtcactgccgtcct

SEQ ID NO: 22634 - DNA, 25 bp, Mus musculus
cgcagaagaagttcgccccggttgt

SEQ ID NO: 22635 - DNA, 25 bp, Mus musculus
cgcagaagatcactagtttggctta

SEQ ID NO: 22636 - DNA, 25 bp, Mus musculus
cgcagaatcccagcgccatgtagtg

SEQ ID NO: 22637 - DNA, 25 bp, Mus musculus
cgcagaatgcatcgcctaagcaaag

SEQ ID NO: 22638 - DNA, 25 bp, Mus musculus
cgcagacaggagctctccagcttct

SEQ ID NO: 22639 - DNA, 25 bp, Mus musculus
cgcagactctaagcctgggaccata

SEQ ID NO: 22640 - DNA, 25 bp, Mus musculus
cgcagagagccaagttaaaataaat

SEQ ID NO: 22641 - DNA, 25 bp, Mus musculus
cgcagagcctctttgtgtggaaaac

SEQ ID NO: 22642 - DNA, 25 bp, Mus musculus
cgcagaggccttggctccagatctg

SEQ ID NO: 22643 - DNA, 25 bp, Mus musculus
cgcagatcttcttctcactgggctt

SEQ ID NO: 22644 - DNA, 25 bp, Mus musculus
cgcagcaaagtgagaagcacctgga

SEQ ID NO: 22645 - DNA, 25 bp, Mus musculus
cgcagcatgcaagtagccatttcat

SEQ ID NO: 22646 - DNA, 25 bp, Mus musculus
cgcagccaagacacggtttgcaaga

SEQ ID NO: 22647 - DNA, 25 bp, Mus musculus
cgcagccaagactcggtttgcaaga

SEQ ID NO: 22648 - DNA, 25 bp, Mus musculus
cgcagccaagtgagtcgccttgtga

SEQ ID NO: 22649 - DNA, 25 bp, Mus musculus
cgcagccattggtacctgtattggg

SEQ ID NO: 22650 - DNA, 25 bp, Mus musculus
cgcagcgctgctatccatcgggtct

SEQ ID NO: 22651 - DNA, 25 bp, Mus musculus
cgcagcgctgctttccatcgggtct

SEQ ID NO: 22652 - DNA, 25 bp, Mus musculus
cgcagctcctggatacagaggacat

SEQ ID NO: 22653 - DNA, 25 bp, Mus musculus
cgcaggagtcttgccacagaatgaa

SEQ ID NO: 22654 - DNA, 25 bp, Mus musculus
cgcaggattgcgaagttctctgaca

SEQ ID NO: 22655 - DNA, 25 bp, Mus musculus
cgcaggccagatgggtccagcttca

SEQ ID NO: 22656 - DNA, 25 bp, Mus musculus
cgcaggctgcaaggagcaacagcga

SEQ ID NO: 22657 - DNA, 25 bp, Mus musculus
cgcagggattggacacgctatggta

SEQ ID NO: 22658 - DNA, 25 bp, Mus musculus
cgcagtagcctttctcgtttggagc

SEQ ID NO: 22659 - DNA, 25 bp, Mus musculus
cgcagtcagtgtcagagtctctcaa

SEQ ID NO: 22660 - DNA, 25 bp, Mus musculus
cgcagtccacagagtccctggtgca

SEQ ID NO: 22661 - DNA, 25 bp, Mus musculus
cgcagtggtacaggaacagtttact

SEQ ID NO: 22662 - DNA, 25 bp, Mus musculus
cgcagtggtccttcagcaccatcag

SEQ ID NO: 22663 - DNA, 25 bp, Mus musculus
cgcagtgtgcagtaagcgggacttt

SEQ ID NO: 22664 - DNA, 25 bp, Mus musculus
cgcagtgtttcacagtcgtctttga

SEQ ID NO: 22665 - DNA, 25 bp, Mus musculus
cgcataataataatgaaaactggtc

SEQ ID NO: 22666 - DNA, 25 bp, Mus musculus
cgcataataatattgaaaactggtc

SEQ ID NO: 22667 - DNA, 25 bp, Mus musculus
cgcatcaaagatgcagacggtgtta

SEQ ID NO: 22668 - DNA, 25 bp, Mus musculus
cgcatcaagatgtgcatttaggaga

SEQ ID NO: 22669 - DNA, 25 bp, Mus musculus
cgcatccgagtaatggaactccttt

SEQ ID NO: 22670 - DNA, 25 bp, Mus musculus
cgcatccgctacatgggcgaaagaa

SEQ ID NO: 22671 - DNA, 25 bp, Mus musculus
cgcatccttgattggcatgtggcaa

SEQ ID NO: 22672 - DNA, 25 bp, Mus musculus
cgcatctcccaatttcagagaccga

SEQ ID NO: 22673 - DNA, 25 bp, Mus musculus
cgcatctttggctgggcaagcggaa

SEQ ID NO: 22674 - DNA, 25 bp, Mus musculus
cgcatgaagcagacggaagagctga

SEQ ID NO: 22675 - DNA, 25 bp, Mus musculus
cgcatgacagttttgtggtatccaa

SEQ ID NO: 22676 - DNA, 25 bp, Mus musculus
cgcatgactacaacagctgggagtc

SEQ ID NO: 22677 - DNA, 25 bp, Mus musculus
cgcatgactacatcagctgggagtc

SEQ ID NO: 22678 - DNA, 25 bp, Mus musculus
cgcatgatgagaaaggtactgctct

SEQ ID NO: 22679 - DNA, 25 bp, Mus musculus
cgcatgccatcgagaggctgcacca

SEQ ID NO: 22680 - DNA, 25 bp, Mus musculus
cgcatgcgctgagggctacacgtta

SEQ ID NO: 22681 - DNA, 25 bp, Mus musculus
cgcatggaatatctcgtgaaatgga

SEQ ID NO: 22682 - DNA, 25 bp, Mus musculus
cgcatggacctagagcgagccaagc

SEQ ID NO: 22683 - DNA, 25 bp, Mus musculus
cgcatggtaaatgtcttcctgggca

SEQ ID NO: 22684 - DNA, 25 bp, Mus musculus
cgcatgtatattgatagctgggtca

SEQ ID NO: 22685 - DNA, 25 bp, Mus musculus
cgcattagtcttagccccagggcaa

SEQ ID NO: 22686 - DNA, 25 bp, Mus musculus
cgcattagtctttgccccagggcaa

SEQ ID NO: 22687 - DNA, 25 bp, Mus musculus
cgcatttccagcgtcccatgagaat

SEQ ID NO: 22688 - DNA, 25 bp, Mus musculus
cgccaatgctttccggagaatcctg

SEQ ID NO: 22689 - DNA, 25 bp, Mus musculus
cgccacacgcgggtctgctgttaaa

SEQ ID NO: 22690 - DNA, 25 bp, Mus musculus
cgccacagggcttgatgccatatgg

SEQ ID NO: 22691 - DNA, 25 bp, Mus musculus
cgccacatcttgcagcagacactga

SEQ ID NO: 22692 - DNA, 25 bp, Mus musculus
cgccacccaatgtcagctgggcgag

SEQ ID NO: 22693 - DNA, 25 bp, Mus musculus
cgccacgaagtggagataccatgga

SEQ ID NO: 22694 - DNA, 25 bp, Mus musculus
cgccacgcttggttccagtacatta

SEQ ID NO: 22695 - DNA, 25 bp, Mus musculus
cgccactcgataagtatgcctgtca

SEQ ID NO: 22696 - DNA, 25 bp, Mus musculus
cgccactgttgtcggtgcgcttccg

SEQ ID NO: 22697 - DNA, 25 bp, Mus musculus
cgccacttcaagctctacaaatatg

SEQ ID NO: 22698 - DNA, 25 bp, Mus musculus
cgccagaacagttgagtgagcaact

SEQ ID NO: 22699 - DNA, 25 bp, Mus musculus
cgccagcaccagaaatccatgtctg

SEQ ID NO: 22700 - DNA, 25 bp, Mus musculus
cgccagcagctctatgtgggaggcc

SEQ ID NO: 22701 - DNA, 25 bp, Mus musculus
cgccagccagctccgaaagcaaaag

SEQ ID NO: 22702 - DNA, 25 bp, Mus musculus
cgccaggccttccacctttgcaggg

SEQ ID NO: 22703 - DNA, 25 bp, Mus musculus
cgccagggagacttgatggagtctc

SEQ ID NO: 22704 - DNA, 25 bp, Mus musculus
cgccagttccggaacgaagggattg

SEQ ID NO: 22705 - DNA, 25 bp, Mus musculus
cgccagttcttgctaaagtcattga

SEQ ID NO: 22706 - DNA, 25 bp, Mus musculus
cgccatggtgcggatttcaaagccc

SEQ ID NO: 22707 - DNA, 25 bp, Mus musculus
cgccatgtacatggcccttctgtgt

SEQ ID NO: 22708 - DNA, 25 bp, Mus musculus
cgccattccataagtatgcctgcca

SEQ ID NO: 22709 - DNA, 25 bp, Mus musculus
cgcccacaacatcagcagcagtagt

SEQ ID NO: 22710 - DNA, 25 bp, Mus musculus
cgcccaccaggaagcctactgtaat

SEQ ID NO: 22711 - DNA, 25 bp, Mus musculus
cgcccaccaggatgcctactgtaat

SEQ ID NO: 22712 - DNA, 25 bp, Mus musculus
cgcccagagggtggtgctgaagaag

SEQ ID NO: 22713 - DNA, 25 bp, Mus musculus
cgcccagcgaggacatctggaagaa

SEQ ID NO: 22714 - DNA, 25 bp, Mus musculus
cgcccagctggctactctgctggag

SEQ ID NO: 22715 - DNA, 25 bp, Mus musculus
cgcccgtttggtgatatcgaggaaa

SEQ ID NO: 22716 - DNA, 25 bp, Mus musculus
cgccctcaatgaagacacccaggat

SEQ ID NO: 22717 - DNA, 25 bp, Mus musculus
cgccctcagatgagtgcccggaagg

SEQ ID NO: 22718 - DNA, 25 bp, Mus musculus
cgccctcggtcatggatctcagcag

SEQ ID NO: 22719 - DNA, 25 bp, Mus musculus
cgccctggagagagaagcgtctata

SEQ ID NO: 22720 - DNA, 25 bp, Mus musculus
cgccgatccatgaaaatgctttgga

SEQ ID NO: 22721 - DNA, 25 bp, Mus musculus
cgccgccctgcgaggagtgcattgt

SEQ ID NO: 22722 - DNA, 25 bp, Mus musculus
cgccggaatgaactcttcctagatg

SEQ ID NO: 22723 - DNA, 25 bp, Mus musculus
cgccgtagatcaagctcgagttttt

SEQ ID NO: 22724 - DNA, 25 bp, Mus musculus
cgccgtcgctcagtacagttgatgg

SEQ ID NO: 22725 - DNA, 25 bp, Mus musculus
cgccgtttgctggagaaagaggatc

SEQ ID NO: 22726 - DNA, 25 bp, Mus musculus
cgcctagtagttccctgtcacaaag

SEQ ID NO: 22727 - DNA, 25 bp, Mus musculus
cgcctatgtaccagtgctacagaga

SEQ ID NO: 22728 - DNA, 25 bp, Mus musculus
cgcctcactaactgttgtgaaattg

SEQ ID NO: 22729 - DNA, 25 bp, Mus musculus
cgcctcataggccagtttgtctttg

SEQ ID NO: 22730 - DNA, 25 bp, Mus musculus
cgcctcataggcgagtttgtctttg

SEQ ID NO: 22731 - DNA, 25 bp, Mus musculus
cgcctcatgcgttcctgggagacca

SEQ ID NO: 22732 - DNA, 25 bp, Mus musculus
cgcctccttggagtgacatcatgaa

SEQ ID NO: 22733 - DNA, 25 bp, Mus musculus
cgcctgcagaagaacagcctaaaaa

SEQ ID NO: 22734 - DNA, 25 bp, Mus musculus
cgcctgcgaaatgttcctgttcttt

SEQ ID NO: 22735 - DNA, 25 bp, Mus musculus
cgcctgctcatgtcaggtgctgctt

SEQ ID NO: 22736 - DNA, 25 bp, Mus musculus
cgcctgcttgggtgcattcagcctt

SEQ ID NO: 22737 - DNA, 25 bp, Mus musculus
cgcctggaacaaagcctttctgagg

SEQ ID NO: 22738 - DNA, 25 bp, Mus musculus
cgcctggcaaatctatctgcagagg

SEQ ID NO: 22739 - DNA, 25 bp, Mus musculus
cgcctggtggtattaccagtatcag

SEQ ID NO: 22740 - DNA, 25 bp, Mus musculus
cgccttaggcataggagctgtggaa

SEQ ID NO: 22741 - DNA, 25 bp, Mus musculus
cgccttcataccaaaggatctacag

SEQ ID NO: 22742 - DNA, 25 bp, Mus musculus
cgccttcgccggactgatgtacctg

SEQ ID NO: 22743 - DNA, 25 bp, Mus musculus
cgcctttgtagcaggtgtggaccaa

SEQ ID NO: 22744 - DNA, 25 bp, Mus musculus
cgcgaagaagtactgtggcttgcca

SEQ ID NO: 22745 - DNA, 25 bp, Mus musculus
cgcgacaagtagaggagaaaattcc

SEQ ID NO: 22746 - DNA, 25 bp, Mus musculus
cgcgaggccgagttccagaagatgc

SEQ ID NO: 22747 - DNA, 25 bp, Mus musculus
cgcgatagtattttcctcaagtccc

SEQ ID NO: 22748 - DNA, 25 bp, Mus musculus
cgcgattggtcagaagcggtccact

SEQ ID NO: 22749 - DNA, 25 bp, Mus musculus
cgcgatttgctaagcagtgtaagcc

SEQ ID NO: 22750 - DNA, 25 bp, Mus musculus
cgcgcaatgatctcccgctggtact

SEQ ID NO: 22751 - DNA, 25 bp, Mus musculus
cgcgcaggccagatgggtccagctt

SEQ ID NO: 22752 - DNA, 25 bp, Mus musculus
cgcgcatgcaactggcatataactt

SEQ ID NO: 22753 - DNA, 25 bp, Mus musculus
cgcgcattgcttattgtgcctggca

SEQ ID NO: 22754 - DNA, 25 bp, Mus musculus
cgcgcattgctttttgtgcctggca

SEQ ID NO: 22755 - DNA, 25 bp, Mus musculus
cgcgccagtacttcataggtgtcct

SEQ ID NO: 22756 - DNA, 25 bp, Mus musculus
cgcgcccagagttccactggtctag

SEQ ID NO: 22757 - DNA, 25 bp, Mus musculus
cgcgcctaccgagaactagttctta

SEQ ID NO: 22758 - DNA, 25 bp, Mus musculus
cgcgcctgccttatctccatgggtt

SEQ ID NO: 22759 - DNA, 25 bp, Mus musculus
cgcgctcaatggaggccactgtctg

SEQ ID NO: 22760 - DNA, 25 bp, Mus musculus
cgcgctggaacaccatggcctgtag

SEQ ID NO: 22761 - DNA, 25 bp, Mus musculus
cgcggacggtggtcagtgtcttccc

SEQ ID NO: 22762 - DNA, 25 bp, Mus musculus
cgcggagaatgaggtgtcttcacac

SEQ ID NO: 22763 - DNA, 25 bp, Mus musculus
cgcggatgtcgaagtggccagattt

SEQ ID NO: 22764 - DNA, 25 bp, Mus musculus
cgcggcagcctctggaggttcttca

SEQ ID NO: 22765 - DNA, 25 bp, Mus musculus
cgcggcaggtagaccacttactctt

SEQ ID NO: 22766 - DNA, 25 bp, Mus musculus
cgcggcttggatttcaaactggagg

SEQ ID NO: 22767 - DNA, 25 bp, Mus musculus
cgcgggtgccgttgtgcctgttcca

SEQ ID NO: 22768 - DNA, 25 bp, Mus musculus
cgcgggtttatgagagcaaagctga

SEQ ID NO: 22769 - DNA, 25 bp, Mus musculus
cgcgtcaacggtgccagcaagagca

SEQ ID NO: 22770 - DNA, 25 bp, Mus musculus
cgcgtcgagccagacagactgctga

SEQ ID NO: 22771 - DNA, 25 bp, Mus musculus
cgcgttaccccaactatgttgcaga

SEQ ID NO: 22772 - DNA, 25 bp, Mus musculus
cgcgttccttactgaatatagaagt

SEQ ID NO: 22773 - DNA, 25 bp, Mus musculus
cgcgttgagcacacgctcttggaga

SEQ ID NO: 22774 - DNA, 25 bp, Mus musculus
cgcgtttcaagagggagttcattca

SEQ ID NO: 22775 - DNA, 25 bp, Mus musculus
cgcgtttctgaaggagcataactca

SEQ ID NO: 22776 - DNA, 25 bp, Mus musculus
cgctacatggagaagactggcaagt

SEQ ID NO: 22777 - DNA, 25 bp, Mus musculus
cgctagaagagattgttgacaacta

SEQ ID NO: 22778 - DNA, 25 bp, Mus musculus
cgctatcatgggtgtggtcttcacc

SEQ ID NO: 22779 - DNA, 25 bp, Mus musculus
cgctatggccttaaggatatcgatg

SEQ ID NO: 22780 - DNA, 25 bp, Mus musculus
cgctatggctctcgccctgtttggg

SEQ ID NO: 22781 - DNA, 25 bp, Mus musculus
cgctatggtaaacaaactgcattat

SEQ ID NO: 22782 - DNA, 25 bp, Mus musculus
cgctatgtggagctgttcattgttg

SEQ ID NO: 22783 - DNA, 25 bp, Mus musculus
cgctcaatgcggacagggtacgaga

SEQ ID NO: 22784 - DNA, 25 bp, Mus musculus
cgctcagcctgcagagaaacatgat

SEQ ID NO: 22785 - DNA, 25 bp, Mus musculus
cgctcagggaaagttcgtgacgact

SEQ ID NO: 22786 - DNA, 25 bp, Mus musculus
cgctcagggcctcagtgtatccgtg

SEQ ID NO: 22787 - DNA, 25 bp, Mus musculus
cgctcagtacagttgatggaaagaa

SEQ ID NO: 22788 - DNA, 25 bp, Mus musculus
cgctcatcagtatgtggccagagca

SEQ ID NO: 22789 - DNA, 25 bp, Mus musculus
cgctcatggacttcctgtttccact

SEQ ID NO: 22790 - DNA, 25 bp, Mus musculus
cgctcatgtgctcctggctgccttt

SEQ ID NO: 22791 - DNA, 25 bp, Mus musculus
cgctccaagagaggacatcgagagt

SEQ ID NO: 22792 - DNA, 25 bp, Mus musculus
cgctccaagatgagccaagtagccc

SEQ ID NO: 22793 - DNA, 25 bp, Mus musculus
cgctccattcagcattcgattagca

SEQ ID NO: 22794 - DNA, 25 bp, Mus musculus
cgctccctgttgtgatggagctcac

SEQ ID NO: 22795 - DNA, 25 bp, Mus musculus
cgctccgaggacgatggcattggca

SEQ ID NO: 22796 - DNA, 25 bp, Mus musculus
cgctccggagtttgagccgcagaag

SEQ ID NO: 22797 - DNA, 25 bp, Mus musculus
cgctcggaagaaagtaacgtgaaag

SEQ ID NO: 22798 - DNA, 25 bp, Mus musculus
cgctcgggcaagtcaccaagtccat

SEQ ID NO: 22799 - DNA, 25 bp, Mus musculus
cgctcgtggctacccatgactacta

SEQ ID NO: 22800 - DNA, 25 bp, Mus musculus
cgctctaaagccattgcctcgaaaa

SEQ ID NO: 22801 - DNA, 25 bp, Mus musculus
cgctctcgatgaccatgtctgcatg

SEQ ID NO: 22802 - DNA, 25 bp, Mus musculus
cgctctggatatccaggcctaccag

SEQ ID NO: 22803 - DNA, 25 bp, Mus musculus
cgctctgtgagaacgtggaaggctc

SEQ ID NO: 22804 - DNA, 25 bp, Mus musculus
cgctctgtgagatcgtggaaggctc

SEQ ID NO: 22805 - DNA, 25 bp, Mus musculus
cgctcttcaagctcacaaactctga

SEQ ID NO: 22806 - DNA, 25 bp, Mus musculus
cgctcttcgtggctcagaagatgta

SEQ ID NO: 22807 - DNA, 25 bp, Mus musculus
cgctcttgttcaggtcacgtttgga

SEQ ID NO: 22808 - DNA, 25 bp, Mus musculus
cgctgaacgaaagggacacggagca

SEQ ID NO: 22809 - DNA, 25 bp, Mus musculus
cgctgaagagcccaacatcgacatt

SEQ ID NO: 22810 - DNA, 25 bp, Mus musculus
cgctgaaggacttccagtatgtgga

SEQ ID NO: 22811 - DNA, 25 bp, Mus musculus
cgctgaaggagtttgtgcagtttgt

SEQ ID NO: 22812 - DNA, 25 bp, Mus musculus
cgctgaatgggtttgtaaagtttcg

SEQ ID NO: 22813 - DNA, 25 bp, Mus musculus
cgctgacagatctgggcggtcttga

SEQ ID NO: 22814 - DNA, 25 bp, Mus musculus
cgctgacggccaacaccgtgtgctt

SEQ ID NO: 22815 - DNA, 25 bp, Mus musculus
cgctgagagacagacactgggcctg

SEQ ID NO: 22816 - DNA, 25 bp, Mus musculus
cgctgagcagtttatggaagagaca

SEQ ID NO: 22817 - DNA, 25 bp, Mus musculus
cgctgaggccaaccagcagcagact

SEQ ID NO: 22818 - DNA, 25 bp, Mus musculus
cgctgagggctacacgttaagccga

SEQ ID NO: 22819 - DNA, 25 bp, Mus musculus
cgctgcaaaatgcaacttgagagct

SEQ ID NO: 22820 - DNA, 25 bp, Mus musculus
cgctgcagggtcttgaaaacccctc

SEQ ID NO: 22821 - DNA, 25 bp, Mus musculus
cgctgcatccagctaaccatgggac

SEQ ID NO: 22822 - DNA, 25 bp, Mus musculus
cgctgcattgggatacagatccatc

SEQ ID NO: 22823 - DNA, 25 bp, Mus musculus
cgctgccgtccgttagtcctggagt

SEQ ID NO: 22824 - DNA, 25 bp, Mus musculus
cgctgcgacttctgctgcgacaagc

SEQ ID NO: 22825 - DNA, 25 bp, Mus musculus
cgctgcgagcacaagtggccaaact

SEQ ID NO: 22826 - DNA, 25 bp, Mus musculus
cgctgctgaccgaggactgaccact

SEQ ID NO: 22827 - DNA, 25 bp, Mus musculus
cgctgctgtatgtcccctgggacct

SEQ ID NO: 22828 - DNA, 25 bp, Mus musculus
cgctgcttcataggcactgtgatta

SEQ ID NO: 22829 - DNA, 25 bp, Mus musculus
cgctggaaaaaccttctgaatcttg

SEQ ID NO: 22830 - DNA, 25 bp, Mus musculus
cgctggaggtgaccaaacttatcta

SEQ ID NO: 22831 - DNA, 25 bp, Mus musculus
cgctggataagatagctgagatcaa

SEQ ID NO: 22832 - DNA, 25 bp, Mus musculus
cgctggccagtatagcacgagctat

SEQ ID NO: 22833 - DNA, 25 bp, Mus musculus
cgctggctattaccaagctaatgag

SEQ ID NO: 22834 - DNA, 25 bp, Mus musculus
cgctggctgactgatgaggatacaa

SEQ ID NO: 22835 - DNA, 25 bp, Mus musculus
cgctggtactttgatgtcactgaag

SEQ ID NO: 22836 - DNA, 25 bp, Mus musculus
cgctgtaagatgaacgaggacactg

SEQ ID NO: 22837 - DNA, 25 bp, Mus musculus
cgctgtagatgtgaaacgcttcaac

SEQ ID NO: 22838 - DNA, 25 bp, Mus musculus
cgctgtctggccttacatcaggatg

SEQ ID NO: 22839 - DNA, 25 bp, Mus musculus
cgctgtgacattcgctacacaggac

SEQ ID NO: 22840 - DNA, 25 bp, Mus musculus
cgctgtgacattggctacacaggac

SEQ ID NO: 22841 - DNA, 25 bp, Mus musculus
cgctgtgagtatacaactgcatttg

SEQ ID NO: 22842 - DNA, 25 bp, Mus musculus
cgctgtgtatgaaaagatcgtgcac

SEQ ID NO: 22843 - DNA, 25 bp, Mus musculus
cgctgtgtcatgagattgagaacat

SEQ ID NO: 22844 - DNA, 25 bp, Mus musculus
cgcttacgcagaatccatgcggaat

SEQ ID NO: 22845 - DNA, 25 bp, Mus musculus
cgcttagcagaagcccatgctaaag

SEQ ID NO: 22846 - DNA, 25 bp, Mus musculus
cgcttcacgaccatgatggctccag

SEQ ID NO: 22847 - DNA, 25 bp, Mus musculus
cgcttcatttggcaacattctggat

SEQ ID NO: 22848 - DNA, 25 bp, Mus musculus
cgcttctgggaaagctatacgtaca

SEQ ID NO: 22849 - DNA, 25 bp, Mus musculus
cgcttgctagctttacccgagaggc

SEQ ID NO: 22850 - DNA, 25 bp, Mus musculus
cgcttgctggtggtgtcagcccagt

SEQ ID NO: 22851 - DNA, 25 bp, Mus musculus
cgcttgggaatggacacgctggatc

SEQ ID NO: 22852 - DNA, 25 bp, Mus musculus
cgctttgtgcagtggcagtcttcca

SEQ ID NO: 22853 - DNA, 25 bp, Mus musculus
cgcttttaagaaatgcagatcacca

SEQ ID NO: 22854 - DNA, 25 bp, Mus musculus
cggaaaaatctctggctcaaagttg

SEQ ID NO: 22855 - DNA, 25 bp, Mus musculus
cggaaaaccctctgcccggatgctg

SEQ ID NO: 22856 - DNA, 25 bp, Mus musculus
cggaaaatagggaagaagtgagcct

SEQ ID NO: 22857 - DNA, 25 bp, Mus musculus
cggaaactacagaaggcagtggaga

SEQ ID NO: 22858 - DNA, 25 bp, Mus musculus
cggaaagaatcctagcaatgtctgc

SEQ ID NO: 22859 - DNA, 25 bp, Mus musculus
cggaaagacgacaccaaggcagcag

SEQ ID NO: 22860 - DNA, 25 bp, Mus musculus
cggaaagcctgtgcctctgctgaga

SEQ ID NO: 22861 - DNA, 25 bp, Mus musculus
cggaaaggtgcgagatccacagcta

SEQ ID NO: 22862 - DNA, 25 bp, Mus musculus
cggaaatctaccagctttatgtcag

SEQ ID NO: 22863 - DNA, 25 bp, Mus musculus
cggaaatgacacagcaggacacagc

SEQ ID NO: 22864 - DNA, 25 bp, Mus musculus
cggaaatgcgagtgccaaataggtc

SEQ ID NO: 22865 - DNA, 25 bp, Mus musculus
cggaacatcaaaatcccaatgaaac

SEQ ID NO: 22866 - DNA, 25 bp, Mus musculus
cggaaccacagcctcctttcaataa

SEQ ID NO: 22867 - DNA, 25 bp, Mus musculus
cggaacctgcctcttcttggtggcg

SEQ ID NO: 22868 - DNA, 25 bp, Mus musculus
cggaacgatccggaacatccttggg

SEQ ID NO: 22869 - DNA, 25 bp, Mus musculus
cggaagaacacgctcctctcggtgg

SEQ ID NO: 22870 - DNA, 25 bp, Mus musculus
cggaagacgagaccagggcaaacat

SEQ ID NO: 22871 - DNA, 25 bp, Mus musculus
cggaagaggcataagatgccctgaa

SEQ ID NO: 22872 - DNA, 25 bp, Mus musculus
cggaagaggcattagatgccctgaa

SEQ ID NO: 22873 - DNA, 25 bp, Mus musculus
cggaagcatcttacagtggtcgact

SEQ ID NO: 22874 - DNA, 25 bp, Mus musculus
cggaagcggcagagtcagcgctggg

SEQ ID NO: 22875 - DNA, 25 bp, Mus musculus
cggaagctccgggaacaagtgaatt

SEQ ID NO: 22876 - DNA, 25 bp, Mus musculus
cggaaggatccgaggcagattttct

SEQ ID NO: 22877 - DNA, 25 bp, Mus musculus
cggaagggccttgcactggacccag

SEQ ID NO: 22878 - DNA, 25 bp, Mus musculus
cggaaggtgccctttactgagaagg

SEQ ID NO: 22879 - DNA, 25 bp, Mus musculus
cggaagtctgcaatgaccccaaggt

SEQ ID NO: 22880 - DNA, 25 bp, Mus musculus
cggaatatcaatcccagcacagcaa

SEQ ID NO: 22881 - DNA, 25 bp, Mus musculus
cggaatgaactcttcctagatgttc

SEQ ID NO: 22882 - DNA, 25 bp, Mus musculus
cggaattgcagatggagacgcccat

SEQ ID NO: 22883 - DNA, 25 bp, Mus musculus
cggaatttcagcaagcaggccacag

SEQ ID NO: 22884 - DNA, 25 bp, Mus musculus
cggacaaagagattgaggttctcta

SEQ ID NO: 22885 - DNA, 25 bp, Mus musculus
cggacaaagcttcgaggcctctaca

SEQ ID NO: 22886 - DNA, 25 bp, Mus musculus
cggacaaaggcatagggctgtgttt

SEQ ID NO: 22887 - DNA, 25 bp, Mus musculus
cggacaattcagaagaaaagtggaa

SEQ ID NO: 22888 - DNA, 25 bp, Mus musculus
cggacactagaggagctcctgaagc

SEQ ID NO: 22889 - DNA, 25 bp, Mus musculus
cggacagaagccaccctggaggctg

SEQ ID NO: 22890 - DNA, 25 bp, Mus musculus
cggacagttactatgcataaggaca

SEQ ID NO: 22891 - DNA, 25 bp, Mus musculus
cggacatcggcttgggcccagtctt

SEQ ID NO: 22892 - DNA, 25 bp, Mus musculus
cggaccaagggtcagctggcttctt

SEQ ID NO: 22893 - DNA, 25 bp, Mus musculus
cggacccagagctggatcctgagca

SEQ ID NO: 22894 - DNA, 25 bp, Mus musculus
cggaccccttggactatgttagcat

SEQ ID NO: 22895 - DNA, 25 bp, Mus musculus
cggaccggatatgcagagcctgttc

SEQ ID NO: 22896 - DNA, 25 bp, Mus musculus
cggaccgtggaggagtcactgcaca

SEQ ID NO: 22897 - DNA, 25 bp, Mus musculus
cggacctcacggacgtgatggagca

SEQ ID NO: 22898 - DNA, 25 bp, Mus musculus
cggacgagttgaggccatcaaggct

SEQ ID NO: 22899 - DNA, 25 bp, Mus musculus
cggacgcccgtggtctactgcgtga

SEQ ID NO: 22900 - DNA, 25 bp, Mus musculus
cggacggcactcctagtctggaagc

SEQ ID NO: 22901 - DNA, 25 bp, Mus musculus
cggacggccaaagcacatgcgggtt

SEQ ID NO: 22902 - DNA, 25 bp, Mus musculus
cggactctcccaagagccggaaaga

SEQ ID NO: 22903 - DNA, 25 bp, Mus musculus
cggactggtattctaactcgtagca

SEQ ID NO: 22904 - DNA, 25 bp, Mus musculus
cggactgtgacaggtttgtgttagc

SEQ ID NO: 22905 - DNA, 25 bp, Mus musculus
cggactgttttgatacattgtccaa

SEQ ID NO: 22906 - DNA, 25 bp, Mus musculus
cggagaaggatgcacagccacagct

SEQ ID NO: 22907 - DNA, 25 bp, Mus musculus
cggagaatcacagcagctgccacta

SEQ ID NO: 22908 - DNA, 25 bp, Mus musculus
cggagacagaaaagtgctggacgcc

SEQ ID NO: 22909 - DNA, 25 bp, Mus musculus
cggagactattgtggatcccagtcc

SEQ ID NO: 22910 - DNA, 25 bp, Mus musculus
cggagactgactcttagcacgtggc

SEQ ID NO: 22911 - DNA, 25 bp, Mus musculus
cggagactgactgttagcacgtggc

SEQ ID NO: 22912 - DNA, 25 bp, Mus musculus
cggagagctacggaaccactagtgt

SEQ ID NO: 22913 - DNA, 25 bp, Mus musculus
cggagatatgtacgcaagtttgtgt

SEQ ID NO: 22914 - DNA, 25 bp, Mus musculus
cggagatcttgctaggcttgcccta

SEQ ID NO: 22915 - DNA, 25 bp, Mus musculus
cggagattatgctggcaaggcagaa

SEQ ID NO: 22916 - DNA, 25 bp, Mus musculus
cggagcagcacgcagatggaattat

SEQ ID NO: 22917 - DNA, 25 bp, Mus musculus
cggagccccaggaaaccaggtcctg

SEQ ID NO: 22918 - DNA, 25 bp, Mus musculus
cggagccgtctggaacaggaaaagc

SEQ ID NO: 22919 - DNA, 25 bp, Mus musculus
cggagcgtgccttccgacgctcgga

SEQ ID NO: 22920 - DNA, 25 bp, Mus musculus
cggagctcggaggacactaagcaga

SEQ ID NO: 22921 - DNA, 25 bp, Mus musculus
cggaggacactaagcagatgatgag

SEQ ID NO: 22922 - DNA, 25 bp, Mus musculus
cggaggacgagctagtgtctacact

SEQ ID NO: 22923 - DNA, 25 bp, Mus musculus
cggaggagaaagagatggacacccc

SEQ ID NO: 22924 - DNA, 25 bp, Mus musculus
cggaggatgaatcgtgccttgctca

SEQ ID NO: 22925 - DNA, 25 bp, Mus musculus
cggaggatgaatggtgccttgctca

SEQ ID NO: 22926 - DNA, 25 bp, Mus musculus
cggaggccgaaaagagagaaacatc

SEQ ID NO: 22927 - DNA, 25 bp, Mus musculus
cggaggcctggctcgactgtcctca

SEQ ID NO: 22928 - DNA, 25 bp, Mus musculus
cggaggcggctatggctccacccag

SEQ ID NO: 22929 - DNA, 25 bp, Mus musculus
cggaggctccctgaagcccagtgga

SEQ ID NO: 22930 - DNA, 25 bp, Mus musculus
cggaggcttcctggttcgagacaaa

SEQ ID NO: 22931 - DNA, 25 bp, Mus musculus
cggagggtcgattgtcaatatcatt

SEQ ID NO: 22932 - DNA, 25 bp, Mus musculus
cggaggtgctgccaaaccagagata

SEQ ID NO: 22933 - DNA, 25 bp, Mus musculus
cggagtcgcctcactagtggcaccg

SEQ ID NO: 22934 - DNA, 25 bp, Mus musculus
cggagtgtcacagtacaagaaacaa

SEQ ID NO: 22935 - DNA, 25 bp, Mus musculus
cggagttcagcaagatccagacaac

SEQ ID NO: 22936 - DNA, 25 bp, Mus musculus
cggagttgactaccgaccttgcgcg

SEQ ID NO: 22937 - DNA, 25 bp, Mus musculus
cggagttgactagcgaccttgcgcg

SEQ ID NO: 22938 - DNA, 25 bp, Mus musculus
cggagttttatcagcttgtaagtac

SEQ ID NO: 22939 - DNA, 25 bp, Mus musculus
cggataccagtatgggcacaaaaag

SEQ ID NO: 22940 - DNA, 25 bp, Mus musculus
cggataggtagcactgggcttcttt

SEQ ID NO: 22941 - DNA, 25 bp, Mus musculus
cggatatgcagagcctgttcactca

SEQ ID NO: 22942 - DNA, 25 bp, Mus musculus
cggatcagcagctggtgagtgccac

SEQ ID NO: 22943 - DNA, 25 bp, Mus musculus
cggatccaggatacctgacaggagt

SEQ ID NO: 22944 - DNA, 25 bp, Mus musculus
cggatcctaacccatgaggctggaa

SEQ ID NO: 22945 - DNA, 25 bp, Mus musculus
cggatcggcgattggctccaagagc

SEQ ID NO: 22946 - DNA, 25 bp, Mus musculus
cggatctcatcagccactttgaagg

SEQ ID NO: 22947 - DNA, 25 bp, Mus musculus
cggatctgggttcatgcagaagaaa

SEQ ID NO: 22948 - DNA, 25 bp, Mus musculus
cggatctgggttgatgcagaagaaa

SEQ ID NO: 22949 - DNA, 25 bp, Mus musculus
cggatgaaataaccaaagatgaatg

SEQ ID NO: 22950 - DNA, 25 bp, Mus musculus
cggatgaaatccatgttcgcgattg

SEQ ID NO: 22951 - DNA, 25 bp, Mus musculus
cggatgaagataggagacccaaagt

SEQ ID NO: 22952 - DNA, 25 bp, Mus musculus
cggatgaataccaggccatccagaa

SEQ ID NO: 22953 - DNA, 25 bp, Mus musculus
cggatgaatcctgtttcaacatgat

SEQ ID NO: 22954 - DNA, 25 bp, Mus musculus
cggatgactccatgaagatggcgaa

SEQ ID NO: 22955 - DNA, 25 bp, Mus musculus
cggatgatggtacaaactttcgagt

SEQ ID NO: 22956 - DNA, 25 bp, Mus musculus
cggatgcatatgagaagtgtccttc

SEQ ID NO: 22957 - DNA, 25 bp, Mus musculus
cggatgctctctatattgtgtcgca

SEQ ID NO: 22958 - DNA, 25 bp, Mus musculus
cggatgctgctcaaggccaagatgg

SEQ ID NO: 22959 - DNA, 25 bp, Mus musculus
cggatgtccggaatggccgctaccg

SEQ ID NO: 22960 - DNA, 25 bp, Mus musculus
cggatgtccggattggccgctaccg

SEQ ID NO: 22961 - DNA, 25 bp, Mus musculus
cggatgtcgaagtggccagattttg

SEQ ID NO: 22962 - DNA, 25 bp, Mus musculus
cggatgttaggatgaaatcagatct

SEQ ID NO: 22963 - DNA, 25 bp, Mus musculus
cggattctaacggaagacactgaaa

SEQ ID NO: 22964 - DNA, 25 bp, Mus musculus
cggattctgaaggtaattttgagac

SEQ ID NO: 22965 - DNA, 25 bp, Mus musculus
cggatttctggagcgctttccagga

SEQ ID NO: 22966 - DNA, 25 bp, Mus musculus
cggattttgggctttgcaaagaagg

SEQ ID NO: 22967 - DNA, 25 bp, Mus musculus
cggcaactggaggaaccttcatcgt

SEQ ID NO: 22968 - DNA, 25 bp, Mus musculus
cggcaactttggctttgatgatcta

SEQ ID NO: 22969 - DNA, 25 bp, Mus musculus
cggcaagagtcagtatcttctgggc

SEQ ID NO: 22970 - DNA, 25 bp, Mus musculus
cggcaagctgagcagcttcaagaga

SEQ ID NO: 22971 - DNA, 25 bp, Mus musculus
cggcaatgtgccacttcactatgca

SEQ ID NO: 22972 - DNA, 25 bp, Mus musculus
cggcaattcaggatgagagtacggt

SEQ ID NO: 22973 - DNA, 25 bp, Mus musculus
cggcaatttccaaggcaaaatgagt

SEQ ID NO: 22974 - DNA, 25 bp, Mus musculus
cggcacaagaagtaccctaccaaag

SEQ ID NO: 22975 - DNA, 25 bp, Mus musculus
cggcacaatagagggatgaaagttc

SEQ ID NO: 22976 - DNA, 25 bp, Mus musculus
cggcacagcagcagactaacttttt

SEQ ID NO: 22977 - DNA, 25 bp, Mus musculus
cggcaccaacgtgatggtgacagtg

SEQ ID NO: 22978 - DNA, 25 bp, Mus musculus
cggcaccctccttctcagtgtggta

SEQ ID NO: 22979 - DNA, 25 bp, Mus musculus
cggcacgtgatctgagtgtcactaa

SEQ ID NO: 22980 - DNA, 25 bp, Mus musculus
cggcagaagcttcatcacagaagtg

SEQ ID NO: 22981 - DNA, 25 bp, Mus musculus
cggcagaggccgttgtgcaaatcct

SEQ ID NO: 22982 - DNA, 25 bp, Mus musculus
cggcagatcgagagcatagagactt

SEQ ID NO: 22983 - DNA, 25 bp, Mus musculus
cggcagcagcaagacgctggctgtt

SEQ ID NO: 22984 - DNA, 25 bp, Mus musculus
cggcagcatgccaccaatgttggca

SEQ ID NO: 22985 - DNA, 25 bp, Mus musculus
cggcagcctgatgagcctatccggg

SEQ ID NO: 22986 - DNA, 25 bp, Mus musculus
cggcagctctatgggcgaggaccca

SEQ ID NO: 22987 - DNA, 25 bp, Mus musculus
cggcagggtcataaaaatgtaattc

SEQ ID NO: 22988 - DNA, 25 bp, Mus musculus
cggcattgtgtttggaatacaaaga

SEQ ID NO: 22989 - DNA, 25 bp, Mus musculus
cggccaaagcacatgcgggttatgg

SEQ ID NO: 22990 - DNA, 25 bp, Mus musculus
cggccaacgcctttcctgagtgcgg

SEQ ID NO: 22991 - DNA, 25 bp, Mus musculus
cggccaatggcaagttcagtaagtc

SEQ ID NO: 22992 - DNA, 25 bp, Mus musculus
cggccacaacagatctggtgcccat

SEQ ID NO: 22993 - DNA, 25 bp, Mus musculus
cggccacatcctggtatgaggagtt

SEQ ID NO: 22994 - DNA, 25 bp, Mus musculus
cggccagtcttctcttgaggaggtt

SEQ ID NO: 22995 - DNA, 25 bp, Mus musculus
cggccattgagttctaggaatcgaa

SEQ ID NO: 22996 - DNA, 25 bp, Mus musculus
cggcccctgcagttcagcatgagga

SEQ ID NO: 22997 - DNA, 25 bp, Mus musculus
cggccgcttccgctgcaatggattt

SEQ ID NO: 22998 - DNA, 25 bp, Mus musculus
cggccgtcagaatgtgacgatggca

SEQ ID NO: 22999 - DNA, 25 bp, Mus musculus
cggccgtggctactttacctctctg

SEQ ID NO: 23000 - DNA, 25 bp, Mus musculus
cggcctatcatagcctcttatgtgc

SEQ ID NO: 23001 - DNA, 25 bp, Mus musculus
cggcctcagaagtgatcagcgagta

SEQ ID NO: 23002 - DNA, 25 bp, Mus musculus
cggcctccaacgtgtaagtaaagct

SEQ ID NO: 23003 - DNA, 25 bp, Mus musculus
cggcctgcagatttcaagatggttg

SEQ ID NO: 23004 - DNA, 25 bp, Mus musculus
cggcctgccggattgattgtgaaac

SEQ ID NO: 23005 - DNA, 25 bp, Mus musculus
cggcctgcctcctcggtacatgatg

SEQ ID NO: 23006 - DNA, 25 bp, Mus musculus
cggccttacgcctttcttgagtttg

SEQ ID NO: 23007 - DNA, 25 bp, Mus musculus
cggcctttctcgtctcctatagcag

SEQ ID NO: 23008 - DNA, 25 bp, Mus musculus
cggcctttgacgacgcagtggaaga

SEQ ID NO: 23009 - DNA, 25 bp, Mus musculus
cggcgactagccactgtggaagaaa

SEQ ID NO: 23010 - DNA, 25 bp, Mus musculus
cggcgatctccgaggtgacttttcg

SEQ ID NO: 23011 - DNA, 25 bp, Mus musculus
cggcggaatttcagcaagcaggcca

SEQ ID NO: 23012 - DNA, 25 bp, Mus musculus
cggcggccaatctaaggtccaacat

SEQ ID NO: 23013 - DNA, 25 bp, Mus musculus
cggcggcctcactatcgctgggatc

SEQ ID NO: 23014 - DNA, 25 bp, Mus musculus
cggcggtatcccaaggaggtccaag

SEQ ID NO: 23015 - DNA, 25 bp, Mus musculus
cggcgtagtctgctccgagacagct

SEQ ID NO: 23016 - DNA, 25 bp, Mus musculus
cggcgtgtgtacaagtccctctgtc

SEQ ID NO: 23017 - DNA, 25 bp, Mus musculus
cggcgtttctccctcatggtcttaa

SEQ ID NO: 23018 - DNA, 25 bp, Mus musculus
cggctacatccacctatgaagtggg

SEQ ID NO: 23019 - DNA, 25 bp, Mus musculus
cggctaccgacaccttccttcatta

SEQ ID NO: 23020 - DNA, 25 bp, Mus musculus
cggctactcaggtggaaagattatc

SEQ ID NO: 23021 - DNA, 25 bp, Mus musculus
cggctactgagaaaagaacttacca

SEQ ID NO: 23022 - DNA, 25 bp, Mus musculus
cggctagtgacagcgaagacagagt

SEQ ID NO: 23023 - DNA, 25 bp, Mus musculus
cggctatcatgtctctcctggtgtc

SEQ ID NO: 23024 - DNA, 25 bp, Mus musculus
cggctcaatgagtttgtcactgtgc

SEQ ID NO: 23025 - DNA, 25 bp, Mus musculus
cggctccagtatggcctcctgattt

SEQ ID NO: 23026 - DNA, 25 bp, Mus musculus
cggctctgaaatcaggctcagcggc

SEQ ID NO: 23027 - DNA, 25 bp, Mus musculus
cggctctgagctaattctctccagc

SEQ ID NO: 23028 - DNA, 25 bp, Mus musculus
cggctctgagcttattctctccagc

SEQ ID NO: 23029 - DNA, 25 bp, Mus musculus
cggctctggaccagcagcctgaggt

SEQ ID NO: 23030 - DNA, 25 bp, Mus musculus
cggctcttagataccttcacgaaaa

SEQ ID NO: 23031 - DNA, 25 bp, Mus musculus
cggctctttggagctaaagcactgc

SEQ ID NO: 23032 - DNA, 25 bp, Mus musculus
cggctgagtgtggactgtgtcaata

SEQ ID NO: 23033 - DNA, 25 bp, Mus musculus
cggctgcagtacacctatgaggaac

SEQ ID NO: 23034 - DNA, 25 bp, Mus musculus
cggctgccagcgcaggcggattcgg

SEQ ID NO: 23035 - DNA, 25 bp, Mus musculus
cggctgccctgaatgctgactttaa

SEQ ID NO: 23036 - DNA, 25 bp, Mus musculus
cggctgctgtaacgtctgcgctaaa

SEQ ID NO: 23037 - DNA, 25 bp, Mus musculus
cggctgctgtaaggtctgcgctaaa

SEQ ID NO: 23038 - DNA, 25 bp, Mus musculus
cggctggaacccacacatgaggagg

SEQ ID NO: 23039 - DNA, 25 bp, Mus musculus
cggctggaggacttcaagccccaga

SEQ ID NO: 23040 - DNA, 25 bp, Mus musculus
cggctggctctggtttaaagcaagc

SEQ ID NO: 23041 - DNA, 25 bp, Mus musculus
cggctgggatgctctagcagatgaa

SEQ ID NO: 23042 - DNA, 25 bp, Mus musculus
cggctgtactcttgggtgtgaaaac

SEQ ID NO: 23043 - DNA, 25 bp, Mus musculus
cggctgtctaaggtgaagtgtgtca

SEQ ID NO: 23044 - DNA, 25 bp, Mus musculus
cggctgtgttttcaatgcacaaggg

SEQ ID NO: 23045 - DNA, 25 bp, Mus musculus
cggcttcgcgatgatgtgcagagca

SEQ ID NO: 23046 - DNA, 25 bp, Mus musculus
cggcttgattcggtggaatctgttc

SEQ ID NO: 23047 - DNA, 25 bp, Mus musculus
cgggaaaaacagcagattacgcctt

SEQ ID NO: 23048 - DNA, 25 bp, Mus musculus
cgggaacaagacgttgtcatcacag

SEQ ID NO: 23049 - DNA, 25 bp, Mus musculus
cgggaacaggcatcccgaccactgt

SEQ ID NO: 23050 - DNA, 25 bp, Mus musculus
cgggaacccaagagcagactacctc

SEQ ID NO: 23051 - DNA, 25 bp, Mus musculus
cgggaactggcaaatcttgcttgct

SEQ ID NO: 23052 - DNA, 25 bp, Mus musculus
cgggaactggcatatcttgcttgct

SEQ ID NO: 23053 - DNA, 25 bp, Mus musculus
cgggaagaagttccgcagcaagcca

SEQ ID NO: 23054 - DNA, 25 bp, Mus musculus
cgggaagaggtcaacaagtttcatt

SEQ ID NO: 23055 - DNA, 25 bp, Mus musculus
cgggaagaggtgactttcatctatc

SEQ ID NO: 23056 - DNA, 25 bp, Mus musculus
cgggaagccccgagaagctgaagtt

SEQ ID NO: 23057 - DNA, 25 bp, Mus musculus
cgggaaggcggcgttcagcacatca

SEQ ID NO: 23058 - DNA, 25 bp, Mus musculus
cgggaatatgcttggccgccacttc

SEQ ID NO: 23059 - DNA, 25 bp, Mus musculus
cgggaatcagatcaagcccaagatg

SEQ ID NO: 23060 - DNA, 25 bp, Mus musculus
cgggacacaggaatgctgccaaggt

SEQ ID NO: 23061 - DNA, 25 bp, Mus musculus
cgggacaccatgcagatcattctac

SEQ ID NO: 23062 - DNA, 25 bp, Mus musculus
cgggacagatcaccctgctgaagct

SEQ ID NO: 23063 - DNA, 25 bp, Mus musculus
cgggacaggaaagccactgcagcgt

SEQ ID NO: 23064 - DNA, 25 bp, Mus musculus
cgggacatgcatcgtcccctggact

SEQ ID NO: 23065 - DNA, 25 bp, Mus musculus
cgggaccagatcgaccagttcagta

SEQ ID NO: 23066 - DNA, 25 bp, Mus musculus
cgggaccggctcaatgagtttgtca

SEQ ID NO: 23067 - DNA, 25 bp, Mus musculus
cgggacctctttgagcaattccgaa

SEQ ID NO: 23068 - DNA, 25 bp, Mus musculus
cgggactctggaagaccagctgagc

SEQ ID NO: 23069 - DNA, 25 bp, Mus musculus
cgggactttatctgcagtaggttcc

SEQ ID NO: 23070 - DNA, 25 bp, Mus musculus
cgggactttatgctgatcacaaaca

SEQ ID NO: 23071 - DNA, 25 bp, Mus musculus
cgggactttggctgggatccctgct

SEQ ID NO: 23072 - DNA, 25 bp, Mus musculus
cgggagaaaggcgagttccagattc

SEQ ID NO: 23073 - DNA, 25 bp, Mus musculus
cgggagagaagttaccatagctgct

SEQ ID NO: 23074 - DNA, 25 bp, Mus musculus
cgggagatctatgaccgctatggcc

SEQ ID NO: 23075 - DNA, 25 bp, Mus musculus
cgggagcaacaccttcacagtcaag

SEQ ID NO: 23076 - DNA, 25 bp, Mus musculus
cgggagcaccacctacgctattggc

SEQ ID NO: 23077 - DNA, 25 bp, Mus musculus
cgggagcaccacgtacgctattggc

SEQ ID NO: 23078 - DNA, 25 bp, Mus musculus
cgggagccactgctgtacattgagc

SEQ ID NO: 23079 - DNA, 25 bp, Mus musculus
cgggagcctctctgagcagggtttc

SEQ ID NO: 23080 - DNA, 25 bp, Mus musculus
cgggagcctttttgcacattactgt

SEQ ID NO: 23081 - DNA, 25 bp, Mus musculus
cgggaggcccgcaagtatgctagca

SEQ ID NO: 23082 - DNA, 25 bp, Mus musculus
cgggagggctacacttgcgactgct

SEQ ID NO: 23083 - DNA, 25 bp, Mus musculus
cgggagggctactcttgcgactgct

SEQ ID NO: 23084 - DNA, 25 bp, Mus musculus
cgggagtaacaccaatgtgaccagc

SEQ ID NO: 23085 - DNA, 25 bp, Mus musculus
cgggagttggtcactaaagacaagc

SEQ ID NO: 23086 - DNA, 25 bp, Mus musculus
cgggagttggtctctaaagacaagc

SEQ ID NO: 23087 - DNA, 25 bp, Mus musculus
cgggataagcagatagaagaaagga

SEQ ID NO: 23088 - DNA, 25 bp, Mus musculus
cgggatatcctttcactctgcatgg

SEQ ID NO: 23089 - DNA, 25 bp, Mus musculus
cgggatattatactcgcacttaaaa

SEQ ID NO: 23090 - DNA, 25 bp, Mus musculus
cgggatcacaagttgcatgttgact

SEQ ID NO: 23091 - DNA, 25 bp, Mus musculus
cgggatctgcaatctctgagatgac

SEQ ID NO: 23092 - DNA, 25 bp, Mus musculus
cgggattgccttcctagctgactat

SEQ ID NO: 23093 - DNA, 25 bp, Mus musculus
cgggcacagtcaccggctcaggatc

SEQ ID NO: 23094 - DNA, 25 bp, Mus musculus
cgggcagctgcttgtcttaaaaaat

SEQ ID NO: 23095 - DNA, 25 bp, Mus musculus
cgggcatgatggacacagacgattt

SEQ ID NO: 23096 - DNA, 25 bp, Mus musculus
cgggcatggagaacctcattagtgc

SEQ ID NO: 23097 - DNA, 25 bp, Mus musculus
cgggcatgtttaaggaactctggaa

SEQ ID NO: 23098 - DNA, 25 bp, Mus musculus
cgggcattgcgagacgtccagcctg

SEQ ID NO: 23099 - DNA, 25 bp, Mus musculus
cgggccacaaatgttcttgcaaacc

SEQ ID NO: 23100 - DNA, 25 bp, Mus musculus
cgggccaccacactcctggaaggtg

SEQ ID NO: 23101 - DNA, 25 bp, Mus musculus
cgggccacctgtcattcaagggaca

SEQ ID NO: 23102 - DNA, 25 bp, Mus musculus
cgggccagattaagtaacttagcac

SEQ ID NO: 23103 - DNA, 25 bp, Mus musculus
cgggccagattatgtaacttagcac

SEQ ID NO: 23104 - DNA, 25 bp, Mus musculus
cgggcccatggaagacaaaagagag

SEQ ID NO: 23105 - DNA, 25 bp, Mus musculus
cgggccgagcactgtgtgaacacgc

SEQ ID NO: 23106 - DNA, 25 bp, Mus musculus
cgggccgtcttcaccgcagacggga

SEQ ID NO: 23107 - DNA, 25 bp, Mus musculus
cgggcctatagagatcacatatcga

SEQ ID NO: 23108 - DNA, 25 bp, Mus musculus
cgggcctcttctagggccagctctg

SEQ ID NO: 23109 - DNA, 25 bp, Mus musculus
cgggcctgcatcaattgagcgagtt

SEQ ID NO: 23110 - DNA, 25 bp, Mus musculus
cgggcctttgctcatagaaacacag

SEQ ID NO: 23111 - DNA, 25 bp, Mus musculus
cgggcgaacctacttcagctgtaca

SEQ ID NO: 23112 - DNA, 25 bp, Mus musculus
cgggcgcaggactcgggtagaaggg

SEQ ID NO: 23113 - DNA, 25 bp, Mus musculus
cgggctctaaagagatgaatccaat

SEQ ID NO: 23114 - DNA, 25 bp, Mus musculus
cgggctctctactacgacctgatca

SEQ ID NO: 23115 - DNA, 25 bp, Mus musculus
cgggctgaccgcatcctgtgtaagc

SEQ ID NO: 23116 - DNA, 25 bp, Mus musculus
cgggctgtagcggaactcaataacc

SEQ ID NO: 23117 - DNA, 25 bp, Mus musculus
cgggtaattaatctggccaatgaga

SEQ ID NO: 23118 - DNA, 25 bp, Mus musculus
cgggtaattctatcgggatatcctt

SEQ ID NO: 23119 - DNA, 25 bp, Mus musculus
cgggtaggaccgaaaatcctctgca

SEQ ID NO: 23120 - DNA, 25 bp, Mus musculus
cgggtcacagtgaaacatctagaag

SEQ ID NO: 23121 - DNA, 25 bp, Mus musculus
cgggtcctttcaggacaccttatgc

SEQ ID NO: 23122 - DNA, 25 bp, Mus musculus
cgggtcggtcaaggtctactcctat

SEQ ID NO: 23123 - DNA, 25 bp, Mus musculus
cgggtctggctaagagaaaatggcc

SEQ ID NO: 23124 - DNA, 25 bp, Mus musculus
cgggtcttacacagcctctcggaaa

SEQ ID NO: 23125 - DNA, 25 bp, Mus musculus
cgggtgaacagacgccaaggatctc

SEQ ID NO: 23126 - DNA, 25 bp, Mus musculus
cgggtgatcaacgaggagtacaaaa

SEQ ID NO: 23127 - DNA, 25 bp, Mus musculus
cgggtgctacttctatgtgggcttc

SEQ ID NO: 23128 - DNA, 25 bp, Mus musculus
cgggtggttctcaaatacaggcatg

SEQ ID NO: 23129 - DNA, 25 bp, Mus musculus
cgggtgtactggatcgccactgtca

SEQ ID NO: 23130 - DNA, 25 bp, Mus musculus
cgggtttaccatcaagagatcaggg

SEQ ID NO: 23131 - DNA, 25 bp, Mus musculus
cgggtttgtgatggttccaatggct

SEQ ID NO: 23132 - DNA, 25 bp, Mus musculus
cggtacattacagaattagcaaaag

SEQ ID NO: 23133 - DNA, 25 bp, Mus musculus
cggtaccgtgttaggtattctaatg

SEQ ID NO: 23134 - DNA, 25 bp, Mus musculus
cggtacctgtggatgccagattccc

SEQ ID NO: 23135 - DNA, 25 bp, Mus musculus
cggtactgccgaggagtcaatgcaa

SEQ ID NO: 23136 - DNA, 25 bp, Mus musculus
cggtagaatccagagccctgtgctg

SEQ ID NO: 23137 - DNA, 25 bp, Mus musculus
cggtagtgggtgacctgttctctgc

SEQ ID NO: 23138 - DNA, 25 bp, Mus musculus
cggtatgaatatcatccagtctgtg

SEQ ID NO: 23139 - DNA, 25 bp, Mus musculus
cggtattttattctaccagacagct

SEQ ID NO: 23140 - DNA, 25 bp, Mus musculus
cggtcaaagacagcggcagagacta

SEQ ID NO: 23141 - DNA, 25 bp, Mus musculus
cggtcaaggtctactcctattacaa

SEQ ID NO: 23142 - DNA, 25 bp, Mus musculus
cggtcacacagcaaaagtatctact

SEQ ID NO: 23143 - DNA, 25 bp, Mus musculus
cggtcactggctctgtcgccatcta

SEQ ID NO: 23144 - DNA, 25 bp, Mus musculus
cggtcagaactattgctatggatgg

SEQ ID NO: 23145 - DNA, 25 bp, Mus musculus
cggtcagaagcgaagctctcccttc

SEQ ID NO: 23146 - DNA, 25 bp, Mus musculus
cggtcagaatagagatgtttcgaaa

SEQ ID NO: 23147 - DNA, 25 bp, Mus musculus
cggtcagaggcagagccaggaatct

SEQ ID NO: 23148 - DNA, 25 bp, Mus musculus
cggtcagtgccagccgtactattca

SEQ ID NO: 23149 - DNA, 25 bp, Mus musculus
cggtccacagagcatgggctacaag

SEQ ID NO: 23150 - DNA, 25 bp, Mus musculus
cggtccagctgcaacctatttcagg

SEQ ID NO: 23151 - DNA, 25 bp, Mus musculus
cggtcctgagatctttgcggttgct

SEQ ID NO: 23152 - DNA, 25 bp, Mus musculus
cggtcgcagagggttagatcactgc

SEQ ID NO: 23153 - DNA, 25 bp, Mus musculus
cggtcggcctcaccgcctatgtgat

SEQ ID NO: 23154 - DNA, 25 bp, Mus musculus
cggtctcctacagcgccattgaaga

SEQ ID NO: 23155 - DNA, 25 bp, Mus musculus
cggtctgactccgttgcactgtggg

SEQ ID NO: 23156 - DNA, 25 bp, Mus musculus
cggtctggtcgagttgggcctctct

SEQ ID NO: 23157 - DNA, 25 bp, Mus musculus
cggtctggtgtggtgacctccgcaa

SEQ ID NO: 23158 - DNA, 25 bp, Mus musculus
cggtctgtcgtcagcatccgtctgc

SEQ ID NO: 23159 - DNA, 25 bp, Mus musculus
cggtgaaataaaagtggccatcagc

SEQ ID NO: 23160 - DNA, 25 bp, Mus musculus
cggtgaagagcttgtggaaaagaaa

SEQ ID NO: 23161 - DNA, 25 bp, Mus musculus
cggtgacatcagtgatccagaagag

SEQ ID NO: 23162 - DNA, 25 bp, Mus musculus
cggtgagaagcgtccggctgcttcc

SEQ ID NO: 23163 - DNA, 25 bp, Mus musculus
cggtgagacttcctggatcacactg

SEQ ID NO: 23164 - DNA, 25 bp, Mus musculus
cggtgagcagatgtgtgagatcttc

SEQ ID NO: 23165 - DNA, 25 bp, Mus musculus
cggtgatcattgtgggtgccctcag

SEQ ID NO: 23166 - DNA, 25 bp, Mus musculus
cggtgattcagtatagcctggacca

SEQ ID NO: 23167 - DNA, 25 bp, Mus musculus
cggtgattctctggcaaagcgaggc

SEQ ID NO: 23168 - DNA, 25 bp, Mus musculus
cggtgcaagcaaaaaccaggaggaa

SEQ ID NO: 23169 - DNA, 25 bp, Mus musculus
cggtgcctatgggacggtgtacaaa

SEQ ID NO: 23170 - DNA, 25 bp, Mus musculus
cggtgctgtcccggctgaagctaag

SEQ ID NO: 23171 - DNA, 25 bp, Mus musculus
cggtgctttctgaagaatctctttc

SEQ ID NO: 23172 - DNA, 25 bp, Mus musculus
cggtggattgtgttatcgaggttca

SEQ ID NO: 23173 - DNA, 25 bp, Mus musculus
cggtggcaattttggaccaggacca

SEQ ID NO: 23174 - DNA, 25 bp, Mus musculus
cggtggcagccagaactgatacagc

SEQ ID NO: 23175 - DNA, 25 bp, Mus musculus
cggtggcttctgtcccaaggaagga

SEQ ID NO: 23176 - DNA, 25 bp, Mus musculus
cggtgggtctcggaaaagttcattg

SEQ ID NO: 23177 - DNA, 25 bp, Mus musculus
cggtggtattgtcatctgcgaagca

SEQ ID NO: 23178 - DNA, 25 bp, Mus musculus
cggtggtcagtgtcttcccagggaa

SEQ ID NO: 23179 - DNA, 25 bp, Mus musculus
cggtgtatagaatgacatatgtggg

SEQ ID NO: 23180 - DNA, 25 bp, Mus musculus
cggtgtccatgtacacaaggacagg

SEQ ID NO: 23181 - DNA, 25 bp, Mus musculus
cggtgtgaagctgaacagacggata

SEQ ID NO: 23182 - DNA, 25 bp, Mus musculus
cggtgtgattgtggattaccacggc

SEQ ID NO: 23183 - DNA, 25 bp, Mus musculus
cggtgttgctgttgaaacaggaaca

SEQ ID NO: 23184 - DNA, 25 bp, Mus musculus
cggttacagggatagcagtgtcttg

SEQ ID NO: 23185 - DNA, 25 bp, Mus musculus
cggttagaacacctgcaggagaaaa

SEQ ID NO: 23186 - DNA, 25 bp, Mus musculus
cggttatcaggttgttggcagctac

SEQ ID NO: 23187 - DNA, 25 bp, Mus musculus
cggttatgacggagactattgtgga

SEQ ID NO: 23188 - DNA, 25 bp, Mus musculus
cggttatgcgggagcatgaacgcaa

SEQ ID NO: 23189 - DNA, 25 bp, Mus musculus
cggttcaaattgcaactaggaggcc

SEQ ID NO: 23190 - DNA, 25 bp, Mus musculus
cggttcatctgggagtacgatccaa

SEQ ID NO: 23191 - DNA, 25 bp, Mus musculus
cggttccctcatcggatcttacaac

SEQ ID NO: 23192 - DNA, 25 bp, Mus musculus
cggttgaggccctgacgctcgactc

SEQ ID NO: 23193 - DNA, 25 bp, Mus musculus
cggtttcatatccagatcaccagag

SEQ ID NO: 23194 - DNA, 25 bp, Mus musculus
cggtttcctctgagtagcgctggct

SEQ ID NO: 23195 - DNA, 25 bp, Mus musculus
cggtttgtagcggacagcaaagaca

SEQ ID NO: 23196 - DNA, 25 bp, Mus musculus
cgtaaaaaaccagacagcatcaagt

SEQ ID NO: 23197 - DNA, 25 bp, Mus musculus
cgtaaaaccgcttcatttggcaaca

SEQ ID NO: 23198 - DNA, 25 bp, Mus musculus
cgtaaatttttatcaaagctaatgg

SEQ ID NO: 23199 - DNA, 25 bp, Mus musculus
cgtaacctaacatgggaagagagca

SEQ ID NO: 23200 - DNA, 25 bp, Mus musculus
cgtaactgaagtgggcctgtcctgg

SEQ ID NO: 23201 - DNA, 25 bp, Mus musculus
cgtaaggcttgaggaagtagaatcc

SEQ ID NO: 23202 - DNA, 25 bp, Mus musculus
cgtaatcctgcctcatacgccgagg

SEQ ID NO: 23203 - DNA, 25 bp, Mus musculus
cgtaatcgcggtcctgctactcgct

SEQ ID NO: 23204 - DNA, 25 bp, Mus musculus
cgtaatgacagtgtcattgtggctg

SEQ ID NO: 23205 - DNA, 25 bp, Mus musculus
cgtaattgagcaggtctcatgggat

SEQ ID NO: 23206 - DNA, 25 bp, Mus musculus
cgtacacaccctcagaggcaggcaa

SEQ ID NO: 23207 - DNA, 25 bp, Mus musculus
cgtacatatctcctgtggcttccta

SEQ ID NO: 23208 - DNA, 25 bp, Mus musculus
cgtacatgggagtgcaaaggccgat

SEQ ID NO: 23209 - DNA, 25 bp, Mus musculus
cgtaccactggcatctgtgacaagt

SEQ ID NO: 23210 - DNA, 25 bp, Mus musculus
cgtaccagggacataacaggtctca

SEQ ID NO: 23211 - DNA, 25 bp, Mus musculus
cgtaccagtaatgttcgatccacat

SEQ ID NO: 23212 - DNA, 25 bp, Mus musculus
cgtacccacacaagttccacgtgga

SEQ ID NO: 23213 - DNA, 25 bp, Mus musculus
cgtacccggagatatgtacgcaagt

SEQ ID NO: 23214 - DNA, 25 bp, Mus musculus
cgtaccgtcatttctcctaacaaag

SEQ ID NO: 23215 - DNA, 25 bp, Mus musculus
cgtacctaagaacaggcccctggtg

SEQ ID NO: 23216 - DNA, 25 bp, Mus musculus
cgtactacgtatttcacaaaaattg

SEQ ID NO: 23217 - DNA, 25 bp, Mus musculus
cgtactctggccgaaagcacagcaa

SEQ ID NO: 23218 - DNA, 25 bp, Mus musculus
cgtactggtgccgaagaaagcattg

SEQ ID NO: 23219 - DNA, 25 bp, Mus musculus
cgtagaaccgccagagttgagtcct

SEQ ID NO: 23220 - DNA, 25 bp, Mus musculus
cgtagacatggaaggtgcaccagga

SEQ ID NO: 23221 - DNA, 25 bp, Mus musculus
cgtagaccatgaagcagtactggac

SEQ ID NO: 23222 - DNA, 25 bp, Mus musculus
cgtagactgctataaaccaacagag

SEQ ID NO: 23223 - DNA, 25 bp, Mus musculus
cgtagatgcgtaccccactttcctt

SEQ ID NO: 23224 - DNA, 25 bp, Mus musculus
cgtagatttccagtggccccattga

SEQ ID NO: 23225 - DNA, 25 bp, Mus musculus
cgtagcagtattttccattctggaa

SEQ ID NO: 23226 - DNA, 25 bp, Mus musculus
cgtaggatttgcttttttccagaag

SEQ ID NO: 23227 - DNA, 25 bp, Mus musculus
cgtaggtggtctgattcagaaggac

SEQ ID NO: 23228 - DNA, 25 bp, Mus musculus
cgtaggttatcaccttcagcaagtc

SEQ ID NO: 23229 - DNA, 25 bp, Mus musculus
cgtataaggctgcttctcttgaaag

SEQ ID NO: 23230 - DNA, 25 bp, Mus musculus
cgtatacatcccttcagtacaatgg

SEQ ID NO: 23231 - DNA, 25 bp, Mus musculus
cgtatacggaaagctacatcagcac

SEQ ID NO: 23232 - DNA, 25 bp, Mus musculus
cgtatatcttgcctcccatgcatgt

SEQ ID NO: 23233 - DNA, 25 bp, Mus musculus
cgtatgctttccttccaagggttag

SEQ ID NO: 23234 - DNA, 25 bp, Mus musculus
cgtcaaagacttactgaaccaatgg

SEQ ID NO: 23235 - DNA, 25 bp, Mus musculus
cgtcaaccccgacttggaggagcca

SEQ ID NO: 23236 - DNA, 25 bp, Mus musculus
cgtcaactggaggtgcagccctgat

SEQ ID NO: 23237 - DNA, 25 bp, Mus musculus
cgtcaaggcgctctataatgagaca

SEQ ID NO: 23238 - DNA, 25 bp, Mus musculus
cgtcaatatggagaggcacccagcc

SEQ ID NO: 23239 - DNA, 25 bp, Mus musculus
cgtcaatgtggagatggacgccgcc

SEQ ID NO: 23240 - DNA, 25 bp, Mus musculus
cgtcacacgcctggagaagaatgcc

SEQ ID NO: 23241 - DNA, 25 bp, Mus musculus
cgtcaccaagtgagaagccatgcct

SEQ ID NO: 23242 - DNA, 25 bp, Mus musculus
cgtcaccttctttcatagcccttgg

SEQ ID NO: 23243 - DNA, 25 bp, Mus musculus
cgtcacgacggcaccagcaacggga

SEQ ID NO: 23244 - DNA, 25 bp, Mus musculus
cgtcactcgaaaggcctactggcag

SEQ ID NO: 23245 - DNA, 25 bp, Mus musculus
cgtcactgccgttattactaccctt

SEQ ID NO: 23246 - DNA, 25 bp, Mus musculus
cgtcagacatgatggacggacgagt

SEQ ID NO: 23247 - DNA, 25 bp, Mus musculus
cgtcagacgtgagggacagtccact

SEQ ID NO: 23248 - DNA, 25 bp, Mus musculus
cgtcagacttaacaggaagcttcag

SEQ ID NO: 23249 - DNA, 25 bp, Mus musculus
cgtcagagctgccaccttcgatgga

SEQ ID NO: 23250 - DNA, 25 bp, Mus musculus
cgtcagcaatgagggcacctcggga

SEQ ID NO: 23251 - DNA, 25 bp, Mus musculus
cgtcatatccagcagtaccatatgg

SEQ ID NO: 23252 - DNA, 25 bp, Mus musculus
cgtcatcaagataaattcagtcctg

SEQ ID NO: 23253 - DNA, 25 bp, Mus musculus
cgtcatccaataagaacatctacag

SEQ ID NO: 23254 - DNA, 25 bp, Mus musculus
cgtcatgactaccttctgagtaaag

SEQ ID NO: 23255 - DNA, 25 bp, Mus musculus
cgtcatgcatcagatctgtgcacag

SEQ ID NO: 23256 - DNA, 25 bp, Mus musculus
cgtcatgcttcatacacagttctga

SEQ ID NO: 23257 - DNA, 25 bp, Mus musculus
cgtcattccatctgtcccgatagat

SEQ ID NO: 23258 - DNA, 25 bp, Mus musculus
cgtcatttctcctaacaaagaagaa

SEQ ID NO: 23259 - DNA, 25 bp, Mus musculus
cgtccaaagaagctatatcagcaga

SEQ ID NO: 23260 - DNA, 25 bp, Mus musculus
cgtccacaccatcgaggagatcgag

SEQ ID NO: 23261 - DNA, 25 bp, Mus musculus
cgtccacaccggtgcggagtccagg

SEQ ID NO: 23262 - DNA, 25 bp, Mus musculus
cgtccacgtctggacccggttcctg

SEQ ID NO: 23263 - DNA, 25 bp, Mus musculus
cgtccatgactcttgagggatttgg

SEQ ID NO: 23264 - DNA, 25 bp, Mus musculus
cgtccatgagaagtggaaccgtctt

SEQ ID NO: 23265 - DNA, 25 bp, Mus musculus
cgtccatgctggatgagagcagcct

SEQ ID NO: 23266 - DNA, 25 bp, Mus musculus
cgtccatggccacctcttggaaggg

SEQ ID NO: 23267 - DNA, 25 bp, Mus musculus
cgtccatggccagctcttggaaggg

SEQ ID NO: 23268 - DNA, 25 bp, Mus musculus
cgtcccaacttccttctaggagtgg

SEQ ID NO: 23269 - DNA, 25 bp, Mus musculus
cgtcccaatgagaagggagaatatg

SEQ ID NO: 23270 - DNA, 25 bp, Mus musculus
cgtcccagggagaacgtatgcagat

SEQ ID NO: 23271 - DNA, 25 bp, Mus musculus
cgtccccgcccgaagacaagatgtt

SEQ ID NO: 23272 - DNA, 25 bp, Mus musculus
cgtcccgtatactcgccatactggg

SEQ ID NO: 23273 - DNA, 25 bp, Mus musculus
cgtccctcattcaatgaagagaaag

SEQ ID NO: 23274 - DNA, 25 bp, Mus musculus
cgtccctgaaatcatagagttaata

SEQ ID NO: 23275 - DNA, 25 bp, Mus musculus
cgtccctgcggaagcgtttcctgct

SEQ ID NO: 23276 - DNA, 25 bp, Mus musculus
cgtccgatccccaggattggaatta

SEQ ID NO: 23277 - DNA, 25 bp, Mus musculus
cgtccgctgcatcaagtcttgccgt

SEQ ID NO: 23278 - DNA, 25 bp, Mus musculus
cgtccgtggagatggcacatctctg

SEQ ID NO: 23279 - DNA, 25 bp, Mus musculus
cgtcctccactggatttattcagaa

SEQ ID NO: 23280 - DNA, 25 bp, Mus musculus
cgtcctgccaacatcgagtctataa

SEQ ID NO: 23281 - DNA, 25 bp, Mus musculus
cgtcctgtcccggatcactagaaga

SEQ ID NO: 23282 - DNA, 25 bp, Mus musculus
cgtcctgtcgagtggataagccttc

SEQ ID NO: 23283 - DNA, 25 bp, Mus musculus
cgtccttggcgtcagagtagcttct

SEQ ID NO: 23284 - DNA, 25 bp, Mus musculus
cgtcgagagtcagaactcaggttca

SEQ ID NO: 23285 - DNA, 25 bp, Mus musculus
cgtcgagatcttttccacatgcaac

SEQ ID NO: 23286 - DNA, 25 bp, Mus musculus
cgtcgcagagaactcaggagacaaa

SEQ ID NO: 23287 - DNA, 25 bp, Mus musculus
cgtcgcagccctcacgtgagggtca

SEQ ID NO: 23288 - DNA, 25 bp, Mus musculus
cgtcgcctggttcatcatcacgcag

SEQ ID NO: 23289 - DNA, 25 bp, Mus musculus
cgtcgcggcttggatttcaaactgg

SEQ ID NO: 23290 - DNA, 25 bp, Mus musculus
cgtcgctcagtacagttgatggaaa

SEQ ID NO: 23291 - DNA, 25 bp, Mus musculus
cgtcggaaatggaagctgaaactta

SEQ ID NO: 23292 - DNA, 25 bp, Mus musculus
cgtcggaacagtccaagctcctcat

SEQ ID NO: 23293 - DNA, 25 bp, Mus musculus
cgtcgtacagaatgccacggtcctg

SEQ ID NO: 23294 - DNA, 25 bp, Mus musculus
cgtcgttggagagtcaaacagcgga

SEQ ID NO: 23295 - DNA, 25 bp, Mus musculus
cgtctacctccttatcacagttgta

SEQ ID NO: 23296 - DNA, 25 bp, Mus musculus
cgtctagtggaggagaatactcggc

SEQ ID NO: 23297 - DNA, 25 bp, Mus musculus
cgtctatgtgaaaaccagattggaa

SEQ ID NO: 23298 - DNA, 25 bp, Mus musculus
cgtctcaagaacaagcctctcctgt

SEQ ID NO: 23299 - DNA, 25 bp, Mus musculus
cgtctccatcggaaggcagcactgg

SEQ ID NO: 23300 - DNA, 25 bp, Mus musculus
cgtctccatgacagtatttctgaag

SEQ ID NO: 23301 - DNA, 25 bp, Mus musculus
cgtctcgtgactcgcacgcagggca

SEQ ID NO: 23302 - DNA, 25 bp, Mus musculus
cgtctctagcaatcaagggtgattt

SEQ ID NO: 23303 - DNA, 25 bp, Mus musculus
cgtctctcagtgctttgtgttgaaa

SEQ ID NO: 23304 - DNA, 25 bp, Mus musculus
cgtctctgtcactgtgcttcccagg

SEQ ID NO: 23305 - DNA, 25 bp, Mus musculus
cgtctgagatcgaaaggccccgcta

SEQ ID NO: 23306 - DNA, 25 bp, Mus musculus
cgtctgatggctataaagtacaaga

SEQ ID NO: 23307 - DNA, 25 bp, Mus musculus
cgtctgctacgagaaagctgttccc

SEQ ID NO: 23308 - DNA, 25 bp, Mus musculus
cgtctgctgaccttggatagctcaa

SEQ ID NO: 23309 - DNA, 25 bp, Mus musculus
cgtctggaacaggaaaagcaggtgc

SEQ ID NO: 23310 - DNA, 25 bp, Mus musculus
cgtctggcacgtgcggagtaaatgt

SEQ ID NO: 23311 - DNA, 25 bp, Mus musculus
cgtctgggcagaatgtcacgatgga

SEQ ID NO: 23312 - DNA, 25 bp, Mus musculus
cgtctgggtacatggaaaactcggt

SEQ ID NO: 23313 - DNA, 25 bp, Mus musculus
cgtctgtccgtagcctgctgaggca

SEQ ID NO: 23314 - DNA, 25 bp, Mus musculus
cgtcttaaggcagagactagcaagg

SEQ ID NO: 23315 - DNA, 25 bp, Mus musculus
cgtcttacgaagatctgggactctt

SEQ ID NO: 23316 - DNA, 25 bp, Mus musculus
cgtcttccaaggatcagtgatcagc

SEQ ID NO: 23317 - DNA, 25 bp, Mus musculus
cgtcttgaaggtgcttatctctttt

SEQ ID NO: 23318 - DNA, 25 bp, Mus musculus
cgtcttgccaaagaagaggaaccca

SEQ ID NO: 23319 - DNA, 25 bp, Mus musculus
cgtcttggcatagcagtgaggcgtc

SEQ ID NO: 23320 - DNA, 25 bp, Mus musculus
cgtcttgtggcatggctttgcttcc

SEQ ID NO: 23321 - DNA, 25 bp, Mus musculus
cgtctttcagattgtcagactcctt

SEQ ID NO: 23322 - DNA, 25 bp, Mus musculus
cgtctttgatctttacctgtggcta

SEQ ID NO: 23323 - DNA, 25 bp, Mus musculus
cgtctttgggttttctgtccgctca

SEQ ID NO: 23324 - DNA, 25 bp, Mus musculus
cgtgaaacctgagcaacattaaggc

SEQ ID NO: 23325 - DNA, 25 bp, Mus musculus
cgtgaaagtagaaagggagcgccca

SEQ ID NO: 23326 - DNA, 25 bp, Mus musculus
cgtgaaagtctacgaggacgaaaca

SEQ ID NO: 23327 - DNA, 25 bp, Mus musculus
cgtgaacagacaccttctgagagca

SEQ ID NO: 23328 - DNA, 25 bp, Mus musculus
cgtgaacatcaaggacaaagatgga

SEQ ID NO: 23329 - DNA, 25 bp, Mus musculus
cgtgaacccactgagactggaggct

SEQ ID NO: 23330 - DNA, 25 bp, Mus musculus
cgtgaactgcggagctggacctagc

SEQ ID NO: 23331 - DNA, 25 bp, Mus musculus
cgtgaactgcggtgctggacctagc

SEQ ID NO: 23332 - DNA, 25 bp, Mus musculus
cgtgaagacagtgaaaagcccttca

SEQ ID NO: 23333 - DNA, 25 bp, Mus musculus
cgtgaagagcacaactgtagcagtt

SEQ ID NO: 23334 - DNA, 25 bp, Mus musculus
cgtgaagcgattgatgaatttcgac

SEQ ID NO: 23335 - DNA, 25 bp, Mus musculus
cgtgaagctcttagccaggcgaaat

SEQ ID NO: 23336 - DNA, 25 bp, Mus musculus
cgtgacaagagtgatgccctcctca

SEQ ID NO: 23337 - DNA, 25 bp, Mus musculus
cgtgacatcaccgaggctttggcca

SEQ ID NO: 23338 - DNA, 25 bp, Mus musculus
cgtgacgcagccaagtgagtcgcct

SEQ ID NO: 23339 - DNA, 25 bp, Mus musculus
cgtgactcgaaatccccagactgct

SEQ ID NO: 23340 - DNA, 25 bp, Mus musculus
cgtgactgacttacatctagaccct

SEQ ID NO: 23341 - DNA, 25 bp, Mus musculus
cgtgactgcatgtggagcggcttct

SEQ ID NO: 23342 - DNA, 25 bp, Mus musculus
cgtgactgtggaagaattctgtggt

SEQ ID NO: 23343 - DNA, 25 bp, Mus musculus
cgtgagattctccatgaggatttgg

SEQ ID NO: 23344 - DNA, 25 bp, Mus musculus
cgtgagcacagtgggcatcgacttc

SEQ ID NO: 23345 - DNA, 25 bp, Mus musculus
cgtgagcttggcatcaagaatgaag

SEQ ID NO: 23346 - DNA, 25 bp, Mus musculus
cgtgaggaacagagtgctgagacca

SEQ ID NO: 23347 - DNA, 25 bp, Mus musculus
cgtgatacccctgattgtggtgcta

SEQ ID NO: 23348 - DNA, 25 bp, Mus musculus
cgtgatatcacatccaacaagaagt

SEQ ID NO: 23349 - DNA, 25 bp, Mus musculus
cgtgatccaagcagagatcgatgct

SEQ ID NO: 23350 - DNA, 25 bp, Mus musculus
cgtgatctgagtgtcactaacaagg

SEQ ID NO: 23351 - DNA, 25 bp, Mus musculus
cgtgatgaactgtactctctgagag

SEQ ID NO: 23352 - DNA, 25 bp, Mus musculus
cgtgatgccgtcaccaggaacatct

SEQ ID NO: 23353 - DNA, 25 bp, Mus musculus
cgtgattgtgacactgggaggtctc

SEQ ID NO: 23354 - DNA, 25 bp, Mus musculus
cgtgcaactcaggacttgaatctag

SEQ ID NO: 23355 - DNA, 25 bp, Mus musculus
cgtgcacctcggcatcttcttcatg

SEQ ID NO: 23356 - DNA, 25 bp, Mus musculus
cgtgcagactttccgagacctggtc

SEQ ID NO: 23357 - DNA, 25 bp, Mus musculus
cgtgcagccggcagccgttgaatgt

SEQ ID NO: 23358 - DNA, 25 bp, Mus musculus
cgtgcaggaccagctccaagtagag

SEQ ID NO: 23359 - DNA, 25 bp, Mus musculus
cgtgcaggcagcatcgtcttgaagg

SEQ ID NO: 23360 - DNA, 25 bp, Mus musculus
cgtgcagtctgacatcctggctcaa

SEQ ID NO: 23361 - DNA, 25 bp, Mus musculus
cgtgccaaatgggataacattgccg

SEQ ID NO: 23362 - DNA, 25 bp, Mus musculus
cgtgccaaggccaggagtcaggcct

SEQ ID NO: 23363 - DNA, 25 bp, Mus musculus
cgtgcccagaagcagatgtttcgga

SEQ ID NO: 23364 - DNA, 25 bp, Mus musculus
cgtgcccagtgacaacatttggacc

SEQ ID NO: 23365 - DNA, 25 bp, Mus musculus
cgtgcctacgtgacctggatgacca

SEQ ID NO: 23366 - DNA, 25 bp, Mus musculus
cgtgcctacgtgtcctggatgacca

SEQ ID NO: 23367 - DNA, 25 bp, Mus musculus
cgtgccttaaaggaatttgtggcca

SEQ ID NO: 23368 - DNA, 25 bp, Mus musculus
cgtgccttcagcctagctaagaata

SEQ ID NO: 23369 - DNA, 25 bp, Mus musculus
cgtgcgacatttcccgaattctgca

SEQ ID NO: 23370 - DNA, 25 bp, Mus musculus
cgtgctcaatgccttctctcaggca

SEQ ID NO: 23371 - DNA, 25 bp, Mus musculus
cgtgctcgctctatatctgctgtta

SEQ ID NO: 23372 - DNA, 25 bp, Mus musculus
cgtgctctgctacctccaagtgtgg

SEQ ID NO: 23373 - DNA, 25 bp, Mus musculus
cgtgctctgtgttggagctgaagta

SEQ ID NO: 23374 - DNA, 25 bp, Mus musculus
cgtgctctgttggtatagaggagta

SEQ ID NO: 23375 - DNA, 25 bp, Mus musculus
cgtgctgagcctgtccgtgtggcac

SEQ ID NO: 23376 - DNA, 25 bp, Mus musculus
cgtgctgattagaagacttgattgc

SEQ ID NO: 23377 - DNA, 25 bp, Mus musculus
cgtgctgcaagagagtcagctcagt

SEQ ID NO: 23378 - DNA, 25 bp, Mus musculus
cgtgctgctgagataagtttgaaga

SEQ ID NO: 23379 - DNA, 25 bp, Mus musculus
cgtgctggataaccccatgtactgg

SEQ ID NO: 23380 - DNA, 25 bp, Mus musculus
cgtgctgtcagtgtgaacgatgaag

SEQ ID NO: 23381 - DNA, 25 bp, Mus musculus
cgtgctgtcggctgccctgcgagct

SEQ ID NO: 23382 - DNA, 25 bp, Mus musculus
cgtgctgtgtaacaaggaccccttc

SEQ ID NO: 23383 - DNA, 25 bp, Mus musculus
cgtgcttacgtgaattggaggagta

SEQ ID NO: 23384 - DNA, 25 bp, Mus musculus
cgtgcttcagttcctcatcctgcga

SEQ ID NO: 23385 - DNA, 25 bp, Mus musculus
cgtgctttggctcttccgtgtccta

SEQ ID NO: 23386 - DNA, 25 bp, Mus musculus
cgtggaaaaactgtttggatggtgc

SEQ ID NO: 23387 - DNA, 25 bp, Mus musculus
cgtggaaatgaaatgggagttcact

SEQ ID NO: 23388 - DNA, 25 bp, Mus musculus
cgtggaagtgatggatcctggattt

SEQ ID NO: 23389 - DNA, 25 bp, Mus musculus
cgtggaatgaagattgtcctgatca

SEQ ID NO: 23390 - DNA, 25 bp, Mus musculus
cgtggacacccttgagagaaccttc

SEQ ID NO: 23391 - DNA, 25 bp, Mus musculus
cgtggacagtaccacctatgatggg

SEQ ID NO: 23392 - DNA, 25 bp, Mus musculus
cgtggacatgtcaccacacacagct

SEQ ID NO: 23393 - DNA, 25 bp, Mus musculus
cgtggacattgtcagcactctgcaa

SEQ ID NO: 23394 - DNA, 25 bp, Mus musculus
cgtggaccccaaggatgcgtcgata

SEQ ID NO: 23395 - DNA, 25 bp, Mus musculus
cgtggacctgcatgtgtacgagatc

SEQ ID NO: 23396 - DNA, 25 bp, Mus musculus
cgtggacgctgaatgggtttgtaaa

SEQ ID NO: 23397 - DNA, 25 bp, Mus musculus
cgtggacggagtaaaatacgctgct

SEQ ID NO: 23398 - DNA, 25 bp, Mus musculus
cgtggacgggtggatgttgcaggcc

SEQ ID NO: 23399 - DNA, 25 bp, Mus musculus
cgtggactgagtggagagacactac

SEQ ID NO: 23400 - DNA, 25 bp, Mus musculus
cgtggacttaactcaccatagcaag

SEQ ID NO: 23401 - DNA, 25 bp, Mus musculus
cgtggagaaatttgtcattgtggac

SEQ ID NO: 23402 - DNA, 25 bp, Mus musculus
cgtggagaagctctccgacggcatc

SEQ ID NO: 23403 - DNA, 25 bp, Mus musculus
cgtggagaaggtgccctgtaattct

SEQ ID NO: 23404 - DNA, 25 bp, Mus musculus
cgtggagatagattattttgggctg

SEQ ID NO: 23405 - DNA, 25 bp, Mus musculus
cgtggaggaagctttctacaaggtc

SEQ ID NO: 23406 - DNA, 25 bp, Mus musculus
cgtggaggctgcaagaaacctagga

SEQ ID NO: 23407 - DNA, 25 bp, Mus musculus
cgtggagtcccgtcccataggtggc

SEQ ID NO: 23408 - DNA, 25 bp, Mus musculus
cgtggatggcaaacaccaagacctt

SEQ ID NO: 23409 - DNA, 25 bp, Mus musculus
cgtggatgtaaagccagcagcgtca

SEQ ID NO: 23410 - DNA, 25 bp, Mus musculus
cgtggattcccaaggtttactcaag

SEQ ID NO: 23411 - DNA, 25 bp, Mus musculus
cgtggcactggctgatggttgtggc

SEQ ID NO: 23412 - DNA, 25 bp, Mus musculus
cgtggcagacttgaccgagcaatat

SEQ ID NO: 23413 - DNA, 25 bp, Mus musculus
cgtggcagagatccatttcacataa

SEQ ID NO: 23414 - DNA, 25 bp, Mus musculus
cgtggcagagctgggactcactttc

SEQ ID NO: 23415 - DNA, 25 bp, Mus musculus
cgtggcagccaaatacggaaagctt

SEQ ID NO: 23416 - DNA, 25 bp, Mus musculus
cgtggcaggtcagcctgcgttatga

SEQ ID NO: 23417 - DNA, 25 bp, Mus musculus
cgtggcagtatttgaagcagtttct

SEQ ID NO: 23418 - DNA, 25 bp, Mus musculus
cgtggcatataaggatgccatctat

SEQ ID NO: 23419 - DNA, 25 bp, Mus musculus
cgtggcccaggagggcaagcataaa

SEQ ID NO: 23420 - DNA, 25 bp, Mus musculus
cgtggcccggtgtccaatgtgctgt

SEQ ID NO: 23421 - DNA, 25 bp, Mus musculus
cgtggccgttgacttctctccggat

SEQ ID NO: 23422 - DNA, 25 bp, Mus musculus
cgtggctactttacctctctgttat

SEQ ID NO: 23423 - DNA, 25 bp, Mus musculus
cgtggctctgcaacaaggtcatgac

SEQ ID NO: 23424 - DNA, 25 bp, Mus musculus
cgtggctgtgcacttcacccaggac

SEQ ID NO: 23425 - DNA, 25 bp, Mus musculus
cgtggcttacggtgtggctatgaac

SEQ ID NO: 23426 - DNA, 25 bp, Mus musculus
cgtggcttatttgccttcactctca

SEQ ID NO: 23427 - DNA, 25 bp, Mus musculus
cgtggctttgccaccttagctctgg

SEQ ID NO: 23428 - DNA, 25 bp, Mus musculus
cgtgggaaccacaccaagacctact

SEQ ID NO: 23429 - DNA, 25 bp, Mus musculus
cgtgggaaccactccaagacctact

SEQ ID NO: 23430 - DNA, 25 bp, Mus musculus
cgtgggaacggaagcatttggaatc

SEQ ID NO: 23431 - DNA, 25 bp, Mus musculus
cgtgggagcccgaagaaaatattct

SEQ ID NO: 23432 - DNA, 25 bp, Mus musculus
cgtgggagtctgtgcatttgtaaag

SEQ ID NO: 23433 - DNA, 25 bp, Mus musculus
cgtgggtacaaatgaagcaaagaaa

SEQ ID NO: 23434 - DNA, 25 bp, Mus musculus
cgtgggtccatcctccacatggatg

SEQ ID NO: 23435 - DNA, 25 bp, Mus musculus
cgtgggtgcacaaagaaatgcaaac

SEQ ID NO: 23436 - DNA, 25 bp, Mus musculus
cgtgggtgtgactgtggttctcatc

SEQ ID NO: 23437 - DNA, 25 bp, Mus musculus
cgtggtacctttgccctatgagagg

SEQ ID NO: 23438 - DNA, 25 bp, Mus musculus
cgtggtagatgatatagcagtggcc

SEQ ID NO: 23439 - DNA, 25 bp, Mus musculus
cgtggtcacactgtgatcctgcatg

SEQ ID NO: 23440 - DNA, 25 bp, Mus musculus
cgtggtcaccgccttctatgtcatg

SEQ ID NO: 23441 - DNA, 25 bp, Mus musculus
cgtggtgaagagagaggatctcttt

SEQ ID NO: 23442 - DNA, 25 bp, Mus musculus
cgtggtgcaaggaacgggcctccta

SEQ ID NO: 23443 - DNA, 25 bp, Mus musculus
cgtggtggaccgataagtactagaa

SEQ ID NO: 23444 - DNA, 25 bp, Mus musculus
cgtggttgatttgttctgctcctgg

SEQ ID NO: 23445 - DNA, 25 bp, Mus musculus
cgtggttgcacagtttggctgacag

SEQ ID NO: 23446 - DNA, 25 bp, Mus musculus
cgtgtaagtaaagcttggagaagcc

SEQ ID NO: 23447 - DNA, 25 bp, Mus musculus
cgtgtacatgagaccttgggagaac

SEQ ID NO: 23448 - DNA, 25 bp, Mus musculus
cgtgtacctccagtcattgtcctgg

SEQ ID NO: 23449 - DNA, 25 bp, Mus musculus
cgtgtatggactacccagtgaggaa

SEQ ID NO: 23450 - DNA, 25 bp, Mus musculus
cgtgtcaaaagcagaaacgcaggag

SEQ ID NO: 23451 - DNA, 25 bp, Mus musculus
cgtgtcacctctgcaaagggatggg

SEQ ID NO: 23452 - DNA, 25 bp, Mus musculus
cgtgtccctggccatcttcgtggtt

SEQ ID NO: 23453 - DNA, 25 bp, Mus musculus
cgtgtccgggccattggtgccgatc

SEQ ID NO: 23454 - DNA, 25 bp, Mus musculus
cgtgtccgtgcaggagattgttgac

SEQ ID NO: 23455 - DNA, 25 bp, Mus musculus
cgtgtcctccgttgactcctttacg

SEQ ID NO: 23456 - DNA, 25 bp, Mus musculus
cgtgtcctgagctgaagatgttccc

SEQ ID NO: 23457 - DNA, 25 bp, Mus musculus
cgtgtcgaagaaggcatgaaccata

SEQ ID NO: 23458 - DNA, 25 bp, Mus musculus
cgtgtcggcagtaaacctgcccaaa

SEQ ID NO: 23459 - DNA, 25 bp, Mus musculus
cgtgtcggtgcttcctacaaacgac

SEQ ID NO: 23460 - DNA, 25 bp, Mus musculus
cgtgtctctgaatgtgaaagggcca

SEQ ID NO: 23461 - DNA, 25 bp, Mus musculus
cgtgtctgggacatgtttttctgtg

SEQ ID NO: 23462 - DNA, 25 bp, Mus musculus
cgtgtgatagacctcagtgaatgca

SEQ ID NO: 23463 - DNA, 25 bp, Mus musculus
cgtgtgatctcactctcaggagagc

SEQ ID NO: 23464 - DNA, 25 bp, Mus musculus
cgtgtgcactgacttcaagatttcc

SEQ ID NO: 23465 - DNA, 25 bp, Mus musculus
cgtgtgcagaagaaaactttcacca

SEQ ID NO: 23466 - DNA, 25 bp, Mus musculus
cgtgtgctactacatcgagggcatc

SEQ ID NO: 23467 - DNA, 25 bp, Mus musculus
cgtgtggcgctacttccgagactac

SEQ ID NO: 23468 - DNA, 25 bp, Mus musculus
cgtgtgtacaagtccctctgtcccg

SEQ ID NO: 23469 - DNA, 25 bp, Mus musculus
cgtgtgtctgcctatattgactgga

SEQ ID NO: 23470 - DNA, 25 bp, Mus musculus
cgtgtgttgagcagtaaatggaata

SEQ ID NO: 23471 - DNA, 25 bp, Mus musculus
cgtgtgttgagctgtaaatggaata

SEQ ID NO: 23472 - DNA, 25 bp, Mus musculus
cgtgttcaagaaagacgggacagtc

SEQ ID NO: 23473 - DNA, 25 bp, Mus musculus
cgtgttcatccaagtgccacgggaa

SEQ ID NO: 23474 - DNA, 25 bp, Mus musculus
cgtgttcttggagaaggctgtgcca

SEQ ID NO: 23475 - DNA, 25 bp, Mus musculus
cgtgtttcctgccaattacgtcaaa

SEQ ID NO: 23476 - DNA, 25 bp, Mus musculus
cgtgtttcctgcgaattacgtcaaa

SEQ ID NO: 23477 - DNA, 25 bp, Mus musculus
cgtgtttgaggatcacctgtgggtc

SEQ ID NO: 23478 - DNA, 25 bp, Mus musculus
cgtgtttgggaatgacaagctaatt

SEQ ID NO: 23479 - DNA, 25 bp, Mus musculus
cgtgttttcgatgttaacgacaaag

SEQ ID NO: 23480 - DNA, 25 bp, Mus musculus
cgttaatggctgtcgtctaggaaaa

SEQ ID NO: 23481 - DNA, 25 bp, Mus musculus
cgttacaccagtgagatgcggagtg

SEQ ID NO: 23482 - DNA, 25 bp, Mus musculus
cgttacatatccttcagtggcatag

SEQ ID NO: 23483 - DNA, 25 bp, Mus musculus
cgttaccccaactatgttgcagaat

SEQ ID NO: 23484 - DNA, 25 bp, Mus musculus
cgttagcagccagtggagcgtcatg

SEQ ID NO: 23485 - DNA, 25 bp, Mus musculus
cgttataggcatttccgtgggactc

SEQ ID NO: 23486 - DNA, 25 bp, Mus musculus
cgttatccataacccagtggacggg

SEQ ID NO: 23487 - DNA, 25 bp, Mus musculus
cgttattgtgatgctctttgtatgc

SEQ ID NO: 23488 - DNA, 25 bp, Mus musculus
cgttcaaaggccttgtcactggaga

SEQ ID NO: 23489 - DNA, 25 bp, Mus musculus
cgttcaacgataccaacgtggtcca

SEQ ID NO: 23490 - DNA, 25 bp, Mus musculus
cgttcaatatttgatggtttccgag

SEQ ID NO: 23491 - DNA, 25 bp, Mus musculus
cgttcaattggagcagcagctaaga

SEQ ID NO: 23492 - DNA, 25 bp, Mus musculus
cgttcacccaaagtacaacttctat

SEQ ID NO: 23493 - DNA, 25 bp, Mus musculus
cgttcacgagtttagatggcgccta

SEQ ID NO: 23494 - DNA, 25 bp, Mus musculus
cgttcacgggccctggttgttcaca

SEQ ID NO: 23495 - DNA, 25 bp, Mus musculus
cgttcatagacgcaataatcacgcg

SEQ ID NO: 23496 - DNA, 25 bp, Mus musculus
cgttcatccaacattccgttcaaag

SEQ ID NO: 23497 - DNA, 25 bp, Mus musculus
cgttccaatccactggctgttcttc

SEQ ID NO: 23498 - DNA, 25 bp, Mus musculus
cgttccagagcatcgcgggtctgga

SEQ ID NO: 23499 - DNA, 25 bp, Mus musculus
cgttccatctctcagtcatctactg

SEQ ID NO: 23500 - DNA, 25 bp, Mus musculus
cgttccatgtccagcaccagggcag

SEQ ID NO: 23501 - DNA, 25 bp, Mus musculus
cgttcccggtgctttctgaagaatc

SEQ ID NO: 23502 - DNA, 25 bp, Mus musculus
cgttccctgatgcactggtctgcag

SEQ ID NO: 23503 - DNA, 25 bp, Mus musculus
cgttcctgtgtccacgttacaacaa

SEQ ID NO: 23504 - DNA, 25 bp, Mus musculus
cgttccttactgaatatagaagtca

SEQ ID NO: 23505 - DNA, 25 bp, Mus musculus
cgttcgatccagttttctggtggtc

SEQ ID NO: 23506 - DNA, 25 bp, Mus musculus
cgttctagggccctaccatgtgaag

SEQ ID NO: 23507 - DNA, 25 bp, Mus musculus
cgttctctgggtaagaccaccctga

SEQ ID NO: 23508 - DNA, 25 bp, Mus musculus
cgttctggattatgtcaatgactgc

SEQ ID NO: 23509 - DNA, 25 bp, Mus musculus
cgttctgtcaacaggcttcagatga

SEQ ID NO: 23510 - DNA, 25 bp, Mus musculus
cgttgaaacaaggaccattgctgtc

SEQ ID NO: 23511 - DNA, 25 bp, Mus musculus
cgttgaaaggtacatgaagcaggcc

SEQ ID NO: 23512 - DNA, 25 bp, Mus musculus
cgttgaaagtcacttattggcccct

SEQ ID NO: 23513 - DNA, 25 bp, Mus musculus
cgttgaaagtggtttgaagaccatc

SEQ ID NO: 23514 - DNA, 25 bp, Mus musculus
cgttgactacttttggccattccca

SEQ ID NO: 23515 - DNA, 25 bp, Mus musculus
cgttgacttctctccggatgagtgg

SEQ ID NO: 23516 - DNA, 25 bp, Mus musculus
cgttgatgacacatgctggccatga

SEQ ID NO: 23517 - DNA, 25 bp, Mus musculus
cgttgccctacaggctacactggat

SEQ ID NO: 23518 - DNA, 25 bp, Mus musculus
cgttgccgagagatggatgaacaga

SEQ ID NO: 23519 - DNA, 25 bp, Mus musculus
cgttgcctcgaagcgaggaaatgca

SEQ ID NO: 23520 - DNA, 25 bp, Mus musculus
cgttgctaaagcagactccaaactc

SEQ ID NO: 23521 - DNA, 25 bp, Mus musculus
cgttgctaaagctgactccaaactc

SEQ ID NO: 23522 - DNA, 25 bp, Mus musculus
cgttgctgagcttctggtggttgaa

SEQ ID NO: 23523 - DNA, 25 bp, Mus musculus
cgttggacacaaaaggacagctgtg

SEQ ID NO: 23524 - DNA, 25 bp, Mus musculus
cgttggaccacttagtgctgtgatt

SEQ ID NO: 23525 - DNA, 25 bp, Mus musculus
cgttggagccggaagattgaaaagc

SEQ ID NO: 23526 - DNA, 25 bp, Mus musculus
cgttggagtagatgcgactgacctt

SEQ ID NO: 23527 - DNA, 25 bp, Mus musculus
cgttggcaaaaacttctctgaggaa

SEQ ID NO: 23528 - DNA, 25 bp, Mus musculus
cgttggcagagcaccgaaggacact

SEQ ID NO: 23529 - DNA, 25 bp, Mus musculus
cgttggcattgcacatccatccact

SEQ ID NO: 23530 - DNA, 25 bp, Mus musculus
cgttggcattgctcatccatccact

SEQ ID NO: 23531 - DNA, 25 bp, Mus musculus
cgttggcgagttcctcgaagtcaca

SEQ ID NO: 23532 - DNA, 25 bp, Mus musculus
cgttgggctggcctactttgcagct

SEQ ID NO: 23533 - DNA, 25 bp, Mus musculus
cgttgggctggcgtactttgcagct

SEQ ID NO: 23534 - DNA, 25 bp, Mus musculus
cgttgtactgctgggactctgcaca

SEQ ID NO: 23535 - DNA, 25 bp, Mus musculus
cgttgtcagcacacagcgttcacaa

SEQ ID NO: 23536 - DNA, 25 bp, Mus musculus
cgttgtcccctctggctcttcagtt

SEQ ID NO: 23537 - DNA, 25 bp, Mus musculus
cgttgttccccaggatagcagcctg

SEQ ID NO: 23538 - DNA, 25 bp, Mus musculus
cgttgttctctacactggcagagaa

SEQ ID NO: 23539 - DNA, 25 bp, Mus musculus
cgtttaaacaaagatgagtatgagt

SEQ ID NO: 23540 - DNA, 25 bp, Mus musculus
cgtttaagaatgagggtgcagagcc

SEQ ID NO: 23541 - DNA, 25 bp, Mus musculus
cgtttacatcgtatgagctcatgga

SEQ ID NO: 23542 - DNA, 25 bp, Mus musculus
cgtttacgaccaggtggagtttgat

SEQ ID NO: 23543 - DNA, 25 bp, Mus musculus
cgtttatccgagacagcctggagaa

SEQ ID NO: 23544 - DNA, 25 bp, Mus musculus
cgtttatgatcgtatgctgctagac

SEQ ID NO: 23545 - DNA, 25 bp, Mus musculus
cgtttatggattataggagcgatgg

SEQ ID NO: 23546 - DNA, 25 bp, Mus musculus
cgtttcaaggacatcttccaggaga

SEQ ID NO: 23547 - DNA, 25 bp, Mus musculus
cgtttccgaagatgatgggctcagc

SEQ ID NO: 23548 - DNA, 25 bp, Mus musculus
cgtttctcactcatgacgctgcgga

SEQ ID NO: 23549 - DNA, 25 bp, Mus musculus
cgtttctctacacagaacaagttga

SEQ ID NO: 23550 - DNA, 25 bp, Mus musculus
cgtttctgacagagcaaacagcaac

SEQ ID NO: 23551 - DNA, 25 bp, Mus musculus
cgtttctgctcggtctgacgctgat

SEQ ID NO: 23552 - DNA, 25 bp, Mus musculus
cgtttgagtttcagcttatgccagc

SEQ ID NO: 23553 - DNA, 25 bp, Mus musculus
cgtttgattgctaaggtaatgctgg

SEQ ID NO: 23554 - DNA, 25 bp, Mus musculus
cgtttgcggcatgtcatccctgggc

SEQ ID NO: 23555 - DNA, 25 bp, Mus musculus
cgtttgggaggatggatccgctcaa

SEQ ID NO: 23556 - DNA, 25 bp, Mus musculus
cgtttggtgctacgttggatgtaaa

SEQ ID NO: 23557 - DNA, 25 bp, Mus musculus
cgtttgtcaccagttaagcaggctc

SEQ ID NO: 23558 - DNA, 25 bp, Mus musculus
cgtttgtcaggtatcgttcaagcta

SEQ ID NO: 23559 - DNA, 25 bp, Mus musculus
cgtttgtgagataaactatcgtgac

SEQ ID NO: 23560 - DNA, 25 bp, Mus musculus
cgtttgtggacagcaacctcctcta

SEQ ID NO: 23561 - DNA, 25 bp, Mus musculus
cgtttgtgtcttgccaggagcagag

SEQ ID NO: 23562 - DNA, 25 bp, Mus musculus
cgttttaccaacgaggatcatttgg

SEQ ID NO: 23563 - DNA, 25 bp, Mus musculus
cgttttacgggtgctgtgccgtgtc

SEQ ID NO: 23564 - DNA, 25 bp, Mus musculus
cgttttactatatgaagcagccact

SEQ ID NO: 23565 - DNA, 25 bp, Mus musculus
cgttttagccattcaagggaagaga

SEQ ID NO: 23566 - DNA, 25 bp, Mus musculus
cgttttcagcgagacaaggaaatga

SEQ ID NO: 23567 - DNA, 25 bp, Mus musculus
cgttttcctcgtgctaaccactggg

SEQ ID NO: 23568 - DNA, 25 bp, Mus musculus
cgttttggacagagaatcgccaaat

SEQ ID NO: 23569 - DNA, 25 bp, Mus musculus
cgttttggacagtgaatcgccaaat

SEQ ID NO: 23570 - DNA, 25 bp, Mus musculus
cgtttttcatcccaacagttcctgg

SEQ ID NO: 23571 - DNA, 25 bp, Mus musculus
cgttttttctatcagcggctggtgg

SEQ ID NO: 23572 - DNA, 25 bp, Mus musculus
ctaaaacagcactttaataatgcgc

SEQ ID NO: 23573 - DNA, 25 bp, Mus musculus
ctaaaactgttctagagtggcagcg

SEQ ID NO: 23574 - DNA, 25 bp, Mus musculus
ctaaaagcaagaagaagcgcctgga

SEQ ID NO: 23575 - DNA, 25 bp, Mus musculus
ctaaaatagggcacagtggctggaa

SEQ ID NO: 23576 - DNA, 25 bp, Mus musculus
ctaaagaaacatgtggtggcgtgga

SEQ ID NO: 23577 - DNA, 25 bp, Mus musculus
ctaaagaagatgcagagcagtctga

SEQ ID NO: 23578 - DNA, 25 bp, Mus musculus
ctaaagagcaacagaggcagagact

SEQ ID NO: 23579 - DNA, 25 bp, Mus musculus
ctaaagcaagcttcaagaagtaagc

SEQ ID NO: 23580 - DNA, 25 bp, Mus musculus
ctaaaggagaaagagtattctgtgc

SEQ ID NO: 23581 - DNA, 25 bp, Mus musculus
ctaaaggaggatcaacctccaggct

SEQ ID NO: 23582 - DNA, 25 bp, Mus musculus
ctaaaggcgattttgtgacttcgtt

SEQ ID NO: 23583 - DNA, 25 bp, Mus musculus
ctaaaggtgccaggaacaaccccag

SEQ ID NO: 23584 - DNA, 25 bp, Mus musculus
ctaaataacatcaagagggttgcca

SEQ ID NO: 23585 - DNA, 25 bp, Mus musculus
ctaaatactatcactgcagctggac

SEQ ID NO: 23586 - DNA, 25 bp, Mus musculus
ctaaatagcgatgtctctggaagtt

SEQ ID NO: 23587 - DNA, 25 bp, Mus musculus
ctaaatgcaaatgtgaacagcttcc

SEQ ID NO: 23588 - DNA, 25 bp, Mus musculus
ctaaatggacttgctgtcaaacttc

SEQ ID NO: 23589 - DNA, 25 bp, Mus musculus
ctaaatgggaaaccgtatgagcctg

SEQ ID NO: 23590 - DNA, 25 bp, Mus musculus
ctaaatggtatctacacacctcaca

SEQ ID NO: 23591 - DNA, 25 bp, Mus musculus
ctaaattgacaaagggccagccaca

SEQ ID NO: 23592 - DNA, 25 bp, Mus musculus
ctaaattgacaatgggccagccaca

SEQ ID NO: 23593 - DNA, 25 bp, Mus musculus
ctaacaaaggtaacttagcagtcac

SEQ ID NO: 23594 - DNA, 25 bp, Mus musculus
ctaacagacgaggaatcagctttga

SEQ ID NO: 23595 - DNA, 25 bp, Mus musculus
ctaacaggattttacggatagggag

SEQ ID NO: 23596 - DNA, 25 bp, Mus musculus
ctaacatggaagatccagagaagga

SEQ ID NO: 23597 - DNA, 25 bp, Mus musculus
ctaacccagggaagtcctacggcat

SEQ ID NO: 23598 - DNA, 25 bp, Mus musculus
ctaacctgcaagagagactgccctc

SEQ ID NO: 23599 - DNA, 25 bp, Mus musculus
ctaacgtcaactttgttgttggcaa

SEQ ID NO: 23600 - DNA, 25 bp, Mus musculus
ctaactaaaaggtggctcatgagaa

SEQ ID NO: 23601 - DNA, 25 bp, Mus musculus
ctaactaccgcaacggacacacagg

SEQ ID NO: 23602 - DNA, 25 bp, Mus musculus
ctaactgacaaactcatgatggatg

SEQ ID NO: 23603 - DNA, 25 bp, Mus musculus
ctaactgtatggaagtgatgacggg

SEQ ID NO: 23604 - DNA, 25 bp, Mus musculus
ctaactgtcttgctttgagtggaca

SEQ ID NO: 23605 - DNA, 25 bp, Mus musculus
ctaagaaagtgctgagatagagtat

SEQ ID NO: 23606 - DNA, 25 bp, Mus musculus
ctaagagaattggtgaagcataaac

SEQ ID NO: 23607 - DNA, 25 bp, Mus musculus
ctaagagatgttgagggagagaggc

SEQ ID NO: 23608 - DNA, 25 bp, Mus musculus
ctaagaggcaagagaaaccagttgg

SEQ ID NO: 23609 - DNA, 25 bp, Mus musculus
ctaagatacccttggatagaagaac

SEQ ID NO: 23610 - DNA, 25 bp, Mus musculus
ctaagcagatgatgagtagcttcat

SEQ ID NO: 23611 - DNA, 25 bp, Mus musculus
ctaagcagcctgaagaagtttttga

SEQ ID NO: 23612 - DNA, 25 bp, Mus musculus
ctaagcagtgacgaggacctggaaa

SEQ ID NO: 23613 - DNA, 25 bp, Mus musculus
ctaagcatcgtctttcagctacttc

SEQ ID NO: 23614 - DNA, 25 bp, Mus musculus
ctaagcattgaggatttcacagcat

SEQ ID NO: 23615 - DNA, 25 bp, Mus musculus
ctaagccgggcaagttgcctttggt

SEQ ID NO: 23616 - DNA, 25 bp, Mus musculus
ctaaggactacaacagtctcaaagc

SEQ ID NO: 23617 - DNA, 25 bp, Mus musculus
ctaaggagtatgatgaagacagccc

SEQ ID NO: 23618 - DNA, 25 bp, Mus musculus
ctaaggctttgtgttgagttaatgt

SEQ ID NO: 23619 - DNA, 25 bp, Mus musculus
ctaaggtgaagtgtgtcagtctgtc

SEQ ID NO: 23620 - DNA, 25 bp, Mus musculus
ctaagtgcttagttcaaaccattca

SEQ ID NO: 23621 - DNA, 25 bp, Mus musculus
ctaagtgggaagctgtcagaacaag

SEQ ID NO: 23622 - DNA, 25 bp, Mus musculus
ctaagtgggaaggtgtcagaacaag

SEQ ID NO: 23623 - DNA, 25 bp, Mus musculus
ctaagttactgtcttgcaaggtgac

SEQ ID NO: 23624 - DNA, 25 bp, Mus musculus
ctaatatcaacagcaatggcagcat

SEQ ID NO: 23625 - DNA, 25 bp, Mus musculus
ctaatatcctggacagcatccgcaa

SEQ ID NO: 23626 - DNA, 25 bp, Mus musculus
ctaatatgtgaacttatggacatga

SEQ ID NO: 23627 - DNA, 25 bp, Mus musculus
ctaatcaacaaggtcaagtcacaag

SEQ ID NO: 23628 - DNA, 25 bp, Mus musculus
ctaatccgccagagcaccaaggact

SEQ ID NO: 23629 - DNA, 25 bp, Mus musculus
ctaatcctcatcatgacaacgtcag

SEQ ID NO: 23630 - DNA, 25 bp, Mus musculus
ctaatgaacagaggtatagcaagtt

SEQ ID NO: 23631 - DNA, 25 bp, Mus musculus
ctaatgagcaaggagggcttccggc

SEQ ID NO: 23632 - DNA, 25 bp, Mus musculus
ctaatgaggactgtgccaaagccca

SEQ ID NO: 23633 - DNA, 25 bp, Mus musculus
ctaatgatgaggatgatggacctca

SEQ ID NO: 23634 - DNA, 25 bp, Mus musculus
ctaatgatgaggttgatggacctca

SEQ ID NO: 23635 - DNA, 25 bp, Mus musculus
ctaatgcactccgagtcttgatggg

SEQ ID NO: 23636 - DNA, 25 bp, Mus musculus
ctaatgcttggtggcactgactcca

SEQ ID NO: 23637 - DNA, 25 bp, Mus musculus
ctaatgtatgggatggtgatagaga

SEQ ID NO: 23638 - DNA, 25 bp, Mus musculus
ctaatgtgcatgttccagctgcagt

SEQ ID NO: 23639 - DNA, 25 bp, Mus musculus
ctacaaatatgtcttcaccccacag

SEQ ID NO: 23640 - DNA, 25 bp, Mus musculus
ctacaacatggctcacaatgcagag

SEQ ID NO: 23641 - DNA, 25 bp, Mus musculus
ctacaactgctcagcatgtcatggg

SEQ ID NO: 23642 - DNA, 25 bp, Mus musculus
ctacaagacccaagagactcacaag

SEQ ID NO: 23643 - DNA, 25 bp, Mus musculus
ctacaagctacggttcacagtggat

SEQ ID NO: 23644 - DNA, 25 bp, Mus musculus
ctacaagctgcacggagtgaacatc

SEQ ID NO: 23645 - DNA, 25 bp, Mus musculus
ctacaatgccaaagtcaagacagat

SEQ ID NO: 23646 - DNA, 25 bp, Mus musculus
ctacaatgggtagcttctgtggaag

SEQ ID NO: 23647 - DNA, 25 bp, Mus musculus
ctacaatgtcaccagggagcgctgc

SEQ ID NO: 23648 - DNA, 25 bp, Mus musculus
ctacaccaatcctagcggcattgtc

SEQ ID NO: 23649 - DNA, 25 bp, Mus musculus
ctacacttgtctcgcctgtgaggag

SEQ ID NO: 23650 - DNA, 25 bp, Mus musculus
ctacacttgtctggcctgtgaggag

SEQ ID NO: 23651 - DNA, 25 bp, Mus musculus
ctacagaacagtggccggactgact

SEQ ID NO: 23652 - DNA, 25 bp, Mus musculus
ctacagactacacttggaaacacaa

SEQ ID NO: 23653 - DNA, 25 bp, Mus musculus
ctacagagcggtggattgggcatcc

SEQ ID NO: 23654 - DNA, 25 bp, Mus musculus
ctacagaggaatggaggctaggcat

SEQ ID NO: 23655 - DNA, 25 bp, Mus musculus
ctacagcggaggctacggtgctcct

SEQ ID NO: 23656 - DNA, 25 bp, Mus musculus
ctacagctgcgctaccaggagatcg

SEQ ID NO: 23657 - DNA, 25 bp, Mus musculus
ctacaggagtccagaacccacacat

SEQ ID NO: 23658 - DNA, 25 bp, Mus musculus
ctacagtacatgaccctgagacggg

SEQ ID NO: 23659 - DNA, 25 bp, Mus musculus
ctacatctggtccttctggcttctg

SEQ ID NO: 23660 - DNA, 25 bp, Mus musculus
ctacatgagctctgggcctgtggtg

SEQ ID NO: 23661 - DNA, 25 bp, Mus musculus
ctacatggcggtgcagacaagcgag

SEQ ID NO: 23662 - DNA, 25 bp, Mus musculus
ctacatgtgtgctttcagagcagta

SEQ ID NO: 23663 - DNA, 25 bp, Mus musculus
ctacattgcatatgcccatagtacc

SEQ ID NO: 23664 - DNA, 25 bp, Mus musculus
ctacattgctggctttgtagaattg

SEQ ID NO: 23665 - DNA, 25 bp, Mus musculus
ctaccaaaatctgcactgggaaagg

SEQ ID NO: 23666 - DNA, 25 bp, Mus musculus
ctaccacatcggcagcagctctagg

SEQ ID NO: 23667 - DNA, 25 bp, Mus musculus
ctaccacctaccaggctttgctagg

SEQ ID NO: 23668 - DNA, 25 bp, Mus musculus
ctaccatggcttggatagaaaaggc

SEQ ID NO: 23669 - DNA, 25 bp, Mus musculus
ctaccattttatttactgacaactg

SEQ ID NO: 23670 - DNA, 25 bp, Mus musculus
ctacccacaggtggcagagattagc

SEQ ID NO: 23671 - DNA, 25 bp, Mus musculus
ctacccacgctgaacgaaagggaca

SEQ ID NO: 23672 - DNA, 25 bp, Mus musculus
ctaccccgagggtgtccaagagctt

SEQ ID NO: 23673 - DNA, 25 bp, Mus musculus
ctacccttcagcagacgccggagag

SEQ ID NO: 23674 - DNA, 25 bp, Mus musculus
ctaccgacacccttggttctgcaga

SEQ ID NO: 23675 - DNA, 25 bp, Mus musculus
ctaccgctgggctctgcaggccgga

SEQ ID NO: 23676 - DNA, 25 bp, Mus musculus
ctaccggaagcactttctgggcaag

SEQ ID NO: 23677 - DNA, 25 bp, Mus musculus
ctaccgggatgcacaggagtttgct

SEQ ID NO: 23678 - DNA, 25 bp, Mus musculus
ctaccgtgaacaggaggaacttaag

SEQ ID NO: 23679 - DNA, 25 bp, Mus musculus
ctacctaaaccagtcctatggcatg

SEQ ID NO: 23680 - DNA, 25 bp, Mus musculus
ctacctaggtcgctctggccaacat

SEQ ID NO: 23681 - DNA, 25 bp, Mus musculus
ctacctaggtcggtctggccaacat

SEQ ID NO: 23682 - DNA, 25 bp, Mus musculus
ctacctcaagacaaagggctacaca

SEQ ID NO: 23683 - DNA, 25 bp, Mus musculus
ctacctgcctattgtcaagatgttt

SEQ ID NO: 23684 - DNA, 25 bp, Mus musculus
ctacctgcgggtgaacgtggctgac

SEQ ID NO: 23685 - DNA, 25 bp, Mus musculus
ctacctggctcatcctgtgaatgcc

SEQ ID NO: 23686 - DNA, 25 bp, Mus musculus
ctacctggtgatgccattcatgggc

SEQ ID NO: 23687 - DNA, 25 bp, Mus musculus
ctacctgtttatcttcaactgggca

SEQ ID NO: 23688 - DNA, 25 bp, Mus musculus
ctacgaagagaaggatgaggacgac

SEQ ID NO: 23689 - DNA, 25 bp, Mus musculus
ctacgagaggttcaccacctgctac

SEQ ID NO: 23690 - DNA, 25 bp, Mus musculus
ctacgagcgtgctgctgagtaccac

SEQ ID NO: 23691 - DNA, 25 bp, Mus musculus
ctacgatgcctaccggaaagcctgt

SEQ ID NO: 23692 - DNA, 25 bp, Mus musculus
ctacgattacacctatggctatggg

SEQ ID NO: 23693 - DNA, 25 bp, Mus musculus
ctacgctgtctaccctcaggcaacc

SEQ ID NO: 23694 - DNA, 25 bp, Mus musculus
ctacggaactctcctacagagaatg

SEQ ID NO: 23695 - DNA, 25 bp, Mus musculus
ctacggcctggactccatggacgaa

SEQ ID NO: 23696 - DNA, 25 bp, Mus musculus
ctacggtgctcctgatggcttggga

SEQ ID NO: 23697 - DNA, 25 bp, Mus musculus
ctacgtaggccaggctggcatcaga

SEQ ID NO: 23698 - DNA, 25 bp, Mus musculus
ctacgtatctcatgcttcaggtggg

SEQ ID NO: 23699 - DNA, 25 bp, Mus musculus
ctacgtggaaatgaaatgggagttc

SEQ ID NO: 23700 - DNA, 25 bp, Mus musculus
ctactaagaagagagaacgagccac

SEQ ID NO: 23701 - DNA, 25 bp, Mus musculus
ctactacaaaactgagggcgaggaa

SEQ ID NO: 23702 - DNA, 25 bp, Mus musculus
ctactacaacctggatggagaatac

SEQ ID NO: 23703 - DNA, 25 bp, Mus musculus
ctactacatcgagggcatcaaccag

SEQ ID NO: 23704 - DNA, 25 bp, Mus musculus
ctactacgaagagaaggatgaggac

SEQ ID NO: 23705 - DNA, 25 bp, Mus musculus
ctactatggagttcttgagcgtgac

SEQ ID NO: 23706 - DNA, 25 bp, Mus musculus
ctactcagtgctcggcagcctggtg

SEQ ID NO: 23707 - DNA, 25 bp, Mus musculus
ctactcatcccacagagaagagtgg

SEQ ID NO: 23708 - DNA, 25 bp, Mus musculus
ctactccttaaacttttgcctgatg

SEQ ID NO: 23709 - DNA, 25 bp, Mus musculus
ctactcgtgtaagatggcgggagat

SEQ ID NO: 23710 - DNA, 25 bp, Mus musculus
ctactgacagcaccctgcggcagaa

SEQ ID NO: 23711 - DNA, 25 bp, Mus musculus
ctactgcaggaacccggatggtgac

SEQ ID NO: 23712 - DNA, 25 bp, Mus musculus
ctactggaaccagggctacggctac

SEQ ID NO: 23713 - DNA, 25 bp, Mus musculus
ctactggcttagatgcagaagagaa

SEQ ID NO: 23714 - DNA, 25 bp, Mus musculus
ctactgggcttgttgaaggaaactc

SEQ ID NO: 23715 - DNA, 25 bp, Mus musculus
ctactggtgtcagaacatggagact

SEQ ID NO: 23716 - DNA, 25 bp, Mus musculus
ctactggttctggaagggccaaaat

SEQ ID NO: 23717 - DNA, 25 bp, Mus musculus
ctactggtttgacatattcaatgac

SEQ ID NO: 23718 - DNA, 25 bp, Mus musculus
ctactgtcctctgcttctcagatga

SEQ ID NO: 23719 - DNA, 25 bp, Mus musculus
ctactgtgtctggtcctcacctggg

SEQ ID NO: 23720 - DNA, 25 bp, Mus musculus
ctacttccctatcctcggcaacaag

SEQ ID NO: 23721 - DNA, 25 bp, Mus musculus
ctacttggacaacagcacaccagcg

SEQ ID NO: 23722 - DNA, 25 bp, Mus musculus
ctacttggtccgtggccttacactc

SEQ ID NO: 23723 - DNA, 25 bp, Mus musculus
ctactttgacgtctatgcccagcac

SEQ ID NO: 23724 - DNA, 25 bp, Mus musculus
ctactttgacgtgtatgcccagcac

SEQ ID NO: 23725 - DNA, 25 bp, Mus musculus
ctagaagacctttgcccagggccag

SEQ ID NO: 23726 - DNA, 25 bp, Mus musculus
ctagaagagattgttgacaactatc

SEQ ID NO: 23727 - DNA, 25 bp, Mus musculus
ctagaagaggaacagaagttgatat

SEQ ID NO: 23728 - DNA, 25 bp, Mus musculus
ctagaagaggctgacaagggagacc

SEQ ID NO: 23729 - DNA, 25 bp, Mus musculus
ctagaagggctaaagagatgactca

SEQ ID NO: 23730 - DNA, 25 bp, Mus musculus
ctagaagtggctgcatcacaaggag

SEQ ID NO: 23731 - DNA, 25 bp, Mus musculus
ctagaagtgtgggttgatgatctgc

SEQ ID NO: 23732 - DNA, 25 bp, Mus musculus
ctagaatggctgatcatgaaggtgc

SEQ ID NO: 23733 - DNA, 25 bp, Mus musculus
ctagactcatcagtggagaggaaga

SEQ ID NO: 23734 - DNA, 25 bp, Mus musculus
ctagagaagcaaaaagaggtggaat

SEQ ID NO: 23735 - DNA, 25 bp, Mus musculus
ctagagaagcagcacgggagcaaca

SEQ ID NO: 23736 - DNA, 25 bp, Mus musculus
ctagagagagagttcagcatggccc

SEQ ID NO: 23737 - DNA, 25 bp, Mus musculus
ctagagagtgtaaatcattgtcacc

SEQ ID NO: 23738 - DNA, 25 bp, Mus musculus
ctagagatggttggtcatcctggga

SEQ ID NO: 23739 - DNA, 25 bp, Mus musculus
ctagagccatccagggcctcggtgt

SEQ ID NO: 23740 - DNA, 25 bp, Mus musculus
ctagagctcggatttctataagtgt

SEQ ID NO: 23741 - DNA, 25 bp, Mus musculus
ctagaggaagaacacaatggctacc

SEQ ID NO: 23742 - DNA, 25 bp, Mus musculus
ctagaggccgattcctgactgccac

SEQ ID NO: 23743 - DNA, 25 bp, Mus musculus
ctagagttcacgttggaggtgcgaa

SEQ ID NO: 23744 - DNA, 25 bp, Mus musculus
ctagatccttgaatggagagaaaag

SEQ ID NO: 23745 - DNA, 25 bp, Mus musculus
ctagatccttgattggagagaaaag

SEQ ID NO: 23746 - DNA, 25 bp, Mus musculus
ctagatgagggcatgcagatcccat

SEQ ID NO: 23747 - DNA, 25 bp, Mus musculus
ctagatgcctggagccagagttaca

SEQ ID NO: 23748 - DNA, 25 bp, Mus musculus
ctagattctgaagctggtggaaggt

SEQ ID NO: 23749 - DNA, 25 bp, Mus musculus
ctagattggactggtaggatggctc

SEQ ID NO: 23750 - DNA, 25 bp, Mus musculus
ctagcaacggtgctgtgttactgag

SEQ ID NO: 23751 - DNA, 25 bp, Mus musculus
ctagcacggtatgggcctgcctggc

SEQ ID NO: 23752 - DNA, 25 bp, Mus musculus
ctagcactactacggagagccacca

SEQ ID NO: 23753 - DNA, 25 bp, Mus musculus
ctagcactactagggagagccacca

SEQ ID NO: 23754 - DNA, 25 bp, Mus musculus
ctagcaggcgggaccaccatgatat

SEQ ID NO: 23755 - DNA, 25 bp, Mus musculus
ctagcattgaaaccctgaagaagaa

SEQ ID NO: 23756 - DNA, 25 bp, Mus musculus
ctagccaaggaaaatataactcagg

SEQ ID NO: 23757 - DNA, 25 bp, Mus musculus
ctagccacaggagataaaggtggga

SEQ ID NO: 23758 - DNA, 25 bp, Mus musculus
ctagccagagaacgccgagaggaac

SEQ ID NO: 23759 - DNA, 25 bp, Mus musculus
ctagccgcagacaggagctctccag

SEQ ID NO: 23760 - DNA, 25 bp, Mus musculus
ctagcctccgtctgcacaaggtgca

SEQ ID NO: 23761 - DNA, 25 bp, Mus musculus
ctagccttcctcaaccagtcggtta

SEQ ID NO: 23762 - DNA, 25 bp, Mus musculus
ctagccttcgttggtattaccttct

SEQ ID NO: 23763 - DNA, 25 bp, Mus musculus
ctagcgaagcaggtggcaagaagaa

SEQ ID NO: 23764 - DNA, 25 bp, Mus musculus
ctagcggctatggttaatgttcggg

SEQ ID NO: 23765 - DNA, 25 bp, Mus musculus
ctagctcagattcatacaaggtcgg

SEQ ID NO: 23766 - DNA, 25 bp, Mus musculus
ctagctcagattgatacaaggtcgg

SEQ ID NO: 23767 - DNA, 25 bp, Mus musculus
ctagctgtggccactggaagactct

SEQ ID NO: 23768 - DNA, 25 bp, Mus musculus
ctaggaaaattctgcgggctttgtg

SEQ ID NO: 23769 - DNA, 25 bp, Mus musculus
ctaggaatctaaagatgaaaagagc

SEQ ID NO: 23770 - DNA, 25 bp, Mus musculus
ctaggacagagcacgggcaactgct

SEQ ID NO: 23771 - DNA, 25 bp, Mus musculus
ctaggactccacccggtctggtcag

SEQ ID NO: 23772 - DNA, 25 bp, Mus musculus
ctaggactccacgcggtctggtcag

SEQ ID NO: 23773 - DNA, 25 bp, Mus musculus
ctaggagtctgtgttacaaaacaac

SEQ ID NO: 23774 - DNA, 25 bp, Mus musculus
ctaggagttccagagcctgtgggtt

SEQ ID NO: 23775 - DNA, 25 bp, Mus musculus
ctaggagttgctgcatataaactgg

SEQ ID NO: 23776 - DNA, 25 bp, Mus musculus
ctaggatggaagatgactgctgtca

SEQ ID NO: 23777 - DNA, 25 bp, Mus musculus
ctaggcaaactatggacagcaagat

SEQ ID NO: 23778 - DNA, 25 bp, Mus musculus
ctaggccgtctgacactggatcagg

SEQ ID NO: 23779 - DNA, 25 bp, Mus musculus
ctaggcctgatctcagatggatttc

SEQ ID NO: 23780 - DNA, 25 bp, Mus musculus
ctaggcgcctgtgaacagccagcgt

SEQ ID NO: 23781 - DNA, 25 bp, Mus musculus
ctagggaagaagatagagaccatca

SEQ ID NO: 23782 - DNA, 25 bp, Mus musculus
ctagggctgcagataaggctgttgc

SEQ ID NO: 23783 - DNA, 25 bp, Mus musculus
ctagggtatggaccaattccactaa

SEQ ID NO: 23784 - DNA, 25 bp, Mus musculus
ctagggtatggagcaattccactaa

SEQ ID NO: 23785 - DNA, 25 bp, Mus musculus
ctaggtcagcttctactagaatggc

SEQ ID NO: 23786 - DNA, 25 bp, Mus musculus
ctagtaaatggagccaggattccag

SEQ ID NO: 23787 - DNA, 25 bp, Mus musculus
ctagtagtgaaggaacggaatcgca

SEQ ID NO: 23788 - DNA, 25 bp, Mus musculus
ctagtatctgtaggagcccgtggaa

SEQ ID NO: 23789 - DNA, 25 bp, Mus musculus
ctagtccctgtgacgggaggagccc

SEQ ID NO: 23790 - DNA, 25 bp, Mus musculus
ctagtctctaccacaagatccatct

SEQ ID NO: 23791 - DNA, 25 bp, Mus musculus
ctagtgattcaagttcatccacaga

SEQ ID NO: 23792 - DNA, 25 bp, Mus musculus
ctagtgctcctatatctccagctgc

SEQ ID NO: 23793 - DNA, 25 bp, Mus musculus
ctagtggaacaatgccccaacaggt

SEQ ID NO: 23794 - DNA, 25 bp, Mus musculus
ctagtgggcagggaccttcttccca

SEQ ID NO: 23795 - DNA, 25 bp, Mus musculus
ctagtggtactgtttcttcctctgg

SEQ ID NO: 23796 - DNA, 25 bp, Mus musculus
ctagtgttgagagttccccatccct

SEQ ID NO: 23797 - DNA, 25 bp, Mus musculus
ctagtgttgccttggaccttgtgga

SEQ ID NO: 23798 - DNA, 25 bp, Mus musculus
ctagttcgagaagcttaaaatccct

SEQ ID NO: 23799 - DNA, 25 bp, Mus musculus
ctagtttccaatggcacagatgtga

SEQ ID NO: 23800 - DNA, 25 bp, Mus musculus
ctataaaggaggattcgagcagaaa

SEQ ID NO: 23801 - DNA, 25 bp, Mus musculus
ctataatagcctcacccggaacaag

SEQ ID NO: 23802 - DNA, 25 bp, Mus musculus
ctataatgaggatgatgcaaaggca

SEQ ID NO: 23803 - DNA, 25 bp, Mus musculus
ctatacaaatggctgcaagttggga

SEQ ID NO: 23804 - DNA, 25 bp, Mus musculus
ctatacattgaacccggtgctttta

SEQ ID NO: 23805 - DNA, 25 bp, Mus musculus
ctataccacgcaagaagaaacctaa

SEQ ID NO: 23806 - DNA, 25 bp, Mus musculus
ctatactagaagatatcattctggg

SEQ ID NO: 23807 - DNA, 25 bp, Mus musculus
ctatagacatagatgctactggctt

SEQ ID NO: 23808 - DNA, 25 bp, Mus musculus
ctatagcgagctccaggacgcgtgt

SEQ ID NO: 23809 - DNA, 25 bp, Mus musculus
ctatagcgagctgcaggacgcgtgt

SEQ ID NO: 23810 - DNA, 25 bp, Mus musculus
ctataggccaggcttgtgtcaaact

SEQ ID NO: 23811 - DNA, 25 bp, Mus musculus
ctataggtatgcctggcttgacttc

SEQ ID NO: 23812 - DNA, 25 bp, Mus musculus
ctatagtttggccaaggagcagcga

SEQ ID NO: 23813 - DNA, 25 bp, Mus musculus
ctatatccaatgtttgggtgctggg

SEQ ID NO: 23814 - DNA, 25 bp, Mus musculus
ctatatcctggtttatgatggccct

SEQ ID NO: 23815 - DNA, 25 bp, Mus musculus
ctatcacgctcatcagtatgtggcc

SEQ ID NO: 23816 - DNA, 25 bp, Mus musculus
ctatcagacattctttgatgtggac

SEQ ID NO: 23817 - DNA, 25 bp, Mus musculus
ctatcagacctaccgagtgctgctg

SEQ ID NO: 23818 - DNA, 25 bp, Mus musculus
ctatcagctgagatccagccatcag

SEQ ID NO: 23819 - DNA, 25 bp, Mus musculus
ctatcagctgagttccagccatcag

SEQ ID NO: 23820 - DNA, 25 bp, Mus musculus
ctatcaggacgtggcactggctgat

SEQ ID NO: 23821 - DNA, 25 bp, Mus musculus
ctatcattgccgtgactcgaaatcc

SEQ ID NO: 23822 - DNA, 25 bp, Mus musculus
ctatccccacgaccaggagcgttgt

SEQ ID NO: 23823 - DNA, 25 bp, Mus musculus
ctatcctgaaacatctgttggcctg

SEQ ID NO: 23824 - DNA, 25 bp, Mus musculus
ctatccttatttaggccccagcaca

SEQ ID NO: 23825 - DNA, 25 bp, Mus musculus
ctatcgctgggatcctcttcatctt

SEQ ID NO: 23826 - DNA, 25 bp, Mus musculus
ctatcggatttcactttacaaaagg

SEQ ID NO: 23827 - DNA, 25 bp, Mus musculus
ctatcgtgacaaagctgctgatacg

SEQ ID NO: 23828 - DNA, 25 bp, Mus musculus
ctatcgttgttcacatggccagttt

SEQ ID NO: 23829 - DNA, 25 bp, Mus musculus
ctatctagtggaagtactaagtgac

SEQ ID NO: 23830 - DNA, 25 bp, Mus musculus
ctatctcagcaaagagcctcacttg

SEQ ID NO: 23831 - DNA, 25 bp, Mus musculus
ctatctcctcagagccctttggtca

SEQ ID NO: 23832 - DNA, 25 bp, Mus musculus
ctatctcctgagattgagctcacat

SEQ ID NO: 23833 - DNA, 25 bp, Mus musculus
ctatctgaatggtgaatatcgagcc

SEQ ID NO: 23834 - DNA, 25 bp, Mus musculus
ctatctggataagcgtagcaagccc

SEQ ID NO: 23835 - DNA, 25 bp, Mus musculus
ctatctgggatcacagaagccaaga

SEQ ID NO: 23836 - DNA, 25 bp, Mus musculus
ctatcttctatgaggtgactgtgga

SEQ ID NO: 23837 - DNA, 25 bp, Mus musculus
ctatcttctggcctgggagtgacca

SEQ ID NO: 23838 - DNA, 25 bp, Mus musculus
ctatcttgtggatgatcccctgtta

SEQ ID NO: 23839 - DNA, 25 bp, Mus musculus
ctatgaatgctggtgccaagttgga

SEQ ID NO: 23840 - DNA, 25 bp, Mus musculus
ctatgacaacagcagaccaaccggt

SEQ ID NO: 23841 - DNA, 25 bp, Mus musculus
ctatgacacgtaagagaggccccgg

SEQ ID NO: 23842 - DNA, 25 bp, Mus musculus
ctatgacacgtatgagaggccccgg

SEQ ID NO: 23843 - DNA, 25 bp, Mus musculus
ctatgacagctataacaacggagga

SEQ ID NO: 23844 - DNA, 25 bp, Mus musculus
ctatgacgtggagaatgaccggcag

SEQ ID NO: 23845 - DNA, 25 bp, Mus musculus
ctatgactacgtggaggagcccaag

SEQ ID NO: 23846 - DNA, 25 bp, Mus musculus
ctatgactccctgccggagtctaag

SEQ ID NO: 23847 - DNA, 25 bp, Mus musculus
ctatgacttcgtgtatgatcaggca

SEQ ID NO: 23848 - DNA, 25 bp, Mus musculus
ctatgagatagtgcccatcaacctc

SEQ ID NO: 23849 - DNA, 25 bp, Mus musculus
ctatgaggcctgtctcaaggaggag

SEQ ID NO: 23850 - DNA, 25 bp, Mus musculus
ctatgatgagtttggtttccgtgtg

SEQ ID NO: 23851 - DNA, 25 bp, Mus musculus
ctatgatgcctacggaccaagtgat

SEQ ID NO: 23852 - DNA, 25 bp, Mus musculus
ctatgattactaccaagactacttc

SEQ ID NO: 23853 - DNA, 25 bp, Mus musculus
ctatgattgtttcaggccaaattgg

SEQ ID NO: 23854 - DNA, 25 bp, Mus musculus
ctatgcacggatgagttttctaaac

SEQ ID NO: 23855 - DNA, 25 bp, Mus musculus
ctatgcatatggagaatgaaaatac

SEQ ID NO: 23856 - DNA, 25 bp, Mus musculus
ctatgccagacacagggctgcgagt

SEQ ID NO: 23857 - DNA, 25 bp, Mus musculus
ctatgctaacccatgaaaatgttgt

SEQ ID NO: 23858 - DNA, 25 bp, Mus musculus
ctatgctgttcatccagccccgggt

SEQ ID NO: 23859 - DNA, 25 bp, Mus musculus
ctatggaacctgatgggcaacgcca

SEQ ID NO: 23860 - DNA, 25 bp, Mus musculus
ctatggagtgccaattgagacttcc

SEQ ID NO: 23861 - DNA, 25 bp, Mus musculus
ctatggagttagtgagggcctccgt

SEQ ID NO: 23862 - DNA, 25 bp, Mus musculus
ctatggatatgagaccgtgcttgga

SEQ ID NO: 23863 - DNA, 25 bp, Mus musculus
ctatggctattacggctacggcccc

SEQ ID NO: 23864 - DNA, 25 bp, Mus musculus
ctatggctccaacatcagcgcctgg

SEQ ID NO: 23865 - DNA, 25 bp, Mus musculus
ctatgggaacatccgagccgtcacg

SEQ ID NO: 23866 - DNA, 25 bp, Mus musculus
ctatgggtttcctgctcatgtatga

SEQ ID NO: 23867 - DNA, 25 bp, Mus musculus
ctatggtgacagactatggagcttt

SEQ ID NO: 23868 - DNA, 25 bp, Mus musculus
ctatggttgcaacttagtattccag

SEQ ID NO: 23869 - DNA, 25 bp, Mus musculus
ctatggttttacatgctgcgggccg

SEQ ID NO: 23870 - DNA, 25 bp, Mus musculus
ctatgtaccccgatttggcttgact

SEQ ID NO: 23871 - DNA, 25 bp, Mus musculus
ctatgtcaccttcgcctgcatcagg

SEQ ID NO: 23872 - DNA, 25 bp, Mus musculus
ctatgtgaaaacgtctgagaaactt

SEQ ID NO: 23873 - DNA, 25 bp, Mus musculus
ctatgtggagctgttcattgttgta

SEQ ID NO: 23874 - DNA, 25 bp, Mus musculus
ctatgtggagggagtgcagaattcc

SEQ ID NO: 23875 - DNA, 25 bp, Mus musculus
ctatgtgtatcacaatgagaatgag

SEQ ID NO: 23876 - DNA, 25 bp, Mus musculus
ctattaagataatggaagtccctgt

SEQ ID NO: 23877 - DNA, 25 bp, Mus musculus
ctattactggagattcccaagatca

SEQ ID NO: 23878 - DNA, 25 bp, Mus musculus
ctattccagaggatgctgttcatga

SEQ ID NO: 23879 - DNA, 25 bp, Mus musculus
ctattcccagtgtggccgtggctga

SEQ ID NO: 23880 - DNA, 25 bp, Mus musculus
ctattccctggaagcaagaattaag

SEQ ID NO: 23881 - DNA, 25 bp, Mus musculus
ctattctggagattatgcataagga

SEQ ID NO: 23882 - DNA, 25 bp, Mus musculus
ctattctggatagcaggttttgtga

SEQ ID NO: 23883 - DNA, 25 bp, Mus musculus
ctattgaaagagactcactcttggc

SEQ ID NO: 23884 - DNA, 25 bp, Mus musculus
ctattgaagaccgaattcaggagga

SEQ ID NO: 23885 - DNA, 25 bp, Mus musculus
ctattgagctgtaccatgcaggagc

SEQ ID NO: 23886 - DNA, 25 bp, Mus musculus
ctattggtattgatgatggaaaaac

SEQ ID NO: 23887 - DNA, 25 bp, Mus musculus
ctattggtgtaggtataccgacaat

SEQ ID NO: 23888 - DNA, 25 bp, Mus musculus
ctatttgagaagaagcagcgcagga

SEQ ID NO: 23889 - DNA, 25 bp, Mus musculus
ctatttgcatcagtatgcatgcaca

SEQ ID NO: 23890 - DNA, 25 bp, Mus musculus
ctatttgctggtcccacagcaatgc

SEQ ID NO: 23891 - DNA, 25 bp, Mus musculus
ctatttggaccaaatcagcgcccag

SEQ ID NO: 23892 - DNA, 25 bp, Mus musculus
ctatttggaccaagtaccactaaat

SEQ ID NO: 23893 - DNA, 25 bp, Mus musculus
ctatttgtgcccctgttggtgggta

SEQ ID NO: 23894 - DNA, 25 bp, Mus musculus
ctattttgctgacccatacttacgg

SEQ ID NO: 23895 - DNA, 25 bp, Mus musculus
ctattttggtttacagttggctgac

SEQ ID NO: 23896 - DNA, 25 bp, Mus musculus
ctcaaaagctcaggagatagaattg

SEQ ID NO: 23897 - DNA, 25 bp, Mus musculus
ctcaaaaggcccaagtcgcaggtct

SEQ ID NO: 23898 - DNA, 25 bp, Mus musculus
ctcaaacagtgatgaggctgtaatc

SEQ ID NO: 23899 - DNA, 25 bp, Mus musculus
ctcaaagaaggacccagaggatatc

SEQ ID NO: 23900 - DNA, 25 bp, Mus musculus
ctcaaagagcccatgactgtgagct

SEQ ID NO: 23901 - DNA, 25 bp, Mus musculus
ctcaaagagttatgtggacaggcac

SEQ ID NO: 23902 - DNA, 25 bp, Mus musculus
ctcaaagattagaacgactccgcaa

SEQ ID NO: 23903 - DNA, 25 bp, Mus musculus
ctcaaagcactttgaagcctcctgt

SEQ ID NO: 23904 - DNA, 25 bp, Mus musculus
ctcaaagctgatttggacggcccgc

SEQ ID NO: 23905 - DNA, 25 bp, Mus musculus
ctcaaaggacaaactagctggctaa

SEQ ID NO: 23906 - DNA, 25 bp, Mus musculus
ctcaacgagtggctggccagcaaca

SEQ ID NO: 23907 - DNA, 25 bp, Mus musculus
ctcaacgtagaggtggacgctgctc

SEQ ID NO: 23908 - DNA, 25 bp, Mus musculus
ctcaagaaggtgaagatgacacctt

SEQ ID NO: 23909 - DNA, 25 bp, Mus musculus
ctcaagaccaactcagctgtccgga

SEQ ID NO: 23910 - DNA, 25 bp, Mus musculus
ctcaagactaccagtgaacctcttc

SEQ ID NO: 23911 - DNA, 25 bp, Mus musculus
ctcaagaggctggagaccagtgtga

SEQ ID NO: 23912 - DNA, 25 bp, Mus musculus
ctcaagagtgtgagagttcctaatg

SEQ ID NO: 23913 - DNA, 25 bp, Mus musculus
ctcaagatccgggacgtggaaaagg

SEQ ID NO: 23914 - DNA, 25 bp, Mus musculus
ctcaagatgagcaagctaaaagtgg

SEQ ID NO: 23915 - DNA, 25 bp, Mus musculus
ctcaagatgtctgccagggcggagc

SEQ ID NO: 23916 - DNA, 25 bp, Mus musculus
ctcaagcagacctggtgtctccagc

SEQ ID NO: 23917 - DNA, 25 bp, Mus musculus
ctcaaggaacctggtggaagaggaa

SEQ ID NO: 23918 - DNA, 25 bp, Mus musculus
ctcaaggattcaaccagggcctgga

SEQ ID NO: 23919 - DNA, 25 bp, Mus musculus
ctcaaggcaagaccctgtccctgaa

SEQ ID NO: 23920 - DNA, 25 bp, Mus musculus
ctcaaggccctcaggaccattgtct

SEQ ID NO: 23921 - DNA, 25 bp, Mus musculus
ctcaaggccctctggaccattgtct

SEQ ID NO: 23922 - DNA, 25 bp, Mus musculus
ctcaagtatggcacaaagggctggg

SEQ ID NO: 23923 - DNA, 25 bp, Mus musculus
ctcaagtgcaagaggtagtctgaat

SEQ ID NO: 23924 - DNA, 25 bp, Mus musculus
ctcaatcgaaataacaggccggtcg

SEQ ID NO: 23925 - DNA, 25 bp, Mus musculus
ctcaatctaggtgggaggtggcgaa

SEQ ID NO: 23926 - DNA, 25 bp, Mus musculus
ctcaatgaaagtgagcaagcacctg

SEQ ID NO: 23927 - DNA, 25 bp, Mus musculus
ctcaatgacttcaccacacagcgag

SEQ ID NO: 23928 - DNA, 25 bp, Mus musculus
ctcaatgatgctgagtttgctctgc

SEQ ID NO: 23929 - DNA, 25 bp, Mus musculus
ctcaatgattccacttacgatggat

SEQ ID NO: 23930 - DNA, 25 bp, Mus musculus
ctcaatggatgagaatgatggccct

SEQ ID NO: 23931 - DNA, 25 bp, Mus musculus
ctcacaatgcagagcacgaggcttg

SEQ ID NO: 23932 - DNA, 25 bp, Mus musculus
ctcacacgccggtgctgcctgaggg

SEQ ID NO: 23933 - DNA, 25 bp, Mus musculus
ctcacacgggactgacagagaggag

SEQ ID NO: 23934 - DNA, 25 bp, Mus musculus
ctcacagagatatgtttgcctcagc

SEQ ID NO: 23935 - DNA, 25 bp, Mus musculus
ctcacagagtacctgaatgaagaat

SEQ ID NO: 23936 - DNA, 25 bp, Mus musculus
ctcacagagtacgtgaatgaagaat

SEQ ID NO: 23937 - DNA, 25 bp, Mus musculus
ctcacagagttgctggccgggatca

SEQ ID NO: 23938 - DNA, 25 bp, Mus musculus
ctcacaggattcctctttacagcaa

SEQ ID NO: 23939 - DNA, 25 bp, Mus musculus
ctcacaggcctacgacaaatccaaa

SEQ ID NO: 23940 - DNA, 25 bp, Mus musculus
ctcaccatcaggctacttatgcatg

SEQ ID NO: 23941 - DNA, 25 bp, Mus musculus
ctcaccatcaggctgggagtgtgtt

SEQ ID NO: 23942 - DNA, 25 bp, Mus musculus
ctcaccatcagggtgggagtgtgtt

SEQ ID NO: 23943 - DNA, 25 bp, Mus musculus
ctcaccatcttgtcgctttgcttct

SEQ ID NO: 23944 - DNA, 25 bp, Mus musculus
ctcaccatgtccaaacagctgcagg

SEQ ID NO: 23945 - DNA, 25 bp, Mus musculus
ctcaccctctcggtggtgtttggaa

SEQ ID NO: 23946 - DNA, 25 bp, Mus musculus
ctcacctattgcactgttcctctgt

SEQ ID NO: 23947 - DNA, 25 bp, Mus musculus
ctcacctattgctctgttcctctgt

SEQ ID NO: 23948 - DNA, 25 bp, Mus musculus
ctcaccttcagtgacttcaatgcag

SEQ ID NO: 23949 - DNA, 25 bp, Mus musculus
ctcacgaagcgcaggaaagaggagc

SEQ ID NO: 23950 - DNA, 25 bp, Mus musculus
ctcacgctgattggctctcctaatt

SEQ ID NO: 23951 - DNA, 25 bp, Mus musculus
ctcacggctacagttcaacaaagtg

SEQ ID NO: 23952 - DNA, 25 bp, Mus musculus
ctcacgggacagtgagccgaggaac

SEQ ID NO: 23953 - DNA, 25 bp, Mus musculus
ctcacgtacatggaggatgcagtgt

SEQ ID NO: 23954 - DNA, 25 bp, Mus musculus
ctcacgtgaatgacgaccctctaag

SEQ ID NO: 23955 - DNA, 25 bp, Mus musculus
ctcactagtagccagtggagcgtca

SEQ ID NO: 23956 - DNA, 25 bp, Mus musculus
ctcactggagctcagctttgatttt

SEQ ID NO: 23957 - DNA, 25 bp, Mus musculus
ctcactgggaaacattgccagaaag

SEQ ID NO: 23958 - DNA, 25 bp, Mus musculus
ctcactgtggatgggaggctctgcc

SEQ ID NO: 23959 - DNA, 25 bp, Mus musculus
ctcactgtgtgtaagaaagtggtaa

SEQ ID NO: 23960 - DNA, 25 bp, Mus musculus
ctcactgtgtgttagaaagtggtaa

SEQ ID NO: 23961 - DNA, 25 bp, Mus musculus
ctcacttgattaccatcttgcttag

SEQ ID NO: 23962 - DNA, 25 bp, Mus musculus
ctcacttgtgcctggaatgggagca

SEQ ID NO: 23963 - DNA, 25 bp, Mus musculus
ctcagaaaggcgcaaaggaaattgc

SEQ ID NO: 23964 - DNA, 25 bp, Mus musculus
ctcagaaccacagaaaacggaggga

SEQ ID NO: 23965 - DNA, 25 bp, Mus musculus
ctcagaactttggaagagttgcgag

SEQ ID NO: 23966 - DNA, 25 bp, Mus musculus
ctcagaagagggacactactgggtg

SEQ ID NO: 23967 - DNA, 25 bp, Mus musculus
ctcagaatgagcaaggaaagaccca

SEQ ID NO: 23968 - DNA, 25 bp, Mus musculus
ctcagaatggtgaagtaactcatcc

SEQ ID NO: 23969 - DNA, 25 bp, Mus musculus
ctcagaatgtgggaggataccagag

SEQ ID NO: 23970 - DNA, 25 bp, Mus musculus
ctcagacctcagtggatccccaagt

SEQ ID NO: 23971 - DNA, 25 bp, Mus musculus
ctcagagaggtcacatggcttgctc

SEQ ID NO: 23972 - DNA, 25 bp, Mus musculus
ctcagagggtgcacagggctcagtc

SEQ ID NO: 23973 - DNA, 25 bp, Mus musculus
ctcagagtgatgcaaaaagttcaac

SEQ ID NO: 23974 - DNA, 25 bp, Mus musculus
ctcagagttacaggatgacctggaa

SEQ ID NO: 23975 - DNA, 25 bp, Mus musculus
ctcagataatagctgggtgctcgct

SEQ ID NO: 23976 - DNA, 25 bp, Mus musculus
ctcagatactaaagggaaagacttc

SEQ ID NO: 23977 - DNA, 25 bp, Mus musculus
ctcagatgcctgacagtgctttcaa

SEQ ID NO: 23978 - DNA, 25 bp, Mus musculus
ctcagcaaccgctctaaagccattg

SEQ ID NO: 23979 - DNA, 25 bp, Mus musculus
ctcagcaagaaaagagggctgtgga

SEQ ID NO: 23980 - DNA, 25 bp, Mus musculus
ctcagcaatctgttccggaggaatt

SEQ ID NO: 23981 - DNA, 25 bp, Mus musculus
ctcagcactggaggctcagaagtgg

SEQ ID NO: 23982 - DNA, 25 bp, Mus musculus
ctcagcagggccacacgcatatcat

SEQ ID NO: 23983 - DNA, 25 bp, Mus musculus
ctcagcatttagaccgggttgtctc

SEQ ID NO: 23984 - DNA, 25 bp, Mus musculus
ctcagccaggatccaaacagtctct

SEQ ID NO: 23985 - DNA, 25 bp, Mus musculus
ctcagccagtggcatgctcccagtt

SEQ ID NO: 23986 - DNA, 25 bp, Mus musculus
ctcagccggagttgtaccacccaat

SEQ ID NO: 23987 - DNA, 25 bp, Mus musculus
ctcagcctgtatctatattttcgac

SEQ ID NO: 23988 - DNA, 25 bp, Mus musculus
ctcagctccgaattacgtatagaaa

SEQ ID NO: 23989 - DNA, 25 bp, Mus musculus
ctcagctgtgatgatggcggccacc

SEQ ID NO: 23990 - DNA, 25 bp, Mus musculus
ctcagcttcaagaacaaatgagaca

SEQ ID NO: 23991 - DNA, 25 bp, Mus musculus
ctcagcttgtgagggatctgctgga

SEQ ID NO: 23992 - DNA, 25 bp, Mus musculus
ctcaggacaaggaggctgcagaggc

SEQ ID NO: 23993 - DNA, 25 bp, Mus musculus
ctcaggactttgatgtggctaatga

SEQ ID NO: 23994 - DNA, 25 bp, Mus musculus
ctcaggagacctctccatatgacat

SEQ ID NO: 23995 - DNA, 25 bp, Mus musculus
ctcaggagagcgtgggcctcgtaca

SEQ ID NO: 23996 - DNA, 25 bp, Mus musculus
ctcaggagatgatgcggcccgcata

SEQ ID NO: 23997 - DNA, 25 bp, Mus musculus
ctcaggaggccctgtcaactgacag

SEQ ID NO: 23998 - DNA, 25 bp, Mus musculus
ctcaggaggctgaaactgaattgct

SEQ ID NO: 23999 - DNA, 25 bp, Mus musculus
ctcaggagtcctgatctagctgtgg

SEQ ID NO: 24000 - DNA, 25 bp, Mus musculus
ctcaggatccgagggaagcacgtct

SEQ ID NO: 24001 - DNA, 25 bp, Mus musculus
ctcaggatggaacacctgcagcagc

SEQ ID NO: 24002 - DNA, 25 bp, Mus musculus
ctcaggctctgtgttggtaatgaca

SEQ ID NO: 24003 - DNA, 25 bp, Mus musculus
ctcaggctgccttcaggaacgaaaa

SEQ ID NO: 24004 - DNA, 25 bp, Mus musculus
ctcagggaataaatgggaggacacc

SEQ ID NO: 24005 - DNA, 25 bp, Mus musculus
ctcagggacctctagccggctggag

SEQ ID NO: 24006 - DNA, 25 bp, Mus musculus
ctcagggagcttacctggaggacca

SEQ ID NO: 24007 - DNA, 25 bp, Mus musculus
ctcagggccaccaagaccagagcat

SEQ ID NO: 24008 - DNA, 25 bp, Mus musculus
ctcagggcccagtgagtacatggag

SEQ ID NO: 24009 - DNA, 25 bp, Mus musculus
ctcagtaacatcaaagaagctgaca

SEQ ID NO: 24010 - DNA, 25 bp, Mus musculus
ctcagtacagaggacctgctgcggg

SEQ ID NO: 24011 - DNA, 25 bp, Mus musculus
ctcagtacagttgatggaaagaagg

SEQ ID NO: 24012 - DNA, 25 bp, Mus musculus
ctcagtacatcgacgggcagggtcg

SEQ ID NO: 24013 - DNA, 25 bp, Mus musculus
ctcagtatgatgacattgccagccg

SEQ ID NO: 24014 - DNA, 25 bp, Mus musculus
ctcagtatgtgtttggccaggcttt

SEQ ID NO: 24015 - DNA, 25 bp, Mus musculus
ctcagtcaccggtggaacagaagag

SEQ ID NO: 24016 - DNA, 25 bp, Mus musculus
ctcagtcattcttggtggatttttg

SEQ ID NO: 24017 - DNA, 25 bp, Mus musculus
ctcagtcggctgtcaaatcactgaa

SEQ ID NO: 24018 - DNA, 25 bp, Mus musculus
ctcagtctggaacggagtcaagctt

SEQ ID NO: 24019 - DNA, 25 bp, Mus musculus
ctcagtgaattggagcagctgcggc

SEQ ID NO: 24020 - DNA, 25 bp, Mus musculus
ctcagtgcatggtgccaaccggctt

SEQ ID NO: 24021 - DNA, 25 bp, Mus musculus
ctcagtgctggaaagcctagtgggc

SEQ ID NO: 24022 - DNA, 25 bp, Mus musculus
ctcagtggtgattgtgggttctgta

SEQ ID NO: 24023 - DNA, 25 bp, Mus musculus
ctcagtgtactgaagctgtgtgtca

SEQ ID NO: 24024 - DNA, 25 bp, Mus musculus
ctcagttcatgaaccttcttcagca

SEQ ID NO: 24025 - DNA, 25 bp, Mus musculus
ctcagttggaaatagaaggaaacag

SEQ ID NO: 24026 - DNA, 25 bp, Mus musculus
ctcagtttaagaataagatcatagg

SEQ ID NO: 24027 - DNA, 25 bp, Mus musculus
ctcataaacgactttgggagagaga

SEQ ID NO: 24028 - DNA, 25 bp, Mus musculus
ctcataggatttcagcaggcaccat

SEQ ID NO: 24029 - DNA, 25 bp, Mus musculus
ctcatcaaaggtgggaagattgtga

SEQ ID NO: 24030 - DNA, 25 bp, Mus musculus
ctcatcaagaagacctgaattctgt

SEQ ID NO: 24031 - DNA, 25 bp, Mus musculus
ctcatcaatgagctggtagagaatt

SEQ ID NO: 24032 - DNA, 25 bp, Mus musculus
ctcatcagttaagtacaagagcgag

SEQ ID NO: 24033 - DNA, 25 bp, Mus musculus
ctcatccagggttcgaggaagggct

SEQ ID NO: 24034 - DNA, 25 bp, Mus musculus
ctcatcctacaaggcaccctgtcgg

SEQ ID NO: 24035 - DNA, 25 bp, Mus musculus
ctcatcctgcgactcatgggccgca

SEQ ID NO: 24036 - DNA, 25 bp, Mus musculus
ctcatccttctggtgttcgagggaa

SEQ ID NO: 24037 - DNA, 25 bp, Mus musculus
ctcatcgatgttgatcttgtgagag

SEQ ID NO: 24038 - DNA, 25 bp, Mus musculus
ctcatctgctcaggtacggtggcac

SEQ ID NO: 24039 - DNA, 25 bp, Mus musculus
ctcatctgtctgctggagtatcccc

SEQ ID NO: 24040 - DNA, 25 bp, Mus musculus
ctcatctgtggatactgccgtacca

SEQ ID NO: 24041 - DNA, 25 bp, Mus musculus
ctcatgaaaactcacccggagtggc

SEQ ID NO: 24042 - DNA, 25 bp, Mus musculus
ctcatgacccatatgtggtttgtaa

SEQ ID NO: 24043 - DNA, 25 bp, Mus musculus
ctcatgatcgaagaagtggcccatc

SEQ ID NO: 24044 - DNA, 25 bp, Mus musculus
ctcatgatggatggccatgaggtga

SEQ ID NO: 24045 - DNA, 25 bp, Mus musculus
ctcatgcagcaaggtatcaaggccg

SEQ ID NO: 24046 - DNA, 25 bp, Mus musculus
ctcatgctgtttctataggtccaac

SEQ ID NO: 24047 - DNA, 25 bp, Mus musculus
ctcatgggcttctcgctgctgctgg

SEQ ID NO: 24048 - DNA, 25 bp, Mus musculus
ctcatgtacaccttctgcacagact

SEQ ID NO: 24049 - DNA, 25 bp, Mus musculus
ctcatgtacagtcaggaatggttcc

SEQ ID NO: 24050 - DNA, 25 bp, Mus musculus
ctcatgtgccagaggagcttaaaca

SEQ ID NO: 24051 - DNA, 25 bp, Mus musculus
ctcattcaagatggccaagtatggg

SEQ ID NO: 24052 - DNA, 25 bp, Mus musculus
ctcattcaagtttgggatggagtcc

SEQ ID NO: 24053 - DNA, 25 bp, Mus musculus
ctcattcaatgccttgctgaggaag

SEQ ID NO: 24054 - DNA, 25 bp, Mus musculus
ctcattcctgagacggacgccgtgg

SEQ ID NO: 24055 - DNA, 25 bp, Mus musculus
ctcattgaaagaagaatcagggact

SEQ ID NO: 24056 - DNA, 25 bp, Mus musculus
ctcattgagagagggcacaaggtca

SEQ ID NO: 24057 - DNA, 25 bp, Mus musculus
ctcattgcagttccctgaagagact

SEQ ID NO: 24058 - DNA, 25 bp, Mus musculus
ctcattgccatcagcatcttctctg

SEQ ID NO: 24059 - DNA, 25 bp, Mus musculus
ctcattgctgtctcgggacatggca

SEQ ID NO: 24060 - DNA, 25 bp, Mus musculus
ctccaaagcaagcacgatgcagcca

SEQ ID NO: 24061 - DNA, 25 bp, Mus musculus
ctccaaccccagaaaaaattcagtg

SEQ ID NO: 24062 - DNA, 25 bp, Mus musculus
ctccaacgacagtggcatctacgtc

SEQ ID NO: 24063 - DNA, 25 bp, Mus musculus
ctccaagaagaatgcggccagggct

SEQ ID NO: 24064 - DNA, 25 bp, Mus musculus
ctccaagaagattgaagaaaaccat

SEQ ID NO: 24065 - DNA, 25 bp, Mus musculus
ctccaagagacaaccaccaaacatg

SEQ ID NO: 24066 - DNA, 25 bp, Mus musculus
ctccaagatgtgacaggcccagaca

SEQ ID NO: 24067 - DNA, 25 bp, Mus musculus
ctccaagctgaacagaagcaaatga

SEQ ID NO: 24068 - DNA, 25 bp, Mus musculus
ctccactccaggaatgaaggcgtgg

SEQ ID NO: 24069 - DNA, 25 bp, Mus musculus
ctccactgcatgtagcagcgcatta

SEQ ID NO: 24070 - DNA, 25 bp, Mus musculus
ctccagaaagactttgcacagcact

SEQ ID NO: 24071 - DNA, 25 bp, Mus musculus
ctccagaacagattatgcaagaaaa

SEQ ID NO: 24072 - DNA, 25 bp, Mus musculus
ctccagactgctcggtgctgagtaa

SEQ ID NO: 24073 - DNA, 25 bp, Mus musculus
ctccagatgaaccagggtagtgtgt

SEQ ID NO: 24074 - DNA, 25 bp, Mus musculus
ctccagccttgggacatttaatttc

SEQ ID NO: 24075 - DNA, 25 bp, Mus musculus
ctccagcgaggagctcttggtggca

SEQ ID NO: 24076 - DNA, 25 bp, Mus musculus
ctccagctccacagaatttaacaca

SEQ ID NO: 24077 - DNA, 25 bp, Mus musculus
ctccagctgcagtcagactcagaac

SEQ ID NO: 24078 - DNA, 25 bp, Mus musculus
ctccagctggtgtgttgtggccctg

SEQ ID NO: 24079 - DNA, 25 bp, Mus musculus
ctccaggatcgcagagggcttcggt

SEQ ID NO: 24080 - DNA, 25 bp, Mus musculus
ctccaggatctgaagacagtgtttc

SEQ ID NO: 24081 - DNA, 25 bp, Mus musculus
ctccaggccttatctgtagggctgg

SEQ ID NO: 24082 - DNA, 25 bp, Mus musculus
ctccagggatgagcgcttccggtca

SEQ ID NO: 24083 - DNA, 25 bp, Mus musculus
ctccagtaatggacggaagcgggca

SEQ ID NO: 24084 - DNA, 25 bp, Mus musculus
ctccagtcaggcagtccctctgaag

SEQ ID NO: 24085 - DNA, 25 bp, Mus musculus
ctccagtgcctattctacagccaaa

SEQ ID NO: 24086 - DNA, 25 bp, Mus musculus
ctccagttggttttctgaacagaag

SEQ ID NO: 24087 - DNA, 25 bp, Mus musculus
ctccataggaatggcctgtaggcct

SEQ ID NO: 24088 - DNA, 25 bp, Mus musculus
ctccatctgggctcctgtgaatagg

SEQ ID NO: 24089 - DNA, 25 bp, Mus musculus
ctccatggagactgcgtggcccttc

SEQ ID NO: 24090 - DNA, 25 bp, Mus musculus
ctccatgtcctggaagccagaaatg

SEQ ID NO: 24091 - DNA, 25 bp, Mus musculus
ctccattagaggacacactggttaa

SEQ ID NO: 24092 - DNA, 25 bp, Mus musculus
ctccattctgcacgagaattctcag

SEQ ID NO: 24093 - DNA, 25 bp, Mus musculus
ctccatttcacatgagagccctgca

SEQ ID NO: 24094 - DNA, 25 bp, Mus musculus
ctcccaaattagctttgtcaacagt

SEQ ID NO: 24095 - DNA, 25 bp, Mus musculus
ctcccagtcggtgttcatggctggt

SEQ ID NO: 24096 - DNA, 25 bp, Mus musculus
ctcccatggaattattgcacaaaga

SEQ ID NO: 24097 - DNA, 25 bp, Mus musculus
ctccccagggaggaagcacaaggct

SEQ ID NO: 24098 - DNA, 25 bp, Mus musculus
ctccccggagaagctgcaggagacg

SEQ ID NO: 24099 - DNA, 25 bp, Mus musculus
ctccccggtcctagaggtcaggcat

SEQ ID NO: 24100 - DNA, 25 bp, Mus musculus
ctcccctcagagagaggacgtttga

SEQ ID NO: 24101 - DNA, 25 bp, Mus musculus
ctcccctgattcctatgcctgtggg

SEQ ID NO: 24102 - DNA, 25 bp, Mus musculus
ctcccgaggagctgtatacttctct

SEQ ID NO: 24103 - DNA, 25 bp, Mus musculus
ctccctcatctgagaaggcagagtt

SEQ ID NO: 24104 - DNA, 25 bp, Mus musculus
ctccctccctgaagatgacgtgttc

SEQ ID NO: 24105 - DNA, 25 bp, Mus musculus
ctccctgagttgtcaggagccctgg

SEQ ID NO: 24106 - DNA, 25 bp, Mus musculus
ctccctggccagcaagaaacctaaa

SEQ ID NO: 24107 - DNA, 25 bp, Mus musculus
ctccctgtccaccatgattgacggg

SEQ ID NO: 24108 - DNA, 25 bp, Mus musculus
ctcccttaggaaagacagcagtagc

SEQ ID NO: 24109 - DNA, 25 bp, Mus musculus
ctcccttaggaatgacagcagtagc

SEQ ID NO: 24110 - DNA, 25 bp, Mus musculus
ctcccttgtggctggacagcagctg

SEQ ID NO: 24111 - DNA, 25 bp, Mus musculus
ctccgaaagggttttgctgagaaca

SEQ ID NO: 24112 - DNA, 25 bp, Mus musculus
ctccgaagacgttgtcagtgagaac

SEQ ID NO: 24113 - DNA, 25 bp, Mus musculus
ctccgaaggcggacgtgaagaactt

SEQ ID NO: 24114 - DNA, 25 bp, Mus musculus
ctccgactatgagcactatgacttc

SEQ ID NO: 24115 - DNA, 25 bp, Mus musculus
ctccgagaagtcgtcctggcgggat

SEQ ID NO: 24116 - DNA, 25 bp, Mus musculus
ctccgagagctaaatgagaaacttg

SEQ ID NO: 24117 - DNA, 25 bp, Mus musculus
ctccgaggtgacttttcgacagtgc

SEQ ID NO: 24118 - DNA, 25 bp, Mus musculus
ctccgatatacagtaccagttgtcg

SEQ ID NO: 24119 - DNA, 25 bp, Mus musculus
ctccgcaacctttgagcagccaggg

SEQ ID NO: 24120 - DNA, 25 bp, Mus musculus
ctccgccagcacctcgagagaagga

SEQ ID NO: 24121 - DNA, 25 bp, Mus musculus
ctccgccagcacgtcgagagaagga

SEQ ID NO: 24122 - DNA, 25 bp, Mus musculus
ctccgcgccctgaactcaatatgtg

SEQ ID NO: 24123 - DNA, 25 bp, Mus musculus
ctccggcacgttgggtcccgaagag

SEQ ID NO: 24124 - DNA, 25 bp, Mus musculus
ctccggccaatgagagccagaggcg

SEQ ID NO: 24125 - DNA, 25 bp, Mus musculus
ctccgtcatctctgcagagcttcag

SEQ ID NO: 24126 - DNA, 25 bp, Mus musculus
ctccgtggagcttgaagctgggcac

SEQ ID NO: 24127 - DNA, 25 bp, Mus musculus
ctccgtggtggcctttgtcaatgca

SEQ ID NO: 24128 - DNA, 25 bp, Mus musculus
ctcctaatgtacagcggacacgccg

SEQ ID NO: 24129 - DNA, 25 bp, Mus musculus
ctcctactctggcacatcaagtttc

SEQ ID NO: 24130 - DNA, 25 bp, Mus musculus
ctcctactctgggacatcaagtttc

SEQ ID NO: 24131 - DNA, 25 bp, Mus musculus
ctcctagatggagcaggtgccatta

SEQ ID NO: 24132 - DNA, 25 bp, Mus musculus
ctcctatttccgaagctcctgttca

SEQ ID NO: 24133 - DNA, 25 bp, Mus musculus
ctcctcaaagctgataggagcatga

SEQ ID NO: 24134 - DNA, 25 bp, Mus musculus
ctcctcaatggacaaactagacaag

SEQ ID NO: 24135 - DNA, 25 bp, Mus musculus
ctcctcaatggagggaacaaccagg

SEQ ID NO: 24136 - DNA, 25 bp, Mus musculus
ctcctcataaaatcttgcttgatac

SEQ ID NO: 24137 - DNA, 25 bp, Mus musculus
ctcctcatctatacagtgtcactgt

SEQ ID NO: 24138 - DNA, 25 bp, Mus musculus
ctcctccctaggacgttaggattgc

SEQ ID NO: 24139 - DNA, 25 bp, Mus musculus
ctcctccctcatctgagaaggcaga

SEQ ID NO: 24140 - DNA, 25 bp, Mus musculus
ctcctcctctgaaaaagctctagct

SEQ ID NO: 24141 - DNA, 25 bp, Mus musculus
ctcctccttgcaggtgggaatccta

SEQ ID NO: 24142 - DNA, 25 bp, Mus musculus
ctcctcgaagatagactctcatggt

SEQ ID NO: 24143 - DNA, 25 bp, Mus musculus
ctcctcggattaaattgtggaaaga

SEQ ID NO: 24144 - DNA, 25 bp, Mus musculus
ctcctcggtgactctaggatgcctg

SEQ ID NO: 24145 - DNA, 25 bp, Mus musculus
ctcctctgataaaatgcctaatgac

SEQ ID NO: 24146 - DNA, 25 bp, Mus musculus
ctcctctgtggcctcggaggaatta

SEQ ID NO: 24147 - DNA, 25 bp, Mus musculus
ctcctgaacccaccagcgaagggag

SEQ ID NO: 24148 - DNA, 25 bp, Mus musculus
ctcctgagcaatgggaagcgacatc

SEQ ID NO: 24149 - DNA, 25 bp, Mus musculus
ctcctgagggttcaattattcaaca

SEQ ID NO: 24150 - DNA, 25 bp, Mus musculus
ctcctgaggtttggctctggcacca

SEQ ID NO: 24151 - DNA, 25 bp, Mus musculus
ctcctgagtgtcgtaaatttttatc

SEQ ID NO: 24152 - DNA, 25 bp, Mus musculus
ctcctgcagaatccgaaagtcacag

SEQ ID NO: 24153 - DNA, 25 bp, Mus musculus
ctcctggagagcattgccgtggcca

SEQ ID NO: 24154 - DNA, 25 bp, Mus musculus
ctcctggctcgggtgtgtcacctgt

SEQ ID NO: 24155 - DNA, 25 bp, Mus musculus
ctcctggctttggagtgttgggaaa

SEQ ID NO: 24156 - DNA, 25 bp, Mus musculus
ctcctgggtctagcttgcatgcctg

SEQ ID NO: 24157 - DNA, 25 bp, Mus musculus
ctcctgggtgccagtgtaacggagc

SEQ ID NO: 24158 - DNA, 25 bp, Mus musculus
ctcctgtccacgtccacataaaaaa

SEQ ID NO: 24159 - DNA, 25 bp, Mus musculus
ctcctgtcgaaagggcttctgaaga

SEQ ID NO: 24160 - DNA, 25 bp, Mus musculus
ctccttatgtctggaggagactgtg

SEQ ID NO: 24161 - DNA, 25 bp, Mus musculus
ctccttccatttctggaggactcct

SEQ ID NO: 24162 - DNA, 25 bp, Mus musculus
ctccttgcaggtgggaatcctagat

SEQ ID NO: 24163 - DNA, 25 bp, Mus musculus
ctccttgggaggcacaggattctca

SEQ ID NO: 24164 - DNA, 25 bp, Mus musculus
ctccttggtccagtttcccttgtgg

SEQ ID NO: 24165 - DNA, 25 bp, Mus musculus
ctccttgtgtgcgagaactggcagg

SEQ ID NO: 24166 - DNA, 25 bp, Mus musculus
ctccttgttctgtgactccctacag

SEQ ID NO: 24167 - DNA, 25 bp, Mus musculus
ctcctttatgggaatcacactattg

SEQ ID NO: 24168 - DNA, 25 bp, Mus musculus
ctcctttgttgatgagagcgagtga

SEQ ID NO: 24169 - DNA, 25 bp, Mus musculus
ctccttttgggcttctggtgagcac

SEQ ID NO: 24170 - DNA, 25 bp, Mus musculus
ctcgaaagcgccagaaagagacttc

SEQ ID NO: 24171 - DNA, 25 bp, Mus musculus
ctcgaacagtatggcttggatgtcc

SEQ ID NO: 24172 - DNA, 25 bp, Mus musculus
ctcgaaggaaggactcccgggctgc

SEQ ID NO: 24173 - DNA, 25 bp, Mus musculus
ctcgaaggctggaagggatcgatca

SEQ ID NO: 24174 - DNA, 25 bp, Mus musculus
ctcgaccgatcatcagacttctctg

SEQ ID NO: 24175 - DNA, 25 bp, Mus musculus
ctcgactcacagcactttacctttt

SEQ ID NO: 24176 - DNA, 25 bp, Mus musculus
ctcgagaaataaaggccacagaacc

SEQ ID NO: 24177 - DNA, 25 bp, Mus musculus
ctcgagacatgggaggctacagcac

SEQ ID NO: 24178 - DNA, 25 bp, Mus musculus
ctcgagagcatcgtgggactaatct

SEQ ID NO: 24179 - DNA, 25 bp, Mus musculus
ctcgagccgggaaaactggacaggc

SEQ ID NO: 24180 - DNA, 25 bp, Mus musculus
ctcgagcgcactctcgtggaggctc

SEQ ID NO: 24181 - DNA, 25 bp, Mus musculus
ctcgaggaccgagggctataccagt

SEQ ID NO: 24182 - DNA, 25 bp, Mus musculus
ctcgaggactggtgcttgaaaatga

SEQ ID NO: 24183 - DNA, 25 bp, Mus musculus
ctcgagtttctgcaccaggtttgga

SEQ ID NO: 24184 - DNA, 25 bp, Mus musculus
ctcgagtttctggaccaggtttgga

SEQ ID NO: 24185 - DNA, 25 bp, Mus musculus
ctcgatggctactctgtaatggcag

SEQ ID NO: 24186 - DNA, 25 bp, Mus musculus
ctcgatgtggttaacatgtttgtga

SEQ ID NO: 24187 - DNA, 25 bp, Mus musculus
ctcgcactggacacgcactactgga

SEQ ID NO: 24188 - DNA, 25 bp, Mus musculus
ctcgccccagtgaatgggagaagcg

SEQ ID NO: 24189 - DNA, 25 bp, Mus musculus
ctcgccttaccctgatgctggctgt

SEQ ID NO: 24190 - DNA, 25 bp, Mus musculus
ctcgcgtgtcggtgcttcctacaaa

SEQ ID NO: 24191 - DNA, 25 bp, Mus musculus
ctcgctagaggcgggaaagtcttag

SEQ ID NO: 24192 - DNA, 25 bp, Mus musculus
ctcgctgctgctgggcaactcggtt

SEQ ID NO: 24193 - DNA, 25 bp, Mus musculus
ctcgctggagatgactctggagcag

SEQ ID NO: 24194 - DNA, 25 bp, Mus musculus
ctcgctggtccccagtcatcaagga

SEQ ID NO: 24195 - DNA, 25 bp, Mus musculus
ctcgctgttgtcactgtcacacctg

SEQ ID NO: 24196 - DNA, 25 bp, Mus musculus
ctcggaaaaacacgagacattagtg

SEQ ID NO: 24197 - DNA, 25 bp, Mus musculus
ctcggaaaagaatcttgtgtccttt

SEQ ID NO: 24198 - DNA, 25 bp, Mus musculus
ctcggaaggtgaaccacccaaagat

SEQ ID NO: 24199 - DNA, 25 bp, Mus musculus
ctcggaagtctgtgctttcttcaag

SEQ ID NO: 24200 - DNA, 25 bp, Mus musculus
ctcggaatgtgaggacatctgagcg

SEQ ID NO: 24201 - DNA, 25 bp, Mus musculus
ctcggagacaatgcggcctcctggt

SEQ ID NO: 24202 - DNA, 25 bp, Mus musculus
ctcggagactccagcaggagcgcag

SEQ ID NO: 24203 - DNA, 25 bp, Mus musculus
ctcggaggacactaagcagatgatg

SEQ ID NO: 24204 - DNA, 25 bp, Mus musculus
ctcggattgggaaaatgaaacggag

SEQ ID NO: 24205 - DNA, 25 bp, Mus musculus
ctcggcagagtgtcccagtgacgat

SEQ ID NO: 24206 - DNA, 25 bp, Mus musculus
ctcgggaatgcaccacaggaagaga

SEQ ID NO: 24207 - DNA, 25 bp, Mus musculus
ctcgggaggagaagcaccagaagca

SEQ ID NO: 24208 - DNA, 25 bp, Mus musculus
ctcgggcaagtcaccaagtccatca

SEQ ID NO: 24209 - DNA, 25 bp, Mus musculus
ctcgggcgacgggactcagggtgag

SEQ ID NO: 24210 - DNA, 25 bp, Mus musculus
ctcgggctaccaactccagggatga

SEQ ID NO: 24211 - DNA, 25 bp, Mus musculus
ctcggtccggacaagcagaagtggt

SEQ ID NO: 24212 - DNA, 25 bp, Mus musculus
ctcggtgaggaccatgagaaaacca

SEQ ID NO: 24213 - DNA, 25 bp, Mus musculus
ctcggtggtgtttggaaccatggtt

SEQ ID NO: 24214 - DNA, 25 bp, Mus musculus
ctcggttggtcagtgagcggaatct

SEQ ID NO: 24215 - DNA, 25 bp, Mus musculus
ctcgtaccgggacgctgtcagcatg

SEQ ID NO: 24216 - DNA, 25 bp, Mus musculus
ctcgtagactgctataaaccaacag

SEQ ID NO: 24217 - DNA, 25 bp, Mus musculus
ctcgtagctctattttccatgacag

SEQ ID NO: 24218 - DNA, 25 bp, Mus musculus
ctcgtcaaggtgaggcagtgttgaa

SEQ ID NO: 24219 - DNA, 25 bp, Mus musculus
ctcgtcactggttgtggtccatcca

SEQ ID NO: 24220 - DNA, 25 bp, Mus musculus
ctcgtgctgctgagataagtttgaa

SEQ ID NO: 24221 - DNA, 25 bp, Mus musculus
ctcgtgggaggaaccactccaggga

SEQ ID NO: 24222 - DNA, 25 bp, Mus musculus
ctcgtttgctgtcacgtgcctgtgg

SEQ ID NO: 24223 - DNA, 25 bp, Mus musculus
ctctaaaacaacatgggaaatcctc

SEQ ID NO: 24224 - DNA, 25 bp, Mus musculus
ctctaaagcatgaattccaaaaaca

SEQ ID NO: 24225 - DNA, 25 bp, Mus musculus
ctctaaagcatgtattccaaaaaca

SEQ ID NO: 24226 - DNA, 25 bp, Mus musculus
ctctaaatgccatgtggtatgcaga

SEQ ID NO: 24227 - DNA, 25 bp, Mus musculus
ctctaagttactgtcttgcaaggtg

SEQ ID NO: 24228 - DNA, 25 bp, Mus musculus
ctctacaacagaagatagcgggagt

SEQ ID NO: 24229 - DNA, 25 bp, Mus musculus
ctctacatcagagtgtgctttcctc

SEQ ID NO: 24230 - DNA, 25 bp, Mus musculus
ctctacattacgagcgccacagcag

SEQ ID NO: 24231 - DNA, 25 bp, Mus musculus
ctctacgggccagaggaactacgca

SEQ ID NO: 24232 - DNA, 25 bp, Mus musculus
ctctactctgcctggcgaggactct

SEQ ID NO: 24233 - DNA, 25 bp, Mus musculus
ctctactgctgccatggtgatgccc

SEQ ID NO: 24234 - DNA, 25 bp, Mus musculus
ctctagaccatgctagcgtcagact

SEQ ID NO: 24235 - DNA, 25 bp, Mus musculus
ctctaggagtctgtgttacaaaaca

SEQ ID NO: 24236 - DNA, 25 bp, Mus musculus
ctctagggctgcagataaggctgtt

SEQ ID NO: 24237 - DNA, 25 bp, Mus musculus
ctctaggggagagtacaatgtttac

SEQ ID NO: 24238 - DNA, 25 bp, Mus musculus
ctctaggtcgccatggcaactgggc

SEQ ID NO: 24239 - DNA, 25 bp, Mus musculus
ctctataatagcctcacccggaaca

SEQ ID NO: 24240 - DNA, 25 bp, Mus musculus
ctctatccttatttaggccccagca

SEQ ID NO: 24241 - DNA, 25 bp, Mus musculus
ctctatcgccacattgctcagctag

SEQ ID NO: 24242 - DNA, 25 bp, Mus musculus
ctctatgcccaggtctctgtggctg

SEQ ID NO: 24243 - DNA, 25 bp, Mus musculus
ctctatggaaacacatgtaggttca

SEQ ID NO: 24244 - DNA, 25 bp, Mus musculus
ctctatggaatagttggtgcaaacc

SEQ ID NO: 24245 - DNA, 25 bp, Mus musculus
ctctattcccagtgtggccgtggct

SEQ ID NO: 24246 - DNA, 25 bp, Mus musculus
ctctcaatgggacggacagctgaaa

SEQ ID NO: 24247 - DNA, 25 bp, Mus musculus
ctctcaccagcctgaataccaagga

SEQ ID NO: 24248 - DNA, 25 bp, Mus musculus
ctctcagcaagaaaagagggctgtg

SEQ ID NO: 24249 - DNA, 25 bp, Mus musculus
ctctcagcctgtatctatattttcg

SEQ ID NO: 24250 - DNA, 25 bp, Mus musculus
ctctcatgctgggaacaagttggcc

SEQ ID NO: 24251 - DNA, 25 bp, Mus musculus
ctctcatgggtgaagaacacagtat

SEQ ID NO: 24252 - DNA, 25 bp, Mus musculus
ctctccagtgtatggcacagacatg

SEQ ID NO: 24253 - DNA, 25 bp, Mus musculus
ctctccatccacagtgacatggcgg

SEQ ID NO: 24254 - DNA, 25 bp, Mus musculus
ctctccatggacaggtatggcaaat

SEQ ID NO: 24255 - DNA, 25 bp, Mus musculus
ctctccatggactggtatggcaaat

SEQ ID NO: 24256 - DNA, 25 bp, Mus musculus
ctctcccttcgggatgttgggaatg

SEQ ID NO: 24257 - DNA, 25 bp, Mus musculus
ctctccctttagtggctcgtgggtt

SEQ ID NO: 24258 - DNA, 25 bp, Mus musculus
ctctccggtcctgatgtgggtccag

SEQ ID NO: 24259 - DNA, 25 bp, Mus musculus
ctctcctgtcttttgattggaaaca

SEQ ID NO: 24260 - DNA, 25 bp, Mus musculus
ctctcgagcagtcgtgactggacag

SEQ ID NO: 24261 - DNA, 25 bp, Mus musculus
ctctcgagcgcactctcgtggaggc

SEQ ID NO: 24262 - DNA, 25 bp, Mus musculus
ctctcgcccatatgtttgagaccgt

SEQ ID NO: 24263 - DNA, 25 bp, Mus musculus
ctctcggacatcttcaggctcgctt

SEQ ID NO: 24264 - DNA, 25 bp, Mus musculus
ctctcggaggacaacggaccaaaag

SEQ ID NO: 24265 - DNA, 25 bp, Mus musculus
ctctcggtagcagatccttgtaaga

SEQ ID NO: 24266 - DNA, 25 bp, Mus musculus
ctctcgtagactgctataaaccaac

SEQ ID NO: 24267 - DNA, 25 bp, Mus musculus
ctctcgtagattccggagaaacacg

SEQ ID NO: 24268 - DNA, 25 bp, Mus musculus
ctctcgtggcgctctccttcagtgg

SEQ ID NO: 24269 - DNA, 25 bp, Mus musculus
ctctctaagtatgcaatgccagaga

SEQ ID NO: 24270 - DNA, 25 bp, Mus musculus
ctctctacttaatcatggaatatgc

SEQ ID NO: 24271 - DNA, 25 bp, Mus musculus
ctctctccctttagtggctcgtggg

SEQ ID NO: 24272 - DNA, 25 bp, Mus musculus
ctctctgactctgcaggatggtggt

SEQ ID NO: 24273 - DNA, 25 bp, Mus musculus
ctctctgagagcaactcgacactct

SEQ ID NO: 24274 - DNA, 25 bp, Mus musculus
ctctctgcaattgatgcctgtatta

SEQ ID NO: 24275 - DNA, 25 bp, Mus musculus
ctctctggatgggttctacaacggc

SEQ ID NO: 24276 - DNA, 25 bp, Mus musculus
ctctctgttgtttgtgatgatggaa

SEQ ID NO: 24277 - DNA, 25 bp, Mus musculus
ctctctttccccagcaataaactgg

SEQ ID NO: 24278 - DNA, 25 bp, Mus musculus
ctctgaaccaccgaaggaagcttct

SEQ ID NO: 24279 - DNA, 25 bp, Mus musculus
ctctgaagaaagaggacaccacctt

SEQ ID NO: 24280 - DNA, 25 bp, Mus musculus
ctctgaagcccaagaagccggcaag

SEQ ID NO: 24281 - DNA, 25 bp, Mus musculus
ctctgaagtcacagcaaaaagtatt

SEQ ID NO: 24282 - DNA, 25 bp, Mus musculus
ctctgaatgtagtggaggagaagaa

SEQ ID NO: 24283 - DNA, 25 bp, Mus musculus
ctctgacaggtcgtggtgaagtctg

SEQ ID NO: 24284 - DNA, 25 bp, Mus musculus
ctctgacatccttgttgtaccccag

SEQ ID NO: 24285 - DNA, 25 bp, Mus musculus
ctctgacatgtgtggtaactcctca

SEQ ID NO: 24286 - DNA, 25 bp, Mus musculus
ctctgaccaagtagcgcagagtgat

SEQ ID NO: 24287 - DNA, 25 bp, Mus musculus
ctctgacgtcagagattgtgtctga

SEQ ID NO: 24288 - DNA, 25 bp, Mus musculus
ctctgactctgcaggatggtggtgc

SEQ ID NO: 24289 - DNA, 25 bp, Mus musculus
ctctgagaagctctttgccccggca

SEQ ID NO: 24290 - DNA, 25 bp, Mus musculus
ctctgagacagtgctctgcgaggtg

SEQ ID NO: 24291 - DNA, 25 bp, Mus musculus
ctctgagagccacggccgagaatga

SEQ ID NO: 24292 - DNA, 25 bp, Mus musculus
ctctgagcacactgtgaacaaaaaa

SEQ ID NO: 24293 - DNA, 25 bp, Mus musculus
ctctgagcctcgtgccccgaagttg

SEQ ID NO: 24294 - DNA, 25 bp, Mus musculus
ctctgaggagctcttggccactgat

SEQ ID NO: 24295 - DNA, 25 bp, Mus musculus
ctctgagggaagtctgcgatgatga

SEQ ID NO: 24296 - DNA, 25 bp, Mus musculus
ctctgataaaatgcctaatgaccaa

SEQ ID NO: 24297 - DNA, 25 bp, Mus musculus
ctctgattttgagtatgatctgttc

SEQ ID NO: 24298 - DNA, 25 bp, Mus musculus
ctctgcaaacgctgctgggaggtgc

SEQ ID NO: 24299 - DNA, 25 bp, Mus musculus
ctctgcaaagcactattctgttctg

SEQ ID NO: 24300 - DNA, 25 bp, Mus musculus
ctctgcagttcaggcgcatttggtg

SEQ ID NO: 24301 - DNA, 25 bp, Mus musculus
ctctgcattgagtgctgcgccctgg

SEQ ID NO: 24302 - DNA, 25 bp, Mus musculus
ctctgccatcagcaggaagcttgga

SEQ ID NO: 24303 - DNA, 25 bp, Mus musculus
ctctgcccatgatgcttgctgaacc

SEQ ID NO: 24304 - DNA, 25 bp, Mus musculus
ctctgccctgttgtgtgccccactg

SEQ ID NO: 24305 - DNA, 25 bp, Mus musculus
ctctgcccttctaagtaaacggcgg

SEQ ID NO: 24306 - DNA, 25 bp, Mus musculus
ctctgcctgctgcacttccttgtgg

SEQ ID NO: 24307 - DNA, 25 bp, Mus musculus
ctctgcctgctggacttccttgtgg

SEQ ID NO: 24308 - DNA, 25 bp, Mus musculus
ctctgcggataaagagagacttgcc

SEQ ID NO: 24309 - DNA, 25 bp, Mus musculus
ctctgcgtacaaggccctgttttct

SEQ ID NO: 24310 - DNA, 25 bp, Mus musculus
ctctgctaggagttgctgcatataa

SEQ ID NO: 24311 - DNA, 25 bp, Mus musculus
ctctgctgggaaggtactggctgtc

SEQ ID NO: 24312 - DNA, 25 bp, Mus musculus
ctctgcttatgagacagcaacaact

SEQ ID NO: 24313 - DNA, 25 bp, Mus musculus
ctctggaaagaacgctggagcagaa

SEQ ID NO: 24314 - DNA, 25 bp, Mus musculus
ctctggaaaggtcttccccactagc

SEQ ID NO: 24315 - DNA, 25 bp, Mus musculus
ctctggaactggcaatgttgttgtg

SEQ ID NO: 24316 - DNA, 25 bp, Mus musculus
ctctggaagagcgactggcgttctt

SEQ ID NO: 24317 - DNA, 25 bp, Mus musculus
ctctggaccagcagcctgaggtctc

SEQ ID NO: 24318 - DNA, 25 bp, Mus musculus
ctctggagcagtgctcggatgtgta

SEQ ID NO: 24319 - DNA, 25 bp, Mus musculus
ctctggaggttatgaccatcctgtg

SEQ ID NO: 24320 - DNA, 25 bp, Mus musculus
ctctggagtgtgagatccagttgct

SEQ ID NO: 24321 - DNA, 25 bp, Mus musculus
ctctggatggagtgcgtcacgcaga

SEQ ID NO: 24322 - DNA, 25 bp, Mus musculus
ctctggatgggttctacaacggccg

SEQ ID NO: 24323 - DNA, 25 bp, Mus musculus
ctctggatggtcattttaagaagag

SEQ ID NO: 24324 - DNA, 25 bp, Mus musculus
ctctggatggtctttttaagaagag

SEQ ID NO: 24325 - DNA, 25 bp, Mus musculus
ctctggccagatgcggcagctgtgc

SEQ ID NO: 24326 - DNA, 25 bp, Mus musculus
ctctggcctcagatctggatctttt

SEQ ID NO: 24327 - DNA, 25 bp, Mus musculus
ctctggcctgggagccgcctgaagc

SEQ ID NO: 24328 - DNA, 25 bp, Mus musculus
ctctggcgttaaaaggcattgacta

SEQ ID NO: 24329 - DNA, 25 bp, Mus musculus
ctctggctcattgggcagcttttgc

SEQ ID NO: 24330 - DNA, 25 bp, Mus musculus
ctctggctcccaagcacatcaaggg

SEQ ID NO: 24331 - DNA, 25 bp, Mus musculus
ctctgggcaaggacctcttccacag

SEQ ID NO: 24332 - DNA, 25 bp, Mus musculus
ctctgggctcagatagaattttatc

SEQ ID NO: 24333 - DNA, 25 bp, Mus musculus
ctctgggtggatttgcatggcgtca

SEQ ID NO: 24334 - DNA, 25 bp, Mus musculus
ctctgggtttaacaaacagagacag

SEQ ID NO: 24335 - DNA, 25 bp, Mus musculus
ctctggtaacgtggaaaactcaaca

SEQ ID NO: 24336 - DNA, 25 bp, Mus musculus
ctctggtctctacctagttgtctta

SEQ ID NO: 24337 - DNA, 25 bp, Mus musculus
ctctggtgaagatctccgaggagct

SEQ ID NO: 24338 - DNA, 25 bp, Mus musculus
ctctggtgatgaccctggctgctgt

SEQ ID NO: 24339 - DNA, 25 bp, Mus musculus
ctctggtgccagagaaagacagccc

SEQ ID NO: 24340 - DNA, 25 bp, Mus musculus
ctctggtttaaagcaagcgtttgca

SEQ ID NO: 24341 - DNA, 25 bp, Mus musculus
ctctgtcaaagggtgaaacaaagtt

SEQ ID NO: 24342 - DNA, 25 bp, Mus musculus
ctctgtcaatgttctccgtggctgc

SEQ ID NO: 24343 - DNA, 25 bp, Mus musculus
ctctgtcactgcctctatccgggta

SEQ ID NO: 24344 - DNA, 25 bp, Mus musculus
ctctgtcagaaacgatggcagccct

SEQ ID NO: 24345 - DNA, 25 bp, Mus musculus
ctctgtcagtctccaacttattttt

SEQ ID NO: 24346 - DNA, 25 bp, Mus musculus
ctctgtcccttaagtatgtccctgc

SEQ ID NO: 24347 - DNA, 25 bp, Mus musculus
ctctgtcctgactggaatctgctgt

SEQ ID NO: 24348 - DNA, 25 bp, Mus musculus
ctctgtcttcgttaggattttgctg

SEQ ID NO: 24349 - DNA, 25 bp, Mus musculus
ctctgtgaagctgcgactgctgtgt

SEQ ID NO: 24350 - DNA, 25 bp, Mus musculus
ctctgtgatacatggcatgggagac

SEQ ID NO: 24351 - DNA, 25 bp, Mus musculus
ctctgtggagccctattgtgccgac

SEQ ID NO: 24352 - DNA, 25 bp, Mus musculus
ctctgtgggtgaggacagcatccct

SEQ ID NO: 24353 - DNA, 25 bp, Mus musculus
ctctgtggtgggacttcatagcttc

SEQ ID NO: 24354 - DNA, 25 bp, Mus musculus
ctctgtggttgatgtgggaaacaca

SEQ ID NO: 24355 - DNA, 25 bp, Mus musculus
ctctgtgtaccgaggagtgcatgca

SEQ ID NO: 24356 - DNA, 25 bp, Mus musculus
ctctgtgtgatgtgtcagggctttg

SEQ ID NO: 24357 - DNA, 25 bp, Mus musculus
ctctgttcagactgagcaagagcca

SEQ ID NO: 24358 - DNA, 25 bp, Mus musculus
ctctgttggatacccgagagtctcg

SEQ ID NO: 24359 - DNA, 25 bp, Mus musculus
ctcttaaagaagaacatgtgtaact

SEQ ID NO: 24360 - DNA, 25 bp, Mus musculus
ctcttaagacaggtggaccatcctg

SEQ ID NO: 24361 - DNA, 25 bp, Mus musculus
ctcttacaaccacagacagattgag

SEQ ID NO: 24362 - DNA, 25 bp, Mus musculus
ctcttagcaagtaccccgccgtgtt

SEQ ID NO: 24363 - DNA, 25 bp, Mus musculus
ctcttcaaggatcggaaacttaagt

SEQ ID NO: 24364 - DNA, 25 bp, Mus musculus
ctcttcaaggatgggaaacttaagt

SEQ ID NO: 24365 - DNA, 25 bp, Mus musculus
ctcttcaatcagctcatcaagtgag

SEQ ID NO: 24366 - DNA, 25 bp, Mus musculus
ctcttcaatgatgctattcgattag

SEQ ID NO: 24367 - DNA, 25 bp, Mus musculus
ctcttcagagaagtaagaataatga

SEQ ID NO: 24368 - DNA, 25 bp, Mus musculus
ctcttccataagtcaggtgctttgg

SEQ ID NO: 24369 - DNA, 25 bp, Mus musculus
ctcttcccaagcagccggagcggag

SEQ ID NO: 24370 - DNA, 25 bp, Mus musculus
ctcttccgtaatgcgggatgtgctg

SEQ ID NO: 24371 - DNA, 25 bp, Mus musculus
ctcttcgcccctttactgcagtggg

SEQ ID NO: 24372 - DNA, 25 bp, Mus musculus
ctcttcgcttttggattacctggaa

SEQ ID NO: 24373 - DNA, 25 bp, Mus musculus
ctcttctccatgattcttgtcgtct

SEQ ID NO: 24374 - DNA, 25 bp, Mus musculus
ctcttctgattctcctcaaggcaag

SEQ ID NO: 24375 - DNA, 25 bp, Mus musculus
ctcttctggaaggatgcctggaatg

SEQ ID NO: 24376 - DNA, 25 bp, Mus musculus
ctcttctgggatgctctaccatgtt

SEQ ID NO: 24377 - DNA, 25 bp, Mus musculus
ctcttcttcaatgggacagaaacct

SEQ ID NO: 24378 - DNA, 25 bp, Mus musculus
ctcttctttagaagaggaaggcaag

SEQ ID NO: 24379 - DNA, 25 bp, Mus musculus
ctcttgaagcaagacgagaattgcc

SEQ ID NO: 24380 - DNA, 25 bp, Mus musculus
ctcttgagctttctgcactaattga

SEQ ID NO: 24381 - DNA, 25 bp, Mus musculus
ctcttgagggatttggatttgctac

SEQ ID NO: 24382 - DNA, 25 bp, Mus musculus
ctcttgagtgcctgaactcaggtcc

SEQ ID NO: 24383 - DNA, 25 bp, Mus musculus
ctcttgccacatcaggttcccaggt

SEQ ID NO: 24384 - DNA, 25 bp, Mus musculus
ctcttgcttctgatgggaattctca

SEQ ID NO: 24385 - DNA, 25 bp, Mus musculus
ctcttggaccttgtagtctttggca

SEQ ID NO: 24386 - DNA, 25 bp, Mus musculus
ctcttggactgaccccgacaggcat

SEQ ID NO: 24387 - DNA, 25 bp, Mus musculus
ctcttgggagaaataatggagcaat

SEQ ID NO: 24388 - DNA, 25 bp, Mus musculus
ctcttgggagaattaatggagcaat

SEQ ID NO: 24389 - DNA, 25 bp, Mus musculus
ctcttgggataatgcccaggttatc

SEQ ID NO: 24390 - DNA, 25 bp, Mus musculus
ctcttgggcatgttgtcaggagacc

SEQ ID NO: 24391 - DNA, 25 bp, Mus musculus
ctcttgtatctgagcttctctgacc

SEQ ID NO: 24392 - DNA, 25 bp, Mus musculus
ctcttgtgttaaggcaaaaggccaa

SEQ ID NO: 24393 - DNA, 25 bp, Mus musculus
ctctttatatatcagaagctggccg

SEQ ID NO: 24394 - DNA, 25 bp, Mus musculus
ctctttccccagcaataaactggtc

SEQ ID NO: 24395 - DNA, 25 bp, Mus musculus
ctctttcctccatgcagcagttcaa

SEQ ID NO: 24396 - DNA, 25 bp, Mus musculus
ctctttgatgactcctgccttgacc

SEQ ID NO: 24397 - DNA, 25 bp, Mus musculus
ctctttggcacacttggaaactgca

SEQ ID NO: 24398 - DNA, 25 bp, Mus musculus
ctctttggctgctggttgagtgaaa

SEQ ID NO: 24399 - DNA, 25 bp, Mus musculus
ctctttgtacccttagcggtcctga

SEQ ID NO: 24400 - DNA, 25 bp, Mus musculus
ctctttgttatcgacaacagcacag

SEQ ID NO: 24401 - DNA, 25 bp, Mus musculus
ctcttttatatggataatgacctca

SEQ ID NO: 24402 - DNA, 25 bp, Mus musculus
ctcttttgaggtacccgcggctggc

SEQ ID NO: 24403 - DNA, 25 bp, Mus musculus
ctgaaaaagagagcggctggtcttc

SEQ ID NO: 24404 - DNA, 25 bp, Mus musculus
ctgaaaacctctacggcccagatgg

SEQ ID NO: 24405 - DNA, 25 bp, Mus musculus
ctgaaaacctcttcggcccagatgg

SEQ ID NO: 24406 - DNA, 25 bp, Mus musculus
ctgaaaagaccacaggaggcttggt

SEQ ID NO: 24407 - DNA, 25 bp, Mus musculus
ctgaaaagaccagaggaggcttggt

SEQ ID NO: 24408 - DNA, 25 bp, Mus musculus
ctgaaaagcaccttacacattgcgg

SEQ ID NO: 24409 - DNA, 25 bp, Mus musculus
ctgaaaaggaaatggatccagaata

SEQ ID NO: 24410 - DNA, 25 bp, Mus musculus
ctgaaaaggaggctgggcctctcca

SEQ ID NO: 24411 - DNA, 25 bp, Mus musculus
ctgaaaaggctctaaagaaacacaa

SEQ ID NO: 24412 - DNA, 25 bp, Mus musculus
ctgaaaattgagaagaccctgaaag

SEQ ID NO: 24413 - DNA, 25 bp, Mus musculus
ctgaaactcacacggtctggaagca

SEQ ID NO: 24414 - DNA, 25 bp, Mus musculus
ctgaaagacgaagctgatgcggatc

SEQ ID NO: 24415 - DNA, 25 bp, Mus musculus
ctgaaagactttgactctgtgcccc

SEQ ID NO: 24416 - DNA, 25 bp, Mus musculus
ctgaaatcccaggaggcctatgaga

SEQ ID NO: 24417 - DNA, 25 bp, Mus musculus
ctgaaatgtcccaggtgatgtggac

SEQ ID NO: 24418 - DNA, 25 bp, Mus musculus
ctgaaattaccccagatccagaaga

SEQ ID NO: 24419 - DNA, 25 bp, Mus musculus
ctgaacaaggtcagcactaagaggc

SEQ ID NO: 24420 - DNA, 25 bp, Mus musculus
ctgaacagacgcatccagctggttg

SEQ ID NO: 24421 - DNA, 25 bp, Mus musculus
ctgaacagcaaccacacaggctacg

SEQ ID NO: 24422 - DNA, 25 bp, Mus musculus
ctgaacatgggggagttgattgcac

SEQ ID NO: 24423 - DNA, 25 bp, Mus musculus
ctgaaccctgtctgccagacaatgc

SEQ ID NO: 24424 - DNA, 25 bp, Mus musculus
ctgaacctcacccagaaaatcaaga

SEQ ID NO: 24425 - DNA, 25 bp, Mus musculus
ctgaacctcaccgagaaaatcaaga

SEQ ID NO: 24426 - DNA, 25 bp, Mus musculus
ctgaacctgtatggaagcagctggc

SEQ ID NO: 24427 - DNA, 25 bp, Mus musculus
ctgaactttgccgagattggtagca

SEQ ID NO: 24428 - DNA, 25 bp, Mus musculus
ctgaagaaaatgaaacgataccaag

SEQ ID NO: 24429 - DNA, 25 bp, Mus musculus
ctgaagaaacgcacgggcccagcag

SEQ ID NO: 24430 - DNA, 25 bp, Mus musculus
ctgaagaaagaggacaccacctttg

SEQ ID NO: 24431 - DNA, 25 bp, Mus musculus
ctgaagaacacctctgtcttcgtta

SEQ ID NO: 24432 - DNA, 25 bp, Mus musculus
ctgaagaacggaagtggcaaggaca

SEQ ID NO: 24433 - DNA, 25 bp, Mus musculus
ctgaagaacttggaggtactaaact

SEQ ID NO: 24434 - DNA, 25 bp, Mus musculus
ctgaagaatataaacccaaacaggg

SEQ ID NO: 24435 - DNA, 25 bp, Mus musculus
ctgaagacgatgacgtgaatgagga

SEQ ID NO: 24436 - DNA, 25 bp, Mus musculus
ctgaagaggaatggcggctcctgca

SEQ ID NO: 24437 - DNA, 25 bp, Mus musculus
ctgaagaggaggtgcatgacctgac

SEQ ID NO: 24438 - DNA, 25 bp, Mus musculus
ctgaagatgaccttagaggagagac

SEQ ID NO: 24439 - DNA, 25 bp, Mus musculus
ctgaagatgctgaccggaagtatga

SEQ ID NO: 24440 - DNA, 25 bp, Mus musculus
ctgaagcagaagattgttataacac

SEQ ID NO: 24441 - DNA, 25 bp, Mus musculus
ctgaagcagcagtccactaaggggg

SEQ ID NO: 24442 - DNA, 25 bp, Mus musculus
ctgaagccacagctgtggaatgcag

SEQ ID NO: 24443 - DNA, 25 bp, Mus musculus
ctgaagcccaagaagccggcaaggc

SEQ ID NO: 24444 - DNA, 25 bp, Mus musculus
ctgaagcgtctgtttgttgttaaag

SEQ ID NO: 24445 - DNA, 25 bp, Mus musculus
ctgaagctaggtcgcgaccacgagc

SEQ ID NO: 24446 - DNA, 25 bp, Mus musculus
ctgaaggaaaaggagcgcaaggcaa

SEQ ID NO: 24447 - DNA, 25 bp, Mus musculus
ctgaaggaggccctgctgtttaaat

SEQ ID NO: 24448 - DNA, 25 bp, Mus musculus
ctgaaggcaaaatgaatgaggaaac

SEQ ID NO: 24449 - DNA, 25 bp, Mus musculus
ctgaagggccagatggaagccatcc

SEQ ID NO: 24450 - DNA, 25 bp, Mus musculus
ctgaaggtttggatacgagatgtga

SEQ ID NO: 24451 - DNA, 25 bp, Mus musculus
ctgaagtctgggttagtgggaccat

SEQ ID NO: 24452 - DNA, 25 bp, Mus musculus
ctgaagtggctgtggtatggaaaca

SEQ ID NO: 24453 - DNA, 25 bp, Mus musculus
ctgaagttatgaagatgcagagtct

SEQ ID NO: 24454 - DNA, 25 bp, Mus musculus
ctgaagtttatggtatagagaaaga

SEQ ID NO: 24455 - DNA, 25 bp, Mus musculus
ctgaataatcccctatttgctggaa

SEQ ID NO: 24456 - DNA, 25 bp, Mus musculus
ctgaatagtaatcacacaggctacg

SEQ ID NO: 24457 - DNA, 25 bp, Mus musculus
ctgaatatgagaggaacgggagata

SEQ ID NO: 24458 - DNA, 25 bp, Mus musculus
ctgaatcacattggagttctctgta

SEQ ID NO: 24459 - DNA, 25 bp, Mus musculus
ctgaatcagggcaccactgctcagc

SEQ ID NO: 24460 - DNA, 25 bp, Mus musculus
ctgaatcaggtttccaacaacatca

SEQ ID NO: 24461 - DNA, 25 bp, Mus musculus
ctgaatccttcacaggaaaatcttt

SEQ ID NO: 24462 - DNA, 25 bp, Mus musculus
ctgaatctgtgaaaaaactccgctc

SEQ ID NO: 24463 - DNA, 25 bp, Mus musculus
ctgaatggagtgtgtgttatatgga

SEQ ID NO: 24464 - DNA, 25 bp, Mus musculus
ctgaatggatcagaagtggtggttt

SEQ ID NO: 24465 - DNA, 25 bp, Mus musculus
ctgaatgggaatcactgcatccttc

SEQ ID NO: 24466 - DNA, 25 bp, Mus musculus
ctgaatggtgttcccacgcctgtcc

SEQ ID NO: 24467 - DNA, 25 bp, Mus musculus
ctgacaaaccaagtgaacatctgag

SEQ ID NO: 24468 - DNA, 25 bp, Mus musculus
ctgacaaaggttgtcttagctggcg

SEQ ID NO: 24469 - DNA, 25 bp, Mus musculus
ctgacaagtatctcgggccacagga

SEQ ID NO: 24470 - DNA, 25 bp, Mus musculus
ctgacactgagagctctatcatcat

SEQ ID NO: 24471 - DNA, 25 bp, Mus musculus
ctgacactgtccttctctcgtcaag

SEQ ID NO: 24472 - DNA, 25 bp, Mus musculus
ctgacagagatggtgtacatagatg

SEQ ID NO: 24473 - DNA, 25 bp, Mus musculus
ctgacagcaaggtcatctccagcta

SEQ ID NO: 24474 - DNA, 25 bp, Mus musculus
ctgacagcaccctgcggcagaatgg

SEQ ID NO: 24475 - DNA, 25 bp, Mus musculus
ctgacagcctacgtggtcaaggtct

SEQ ID NO: 24476 - DNA, 25 bp, Mus musculus
ctgacaggagatgaacttgagcaca

SEQ ID NO: 24477 - DNA, 25 bp, Mus musculus
ctgacagggagcgtgaggccatcct

SEQ ID NO: 24478 - DNA, 25 bp, Mus musculus
ctgacagggtggcttcctacctggt

SEQ ID NO: 24479 - DNA, 25 bp, Mus musculus
ctgacagtagaagaattgaaggcct

SEQ ID NO: 24480 - DNA, 25 bp, Mus musculus
ctgaccatcagttgccctgatgtag

SEQ ID NO: 24481 - DNA, 25 bp, Mus musculus
ctgaccatgcgtctgagaattcctt

SEQ ID NO: 24482 - DNA, 25 bp, Mus musculus
ctgacccagttgaaggctggcgtag

SEQ ID NO: 24483 - DNA, 25 bp, Mus musculus
ctgaccccaagaagaacaaaccatc

SEQ ID NO: 24484 - DNA, 25 bp, Mus musculus
ctgaccccactggagcctttgggaa

SEQ ID NO: 24485 - DNA, 25 bp, Mus musculus
ctgaccccagccagcgtagacagtt

SEQ ID NO: 24486 - DNA, 25 bp, Mus musculus
ctgaccccgacaggcatattaatct

SEQ ID NO: 24487 - DNA, 25 bp, Mus musculus
ctgaccctcaatgtcaagagtgaaa

SEQ ID NO: 24488 - DNA, 25 bp, Mus musculus
ctgaccctgaactcaaagcaatcct

SEQ ID NO: 24489 - DNA, 25 bp, Mus musculus
ctgacccttctgttgataaagatgg

SEQ ID NO: 24490 - DNA, 25 bp, Mus musculus
ctgaccgtcagcaacattggcatca

SEQ ID NO: 24491 - DNA, 25 bp, Mus musculus
ctgaccgtggcaggatgcatctata

SEQ ID NO: 24492 - DNA, 25 bp, Mus musculus
ctgacctagcagctgcagaggactg

SEQ ID NO: 24493 - DNA, 25 bp, Mus musculus
ctgacctgagccttctggaccgctg

SEQ ID NO: 24494 - DNA, 25 bp, Mus musculus
ctgacctgatttctgtactgtggga

SEQ ID NO: 24495 - DNA, 25 bp, Mus musculus
ctgaccttgtgtttggtgctgctcg

SEQ ID NO: 24496 - DNA, 25 bp, Mus musculus
ctgacgacatgggatcaaaaggcct

SEQ ID NO: 24497 - DNA, 25 bp, Mus musculus
ctgacgacgggcttggtccaagctc

SEQ ID NO: 24498 - DNA, 25 bp, Mus musculus
ctgacgacttcgtgggacaatgcca

SEQ ID NO: 24499 - DNA, 25 bp, Mus musculus
ctgacgagcagcaggatgccatgga

SEQ ID NO: 24500 - DNA, 25 bp, Mus musculus
ctgacgatctgactctcacatctgg

SEQ ID NO: 24501 - DNA, 25 bp, Mus musculus
ctgacgatctgagtctcacatctgg

SEQ ID NO: 24502 - DNA, 25 bp, Mus musculus
ctgacgatttctctagggctctgca

SEQ ID NO: 24503 - DNA, 25 bp, Mus musculus
ctgacgcccagagtttgagtcccag

SEQ ID NO: 24504 - DNA, 25 bp, Mus musculus
ctgacgcttcgccaaattgttttga

SEQ ID NO: 24505 - DNA, 25 bp, Mus musculus
ctgacgtcaagaccccaatggctaa

SEQ ID NO: 24506 - DNA, 25 bp, Mus musculus
ctgactcaagagactctcctctcag

SEQ ID NO: 24507 - DNA, 25 bp, Mus musculus
ctgactcattagtagagagcagtga

SEQ ID NO: 24508 - DNA, 25 bp, Mus musculus
ctgactctgaaaagccctgcctatc

SEQ ID NO: 24509 - DNA, 25 bp, Mus musculus
ctgactctgactcccgcatcaatgg

SEQ ID NO: 24510 - DNA, 25 bp, Mus musculus
ctgactgatgaggatacaagaaacc

SEQ ID NO: 24511 - DNA, 25 bp, Mus musculus
ctgactgcagatcccataggaacca

SEQ ID NO: 24512 - DNA, 25 bp, Mus musculus
ctgactgcgcgagaagagcaggacc

SEQ ID NO: 24513 - DNA, 25 bp, Mus musculus
ctgactggaggaccccgaactgcaa

SEQ ID NO: 24514 - DNA, 25 bp, Mus musculus
ctgactggttggacagcatacggcc

SEQ ID NO: 24515 - DNA, 25 bp, Mus musculus
ctgactgtgcatgggcgcaccaagg

SEQ ID NO: 24516 - DNA, 25 bp, Mus musculus
ctgactgtggcttctggtcttgctg

SEQ ID NO: 24517 - DNA, 25 bp, Mus musculus
ctgactgtggttgtactggaggctc

SEQ ID NO: 24518 - DNA, 25 bp, Mus musculus
ctgacttccgggagtggatcttcaa

SEQ ID NO: 24519 - DNA, 25 bp, Mus musculus
ctgacttcggagattataaccagtt

SEQ ID NO: 24520 - DNA, 25 bp, Mus musculus
ctgactttgcaaaatgacccgccca

SEQ ID NO: 24521 - DNA, 25 bp, Mus musculus
ctgagaaagaaaaggacagtgctcc

SEQ ID NO: 24522 - DNA, 25 bp, Mus musculus
ctgagaaagtgcaggccatgtttac

SEQ ID NO: 24523 - DNA, 25 bp, Mus musculus
ctgagaaccgctcccactagacgaa

SEQ ID NO: 24524 - DNA, 25 bp, Mus musculus
ctgagaagagtctaaaatggagtct

SEQ ID NO: 24525 - DNA, 25 bp, Mus musculus
ctgagaagggctatgaagaatggct

SEQ ID NO: 24526 - DNA, 25 bp, Mus musculus
ctgagaagtcgtcctcttcagaaag

SEQ ID NO: 24527 - DNA, 25 bp, Mus musculus
ctgagaatgccgagcgcagccggat

SEQ ID NO: 24528 - DNA, 25 bp, Mus musculus
ctgagaattacttaacaactgtatg

SEQ ID NO: 24529 - DNA, 25 bp, Mus musculus
ctgagacagtcattacatctgtagg

SEQ ID NO: 24530 - DNA, 25 bp, Mus musculus
ctgagaccatagagttctaagaata

SEQ ID NO: 24531 - DNA, 25 bp, Mus musculus
ctgagacccaggcagattcaggagc

SEQ ID NO: 24532 - DNA, 25 bp, Mus musculus
ctgagacccgagaggtggatgccca

SEQ ID NO: 24533 - DNA, 25 bp, Mus musculus
ctgagactcacagccggaaatggca

SEQ ID NO: 24534 - DNA, 25 bp, Mus musculus
ctgagactcagaatggtgaagtaac

SEQ ID NO: 24535 - DNA, 25 bp, Mus musculus
ctgagactgacatcggagccagagg

SEQ ID NO: 24536 - DNA, 25 bp, Mus musculus
ctgagagccccatggctttgttggc

SEQ ID NO: 24537 - DNA, 25 bp, Mus musculus
ctgagagccgtggtccggaacctca

SEQ ID NO: 24538 - DNA, 25 bp, Mus musculus
ctgagatagtagatgttggagacaa

SEQ ID NO: 24539 - DNA, 25 bp, Mus musculus
ctgagatcaatgcaaaaaggaagag

SEQ ID NO: 24540 - DNA, 25 bp, Mus musculus
ctgagatcaatggaaaaaggaagag

SEQ ID NO: 24541 - DNA, 25 bp, Mus musculus
ctgagatctggacctggcttcggaa

SEQ ID NO: 24542 - DNA, 25 bp, Mus musculus
ctgagatctggagctggcttcggaa

SEQ ID NO: 24543 - DNA, 25 bp, Mus musculus
ctgagatggagggaaagtacatcat

SEQ ID NO: 24544 - DNA, 25 bp, Mus musculus
ctgagatggcatccgctagtgagcc

SEQ ID NO: 24545 - DNA, 25 bp, Mus musculus
ctgagatttctgctaagtgatgtta

SEQ ID NO: 24546 - DNA, 25 bp, Mus musculus
ctgagcaagaggaggacctatgctg

SEQ ID NO: 24547 - DNA, 25 bp, Mus musculus
ctgagcaccctgaactgcatgccga

SEQ ID NO: 24548 - DNA, 25 bp, Mus musculus
ctgagcagcaatgactcctgggaac

SEQ ID NO: 24549 - DNA, 25 bp, Mus musculus
ctgagcatgtattcctgtgtctggt

SEQ ID NO: 24550 - DNA, 25 bp, Mus musculus
ctgagccagcagctaaaaagccgcc

SEQ ID NO: 24551 - DNA, 25 bp, Mus musculus
ctgagccaggtgaagggccccgtaa

SEQ ID NO: 24552 - DNA, 25 bp, Mus musculus
ctgagcctcctctgcctgttgcaga

SEQ ID NO: 24553 - DNA, 25 bp, Mus musculus
ctgagcctgccaaacctggagatct

SEQ ID NO: 24554 - DNA, 25 bp, Mus musculus
ctgagcctgttggtccttctagcag

SEQ ID NO: 24555 - DNA, 25 bp, Mus musculus
ctgagcgcagccgagcgtgccaaga

SEQ ID NO: 24556 - DNA, 25 bp, Mus musculus
ctgagcgcggcagcatccagaatgc

SEQ ID NO: 24557 - DNA, 25 bp, Mus musculus
ctgagcgggaagaccttgaggaatc

SEQ ID NO: 24558 - DNA, 25 bp, Mus musculus
ctgagctcctacctggttttcgggc

SEQ ID NO: 24559 - DNA, 25 bp, Mus musculus
ctgagcttgctgtggagtgtacagt

SEQ ID NO: 24560 - DNA, 25 bp, Mus musculus
ctgaggaatagtatgagaaactgga

SEQ ID NO: 24561 - DNA, 25 bp, Mus musculus
ctgaggactcacccagcagagagga

SEQ ID NO: 24562 - DNA, 25 bp, Mus musculus
ctgaggagaacatggccacccattt

SEQ ID NO: 24563 - DNA, 25 bp, Mus musculus
ctgaggagggcagcacaattcctct

SEQ ID NO: 24564 - DNA, 25 bp, Mus musculus
ctgaggaggtctgctcttgtttggt

SEQ ID NO: 24565 - DNA, 25 bp, Mus musculus
ctgaggatattcaaatgggtgcctg

SEQ ID NO: 24566 - DNA, 25 bp, Mus musculus
ctgaggatgacgtccagctccagct

SEQ ID NO: 24567 - DNA, 25 bp, Mus musculus
ctgaggcaaaagctgtggcttccgc

SEQ ID NO: 24568 - DNA, 25 bp, Mus musculus
ctgaggcaaaaggtgtggcttccgc

SEQ ID NO: 24569 - DNA, 25 bp, Mus musculus
ctgaggcaagccaagtgatcattaa

SEQ ID NO: 24570 - DNA, 25 bp, Mus musculus
ctgaggcagtttgacctggcctggc

SEQ ID NO: 24571 - DNA, 25 bp, Mus musculus
ctgaggccaaaaaacattgctggta

SEQ ID NO: 24572 - DNA, 25 bp, Mus musculus
ctgaggccaaccagcagcagactcg

SEQ ID NO: 24573 - DNA, 25 bp, Mus musculus
ctgaggctgcatgtctatacagagg

SEQ ID NO: 24574 - DNA, 25 bp, Mus musculus
ctgaggcttatcttaaaatgaccac

SEQ ID NO: 24575 - DNA, 25 bp, Mus musculus
ctgagggagaggacatttaaaggtc

SEQ ID NO: 24576 - DNA, 25 bp, Mus musculus
ctgagtacaataacctgaagagtgc

SEQ ID NO: 24577 - DNA, 25 bp, Mus musculus
ctgagtcccctaggtaccagaactt

SEQ ID NO: 24578 - DNA, 25 bp, Mus musculus
ctgagtcctgccacaggccctggga

SEQ ID NO: 24579 - DNA, 25 bp, Mus musculus
ctgagtcttaaggacatggatttga

SEQ ID NO: 24580 - DNA, 25 bp, Mus musculus
ctgagtgatcgctctcgtgaacgca

SEQ ID NO: 24581 - DNA, 25 bp, Mus musculus
ctgagtgtgaccagtaccgcaccat

SEQ ID NO: 24582 - DNA, 25 bp, Mus musculus
ctgagtgtgtggaggccgacagcgg

SEQ ID NO: 24583 - DNA, 25 bp, Mus musculus
ctgataatatacatgtacaaagaca

SEQ ID NO: 24584 - DNA, 25 bp, Mus musculus
ctgataatcagccttaagctgtgtg

SEQ ID NO: 24585 - DNA, 25 bp, Mus musculus
ctgataatgactctgcagacctgaa

SEQ ID NO: 24586 - DNA, 25 bp, Mus musculus
ctgataccgtcctctgctcgggcag

SEQ ID NO: 24587 - DNA, 25 bp, Mus musculus
ctgatactgggctgctgggcgcaca

SEQ ID NO: 24588 - DNA, 25 bp, Mus musculus
ctgatagctccgtgcagcgcccagg

SEQ ID NO: 24589 - DNA, 25 bp, Mus musculus
ctgatagtaagcctggccctctctg

SEQ ID NO: 24590 - DNA, 25 bp, Mus musculus
ctgatattagcttcatgtgtagcag

SEQ ID NO: 24591 - DNA, 25 bp, Mus musculus
ctgatcacaggctgaatgaagccaa

SEQ ID NO: 24592 - DNA, 25 bp, Mus musculus
ctgatcatttcaaacctttgtgggc

SEQ ID NO: 24593 - DNA, 25 bp, Mus musculus
ctgatccctgacagtgcggacacca

SEQ ID NO: 24594 - DNA, 25 bp, Mus musculus
ctgatcctggacgaggccaccagtg

SEQ ID NO: 24595 - DNA, 25 bp, Mus musculus
ctgatctgggacaatggcatggtcc

SEQ ID NO: 24596 - DNA, 25 bp, Mus musculus
ctgatcttggaaatgtggagctggt

SEQ ID NO: 24597 - DNA, 25 bp, Mus musculus
ctgatgaactatagcaatgagaatg

SEQ ID NO: 24598 - DNA, 25 bp, Mus musculus
ctgatgaacttcctgtatacgtggg

SEQ ID NO: 24599 - DNA, 25 bp, Mus musculus
ctgatgaagagactagcagctcgct

SEQ ID NO: 24600 - DNA, 25 bp, Mus musculus
ctgatgaagagtttgacgaactgtg

SEQ ID NO: 24601 - DNA, 25 bp, Mus musculus
ctgatgacaaacctgaagaccaccc

SEQ ID NO: 24602 - DNA, 25 bp, Mus musculus
ctgatgacaacaaacgtgtggctga

SEQ ID NO: 24603 - DNA, 25 bp, Mus musculus
ctgatgagccaagaagtgcctgaag

SEQ ID NO: 24604 - DNA, 25 bp, Mus musculus
ctgatgagctgcttccgagtctgtg

SEQ ID NO: 24605 - DNA, 25 bp, Mus musculus
ctgatgaggctgacctggtccctgc

SEQ ID NO: 24606 - DNA, 25 bp, Mus musculus
ctgatgaggctgtggcagaagataa

SEQ ID NO: 24607 - DNA, 25 bp, Mus musculus
ctgatgagtacattgagaaactggc

SEQ ID NO: 24608 - DNA, 25 bp, Mus musculus
ctgatgcagatgttcctccctttcg

SEQ ID NO: 24609 - DNA, 25 bp, Mus musculus
ctgatgcccgctgcaagctggctga

SEQ ID NO: 24610 - DNA, 25 bp, Mus musculus
ctgatgctgatgtcaaaatgaaatc

SEQ ID NO: 24611 - DNA, 25 bp, Mus musculus
ctgatgctgctaacaaggaaattgc

SEQ ID NO: 24612 - DNA, 25 bp, Mus musculus
ctgatgctggacgttggaggttaca

SEQ ID NO: 24613 - DNA, 25 bp, Mus musculus
ctgatggaattggaaaagcatatgc

SEQ ID NO: 24614 - DNA, 25 bp, Mus musculus
ctgatggacatatagggatcttgaa

SEQ ID NO: 24615 - DNA, 25 bp, Mus musculus
ctgatggaggataccgaagactggc

SEQ ID NO: 24616 - DNA, 25 bp, Mus musculus
ctgatggagtgcctttgtacccgcc

SEQ ID NO: 24617 - DNA, 25 bp, Mus musculus
ctgatggagtgcgtttgtacccgcc

SEQ ID NO: 24618 - DNA, 25 bp, Mus musculus
ctgatggattctggacgagctccaa

SEQ ID NO: 24619 - DNA, 25 bp, Mus musculus
ctgatggccccgtgatgtggcatat

SEQ ID NO: 24620 - DNA, 25 bp, Mus musculus
ctgatgggaccacagtagagccacc

SEQ ID NO: 24621 - DNA, 25 bp, Mus musculus
ctgatgggagatgccgctcatgcca

SEQ ID NO: 24622 - DNA, 25 bp, Mus musculus
ctgatgggctgaagcgagcactcag

SEQ ID NO: 24623 - DNA, 25 bp, Mus musculus
ctgatgggtctgatgacacctttgc

SEQ ID NO: 24624 - DNA, 25 bp, Mus musculus
ctgatggtagatcctgcctccaagt

SEQ ID NO: 24625 - DNA, 25 bp, Mus musculus
ctgatgtcgtcgtcatgatgctgga

SEQ ID NO: 24626 - DNA, 25 bp, Mus musculus
ctgatgttactacgcctcagcaagc

SEQ ID NO: 24627 - DNA, 25 bp, Mus musculus
ctgattaaagtcatccacttgctgg

SEQ ID NO: 24628 - DNA, 25 bp, Mus musculus
ctgattcagtgatgtcttgctttaa

SEQ ID NO: 24629 - DNA, 25 bp, Mus musculus
ctgattctctggagcaggtgctggc

SEQ ID NO: 24630 - DNA, 25 bp, Mus musculus
ctgattctgatgatattaaggcaaa

SEQ ID NO: 24631 - DNA, 25 bp, Mus musculus
ctgattgaaaatgcagacgctgtgt

SEQ ID NO: 24632 - DNA, 25 bp, Mus musculus
ctgattgacaaggaggagaccgcgc

SEQ ID NO: 24633 - DNA, 25 bp, Mus musculus
ctgattgtgcagagctcggactgca

SEQ ID NO: 24634 - DNA, 25 bp, Mus musculus
ctgatttaagaaggatcctgacaga

SEQ ID NO: 24635 - DNA, 25 bp, Mus musculus
ctgatttgaaggcagactcaatcaa

SEQ ID NO: 24636 - DNA, 25 bp, Mus musculus
ctgatttgtctccagggtacctggg

SEQ ID NO: 24637 - DNA, 25 bp, Mus musculus
ctgattttagaagaagctgaaaagc

SEQ ID NO: 24638 - DNA, 25 bp, Mus musculus
ctgcaaagagggaccagcagccact

SEQ ID NO: 24639 - DNA, 25 bp, Mus musculus
ctgcaacagtggctgtaagaaatcc

SEQ ID NO: 24640 - DNA, 25 bp, Mus musculus
ctgcaagagagactgccctcccttg

SEQ ID NO: 24641 - DNA, 25 bp, Mus musculus
ctgcaagtgagaacgtatttaacag

SEQ ID NO: 24642 - DNA, 25 bp, Mus musculus
ctgcaagtgtatccaatattcacag

SEQ ID NO: 24643 - DNA, 25 bp, Mus musculus
ctgcaatgaagctactggagcggga

SEQ ID NO: 24644 - DNA, 25 bp, Mus musculus
ctgcaattatacattcctgggtgtg

SEQ ID NO: 24645 - DNA, 25 bp, Mus musculus
ctgcaatttagaaagccaggcaatg

SEQ ID NO: 24646 - DNA, 25 bp, Mus musculus
ctgcaatttagatagccaggcaatg

SEQ ID NO: 24647 - DNA, 25 bp, Mus musculus
ctgcacaaggacagtggcttccggg

SEQ ID NO: 24648 - DNA, 25 bp, Mus musculus
ctgcacaaggactgtggcttccggg

SEQ ID NO: 24649 - DNA, 25 bp, Mus musculus
ctgcacagctctcctggtggctgtg

SEQ ID NO: 24650 - DNA, 25 bp, Mus musculus
ctgcacaggagcgtttcctgggcag

SEQ ID NO: 24651 - DNA, 25 bp, Mus musculus
ctgcacatgccccacaggatttgtt

SEQ ID NO: 24652 - DNA, 25 bp, Mus musculus
ctgcacattcgctctcagcactggg

SEQ ID NO: 24653 - DNA, 25 bp, Mus musculus
ctgcacccgcttataaatgcctttg

SEQ ID NO: 24654 - DNA, 25 bp, Mus musculus
ctgcacctggccgtggagtacgaca

SEQ ID NO: 24655 - DNA, 25 bp, Mus musculus
ctgcacgagaaaccgtctggctaga

SEQ ID NO: 24656 - DNA, 25 bp, Mus musculus
ctgcacgtctgtccgtagcctgctg

SEQ ID NO: 24657 - DNA, 25 bp, Mus musculus
ctgcactgcaccatcttagcatcgg

SEQ ID NO: 24658 - DNA, 25 bp, Mus musculus
ctgcagaagctttctgcatgggaac

SEQ ID NO: 24659 - DNA, 25 bp, Mus musculus
ctgcagaagggcagctgaacggtct

SEQ ID NO: 24660 - DNA, 25 bp, Mus musculus
ctgcagaccagtgtattctaaaaag

SEQ ID NO: 24661 - DNA, 25 bp, Mus musculus
ctgcagagcaggcaaagttcctgat

SEQ ID NO: 24662 - DNA, 25 bp, Mus musculus
ctgcagagcagggaaagttcctgat

SEQ ID NO: 24663 - DNA, 25 bp, Mus musculus
ctgcagagctggagcccttagctga

SEQ ID NO: 24664 - DNA, 25 bp, Mus musculus
ctgcagatatctacctaatcgattg

SEQ ID NO: 24665 - DNA, 25 bp, Mus musculus
ctgcagatccttgcctgagacggtt

SEQ ID NO: 24666 - DNA, 25 bp, Mus musculus
ctgcagatgcctgtgatgggcatga

SEQ ID NO: 24667 - DNA, 25 bp, Mus musculus
ctgcagatggcaatagaggagagca

SEQ ID NO: 24668 - DNA, 25 bp, Mus musculus
ctgcagcactctcccgggaatacaa

SEQ ID NO: 24669 - DNA, 25 bp, Mus musculus
ctgcagcagctgatcggccggctca

SEQ ID NO: 24670 - DNA, 25 bp, Mus musculus
ctgcagcgcaccatgaatgagatct

SEQ ID NO: 24671 - DNA, 25 bp, Mus musculus
ctgcagcggcagaagtgaaccttgt

SEQ ID NO: 24672 - DNA, 25 bp, Mus musculus
ctgcagctggacacttgccactgtg

SEQ ID NO: 24673 - DNA, 25 bp, Mus musculus
ctgcagcttggtgtcactgacgctg

SEQ ID NO: 24674 - DNA, 25 bp, Mus musculus
ctgcaggaatgagcacacaaatgag

SEQ ID NO: 24675 - DNA, 25 bp, Mus musculus
ctgcaggcgaagctacagctgcgct

SEQ ID NO: 24676 - DNA, 25 bp, Mus musculus
ctgcaggcgcagtggaaggcccaca

SEQ ID NO: 24677 - DNA, 25 bp, Mus musculus
ctgcagggtatagcacagccatggc

SEQ ID NO: 24678 - DNA, 25 bp, Mus musculus
ctgcagggtgcgtggtgtacccctc

SEQ ID NO: 24679 - DNA, 25 bp, Mus musculus
ctgcaggtgagagcctcctcacttg

SEQ ID NO: 24680 - DNA, 25 bp, Mus musculus
ctgcagtaatggatgctccgcgccg

SEQ ID NO: 24681 - DNA, 25 bp, Mus musculus
ctgcagtatgagaacgtggatgaag

SEQ ID NO: 24682 - DNA, 25 bp, Mus musculus
ctgcagtcctggctattccagagct

SEQ ID NO: 24683 - DNA, 25 bp, Mus musculus
ctgcagtctgacctctacactctga

SEQ ID NO: 24684 - DNA, 25 bp, Mus musculus
ctgcagtctgtttatgagtgtatag

SEQ ID NO: 24685 - DNA, 25 bp, Mus musculus
ctgcagtgaagacccgccaagcttt

SEQ ID NO: 24686 - DNA, 25 bp, Mus musculus
ctgcagtgcaggaaccactgaagcc

SEQ ID NO: 24687 - DNA, 25 bp, Mus musculus
ctgcagtgccagactttggaggctg

SEQ ID NO: 24688 - DNA, 25 bp, Mus musculus
ctgcagtggctgaacgaggctcgca

SEQ ID NO: 24689 - DNA, 25 bp, Mus musculus
ctgcagtgtaacctcacttccagct

SEQ ID NO: 24690 - DNA, 25 bp, Mus musculus
ctgcataaagagattggtcaactaa

SEQ ID NO: 24691 - DNA, 25 bp, Mus musculus
ctgcataatctcctgctccatcagg

SEQ ID NO: 24692 - DNA, 25 bp, Mus musculus
ctgcatatgaaagagtagtttacaa

SEQ ID NO: 24693 - DNA, 25 bp, Mus musculus
ctgcatcaacaaattgggtggctat

SEQ ID NO: 24694 - DNA, 25 bp, Mus musculus
ctgcatcacagaagctggaagttct

SEQ ID NO: 24695 - DNA, 25 bp, Mus musculus
ctgcatcgccactgaacaaccaagg

SEQ ID NO: 24696 - DNA, 25 bp, Mus musculus
ctgcatctcctgacatctgaccata

SEQ ID NO: 24697 - DNA, 25 bp, Mus musculus
ctgcatctctgttccatgtttctaa

SEQ ID NO: 24698 - DNA, 25 bp, Mus musculus
ctgcatctgagcctgtgataccctc

SEQ ID NO: 24699 - DNA, 25 bp, Mus musculus
ctgcatggaagttggaaatttggac

SEQ ID NO: 24700 - DNA, 25 bp, Mus musculus
ctgcatgtagcagcgcattacgata

SEQ ID NO: 24701 - DNA, 25 bp, Mus musculus
ctgcatgtatgggaatggcaaagac

SEQ ID NO: 24702 - DNA, 25 bp, Mus musculus
ctgcatgtcaccctgtgtgggaccc

SEQ ID NO: 24703 - DNA, 25 bp, Mus musculus
ctgcatttgtctcagctgctggttg

SEQ ID NO: 24704 - DNA, 25 bp, Mus musculus
ctgcatttgtctgagctgctggttg

SEQ ID NO: 24705 - DNA, 25 bp, Mus musculus
ctgccaaagtggctgcgtctgactg

SEQ ID NO: 24706 - DNA, 25 bp, Mus musculus
ctgccaactacacacagtttgggct

SEQ ID NO: 24707 - DNA, 25 bp, Mus musculus
ctgccaatcactgaattctcagaca

SEQ ID NO: 24708 - DNA, 25 bp, Mus musculus
ctgccacacttgtgctgaccagtga

SEQ ID NO: 24709 - DNA, 25 bp, Mus musculus
ctgccacagcaagggaatcatgcac

SEQ ID NO: 24710 - DNA, 25 bp, Mus musculus
ctgccacaggcaccggaagctgaga

SEQ ID NO: 24711 - DNA, 25 bp, Mus musculus
ctgccacgtgtgtcctggctgtgga

SEQ ID NO: 24712 - DNA, 25 bp, Mus musculus
ctgccagaaggcgaaggtctccttc

SEQ ID NO: 24713 - DNA, 25 bp, Mus musculus
ctgccagaatctccacggtggcttc

SEQ ID NO: 24714 - DNA, 25 bp, Mus musculus
ctgccagaggcaaagcgtcaggtcc

SEQ ID NO: 24715 - DNA, 25 bp, Mus musculus
ctgccaggagcagattgtcgcccag

SEQ ID NO: 24716 - DNA, 25 bp, Mus musculus
ctgccatgcctatgactattttaaa

SEQ ID NO: 24717 - DNA, 25 bp, Mus musculus
ctgccatgtggatgcccctggccaa

SEQ ID NO: 24718 - DNA, 25 bp, Mus musculus
ctgccattcacggaggctgcattgg

SEQ ID NO: 24719 - DNA, 25 bp, Mus musculus
ctgcccaaactccaaaatgatgata

SEQ ID NO: 24720 - DNA, 25 bp, Mus musculus
ctgcccaccaggtcgctctggatat

SEQ ID NO: 24721 - DNA, 25 bp, Mus musculus
ctgcccagactcagataatagctgg

SEQ ID NO: 24722 - DNA, 25 bp, Mus musculus
ctgcccagttcggtgatgggaagca

SEQ ID NO: 24723 - DNA, 25 bp, Mus musculus
ctgcccatcgactttccagaagaaa

SEQ ID NO: 24724 - DNA, 25 bp, Mus musculus
ctgccccagtccatgaagattatgc

SEQ ID NO: 24725 - DNA, 25 bp, Mus musculus
ctgccccagtggaaagctaaccctg

SEQ ID NO: 24726 - DNA, 25 bp, Mus musculus
ctgccccataaacattgaggaatag

SEQ ID NO: 24727 - DNA, 25 bp, Mus musculus
ctgccccttactcagcacatgaaat

SEQ ID NO: 24728 - DNA, 25 bp, Mus musculus
ctgccctgatggaggcaaattccac

SEQ ID NO: 24729 - DNA, 25 bp, Mus musculus
ctgccctgatgggaagacaattgag

SEQ ID NO: 24730 - DNA, 25 bp, Mus musculus
ctgcccttcaggtgggagaggcact

SEQ ID NO: 24731 - DNA, 25 bp, Mus musculus
ctgcccttcggagcgagtgactgtg

SEQ ID NO: 24732 - DNA, 25 bp, Mus musculus
ctgccgcatggaacgtctgcagaag

SEQ ID NO: 24733 - DNA, 25 bp, Mus musculus
ctgccgctgcttcataggcactgtg

SEQ ID NO: 24734 - DNA, 25 bp, Mus musculus
ctgccggaagacgacgtggactaca

SEQ ID NO: 24735 - DNA, 25 bp, Mus musculus
ctgccggaggcgtgggcctacacct

SEQ ID NO: 24736 - DNA, 25 bp, Mus musculus
ctgccggctgaagctgaactgatgt

SEQ ID NO: 24737 - DNA, 25 bp, Mus musculus
ctgccgttctggtggaggatatgac

SEQ ID NO: 24738 - DNA, 25 bp, Mus musculus
ctgcctatggatctttgagtaatga

SEQ ID NO: 24739 - DNA, 25 bp, Mus musculus
ctgcctatggatgtttgagtaatga

SEQ ID NO: 24740 - DNA, 25 bp, Mus musculus
ctgcctccagagcatcaggaacgtt

SEQ ID NO: 24741 - DNA, 25 bp, Mus musculus
ctgcctccttctgcagcggaagatg

SEQ ID NO: 24742 - DNA, 25 bp, Mus musculus
ctgcctgccaagtgtccgggaaagg

SEQ ID NO: 24743 - DNA, 25 bp, Mus musculus
ctgcctgccgctctgcagtgaggat

SEQ ID NO: 24744 - DNA, 25 bp, Mus musculus
ctgcctgccgctgtgcagtgaggat

SEQ ID NO: 24745 - DNA, 25 bp, Mus musculus
ctgcctggccagtggagaagtcatg

SEQ ID NO: 24746 - DNA, 25 bp, Mus musculus
ctgcctggcgtcagcagcggcgctt

SEQ ID NO: 24747 - DNA, 25 bp, Mus musculus
ctgcctggtggagctcggtaccttg

SEQ ID NO: 24748 - DNA, 25 bp, Mus musculus
ctgcctgtggaatacggaggcacca

SEQ ID NO: 24749 - DNA, 25 bp, Mus musculus
ctgcctgtgtacaatgcggaagtgg

SEQ ID NO: 24750 - DNA, 25 bp, Mus musculus
ctgcctgtgtgcctccaggataata

SEQ ID NO: 24751 - DNA, 25 bp, Mus musculus
ctgcctgttctgcacaaaggatggg

SEQ ID NO: 24752 - DNA, 25 bp, Mus musculus
ctgcctgtttctgctacttctagga

SEQ ID NO: 24753 - DNA, 25 bp, Mus musculus
ctgccttcatgactggaaagttggg

SEQ ID NO: 24754 - DNA, 25 bp, Mus musculus
ctgccttgataaacttggtgaccaa

SEQ ID NO: 24755 - DNA, 25 bp, Mus musculus
ctgccttggctgtcgaagagcttgg

SEQ ID NO: 24756 - DNA, 25 bp, Mus musculus
ctgccttgggcaggggatttaacac

SEQ ID NO: 24757 - DNA, 25 bp, Mus musculus
ctgcgaagaacaagctccgggtgaa

SEQ ID NO: 24758 - DNA, 25 bp, Mus musculus
ctgcgaccaccggagggaagacgac

SEQ ID NO: 24759 - DNA, 25 bp, Mus musculus
ctgcgacgcagacggactttccgga

SEQ ID NO: 24760 - DNA, 25 bp, Mus musculus
ctgcgacgcagagggactttccgga

SEQ ID NO: 24761 - DNA, 25 bp, Mus musculus
ctgcgacgccacatgatcatccatt

SEQ ID NO: 24762 - DNA, 25 bp, Mus musculus
ctgcgagactggctgtatgaacaca

SEQ ID NO: 24763 - DNA, 25 bp, Mus musculus
ctgcgattggtgaacaaacagaaaa

SEQ ID NO: 24764 - DNA, 25 bp, Mus musculus
ctgcgattttattgagctatggctg

SEQ ID NO: 24765 - DNA, 25 bp, Mus musculus
ctgcgccctggagagagaagcgtct

SEQ ID NO: 24766 - DNA, 25 bp, Mus musculus
ctgcgctgtcaggaggagcgtcttt

SEQ ID NO: 24767 - DNA, 25 bp, Mus musculus
ctgcggaagcgtttcctgcttttct

SEQ ID NO: 24768 - DNA, 25 bp, Mus musculus
ctgcggaatcatggcattgctggcc

SEQ ID NO: 24769 - DNA, 25 bp, Mus musculus
ctgcggaatttaggcatgggaaaaa

SEQ ID NO: 24770 - DNA, 25 bp, Mus musculus
ctgcggataaagagagacttgccag

SEQ ID NO: 24771 - DNA, 25 bp, Mus musculus
ctgcggatcaaagctgcgaagagtg

SEQ ID NO: 24772 - DNA, 25 bp, Mus musculus
ctgcgggaccgtgctgagaagatcc

SEQ ID NO: 24773 - DNA, 25 bp, Mus musculus
ctgcgggcagtgtcaccgaccttgc

SEQ ID NO: 24774 - DNA, 25 bp, Mus musculus
ctgcgggctttgtgtgtgtccctgt

SEQ ID NO: 24775 - DNA, 25 bp, Mus musculus
ctgcggtacctgcaccagcaatggg

SEQ ID NO: 24776 - DNA, 25 bp, Mus musculus
ctgcgtaattcgaattgacttggtt

SEQ ID NO: 24777 - DNA, 25 bp, Mus musculus
ctgcgtctgccctctgagggctgga

SEQ ID NO: 24778 - DNA, 25 bp, Mus musculus
ctgctaaaagtatggaaaggactgt

SEQ ID NO: 24779 - DNA, 25 bp, Mus musculus
ctgctacagctgagaagacacagct

SEQ ID NO: 24780 - DNA, 25 bp, Mus musculus
ctgctacagggatcccgggtaccca

SEQ ID NO: 24781 - DNA, 25 bp, Mus musculus
ctgctactattacagagtactgcag

SEQ ID NO: 24782 - DNA, 25 bp, Mus musculus
ctgctacttctaggaaggaatgatc

SEQ ID NO: 24783 - DNA, 25 bp, Mus musculus
ctgctatacattgaacccggtgctt

SEQ ID NO: 24784 - DNA, 25 bp, Mus musculus
ctgctatgatgagtttggtttccgt

SEQ ID NO: 24785 - DNA, 25 bp, Mus musculus
ctgctattgaaagagagtatgcaca

SEQ ID NO: 24786 - DNA, 25 bp, Mus musculus
ctgctcaggagctagcagagggaca

SEQ ID NO: 24787 - DNA, 25 bp, Mus musculus
ctgctcataaacgactttgggagag

SEQ ID NO: 24788 - DNA, 25 bp, Mus musculus
ctgctcatcaagaagacctgaattc

SEQ ID NO: 24789 - DNA, 25 bp, Mus musculus
ctgctcatcctctgcttgggaatga

SEQ ID NO: 24790 - DNA, 25 bp, Mus musculus
ctgctcatcgggaactttggcctga

SEQ ID NO: 24791 - DNA, 25 bp, Mus musculus
ctgctcatgcccagctggattctct

SEQ ID NO: 24792 - DNA, 25 bp, Mus musculus
ctgctccaggctggtcactgaacag

SEQ ID NO: 24793 - DNA, 25 bp, Mus musculus
ctgctccagtaggaggagctgaaga

SEQ ID NO: 24794 - DNA, 25 bp, Mus musculus
ctgctcctggtcttctgctcctgga

SEQ ID NO: 24795 - DNA, 25 bp, Mus musculus
ctgctctgctggagcggtctgctcc

SEQ ID NO: 24796 - DNA, 25 bp, Mus musculus
ctgctctgtagatctgaaggactgg

SEQ ID NO: 24797 - DNA, 25 bp, Mus musculus
ctgctcttcagggaggtcagttttt

SEQ ID NO: 24798 - DNA, 25 bp, Mus musculus
ctgctcttccgcaatagacctgttc

SEQ ID NO: 24799 - DNA, 25 bp, Mus musculus
ctgctgaagagcagctcttgggaga

SEQ ID NO: 24800 - DNA, 25 bp, Mus musculus
ctgctgaagggctttggcaaagacg

SEQ ID NO: 24801 - DNA, 25 bp, Mus musculus
ctgctgaatcacaggccgatgactg

SEQ ID NO: 24802 - DNA, 25 bp, Mus musculus
ctgctgaatgtcaaggcccacctgg

SEQ ID NO: 24803 - DNA, 25 bp, Mus musculus
ctgctgacaagaaccccagacatag

SEQ ID NO: 24804 - DNA, 25 bp, Mus musculus
ctgctgacaggtgaagagtcagtac

SEQ ID NO: 24805 - DNA, 25 bp, Mus musculus
ctgctgacctgataacaggccatct

SEQ ID NO: 24806 - DNA, 25 bp, Mus musculus
ctgctgactgtgcatgggcgcacca

SEQ ID NO: 24807 - DNA, 25 bp, Mus musculus
ctgctgagccgaggaggtgacccca

SEQ ID NO: 24808 - DNA, 25 bp, Mus musculus
ctgctgagctcaaccatgcacagga

SEQ ID NO: 24809 - DNA, 25 bp, Mus musculus
ctgctgatacgatgagatctcccag

SEQ ID NO: 24810 - DNA, 25 bp, Mus musculus
ctgctgatcttggaaatgtggagct

SEQ ID NO: 24811 - DNA, 25 bp, Mus musculus
ctgctgatgacctgactgaccctgc

SEQ ID NO: 24812 - DNA, 25 bp, Mus musculus
ctgctgatgccataaagttggagcg

SEQ ID NO: 24813 - DNA, 25 bp, Mus musculus
ctgctgatggatactttcttccaaa

SEQ ID NO: 24814 - DNA, 25 bp, Mus musculus
ctgctgatgtcagttaactctgaga

SEQ ID NO: 24815 - DNA, 25 bp, Mus musculus
ctgctgattttgttgaggaccagga

SEQ ID NO: 24816 - DNA, 25 bp, Mus musculus
ctgctgcagattggagtcaagtctg

SEQ ID NO: 24817 - DNA, 25 bp, Mus musculus
ctgctgcatctgagcctgtgatacc

SEQ ID NO: 24818 - DNA, 25 bp, Mus musculus
ctgctgccttcatgtctttggactg

SEQ ID NO: 24819 - DNA, 25 bp, Mus musculus
ctgctgcgctcaactctttcctgtg

SEQ ID NO: 24820 - DNA, 25 bp, Mus musculus
ctgctgctacccctgagatcagagt

SEQ ID NO: 24821 - DNA, 25 bp, Mus musculus
ctgctgctgggcaactcggttgtca

SEQ ID NO: 24822 - DNA, 25 bp, Mus musculus
ctgctgctggtagggatttaaagtt

SEQ ID NO: 24823 - DNA, 25 bp, Mus musculus
ctgctggagaacagggaggatatta

SEQ ID NO: 24824 - DNA, 25 bp, Mus musculus
ctgctggtaggacatcatgttcatg

SEQ ID NO: 24825 - DNA, 25 bp, Mus musculus
ctgctggtagggatttaaagttgga

SEQ ID NO: 24826 - DNA, 25 bp, Mus musculus
ctgctgtacaaagaagttaaatagc

SEQ ID NO: 24827 - DNA, 25 bp, Mus musculus
ctgctgtctgactatgaagtatgca

SEQ ID NO: 24828 - DNA, 25 bp, Mus musculus
ctgctgtgctggctgctaaaggata

SEQ ID NO: 24829 - DNA, 25 bp, Mus musculus
ctgctgtggccctgcagagcttcac

SEQ ID NO: 24830 - DNA, 25 bp, Mus musculus
ctgctgttcctggtggctaacttcc

SEQ ID NO: 24831 - DNA, 25 bp, Mus musculus
ctgctgtttcttcagaatatcaccg

SEQ ID NO: 24832 - DNA, 25 bp, Mus musculus
ctgcttagctgagtgtgacatctac

SEQ ID NO: 24833 - DNA, 25 bp, Mus musculus
ctgcttatgtcagagacttgaggct

SEQ ID NO: 24834 - DNA, 25 bp, Mus musculus
ctgcttcataggcactgtgattaaa

SEQ ID NO: 24835 - DNA, 25 bp, Mus musculus
ctgcttccagatgcaccttgcaagg

SEQ ID NO: 24836 - DNA, 25 bp, Mus musculus
ctgcttcctgagtgaataataatcc

SEQ ID NO: 24837 - DNA, 25 bp, Mus musculus
ctgcttcgcagaatccgggctgaat

SEQ ID NO: 24838 - DNA, 25 bp, Mus musculus
ctgcttctctaaagaagtcaggaaa

SEQ ID NO: 24839 - DNA, 25 bp, Mus musculus
ctgcttctctgctaaatgtttccaa

SEQ ID NO: 24840 - DNA, 25 bp, Mus musculus
ctgcttctggtgtccactgttttgt

SEQ ID NO: 24841 - DNA, 25 bp, Mus musculus
ctgctttaccttgtaggaggtggga

SEQ ID NO: 24842 - DNA, 25 bp, Mus musculus
ctgctttattgggtgtcctgctcct

SEQ ID NO: 24843 - DNA, 25 bp, Mus musculus
ctgctttgggctgggccgctcagct

SEQ ID NO: 24844 - DNA, 25 bp, Mus musculus
ctggaaacaacatttgcagattcaa

SEQ ID NO: 24845 - DNA, 25 bp, Mus musculus
ctggaaacactgaaggccaggctga

SEQ ID NO: 24846 - DNA, 25 bp, Mus musculus
ctggaaacagcggaagatgggattt

SEQ ID NO: 24847 - DNA, 25 bp, Mus musculus
ctggaaagaacatatgagcttggcc

SEQ ID NO: 24848 - DNA, 25 bp, Mus musculus
ctggaaaggagagctgtgtggtacg

SEQ ID NO: 24849 - DNA, 25 bp, Mus musculus
ctggaaataagcttggtagacgttg

SEQ ID NO: 24850 - DNA, 25 bp, Mus musculus
ctggaaatattcttctgggtgagga

SEQ ID NO: 24851 - DNA, 25 bp, Mus musculus
ctggaaatcaaaccccaatcctctg

SEQ ID NO: 24852 - DNA, 25 bp, Mus musculus
ctggaacaggctatccctgtgcggc

SEQ ID NO: 24853 - DNA, 25 bp, Mus musculus
ctggaaccaaggatttaataactat

SEQ ID NO: 24854 - DNA, 25 bp, Mus musculus
ctggaaccagctctataggccaggc

SEQ ID NO: 24855 - DNA, 25 bp, Mus musculus
ctggaaccagggatatagtaactat

SEQ ID NO: 24856 - DNA, 25 bp, Mus musculus
ctggaacccacacatgaggaggacc

SEQ ID NO: 24857 - DNA, 25 bp, Mus musculus
ctggaacgctttagcagttttggct

SEQ ID NO: 24858 - DNA, 25 bp, Mus musculus
ctggaactcagcatttagaccgggt

SEQ ID NO: 24859 - DNA, 25 bp, Mus musculus
ctggaactggcaatgttgttgtgag

SEQ ID NO: 24860 - DNA, 25 bp, Mus musculus
ctggaagaaccataggccctggcct

SEQ ID NO: 24861 - DNA, 25 bp, Mus musculus
ctggaagacatgctgcaggccctga

SEQ ID NO: 24862 - DNA, 25 bp, Mus musculus
ctggaagacccctggcagctgaaga

SEQ ID NO: 24863 - DNA, 25 bp, Mus musculus
ctggaagaccgtgtccatgagatgg

SEQ ID NO: 24864 - DNA, 25 bp, Mus musculus
ctggaagagggcttggaacctgtct

SEQ ID NO: 24865 - DNA, 25 bp, Mus musculus
ctggaagagttacaagtgaattagc

SEQ ID NO: 24866 - DNA, 25 bp, Mus musculus
ctggaagatgttaggcatgcactgt

SEQ ID NO: 24867 - DNA, 25 bp, Mus musculus
ctggaagatgtttggcatgcactgt

SEQ ID NO: 24868 - DNA, 25 bp, Mus musculus
ctggaagcccctacctcattggctt

SEQ ID NO: 24869 - DNA, 25 bp, Mus musculus
ctggaagcggagttagatgaagaaa

SEQ ID NO: 24870 - DNA, 25 bp, Mus musculus
ctggaaggaggttttactcaaacat

SEQ ID NO: 24871 - DNA, 25 bp, Mus musculus
ctggaataacgggtcctcactacag

SEQ ID NO: 24872 - DNA, 25 bp, Mus musculus
ctggaattcgaaaacagtggcatga

SEQ ID NO: 24873 - DNA, 25 bp, Mus musculus
ctggacaatttgcttaatatggcct

SEQ ID NO: 24874 - DNA, 25 bp, Mus musculus
ctggacagaggacaagcgcaagcat

SEQ ID NO: 24875 - DNA, 25 bp, Mus musculus
ctggacagaggagaagcgcaagcat

SEQ ID NO: 24876 - DNA, 25 bp, Mus musculus
ctggacagccccaggctaggactct

SEQ ID NO: 24877 - DNA, 25 bp, Mus musculus
ctggacatgaagaacaccacatgcc

SEQ ID NO: 24878 - DNA, 25 bp, Mus musculus
ctggaccacgccctcaatgacatga

SEQ ID NO: 24879 - DNA, 25 bp, Mus musculus
ctggaccacgctctcaacgatatga

SEQ ID NO: 24880 - DNA, 25 bp, Mus musculus
ctggaccagtttgcaatgccaccag

SEQ ID NO: 24881 - DNA, 25 bp, Mus musculus
ctggacccagagaagctcggtcaag

SEQ ID NO: 24882 - DNA, 25 bp, Mus musculus
ctggaccctaggacagagcacgggc

SEQ ID NO: 24883 - DNA, 25 bp, Mus musculus
ctggacgcggaaaccttcgcggagt

SEQ ID NO: 24884 - DNA, 25 bp, Mus musculus
ctggacgggaagacagcaaagatgt

SEQ ID NO: 24885 - DNA, 25 bp, Mus musculus
ctggacgggctctggacgaccatca

SEQ ID NO: 24886 - DNA, 25 bp, Mus musculus
ctggacggtaccacctggacagcta

SEQ ID NO: 24887 - DNA, 25 bp, Mus musculus
ctggacgtcaagcagatttccctgg

SEQ ID NO: 24888 - DNA, 25 bp, Mus musculus
ctggacgtccctcaaggcctctagg

SEQ ID NO: 24889 - DNA, 25 bp, Mus musculus
ctggactgcaatgccaagcagtgga

SEQ ID NO: 24890 - DNA, 25 bp, Mus musculus
ctggactggaaatggttcgtgattt

SEQ ID NO: 24891 - DNA, 25 bp, Mus musculus
ctggactggatgctatgagttgcta

SEQ ID NO: 24892 - DNA, 25 bp, Mus musculus
ctggacttgttcagtaacgtgccct

SEQ ID NO: 24893 - DNA, 25 bp, Mus musculus
ctggagaaacagcatttcgagcaac

SEQ ID NO: 24894 - DNA, 25 bp, Mus musculus
ctggagaagagtgccgtactccaag

SEQ ID NO: 24895 - DNA, 25 bp, Mus musculus
ctggagaagcacatggcagcggcca

SEQ ID NO: 24896 - DNA, 25 bp, Mus musculus
ctggagacacagatggcctcaaatg

SEQ ID NO: 24897 - DNA, 25 bp, Mus musculus
ctggagactccagagacgcaggctg

SEQ ID NO: 24898 - DNA, 25 bp, Mus musculus
ctggagactctcttcgtgcaccgat

SEQ ID NO: 24899 - DNA, 25 bp, Mus musculus
ctggagactgtgagctgaccttcaa

SEQ ID NO: 24900 - DNA, 25 bp, Mus musculus
ctggagagactgaccaagaaactgg

SEQ ID NO: 24901 - DNA, 25 bp, Mus musculus
ctggagagactgcatgtaagctcgc

SEQ ID NO: 24902 - DNA, 25 bp, Mus musculus
ctggagagagaagcgtctatagcca

SEQ ID NO: 24903 - DNA, 25 bp, Mus musculus
ctggagagcagaggagttatgttat

SEQ ID NO: 24904 - DNA, 25 bp, Mus musculus
ctggagagcattgccgtggccaaat

SEQ ID NO: 24905 - DNA, 25 bp, Mus musculus
ctggagagcccaagcctaatagacc

SEQ ID NO: 24906 - DNA, 25 bp, Mus musculus
ctggagagcttcaagaaacagtcgt

SEQ ID NO: 24907 - DNA, 25 bp, Mus musculus
ctggagaggaggatcaattgcagcc

SEQ ID NO: 24908 - DNA, 25 bp, Mus musculus
ctggagatgcccatattattggcag

SEQ ID NO: 24909 - DNA, 25 bp, Mus musculus
ctggagatgtggttacagggtcatc

SEQ ID NO: 24910 - DNA, 25 bp, Mus musculus
ctggagcaaaagcacaccacctgct

SEQ ID NO: 24911 - DNA, 25 bp, Mus musculus
ctggagcagctcaatgtcatcaatg

SEQ ID NO: 24912 - DNA, 25 bp, Mus musculus
ctggagcaggctgtgctgtatgcca

SEQ ID NO: 24913 - DNA, 25 bp, Mus musculus
ctggagcagtgaccacactgaagtt

SEQ ID NO: 24914 - DNA, 25 bp, Mus musculus
ctggagcagtgtctgaaggataacc

SEQ ID NO: 24915 - DNA, 25 bp, Mus musculus
ctggagccattgatcacatccctca

SEQ ID NO: 24916 - DNA, 25 bp, Mus musculus
ctggagcccaggtcagagccttgga

SEQ ID NO: 24917 - DNA, 25 bp, Mus musculus
ctggagcctggcattgactatgaca

SEQ ID NO: 24918 - DNA, 25 bp, Mus musculus
ctggagcgtcagacttaacaggaag

SEQ ID NO: 24919 - DNA, 25 bp, Mus musculus
ctggagctctgtgaactcgtctgct

SEQ ID NO: 24920 - DNA, 25 bp, Mus musculus
ctggagctggtgtgactgttcaaaa

SEQ ID NO: 24921 - DNA, 25 bp, Mus musculus
ctggaggaagtcacaggagctaaga

SEQ ID NO: 24922 - DNA, 25 bp, Mus musculus
ctggaggacgggaccactgcgtaca

SEQ ID NO: 24923 - DNA, 25 bp, Mus musculus
ctggaggaggccctcagctccacag

SEQ ID NO: 24924 - DNA, 25 bp, Mus musculus
ctggaggagtcagaacgcacgtgct

SEQ ID NO: 24925 - DNA, 25 bp, Mus musculus
ctggaggagtgcctctgcagcctca

SEQ ID NO: 24926 - DNA, 25 bp, Mus musculus
ctggagggtcaggagcctctctact

SEQ ID NO: 24927 - DNA, 25 bp, Mus musculus
ctggaggtagacacacagagcaacc

SEQ ID NO: 24928 - DNA, 25 bp, Mus musculus
ctggaggtgtgaccgcgggagagct

SEQ ID NO: 24929 - DNA, 25 bp, Mus musculus
ctggagtatgagaaggtgccctact

SEQ ID NO: 24930 - DNA, 25 bp, Mus musculus
ctggagtatgggagtccctacgcct

SEQ ID NO: 24931 - DNA, 25 bp, Mus musculus
ctggagtgagactgtgtctgtgata

SEQ ID NO: 24932 - DNA, 25 bp, Mus musculus
ctggagtgaggattacccggagaac

SEQ ID NO: 24933 - DNA, 25 bp, Mus musculus
ctggagtgggctcaggagaagcgga

SEQ ID NO: 24934 - DNA, 25 bp, Mus musculus
ctggagtgtcagtgctcccgtatta

SEQ ID NO: 24935 - DNA, 25 bp, Mus musculus
ctggagttacaggaactggcctaac

SEQ ID NO: 24936 - DNA, 25 bp, Mus musculus
ctggagttcaacaaggcggagaaac

SEQ ID NO: 24937 - DNA, 25 bp, Mus musculus
ctggagttgctgacccctgggaacc

SEQ ID NO: 24938 - DNA, 25 bp, Mus musculus
ctggagtttgaactacggaaagcca

SEQ ID NO: 24939 - DNA, 25 bp, Mus musculus
ctggagtttgaggacggcatgtacg

SEQ ID NO: 24940 - DNA, 25 bp, Mus musculus
ctggagtttgatgaggagcgagccc

SEQ ID NO: 24941 - DNA, 25 bp, Mus musculus
ctggataacacggagaggctggaaa

SEQ ID NO: 24942 - DNA, 25 bp, Mus musculus
ctggataagtatcccattggtgtac

SEQ ID NO: 24943 - DNA, 25 bp, Mus musculus
ctggatactgtctgcctgggatgtc

SEQ ID NO: 24944 - DNA, 25 bp, Mus musculus
ctggatcaggcaagctccagcacag

SEQ ID NO: 24945 - DNA, 25 bp, Mus musculus
ctggatcagggcagtctgtgcacgt

SEQ ID NO: 24946 - DNA, 25 bp, Mus musculus
ctggatcatctcatcaaaggaaggc

SEQ ID NO: 24947 - DNA, 25 bp, Mus musculus
ctggatcatggcgttggcctgtgct

SEQ ID NO: 24948 - DNA, 25 bp, Mus musculus
ctggatccaaacaaaccaataagga

SEQ ID NO: 24949 - DNA, 25 bp, Mus musculus
ctggatcctgcacacagggccgtga

SEQ ID NO: 24950 - DNA, 25 bp, Mus musculus
ctggatcgaatcatcagggtctgga

SEQ ID NO: 24951 - DNA, 25 bp, Mus musculus
ctggatcgtgactatggccatggat

SEQ ID NO: 24952 - DNA, 25 bp, Mus musculus
ctggatgaccgcaacgaggagaagc

SEQ ID NO: 24953 - DNA, 25 bp, Mus musculus
ctggatgctgagttccgtgatgtag

SEQ ID NO: 24954 - DNA, 25 bp, Mus musculus
ctggatgggcattcatcagatggac

SEQ ID NO: 24955 - DNA, 25 bp, Mus musculus
ctggatgggctcttcaggcgctatg

SEQ ID NO: 24956 - DNA, 25 bp, Mus musculus
ctggatgggttctacaacggccgta

SEQ ID NO: 24957 - DNA, 25 bp, Mus musculus
ctggatggtaaacttcaccagcatg

SEQ ID NO: 24958 - DNA, 25 bp, Mus musculus
ctggatggtcatattaagaagagtg

SEQ ID NO: 24959 - DNA, 25 bp, Mus musculus
ctggatggtcattttaagaagagtg

SEQ ID NO: 24960 - DNA, 25 bp, Mus musculus
ctggatgtataaaggtgaacaagaa

SEQ ID NO: 24961 - DNA, 25 bp, Mus musculus
ctggatgtgttgtccagggcagcct

SEQ ID NO: 24962 - DNA, 25 bp, Mus musculus
ctggatgttatgacacctatgcggc

SEQ ID NO: 24963 - DNA, 25 bp, Mus musculus
ctggatgttatgtcacctatgcggc

SEQ ID NO: 24964 - DNA, 25 bp, Mus musculus
ctggattacacaacgaggctctact

SEQ ID NO: 24965 - DNA, 25 bp, Mus musculus
ctggattgccttttgcaattcttac

SEQ ID NO: 24966 - DNA, 25 bp, Mus musculus
ctggattgtgctgaaggacaggttc

SEQ ID NO: 24967 - DNA, 25 bp, Mus musculus
ctggcaaacggactgttgcttccca

SEQ ID NO: 24968 - DNA, 25 bp, Mus musculus
ctggcaaatctatctgcagaggcgg

SEQ ID NO: 24969 - DNA, 25 bp, Mus musculus
ctggcaacgtggcagccttacacta

SEQ ID NO: 24970 - DNA, 25 bp, Mus musculus
ctggcaactatttcctgctgacaag

SEQ ID NO: 24971 - DNA, 25 bp, Mus musculus
ctggcaagctggcaaacggactgtt

SEQ ID NO: 24972 - DNA, 25 bp, Mus musculus
ctggcaaggcagaacagaatcaact

SEQ ID NO: 24973 - DNA, 25 bp, Mus musculus
ctggcaattaaaggtgtccattctc

SEQ ID NO: 24974 - DNA, 25 bp, Mus musculus
ctggcaccacaaacacagaggatga

SEQ ID NO: 24975 - DNA, 25 bp, Mus musculus
ctggcacccaagcagacagcagtca

SEQ ID NO: 24976 - DNA, 25 bp, Mus musculus
ctggcacctgttggatctgtgagcc

SEQ ID NO: 24977 - DNA, 25 bp, Mus musculus
ctggcacgtgcggagtaaatgttga

SEQ ID NO: 24978 - DNA, 25 bp, Mus musculus
ctggcactacatcagctttggcctg

SEQ ID NO: 24979 - DNA, 25 bp, Mus musculus
ctggcacttgtctgggaactggcga

SEQ ID NO: 24980 - DNA, 25 bp, Mus musculus
ctggcagagaactgcggagtgtcat

SEQ ID NO: 24981 - DNA, 25 bp, Mus musculus
ctggcagagctcagggcaagcacag

SEQ ID NO: 24982 - DNA, 25 bp, Mus musculus
ctggcagccaaagagaggcactgtg

SEQ ID NO: 24983 - DNA, 25 bp, Mus musculus
ctggcagctcgggactcagtgcaag

SEQ ID NO: 24984 - DNA, 25 bp, Mus musculus
ctggcaggatcaaagcctttctcat

SEQ ID NO: 24985 - DNA, 25 bp, Mus musculus
ctggcaggccgaggaaacggaccca

SEQ ID NO: 24986 - DNA, 25 bp, Mus musculus
ctggcagggagagactgtgtcacta

SEQ ID NO: 24987 - DNA, 25 bp, Mus musculus
ctggcagtgacatccatgccctcgt

SEQ ID NO: 24988 - DNA, 25 bp, Mus musculus
ctggcagtgccgtcctagtgtttga

SEQ ID NO: 24989 - DNA, 25 bp, Mus musculus
ctggcagtttgagtcctacaggacc

SEQ ID NO: 24990 - DNA, 25 bp, Mus musculus
ctggcatatgggtgtccagtcctgg

SEQ ID NO: 24991 - DNA, 25 bp, Mus musculus
ctggcatggcggagatctttggcac

SEQ ID NO: 24992 - DNA, 25 bp, Mus musculus
ctggcatgtgattggcttggagaaa

SEQ ID NO: 24993 - DNA, 25 bp, Mus musculus
ctggccaaaagaagaccttagacaa

SEQ ID NO: 24994 - DNA, 25 bp, Mus musculus
ctggccaacatagggagtgagcccc

SEQ ID NO: 24995 - DNA, 25 bp, Mus musculus
ctggccaacggttccctgagggcag

SEQ ID NO: 24996 - DNA, 25 bp, Mus musculus
ctggccaatgagatgtttggttaca

SEQ ID NO: 24997 - DNA, 25 bp, Mus musculus
ctggccacacgtctacccggaattt

SEQ ID NO: 24998 - DNA, 25 bp, Mus musculus
ctggccacagcctccatagatcaaa

SEQ ID NO: 24999 - DNA, 25 bp, Mus musculus
ctggccagaaaggaaccggatggct

SEQ ID NO: 25000 - DNA, 25 bp, Mus musculus
ctggccagacgggtcacactgctgg

SEQ ID NO: 25001 - DNA, 25 bp, Mus musculus
ctggccagcaagaaacctaaaaggg

SEQ ID NO: 25002 - DNA, 25 bp, Mus musculus
ctggccaggctaggacagcagcatt

SEQ ID NO: 25003 - DNA, 25 bp, Mus musculus
ctggccagggatatcaacaacatag

SEQ ID NO: 25004 - DNA, 25 bp, Mus musculus
ctggccctgaatgcaacatgaacaa

SEQ ID NO: 25005 - DNA, 25 bp, Mus musculus
ctggcccttagtttgagccgagagg

SEQ ID NO: 25006 - DNA, 25 bp, Mus musculus
ctggccgctggaacctgtgagattg

SEQ ID NO: 25007 - DNA, 25 bp, Mus musculus
ctggccgggatcacaggcactgaag

SEQ ID NO: 25008 - DNA, 25 bp, Mus musculus
ctggcctacagacgacaggaatacg

SEQ ID NO: 25009 - DNA, 25 bp, Mus musculus
ctggcctcaaagctgtgaccctctt

SEQ ID NO: 25010 - DNA, 25 bp, Mus musculus
ctggcctcagatctggatcttttcc

SEQ ID NO: 25011 - DNA, 25 bp, Mus musculus
ctggcctctggagtagatagataca

SEQ ID NO: 25012 - DNA, 25 bp, Mus musculus
ctggcctggacatcatctgcgctta

SEQ ID NO: 25013 - DNA, 25 bp, Mus musculus
ctggcctggtacacgaccgtgatac

SEQ ID NO: 25014 - DNA, 25 bp, Mus musculus
ctggcgaggaccaggagtctatcag

SEQ ID NO: 25015 - DNA, 25 bp, Mus musculus
ctggcgataccttgtatggccggaa

SEQ ID NO: 25016 - DNA, 25 bp, Mus musculus
ctggcggagaggaatggtcacatca

SEQ ID NO: 25017 - DNA, 25 bp, Mus musculus
ctggcggctgaccaagaagcacaca

SEQ ID NO: 25018 - DNA, 25 bp, Mus musculus
ctggcgggcaggtgaccaatctgta

SEQ ID NO: 25019 - DNA, 25 bp, Mus musculus
ctggcggtggtgtacatattcagcc

SEQ ID NO: 25020 - DNA, 25 bp, Mus musculus
ctggcgtgcaggtgtacaagcacac

SEQ ID NO: 25021 - DNA, 25 bp, Mus musculus
ctggcgttaaaaggcattgactatg

SEQ ID NO: 25022 - DNA, 25 bp, Mus musculus
ctggcgttacctgagcgcgtcgagc

SEQ ID NO: 25023 - DNA, 25 bp, Mus musculus
ctggctaaactcattcttggtactg

SEQ ID NO: 25024 - DNA, 25 bp, Mus musculus
ctggctaaagcagagccggagccct

SEQ ID NO: 25025 - DNA, 25 bp, Mus musculus
ctggctaagtctgaccctatggtgc

SEQ ID NO: 25026 - DNA, 25 bp, Mus musculus
ctggctaatcaagagtgaaaaacct

SEQ ID NO: 25027 - DNA, 25 bp, Mus musculus
ctggctaccatcacctgctgcttta

SEQ ID NO: 25028 - DNA, 25 bp, Mus musculus
ctggctacccacagacggaaggctt

SEQ ID NO: 25029 - DNA, 25 bp, Mus musculus
ctggctacttcaatgaggagatggc

SEQ ID NO: 25030 - DNA, 25 bp, Mus musculus
ctggctcaacagatctaaggtggaa

SEQ ID NO: 25031 - DNA, 25 bp, Mus musculus
ctggctcacatgtttgagagagtga

SEQ ID NO: 25032 - DNA, 25 bp, Mus musculus
ctggctcactgtcctgcccaaacag

SEQ ID NO: 25033 - DNA, 25 bp, Mus musculus
ctggctcatcctgtgaatgcctaca

SEQ ID NO: 25034 - DNA, 25 bp, Mus musculus
ctggctccacaacggacacggtgac

SEQ ID NO: 25035 - DNA, 25 bp, Mus musculus
ctggctccacaagggacacggtgac

SEQ ID NO: 25036 - DNA, 25 bp, Mus musculus
ctggctcgcatacagaccgacactg

SEQ ID NO: 25037 - DNA, 25 bp, Mus musculus
ctggctctggtttaaagcaagcgtt

SEQ ID NO: 25038 - DNA, 25 bp, Mus musculus
ctggctctgttcaatgtgacggaga

SEQ ID NO: 25039 - DNA, 25 bp, Mus musculus
ctggctgaagggagagttcatcacg

SEQ ID NO: 25040 - DNA, 25 bp, Mus musculus
ctggctgaccccactggagcctttg

SEQ ID NO: 25041 - DNA, 25 bp, Mus musculus
ctggctgagaagaggcgtctagcca

SEQ ID NO: 25042 - DNA, 25 bp, Mus musculus
ctggctgcaggcatcgagcggtacc

SEQ ID NO: 25043 - DNA, 25 bp, Mus musculus
ctggctgcggctacttctgcacggc

SEQ ID NO: 25044 - DNA, 25 bp, Mus musculus
ctggctgctgaacttggcaagatgc

SEQ ID NO: 25045 - DNA, 25 bp, Mus musculus
ctggctgctgagctcaaccatgcac

SEQ ID NO: 25046 - DNA, 25 bp, Mus musculus
ctggctggaggtggaggcggctccg

SEQ ID NO: 25047 - DNA, 25 bp, Mus musculus
ctggctggtcaggagtatgctgcca

SEQ ID NO: 25048 - DNA, 25 bp, Mus musculus
ctggctgtatccatggcctcagcaa

SEQ ID NO: 25049 - DNA, 25 bp, Mus musculus
ctggctgtggacaacatcctgtata

SEQ ID NO: 25050 - DNA, 25 bp, Mus musculus
ctggcttcctggatgtaagcacagg

SEQ ID NO: 25051 - DNA, 25 bp, Mus musculus
ctggcttgctggtgtggcacttcca

SEQ ID NO: 25052 - DNA, 25 bp, Mus musculus
ctggcttggagccattttctggcct

SEQ ID NO: 25053 - DNA, 25 bp, Mus musculus
ctggcttggcatggcctgttagtgc

SEQ ID NO: 25054 - DNA, 25 bp, Mus musculus
ctggcttggttttatgagtatgcag

SEQ ID NO: 25055 - DNA, 25 bp, Mus musculus
ctgggaaaaagagagtggtcgttat

SEQ ID NO: 25056 - DNA, 25 bp, Mus musculus
ctgggaacaaagtttcagccgtgtc

SEQ ID NO: 25057 - DNA, 25 bp, Mus musculus
ctgggaacaagacccacaatgctgt

SEQ ID NO: 25058 - DNA, 25 bp, Mus musculus
ctgggaacctggaacgggagtgtct

SEQ ID NO: 25059 - DNA, 25 bp, Mus musculus
ctgggaagtcacgtgacaagagtga

SEQ ID NO: 25060 - DNA, 25 bp, Mus musculus
ctgggaatgatctggaccatcatcc

SEQ ID NO: 25061 - DNA, 25 bp, Mus musculus
ctgggacaactggatcgacccctgg

SEQ ID NO: 25062 - DNA, 25 bp, Mus musculus
ctgggacaagtcatctcctgaggaa

SEQ ID NO: 25063 - DNA, 25 bp, Mus musculus
ctgggacctcctgataaggagccag

SEQ ID NO: 25064 - DNA, 25 bp, Mus musculus
ctgggacctctgagcccctgtggag

SEQ ID NO: 25065 - DNA, 25 bp, Mus musculus
ctgggactaagtctccgaagtatgt

SEQ ID NO: 25066 - DNA, 25 bp, Mus musculus
ctgggactattccactgccccagaa

SEQ ID NO: 25067 - DNA, 25 bp, Mus musculus
ctgggactgccctcagaggttaaga

SEQ ID NO: 25068 - DNA, 25 bp, Mus musculus
ctgggagcagcggaaagcacagaat

SEQ ID NO: 25069 - DNA, 25 bp, Mus musculus
ctgggagcctgcaccctgactggag

SEQ ID NO: 25070 - DNA, 25 bp, Mus musculus
ctgggaggacttgagagctgtattc

SEQ ID NO: 25071 - DNA, 25 bp, Mus musculus
ctgggagggaatgccctctcctttt

SEQ ID NO: 25072 - DNA, 25 bp, Mus musculus
ctgggagttacaggccctacgacga

SEQ ID NO: 25073 - DNA, 25 bp, Mus musculus
ctgggatcttgtgggaaacaacacc

SEQ ID NO: 25074 - DNA, 25 bp, Mus musculus
ctgggatgccaatggatcccgagat

SEQ ID NO: 25075 - DNA, 25 bp, Mus musculus
ctgggattcggcttctttttcaaca

SEQ ID NO: 25076 - DNA, 25 bp, Mus musculus
ctgggatttccttctttgcctgtct

SEQ ID NO: 25077 - DNA, 25 bp, Mus musculus
ctgggcaagcagagaggcaaccact

SEQ ID NO: 25078 - DNA, 25 bp, Mus musculus
ctgggcaagcagtgaggcaaccact

SEQ ID NO: 25079 - DNA, 25 bp, Mus musculus
ctgggcaaggacctcttccacagag

SEQ ID NO: 25080 - DNA, 25 bp, Mus musculus
ctgggcactgtgacgtttctggctg

SEQ ID NO: 25081 - DNA, 25 bp, Mus musculus
ctgggcagaatgtcacgatggatga

SEQ ID NO: 25082 - DNA, 25 bp, Mus musculus
ctgggcagacacctcacactattgt

SEQ ID NO: 25083 - DNA, 25 bp, Mus musculus
ctgggcagcaacaagagctggtgtt

SEQ ID NO: 25084 - DNA, 25 bp, Mus musculus
ctgggcataactaaccccgaaggca

SEQ ID NO: 25085 - DNA, 25 bp, Mus musculus
ctgggcatcacctacatgttgttct

SEQ ID NO: 25086 - DNA, 25 bp, Mus musculus
ctgggccaagagttgcttgtcgctg

SEQ ID NO: 25087 - DNA, 25 bp, Mus musculus
ctgggccagagcacagaggagatac

SEQ ID NO: 25088 - DNA, 25 bp, Mus musculus
ctgggcccagtttatggtttccaat

SEQ ID NO: 25089 - DNA, 25 bp, Mus musculus
ctgggccctcccattcagacagtgg

SEQ ID NO: 25090 - DNA, 25 bp, Mus musculus
ctgggccctgcaagcaaacataaaa

SEQ ID NO: 25091 - DNA, 25 bp, Mus musculus
ctgggcctctgcaaggactcggagt

SEQ ID NO: 25092 - DNA, 25 bp, Mus musculus
ctgggcctctgctaggactcggagt

SEQ ID NO: 25093 - DNA, 25 bp, Mus musculus
ctgggcctctgtggagccctattgt

SEQ ID NO: 25094 - DNA, 25 bp, Mus musculus
ctgggccttttccttactgacattc

SEQ ID NO: 25095 - DNA, 25 bp, Mus musculus
ctgggcggcatctgggaaactctcg

SEQ ID NO: 25096 - DNA, 25 bp, Mus musculus
ctgggctacggagaaaaaggcagag

SEQ ID NO: 25097 - DNA, 25 bp, Mus musculus
ctgggctatgacgtggagaatgacc

SEQ ID NO: 25098 - DNA, 25 bp, Mus musculus
ctgggctatgccctcatgctgtgcc

SEQ ID NO: 25099 - DNA, 25 bp, Mus musculus
ctgggctcaagatgaatcgggcact

SEQ ID NO: 25100 - DNA, 25 bp, Mus musculus
ctgggctcagatagaattttatcag

SEQ ID NO: 25101 - DNA, 25 bp, Mus musculus
ctgggctgagtcttaaggacatgga

SEQ ID NO: 25102 - DNA, 25 bp, Mus musculus
ctgggctgctcagtaccgcgaggca

SEQ ID NO: 25103 - DNA, 25 bp, Mus musculus
ctgggctggccgtaccagacaccag

SEQ ID NO: 25104 - DNA, 25 bp, Mus musculus
ctgggctggtgcagagattccgtcc

SEQ ID NO: 25105 - DNA, 25 bp, Mus musculus
ctgggcttcaacatcgtcggtggga

SEQ ID NO: 25106 - DNA, 25 bp, Mus musculus
ctgggcttctcccataggagtttgt

SEQ ID NO: 25107 - DNA, 25 bp, Mus musculus
ctgggcttctgtggcctccagattg

SEQ ID NO: 25108 - DNA, 25 bp, Mus musculus
ctgggctttgagcaggttgcccctt

SEQ ID NO: 25109 - DNA, 25 bp, Mus musculus
ctgggctttgaggaggttgcccctt

SEQ ID NO: 25110 - DNA, 25 bp, Mus musculus
ctggggaaacacacctgccaacgct

SEQ ID NO: 25111 - DNA, 25 bp, Mus musculus
ctgggtaaaggaagctcagagcctg

SEQ ID NO: 25112 - DNA, 25 bp, Mus musculus
ctgggtaatggtgagccctgaagtc

SEQ ID NO: 25113 - DNA, 25 bp, Mus musculus
ctgggtcaccgcctggatattgtat

SEQ ID NO: 25114 - DNA, 25 bp, Mus musculus
ctgggtccagcagcaagcctatgga

SEQ ID NO: 25115 - DNA, 25 bp, Mus musculus
ctgggtcccttcacgaagtatttgg

SEQ ID NO: 25116 - DNA, 25 bp, Mus musculus
ctgggtcctgagtcgtgctctgttg

SEQ ID NO: 25117 - DNA, 25 bp, Mus musculus
ctgggtggtatttaaggacaccaca

SEQ ID NO: 25118 - DNA, 25 bp, Mus musculus
ctgggtggtctactgtgttgctaca

SEQ ID NO: 25119 - DNA, 25 bp, Mus musculus
ctgggtgtgactgagtgatatgact

SEQ ID NO: 25120 - DNA, 25 bp, Mus musculus
ctgggttagtgggaccattttcata

SEQ ID NO: 25121 - DNA, 25 bp, Mus musculus
ctgggttcttataggatgtttcctg

SEQ ID NO: 25122 - DNA, 25 bp, Mus musculus
ctgggttgcctggtgccacaccttt

SEQ ID NO: 25123 - DNA, 25 bp, Mus musculus
ctggtaacagagtgatttggtatgc

SEQ ID NO: 25124 - DNA, 25 bp, Mus musculus
ctggtaaccaaatgggaagcagcag

SEQ ID NO: 25125 - DNA, 25 bp, Mus musculus
ctggtaagccgcctccaggagcgta

SEQ ID NO: 25126 - DNA, 25 bp, Mus musculus
ctggtagattgccagaggactcccc

SEQ ID NO: 25127 - DNA, 25 bp, Mus musculus
ctggtagcagtatttgaggagtaac

SEQ ID NO: 25128 - DNA, 25 bp, Mus musculus
ctggtagtgctgaagatgggttctt

SEQ ID NO: 25129 - DNA, 25 bp, Mus musculus
ctggtatccctccaggagtgcccag

SEQ ID NO: 25130 - DNA, 25 bp, Mus musculus
ctggtatcgggctgtggcagtattc

SEQ ID NO: 25131 - DNA, 25 bp, Mus musculus
ctggtattttggaggattcagcata

SEQ ID NO: 25132 - DNA, 25 bp, Mus musculus
ctggtcaatggcaccatgtgtgagg

SEQ ID NO: 25133 - DNA, 25 bp, Mus musculus
ctggtcaatggctccatgtgtgagg

SEQ ID NO: 25134 - DNA, 25 bp, Mus musculus
ctggtcactctaatgccacggaggg

SEQ ID NO: 25135 - DNA, 25 bp, Mus musculus
ctggtcagcaagttctggcaatgaa

SEQ ID NO: 25136 - DNA, 25 bp, Mus musculus
ctggtcatgcagctcttccaggacc

SEQ ID NO: 25137 - DNA, 25 bp, Mus musculus
ctggtccaggcctgtgcatatgtga

SEQ ID NO: 25138 - DNA, 25 bp, Mus musculus
ctggtctcaaacgaagagattctgt

SEQ ID NO: 25139 - DNA, 25 bp, Mus musculus
ctggtctctggcttcactcaagggc

SEQ ID NO: 25140 - DNA, 25 bp, Mus musculus
ctggtctggttcagatggcaaagat

SEQ ID NO: 25141 - DNA, 25 bp, Mus musculus
ctggtgaagaccaaagaggagctgc

SEQ ID NO: 25142 - DNA, 25 bp, Mus musculus
ctggtgaatgcaccatataagcggg

SEQ ID NO: 25143 - DNA, 25 bp, Mus musculus
ctggtgaattagaagtagagctgac

SEQ ID NO: 25144 - DNA, 25 bp, Mus musculus
ctggtgacacactggcattctgatc

SEQ ID NO: 25145 - DNA, 25 bp, Mus musculus
ctggtgagaaaagggagtgtccact

SEQ ID NO: 25146 - DNA, 25 bp, Mus musculus
ctggtgagcactggagccatcatgt

SEQ ID NO: 25147 - DNA, 25 bp, Mus musculus
ctggtgagtgccacgctggccctga

SEQ ID NO: 25148 - DNA, 25 bp, Mus musculus
ctggtgatcgaaccaaagactttgg

SEQ ID NO: 25149 - DNA, 25 bp, Mus musculus
ctggtgcagatgttccgcagcgacg

SEQ ID NO: 25150 - DNA, 25 bp, Mus musculus
ctggtgccaagttggatttgaagga

SEQ ID NO: 25151 - DNA, 25 bp, Mus musculus
ctggtgccaccaaagtttatgctat

SEQ ID NO: 25152 - DNA, 25 bp, Mus musculus
ctggtgcccttgaaggagaccatta

SEQ ID NO: 25153 - DNA, 25 bp, Mus musculus
ctggtgctacaccacagatcctact

SEQ ID NO: 25154 - DNA, 25 bp, Mus musculus
ctggtgctataccactgacagccag

SEQ ID NO: 25155 - DNA, 25 bp, Mus musculus
ctggtgctcactggtcatcgtagcc

SEQ ID NO: 25156 - DNA, 25 bp, Mus musculus
ctggtgcttgaaaatgagggcgccc

SEQ ID NO: 25157 - DNA, 25 bp, Mus musculus
ctggtggaccgctggatccgcagcc

SEQ ID NO: 25158 - DNA, 25 bp, Mus musculus
ctggtggactcacagtacctgccca

SEQ ID NO: 25159 - DNA, 25 bp, Mus musculus
ctggtggagtcttaccaccatggac

SEQ ID NO: 25160 - DNA, 25 bp, Mus musculus
ctggtggatgactacagcaacgacc

SEQ ID NO: 25161 - DNA, 25 bp, Mus musculus
ctggtggatggtttcctagcctttc

SEQ ID NO: 25162 - DNA, 25 bp, Mus musculus
ctggtggattttcctatggatggtc

SEQ ID NO: 25163 - DNA, 25 bp, Mus musculus
ctggtggctatgacttcaggctgga

SEQ ID NO: 25164 - DNA, 25 bp, Mus musculus
ctggtgggagcaaagattacaatct

SEQ ID NO: 25165 - DNA, 25 bp, Mus musculus
ctggtgggagtctgatattgaaagt

SEQ ID NO: 25166 - DNA, 25 bp, Mus musculus
ctggtgggcgctatgacaatctggt

SEQ ID NO: 25167 - DNA, 25 bp, Mus musculus
ctggtggtattaccagtatcagaga

SEQ ID NO: 25168 - DNA, 25 bp, Mus musculus
ctggtggtgctgtctggcgttcttc

SEQ ID NO: 25169 - DNA, 25 bp, Mus musculus
ctggtgtaaaagagcaagtaaggac

SEQ ID NO: 25170 - DNA, 25 bp, Mus musculus
ctggtgtaaattgttagaacgcttt

SEQ ID NO: 25171 - DNA, 25 bp, Mus musculus
ctggtgtagaggataaagaaatgat

SEQ ID NO: 25172 - DNA, 25 bp, Mus musculus
ctggtgtcttcgtcgcggcttggat

SEQ ID NO: 25173 - DNA, 25 bp, Mus musculus
ctggtgtgaagcgatagcccgtaac

SEQ ID NO: 25174 - DNA, 25 bp, Mus musculus
ctggtgtgactgtggacttccagaa

SEQ ID NO: 25175 - DNA, 25 bp, Mus musculus
ctggtgtggcctccctgggtccttt

SEQ ID NO: 25176 - DNA, 25 bp, Mus musculus
ctggtgtgtgccttgcctagtttca

SEQ ID NO: 25177 - DNA, 25 bp, Mus musculus
ctggttccaagagaatggcacttgc

SEQ ID NO: 25178 - DNA, 25 bp, Mus musculus
ctggttctcttgcttctgatgggaa

SEQ ID NO: 25179 - DNA, 25 bp, Mus musculus
ctggttgacccaagattccagcctc

SEQ ID NO: 25180 - DNA, 25 bp, Mus musculus
ctggttggagatctttgacagtttt

SEQ ID NO: 25181 - DNA, 25 bp, Mus musculus
ctggttggagcaagcgtcttggcat

SEQ ID NO: 25182 - DNA, 25 bp, Mus musculus
ctggttggcaaggtcttccctggga

SEQ ID NO: 25183 - DNA, 25 bp, Mus musculus
ctgtaaacgaggcttcctgtccagc

SEQ ID NO: 25184 - DNA, 25 bp, Mus musculus
ctgtaaacgttctgtccctcctact

SEQ ID NO: 25185 - DNA, 25 bp, Mus musculus
ctgtaaagcagaagaactgggcagg

SEQ ID NO: 25186 - DNA, 25 bp, Mus musculus
ctgtaaatcggatgctccaacaggg

SEQ ID NO: 25187 - DNA, 25 bp, Mus musculus
ctgtaacccaatttcaagggagtca

SEQ ID NO: 25188 - DNA, 25 bp, Mus musculus
ctgtaaggaagcataccatgaaggg

SEQ ID NO: 25189 - DNA, 25 bp, Mus musculus
ctgtaaggcggataagacccagcag

SEQ ID NO: 25190 - DNA, 25 bp, Mus musculus
ctgtaatatgcttcttctctgtctg

SEQ ID NO: 25191 - DNA, 25 bp, Mus musculus
ctgtaatccacgcttccgagtctgg

SEQ ID NO: 25192 - DNA, 25 bp, Mus musculus
ctgtaatgggcaaggagccacagag

SEQ ID NO: 25193 - DNA, 25 bp, Mus musculus
ctgtacagcggcctgcagagtcccg

SEQ ID NO: 25194 - DNA, 25 bp, Mus musculus
ctgtacccaggtggccacagcaagt

SEQ ID NO: 25195 - DNA, 25 bp, Mus musculus
ctgtacctggacgtgacctgggagt

SEQ ID NO: 25196 - DNA, 25 bp, Mus musculus
ctgtacgctggatttgagccaaaag

SEQ ID NO: 25197 - DNA, 25 bp, Mus musculus
ctgtagaagaagatgcactggatcc

SEQ ID NO: 25198 - DNA, 25 bp, Mus musculus
ctgtagacctcttccgtaatgcggg

SEQ ID NO: 25199 - DNA, 25 bp, Mus musculus
ctgtagcaggcttcactcggttccc

SEQ ID NO: 25200 - DNA, 25 bp, Mus musculus
ctgtagctcagtattcaggagtagc

SEQ ID NO: 25201 - DNA, 25 bp, Mus musculus
ctgtaggactaggtgttgcagctgt

SEQ ID NO: 25202 - DNA, 25 bp, Mus musculus
ctgtagttaagaatggcctagaagg

SEQ ID NO: 25203 - DNA, 25 bp, Mus musculus
ctgtatactctgtgtgagcctggca

SEQ ID NO: 25204 - DNA, 25 bp, Mus musculus
ctgtatgtggaagacggtctgatta

SEQ ID NO: 25205 - DNA, 25 bp, Mus musculus
ctgtatgttcttggtcaattccatg

SEQ ID NO: 25206 - DNA, 25 bp, Mus musculus
ctgtattcatcgtaatgctgtggat

SEQ ID NO: 25207 - DNA, 25 bp, Mus musculus
ctgtattggaaaaagtatggaggtc

SEQ ID NO: 25208 - DNA, 25 bp, Mus musculus
ctgtcaaagggtgaaacaaagttca

SEQ ID NO: 25209 - DNA, 25 bp, Mus musculus
ctgtcaagagaaagaacacatcgag

SEQ ID NO: 25210 - DNA, 25 bp, Mus musculus
ctgtcacggacaaagatcagcccca

SEQ ID NO: 25211 - DNA, 25 bp, Mus musculus
ctgtcacggacatagatcagcccca

SEQ ID NO: 25212 - DNA, 25 bp, Mus musculus
ctgtcagcatgtatgcacgggctgg

SEQ ID NO: 25213 - DNA, 25 bp, Mus musculus
ctgtcagctaaagggccctcttgta

SEQ ID NO: 25214 - DNA, 25 bp, Mus musculus
ctgtcagtgctctgagaatgacgat

SEQ ID NO: 25215 - DNA, 25 bp, Mus musculus
ctgtcataaactcattatcagtgga

SEQ ID NO: 25216 - DNA, 25 bp, Mus musculus
ctgtcatccattagagcggtaatca

SEQ ID NO: 25217 - DNA, 25 bp, Mus musculus
ctgtcatccatttgagcggtaatca

SEQ ID NO: 25218 - DNA, 25 bp, Mus musculus
ctgtcattagcaagcggctctcctc

SEQ ID NO: 25219 - DNA, 25 bp, Mus musculus
ctgtccaccatgattgacgggagtg

SEQ ID NO: 25220 - DNA, 25 bp, Mus musculus
ctgtccagcaggctgatctcccagg

SEQ ID NO: 25221 - DNA, 25 bp, Mus musculus
ctgtccagccttccttttggaggag

SEQ ID NO: 25222 - DNA, 25 bp, Mus musculus
ctgtccaggtttattgctgctggaa

SEQ ID NO: 25223 - DNA, 25 bp, Mus musculus
ctgtcccattctagatgaggatagg

SEQ ID NO: 25224 - DNA, 25 bp, Mus musculus
ctgtccgcagctcgcagtggtcctt

SEQ ID NO: 25225 - DNA, 25 bp, Mus musculus
ctgtccgtagcctgctgaggcattg

SEQ ID NO: 25226 - DNA, 25 bp, Mus musculus
ctgtcctcgttcatgcgcgtggtgg

SEQ ID NO: 25227 - DNA, 25 bp, Mus musculus
ctgtcctgaagccatggtttgcatc

SEQ ID NO: 25228 - DNA, 25 bp, Mus musculus
ctgtcctgactaggccacagagggc

SEQ ID NO: 25229 - DNA, 25 bp, Mus musculus
ctgtcctgactggaatctgctgtgt

SEQ ID NO: 25230 - DNA, 25 bp, Mus musculus
ctgtcctgcacatgccaggtgcttc

SEQ ID NO: 25231 - DNA, 25 bp, Mus musculus
ctgtcctggcaacgtggcagcctta

SEQ ID NO: 25232 - DNA, 25 bp, Mus musculus
ctgtcctgggccttggatcggctga

SEQ ID NO: 25233 - DNA, 25 bp, Mus musculus
ctgtcgaatgtttcatgtccggaag

SEQ ID NO: 25234 - DNA, 25 bp, Mus musculus
ctgtcgcctgtctagaagggaagtc

SEQ ID NO: 25235 - DNA, 25 bp, Mus musculus
ctgtcgttctaaatggctatgatgt

SEQ ID NO: 25236 - DNA, 25 bp, Mus musculus
ctgtctacagatccgtgtctttatc

SEQ ID NO: 25237 - DNA, 25 bp, Mus musculus
ctgtctcagggacaaacagggcccc

SEQ ID NO: 25238 - DNA, 25 bp, Mus musculus
ctgtctccagtgcaagtaggatgtt

SEQ ID NO: 25239 - DNA, 25 bp, Mus musculus
ctgtctcgtaatctacttaaggacc

SEQ ID NO: 25240 - DNA, 25 bp, Mus musculus
ctgtctctcccttcgggatgttggg

SEQ ID NO: 25241 - DNA, 25 bp, Mus musculus
ctgtctctgcccagtgaccggcagg

SEQ ID NO: 25242 - DNA, 25 bp, Mus musculus
ctgtctctttctgcgtcctgggttg

SEQ ID NO: 25243 - DNA, 25 bp, Mus musculus
ctgtctgccagacaatgctgttgaa

SEQ ID NO: 25244 - DNA, 25 bp, Mus musculus
ctgtctgctagccaggtcctgaatt

SEQ ID NO: 25245 - DNA, 25 bp, Mus musculus
ctgtctggagaatggatcgttctta

SEQ ID NO: 25246 - DNA, 25 bp, Mus musculus
ctgtctgtatgagcaaggcagagac

SEQ ID NO: 25247 - DNA, 25 bp, Mus musculus
ctgtctgtgcttcatggaattgcca

SEQ ID NO: 25248 - DNA, 25 bp, Mus musculus
ctgtctgtgcttgatggaattgcca

SEQ ID NO: 25249 - DNA, 25 bp, Mus musculus
ctgtctgtgctttaacgcacttggg

SEQ ID NO: 25250 - DNA, 25 bp, Mus musculus
ctgtctgtggtgttcctgagagcaa

SEQ ID NO: 25251 - DNA, 25 bp, Mus musculus
ctgtctgttgggtcctcagggacac

SEQ ID NO: 25252 - DNA, 25 bp, Mus musculus
ctgtcttctatgaggtgactgtgga

SEQ ID NO: 25253 - DNA, 25 bp, Mus musculus
ctgtctttattggtgaatcatcagc

SEQ ID NO: 25254 - DNA, 25 bp, Mus musculus
ctgtctttgggcagatgtgtgctaa

SEQ ID NO: 25255 - DNA, 25 bp, Mus musculus
ctgtgaagctgcgactgctgtgtag

SEQ ID NO: 25256 - DNA, 25 bp, Mus musculus
ctgtgaaggactcggcctcaagcac

SEQ ID NO: 25257 - DNA, 25 bp, Mus musculus
ctgtgaaggcggtggccggagcctc

SEQ ID NO: 25258 - DNA, 25 bp, Mus musculus
ctgtgaatgagtggcctgatcaaga

SEQ ID NO: 25259 - DNA, 25 bp, Mus musculus
ctgtgacaaagaacattagaagagt

SEQ ID NO: 25260 - DNA, 25 bp, Mus musculus
ctgtgacaatgcagtcctcagagag

SEQ ID NO: 25261 - DNA, 25 bp, Mus musculus
ctgtgacaccacagggaccgggttc

SEQ ID NO: 25262 - DNA, 25 bp, Mus musculus
ctgtgacaggggctaccggcccaac

SEQ ID NO: 25263 - DNA, 25 bp, Mus musculus
ctgtgacagggggtaccggcccaac

SEQ ID NO: 25264 - DNA, 25 bp, Mus musculus
ctgtgacaggtttgtgttagcttac

SEQ ID NO: 25265 - DNA, 25 bp, Mus musculus
ctgtgaccagatcttccagaaccac

SEQ ID NO: 25266 - DNA, 25 bp, Mus musculus
ctgtgaccttgctcggcgctatggc

SEQ ID NO: 25267 - DNA, 25 bp, Mus musculus
ctgtgacgtttctggctggcaaccg

SEQ ID NO: 25268 - DNA, 25 bp, Mus musculus
ctgtgactcatcctggtctttggga

SEQ ID NO: 25269 - DNA, 25 bp, Mus musculus
ctgtgacttacagtgagacaaaaga

SEQ ID NO: 25270 - DNA, 25 bp, Mus musculus
ctgtgagaatattgagacgtcggag

SEQ ID NO: 25271 - DNA, 25 bp, Mus musculus
ctgtgagagaagagatgattcgctt

SEQ ID NO: 25272 - DNA, 25 bp, Mus musculus
ctgtgagagacgtggacctcatgga

SEQ ID NO: 25273 - DNA, 25 bp, Mus musculus
ctgtgagaggatttttcatcaaaca

SEQ ID NO: 25274 - DNA, 25 bp, Mus musculus
ctgtgagcgcctgctttggactcag

SEQ ID NO: 25275 - DNA, 25 bp, Mus musculus
ctgtgagctctgtccccgggtttat

SEQ ID NO: 25276 - DNA, 25 bp, Mus musculus
ctgtgaggagaagctgcgttcccta

SEQ ID NO: 25277 - DNA, 25 bp, Mus musculus
ctgtgagtccaacttatagagaaga

SEQ ID NO: 25278 - DNA, 25 bp, Mus musculus
ctgtgagtgcagagacggctaccat

SEQ ID NO: 25279 - DNA, 25 bp, Mus musculus
ctgtgatagtacttggcggaggtat

SEQ ID NO: 25280 - DNA, 25 bp, Mus musculus
ctgtgatcactctcttcagaaaata

SEQ ID NO: 25281 - DNA, 25 bp, Mus musculus
ctgtgatgactaaggaagaactgtg

SEQ ID NO: 25282 - DNA, 25 bp, Mus musculus
ctgtgatggactcttgctctcctag

SEQ ID NO: 25283 - DNA, 25 bp, Mus musculus
ctgtgcacagttttgcccagcgccg

SEQ ID NO: 25284 - DNA, 25 bp, Mus musculus
ctgtgcacttcacccaggacgagtg

SEQ ID NO: 25285 - DNA, 25 bp, Mus musculus
ctgtgcagggctatcggttgacaaa

SEQ ID NO: 25286 - DNA, 25 bp, Mus musculus
ctgtgcatcacccataatgaggctt

SEQ ID NO: 25287 - DNA, 25 bp, Mus musculus
ctgtgcccacagtggatctggcgtc

SEQ ID NO: 25288 - DNA, 25 bp, Mus musculus
ctgtgccccaagactgggacgtttc

SEQ ID NO: 25289 - DNA, 25 bp, Mus musculus
ctgtgccccgattagaagctctcat

SEQ ID NO: 25290 - DNA, 25 bp, Mus musculus
ctgtgccgccttcgctgaccatact

SEQ ID NO: 25291 - DNA, 25 bp, Mus musculus
ctgtgctacactgccatcagatggg

SEQ ID NO: 25292 - DNA, 25 bp, Mus musculus
ctgtgctacgggttgatgaccggca

SEQ ID NO: 25293 - DNA, 25 bp, Mus musculus
ctgtgctcaaatgccgcacggcagg

SEQ ID NO: 25294 - DNA, 25 bp, Mus musculus
ctgtgctgttattgcacctgtccag

SEQ ID NO: 25295 - DNA, 25 bp, Mus musculus
ctgtggaacgagacctcagcagagg

SEQ ID NO: 25296 - DNA, 25 bp, Mus musculus
ctgtggactagtgagcattttttgt

SEQ ID NO: 25297 - DNA, 25 bp, Mus musculus
ctgtggagcaaattgggcggcggcc

SEQ ID NO: 25298 - DNA, 25 bp, Mus musculus
ctgtggagccctattgtgccgacat

SEQ ID NO: 25299 - DNA, 25 bp, Mus musculus
ctgtggaggacaagaacattgggcc

SEQ ID NO: 25300 - DNA, 25 bp, Mus musculus
ctgtggaggcacgtgctgtctctag

SEQ ID NO: 25301 - DNA, 25 bp, Mus musculus
ctgtggatgccagattccctgaaac

SEQ ID NO: 25302 - DNA, 25 bp, Mus musculus
ctgtggatgccggatgcctccttgc

SEQ ID NO: 25303 - DNA, 25 bp, Mus musculus
ctgtggcacagtcgcactacctggg

SEQ ID NO: 25304 - DNA, 25 bp, Mus musculus
ctgtggcatgtttatttctactgaa

SEQ ID NO: 25305 - DNA, 25 bp, Mus musculus
ctgtggccgtcttcctgggagtccc

SEQ ID NO: 25306 - DNA, 25 bp, Mus musculus
ctgtgggaagactaacttggccatg

SEQ ID NO: 25307 - DNA, 25 bp, Mus musculus
ctgtgggagggcttcttccctgtgc

SEQ ID NO: 25308 - DNA, 25 bp, Mus musculus
ctgtgggatctggttctgtagctga

SEQ ID NO: 25309 - DNA, 25 bp, Mus musculus
ctgtgggcaaatccacctttgtgaa

SEQ ID NO: 25310 - DNA, 25 bp, Mus musculus
ctgtgggccggcaccgtcatagcat

SEQ ID NO: 25311 - DNA, 25 bp, Mus musculus
ctgtggggagcttcagctatgagac

SEQ ID NO: 25312 - DNA, 25 bp, Mus musculus
ctgtggtatatgaaactttgttgac

SEQ ID NO: 25313 - DNA, 25 bp, Mus musculus
ctgtggtcctctaacctgtgcctgt

SEQ ID NO: 25314 - DNA, 25 bp, Mus musculus
ctgtggtcgaagtctgccgtgcaga

SEQ ID NO: 25315 - DNA, 25 bp, Mus musculus
ctgtggtcgtcgtacagaatgccac

SEQ ID NO: 25316 - DNA, 25 bp, Mus musculus
ctgtggtctctgaaaagcaccttac

SEQ ID NO: 25317 - DNA, 25 bp, Mus musculus
ctgtggtgaagcttttcgggcccct

SEQ ID NO: 25318 - DNA, 25 bp, Mus musculus
ctgtggtttcttgaaacacaggaag

SEQ ID NO: 25319 - DNA, 25 bp, Mus musculus
ctgtgtaccgaggagtgcatgcacg

SEQ ID NO: 25320 - DNA, 25 bp, Mus musculus
ctgtgtactctgactctggctggca

SEQ ID NO: 25321 - DNA, 25 bp, Mus musculus
ctgtgtagaccacgctgtcctcgag

SEQ ID NO: 25322 - DNA, 25 bp, Mus musculus
ctgtgtagctgagctgggagagctt

SEQ ID NO: 25323 - DNA, 25 bp, Mus musculus
ctgtgtaggcctgttgcccatggga

SEQ ID NO: 25324 - DNA, 25 bp, Mus musculus
ctgtgtattccagcggcagacacac

SEQ ID NO: 25325 - DNA, 25 bp, Mus musculus
ctgtgtctggctgagagtgctcgac

SEQ ID NO: 25326 - DNA, 25 bp, Mus musculus
ctgtgtctgtcaggctcccgggatc

SEQ ID NO: 25327 - DNA, 25 bp, Mus musculus
ctgtgtcttctgtagtattaccagg

SEQ ID NO: 25328 - DNA, 25 bp, Mus musculus
ctgtgtcttgcagggagatggaaca

SEQ ID NO: 25329 - DNA, 25 bp, Mus musculus
ctgtgtgactctgggtttaacaaac

SEQ ID NO: 25330 - DNA, 25 bp, Mus musculus
ctgtgtgagactcgcttccagccct

SEQ ID NO: 25331 - DNA, 25 bp, Mus musculus
ctgtgtgagactggcttccagccct

SEQ ID NO: 25332 - DNA, 25 bp, Mus musculus
ctgtgtgcacctccctttttggaga

SEQ ID NO: 25333 - DNA, 25 bp, Mus musculus
ctgtgtgcctccaggataataatgg

SEQ ID NO: 25334 - DNA, 25 bp, Mus musculus
ctgtgtgctcatcccgaagtgacct

SEQ ID NO: 25335 - DNA, 25 bp, Mus musculus
ctgtgtggccctgggacaactggat

SEQ ID NO: 25336 - DNA, 25 bp, Mus musculus
ctgtgtgtgtaaaagaccagatgtg

SEQ ID NO: 25337 - DNA, 25 bp, Mus musculus
ctgtgtgtgttagcagctgaattgt

SEQ ID NO: 25338 - DNA, 25 bp, Mus musculus
ctgtgttacaggatggcagctcctg

SEQ ID NO: 25339 - DNA, 25 bp, Mus musculus
ctgtgttcacgcagcctcagtttct

SEQ ID NO: 25340 - DNA, 25 bp, Mus musculus
ctgtgttcacgctgcctcagtttct

SEQ ID NO: 25341 - DNA, 25 bp, Mus musculus
ctgtgttcccttctctaggcacttc

SEQ ID NO: 25342 - DNA, 25 bp, Mus musculus
ctgtgttcttataggatgcttcctt

SEQ ID NO: 25343 - DNA, 25 bp, Mus musculus
ctgtgttgagactatgaaagactgc

SEQ ID NO: 25344 - DNA, 25 bp, Mus musculus
ctgtgtttggtctttggcctctgtg

SEQ ID NO: 25345 - DNA, 25 bp, Mus musculus
ctgtgttttcagaaagttgcagcag

SEQ ID NO: 25346 - DNA, 25 bp, Mus musculus
ctgtgttttggtgctgagcaggaac

SEQ ID NO: 25347 - DNA, 25 bp, Mus musculus
ctgttacgaatgtgttggtgagcca

SEQ ID NO: 25348 - DNA, 25 bp, Mus musculus
ctgttactgcccctgagaagaacct

SEQ ID NO: 25349 - DNA, 25 bp, Mus musculus
ctgttcactgtcacaggaatctgtg

SEQ ID NO: 25350 - DNA, 25 bp, Mus musculus
ctgttcagagggagctctacagaga

SEQ ID NO: 25351 - DNA, 25 bp, Mus musculus
ctgttccagagtggtgggaatttgt

SEQ ID NO: 25352 - DNA, 25 bp, Mus musculus
ctgttccagcatccgggaggtccga

SEQ ID NO: 25353 - DNA, 25 bp, Mus musculus
ctgttccccagacaccatctatgag

SEQ ID NO: 25354 - DNA, 25 bp, Mus musculus
ctgttcctggaatgttaattgtacc

SEQ ID NO: 25355 - DNA, 25 bp, Mus musculus
ctgttcctggccattggcctctggg

SEQ ID NO: 25356 - DNA, 25 bp, Mus musculus
ctgttcgctgctttcatgatgctgc

SEQ ID NO: 25357 - DNA, 25 bp, Mus musculus
ctgttctactatgcccagaaggctg

SEQ ID NO: 25358 - DNA, 25 bp, Mus musculus
ctgttctcaggacccagtgtctctg

SEQ ID NO: 25359 - DNA, 25 bp, Mus musculus
ctgttctctgcagggatgggtgacc

SEQ ID NO: 25360 - DNA, 25 bp, Mus musculus
ctgttctggagcagcttaggaggct

SEQ ID NO: 25361 - DNA, 25 bp, Mus musculus
ctgttcttcacttcccgggagcgag

SEQ ID NO: 25362 - DNA, 25 bp, Mus musculus
ctgttgatgccatttagagtggaaa

SEQ ID NO: 25363 - DNA, 25 bp, Mus musculus
ctgttgatggaatgtgaccagctgc

SEQ ID NO: 25364 - DNA, 25 bp, Mus musculus
ctgttgatggacttctcagttggct

SEQ ID NO: 25365 - DNA, 25 bp, Mus musculus
ctgttgatgggctcaccgcagagga

SEQ ID NO: 25366 - DNA, 25 bp, Mus musculus
ctgttgatgtcaagcagtcagttgc

SEQ ID NO: 25367 - DNA, 25 bp, Mus musculus
ctgttgatgtcatgcagtcagttgc

SEQ ID NO: 25368 - DNA, 25 bp, Mus musculus
ctgttgcagaccaagtcagcaatga

SEQ ID NO: 25369 - DNA, 25 bp, Mus musculus
ctgttgcagggaatggaacaattat

SEQ ID NO: 25370 - DNA, 25 bp, Mus musculus
ctgttgccaggacaaacacccgaga

SEQ ID NO: 25371 - DNA, 25 bp, Mus musculus
ctgttgcgtgccttcttccactgtg

SEQ ID NO: 25372 - DNA, 25 bp, Mus musculus
ctgttgcttgtcagggcctgagaac

SEQ ID NO: 25373 - DNA, 25 bp, Mus musculus
ctgttgggatcatcctaaaatgact

SEQ ID NO: 25374 - DNA, 25 bp, Mus musculus
ctgttgggtacagtcatgaccgtga

SEQ ID NO: 25375 - DNA, 25 bp, Mus musculus
ctgttggtgtgcagcaactacaccc

SEQ ID NO: 25376 - DNA, 25 bp, Mus musculus
ctgttgtaggcgttgttctctacac

SEQ ID NO: 25377 - DNA, 25 bp, Mus musculus
ctgttgtcacgagcgctggtgcccg

SEQ ID NO: 25378 - DNA, 25 bp, Mus musculus
ctgttgtcagagctggaagttactg

SEQ ID NO: 25379 - DNA, 25 bp, Mus musculus
ctgttgtctccatatcagatcctcc

SEQ ID NO: 25380 - DNA, 25 bp, Mus musculus
ctgtttactggtgggagtctgatat

SEQ ID NO: 25381 - DNA, 25 bp, Mus musculus
ctgtttatacgccttcagggaaggg

SEQ ID NO: 25382 - DNA, 25 bp, Mus musculus
ctgtttatcggagccagcctgctta

SEQ ID NO: 25383 - DNA, 25 bp, Mus musculus
ctgtttctataggtccaacgtcgga

SEQ ID NO: 25384 - DNA, 25 bp, Mus musculus
ctgtttctgctacttctaggaagga

SEQ ID NO: 25385 - DNA, 25 bp, Mus musculus
ctgtttcttcgggatcatcttcacc

SEQ ID NO: 25386 - DNA, 25 bp, Mus musculus
ctgtttgctgcatgctgcatgacac

SEQ ID NO: 25387 - DNA, 25 bp, Mus musculus
ctgtttggatggtgcaacggatttt

SEQ ID NO: 25388 - DNA, 25 bp, Mus musculus
ctgtttgggctgactaccgccgcaa

SEQ ID NO: 25389 - DNA, 25 bp, Mus musculus
ctgtttgtatggcaggtgcctcagc

SEQ ID NO: 25390 - DNA, 25 bp, Mus musculus
ctgttttaactgcttgccgatagca

SEQ ID NO: 25391 - DNA, 25 bp, Mus musculus
ctgttttactgcatgtggatgcagg

SEQ ID NO: 25392 - DNA, 25 bp, Mus musculus
ctgttttggtccgtatcacatagga

SEQ ID NO: 25393 - DNA, 25 bp, Mus musculus
cttaaaaacttgttcacactacatg

SEQ ID NO: 25394 - DNA, 25 bp, Mus musculus
cttaaaatgaccacaaaatctttgc

SEQ ID NO: 25395 - DNA, 25 bp, Mus musculus
cttaaagaaaatcctgagctcaggg

SEQ ID NO: 25396 - DNA, 25 bp, Mus musculus
cttaaagaagcccagcgtcggagga

SEQ ID NO: 25397 - DNA, 25 bp, Mus musculus
cttaaagctgtgaaaatgaccctga

SEQ ID NO: 25398 - DNA, 25 bp, Mus musculus
cttaaaggaatttgtggccaaggag

SEQ ID NO: 25399 - DNA, 25 bp, Mus musculus
cttaaagtctggatcctgttctcac

SEQ ID NO: 25400 - DNA, 25 bp, Mus musculus
cttaaatttagagcattcgcagccg

SEQ ID NO: 25401 - DNA, 25 bp, Mus musculus
cttaacaactgtatgttcttggtca

SEQ ID NO: 25402 - DNA, 25 bp, Mus musculus
cttaacatgggcagcacggcagggt

SEQ ID NO: 25403 - DNA, 25 bp, Mus musculus
cttaacatttatgagaaagatgaca

SEQ ID NO: 25404 - DNA, 25 bp, Mus musculus
cttaacctctgaccaactctgaaga

SEQ ID NO: 25405 - DNA, 25 bp, Mus musculus
cttaactgcatgcttccaacatggg

SEQ ID NO: 25406 - DNA, 25 bp, Mus musculus
cttaagagcagctcgggcagggcac

SEQ ID NO: 25407 - DNA, 25 bp, Mus musculus
cttaagattgctaccctagctggga

SEQ ID NO: 25408 - DNA, 25 bp, Mus musculus
cttaagattgcttccctagctggga

SEQ ID NO: 25409 - DNA, 25 bp, Mus musculus
cttaaggcacaaacaaagaccctca

SEQ ID NO: 25410 - DNA, 25 bp, Mus musculus
cttaaggcacatacctgaagtggat

SEQ ID NO: 25411 - DNA, 25 bp, Mus musculus
cttaagtggaacatctaaaattagt

SEQ ID NO: 25412 - DNA, 25 bp, Mus musculus
cttaatacggaacatcaaaatccca

SEQ ID NO: 25413 - DNA, 25 bp, Mus musculus
cttaatagacctgagagacttcgtt

SEQ ID NO: 25414 - DNA, 25 bp, Mus musculus
cttaatatattactacaggactgac

SEQ ID NO: 25415 - DNA, 25 bp, Mus musculus
cttaatatggcctatggcgtaaaga

SEQ ID NO: 25416 - DNA, 25 bp, Mus musculus
cttaatgagggttatgccaaggact

SEQ ID NO: 25417 - DNA, 25 bp, Mus musculus
cttaatggctgggatctgtcctact

SEQ ID NO: 25418 - DNA, 25 bp, Mus musculus
cttaattacttgaacggcaccgtca

SEQ ID NO: 25419 - DNA, 25 bp, Mus musculus
cttaattttacagcaggagggatgg

SEQ ID NO: 25420 - DNA, 25 bp, Mus musculus
cttacaagatgtaatagagagagct

SEQ ID NO: 25421 - DNA, 25 bp, Mus musculus
cttacaatctaaggaagaagatgaa

SEQ ID NO: 25422 - DNA, 25 bp, Mus musculus
cttacacgttgcctcgaagcgagga

SEQ ID NO: 25423 - DNA, 25 bp, Mus musculus
cttacagctcgtttatgactaacag

SEQ ID NO: 25424 - DNA, 25 bp, Mus musculus
cttacaggttgtcagagagatgcag

SEQ ID NO: 25425 - DNA, 25 bp, Mus musculus
cttacatatggcagggatcgtaggt

SEQ ID NO: 25426 - DNA, 25 bp, Mus musculus
cttacatcaaggaaccagagcctgg

SEQ ID NO: 25427 - DNA, 25 bp, Mus musculus
cttacatcctggtaaagccagccct

SEQ ID NO: 25428 - DNA, 25 bp, Mus musculus
cttacatgttagagaagtggaggtg

SEQ ID NO: 25429 - DNA, 25 bp, Mus musculus
cttaccaaaggacgtatctgaggat

SEQ ID NO: 25430 - DNA, 25 bp, Mus musculus
cttaccaagcagtatgaaaagtctg

SEQ ID NO: 25431 - DNA, 25 bp, Mus musculus
cttaccagcagatcttggatgtgct

SEQ ID NO: 25432 - DNA, 25 bp, Mus musculus
cttacccctgagtgcacacgaggga

SEQ ID NO: 25433 - DNA, 25 bp, Mus musculus
cttacgaagatctgggactcttcgc

SEQ ID NO: 25434 - DNA, 25 bp, Mus musculus
cttacgatggatatactgctggagg

SEQ ID NO: 25435 - DNA, 25 bp, Mus musculus
cttacgattatgacgacttttctcc

SEQ ID NO: 25436 - DNA, 25 bp, Mus musculus
cttacgtacagaggcctaaggagca

SEQ ID NO: 25437 - DNA, 25 bp, Mus musculus
cttactaaaagatgaccgaaacact

SEQ ID NO: 25438 - DNA, 25 bp, Mus musculus
cttactcactggagctcagctttga

SEQ ID NO: 25439 - DNA, 25 bp, Mus musculus
cttactcggccacccagggtcaagt

SEQ ID NO: 25440 - DNA, 25 bp, Mus musculus
cttactgatggagcaggagctcact

SEQ ID NO: 25441 - DNA, 25 bp, Mus musculus
cttactgcttctcaacttggaggag

SEQ ID NO: 25442 - DNA, 25 bp, Mus musculus
cttactggtgtacacaatagcatcc

SEQ ID NO: 25443 - DNA, 25 bp, Mus musculus
cttactggtgtagacaatagcatcc

SEQ ID NO: 25444 - DNA, 25 bp, Mus musculus
cttactgtcggagcagcggtcctgg

SEQ ID NO: 25445 - DNA, 25 bp, Mus musculus
cttactgtgtatctctggttgaccc

SEQ ID NO: 25446 - DNA, 25 bp, Mus musculus
cttagaactcacacagaaatcagga

SEQ ID NO: 25447 - DNA, 25 bp, Mus musculus
cttagaagtctgctaaataaacagg

SEQ ID NO: 25448 - DNA, 25 bp, Mus musculus
cttagagcgtctacgggatccagca

SEQ ID NO: 25449 - DNA, 25 bp, Mus musculus
cttagaggagttgctagatcgttcg

SEQ ID NO: 25450 - DNA, 25 bp, Mus musculus
cttagatttggttcatgtcacagca

SEQ ID NO: 25451 - DNA, 25 bp, Mus musculus
cttagcaacgtccagtccaagtgtg

SEQ ID NO: 25452 - DNA, 25 bp, Mus musculus
cttagcaagcttccctgtttcaggt

SEQ ID NO: 25453 - DNA, 25 bp, Mus musculus
cttagcagtgtattccaaagataat

SEQ ID NO: 25454 - DNA, 25 bp, Mus musculus
cttagcatttatacgagggcagctt

SEQ ID NO: 25455 - DNA, 25 bp, Mus musculus
cttagccaggcgaaataattcactg

SEQ ID NO: 25456 - DNA, 25 bp, Mus musculus
cttagcccggccaggtggcacaggc

SEQ ID NO: 25457 - DNA, 25 bp, Mus musculus
cttagccgggagcttggatctactg

SEQ ID NO: 25458 - DNA, 25 bp, Mus musculus
cttagcctttgtggatgatgtgcgc

SEQ ID NO: 25459 - DNA, 25 bp, Mus musculus
cttagcgggtaaagcgcttgcagca

SEQ ID NO: 25460 - DNA, 25 bp, Mus musculus
cttagctaagtatggtaagatcaac

SEQ ID NO: 25461 - DNA, 25 bp, Mus musculus
cttaggaagcatctagaggctgtgc

SEQ ID NO: 25462 - DNA, 25 bp, Mus musculus
cttaggactccactccaaggttgac

SEQ ID NO: 25463 - DNA, 25 bp, Mus musculus
cttaggaggctatgagtgcagctgt

SEQ ID NO: 25464 - DNA, 25 bp, Mus musculus
cttaggcaaaacgtataacattgtg

SEQ ID NO: 25465 - DNA, 25 bp, Mus musculus
cttaggcatcgacttacagaagaaa

SEQ ID NO: 25466 - DNA, 25 bp, Mus musculus
cttagggaacaagtccaagacctgt

SEQ ID NO: 25467 - DNA, 25 bp, Mus musculus
cttagtaattgcgactgagtcagga

SEQ ID NO: 25468 - DNA, 25 bp, Mus musculus
cttagtagcaaggacaaaacaattc

SEQ ID NO: 25469 - DNA, 25 bp, Mus musculus
cttagtccaccactgtccaacatgg

SEQ ID NO: 25470 - DNA, 25 bp, Mus musculus
cttagtggaaattaacagacgcacc

SEQ ID NO: 25471 - DNA, 25 bp, Mus musculus
cttagttaggactggagtgcttggc

SEQ ID NO: 25472 - DNA, 25 bp, Mus musculus
cttataacttcatatcaacctactg

SEQ ID NO: 25473 - DNA, 25 bp, Mus musculus
cttataggagacagcgtgtatcggg

SEQ ID NO: 25474 - DNA, 25 bp, Mus musculus
cttatcatggaaggcaacaggtgtc

SEQ ID NO: 25475 - DNA, 25 bp, Mus musculus
cttatccaaaccagtggctggtacc

SEQ ID NO: 25476 - DNA, 25 bp, Mus musculus
cttatccaaacctgtggctggtacc

SEQ ID NO: 25477 - DNA, 25 bp, Mus musculus
cttatgaaatccgaatgctagacaa

SEQ ID NO: 25478 - DNA, 25 bp, Mus musculus
cttatgaaccctacgtctgcatcta

SEQ ID NO: 25479 - DNA, 25 bp, Mus musculus
cttatgaacccttcgtctgcatcta

SEQ ID NO: 25480 - DNA, 25 bp, Mus musculus
cttatgatgagatctttgaggagag

SEQ ID NO: 25481 - DNA, 25 bp, Mus musculus
cttatggaaatcgaaagggcgtccg

SEQ ID NO: 25482 - DNA, 25 bp, Mus musculus
cttatggcgaccctcgactgtccct

SEQ ID NO: 25483 - DNA, 25 bp, Mus musculus
cttatgtcagagacttgaggcttct

SEQ ID NO: 25484 - DNA, 25 bp, Mus musculus
cttatgtctggaggagactgtgtga

SEQ ID NO: 25485 - DNA, 25 bp, Mus musculus
cttattctgagattggaggcctgtc

SEQ ID NO: 25486 - DNA, 25 bp, Mus musculus
cttatttcagaagtctagggagaaa

SEQ ID NO: 25487 - DNA, 25 bp, Mus musculus
cttcaaactatcctaacaatgccag

SEQ ID NO: 25488 - DNA, 25 bp, Mus musculus
cttcaaatagaagactggagactag

SEQ ID NO: 25489 - DNA, 25 bp, Mus musculus
cttcaaatgacagtaaagagtctac

SEQ ID NO: 25490 - DNA, 25 bp, Mus musculus
cttcaacaacaccatctccaatgta

SEQ ID NO: 25491 - DNA, 25 bp, Mus musculus
cttcaacatggaggctgtgggcatt

SEQ ID NO: 25492 - DNA, 25 bp, Mus musculus
cttcaacctgcccaaggagcgggag

SEQ ID NO: 25493 - DNA, 25 bp, Mus musculus
cttcaacctggctctgtggaatgtg

SEQ ID NO: 25494 - DNA, 25 bp, Mus musculus
cttcaacggagatttcagaatggcg

SEQ ID NO: 25495 - DNA, 25 bp, Mus musculus
cttcaactacaagcagaagtcaagg

SEQ ID NO: 25496 - DNA, 25 bp, Mus musculus
cttcaactagctggtgaagaaggtg

SEQ ID NO: 25497 - DNA, 25 bp, Mus musculus
cttcaagatgccacaggagctccct

SEQ ID NO: 25498 - DNA, 25 bp, Mus musculus
cttcaagctggcaaaatggtagggc

SEQ ID NO: 25499 - DNA, 25 bp, Mus musculus
cttcaaggcttctttgaccgagaag

SEQ ID NO: 25500 - DNA, 25 bp, Mus musculus
cttcaatcgcttttttggtacaaag

SEQ ID NO: 25501 - DNA, 25 bp, Mus musculus
cttcaatgaggagatggcacccatt

SEQ ID NO: 25502 - DNA, 25 bp, Mus musculus
cttcaatgcagaagctgtcaagaac

SEQ ID NO: 25503 - DNA, 25 bp, Mus musculus
cttcacacaacgaactagaaaagca

SEQ ID NO: 25504 - DNA, 25 bp, Mus musculus
cttcacactgcagtctggaggctac

SEQ ID NO: 25505 - DNA, 25 bp, Mus musculus
cttcacagacaagagttaccagact

SEQ ID NO: 25506 - DNA, 25 bp, Mus musculus
cttcaccaagccagtgctggctgtg

SEQ ID NO: 25507 - DNA, 25 bp, Mus musculus
cttcacctagcccattgagaccagt

SEQ ID NO: 25508 - DNA, 25 bp, Mus musculus
cttcactagtgggaccagtggccct

SEQ ID NO: 25509 - DNA, 25 bp, Mus musculus
cttcactgatggacatatagggatc

SEQ ID NO: 25510 - DNA, 25 bp, Mus musculus
cttcactgtatccagaactcccaga

SEQ ID NO: 25511 - DNA, 25 bp, Mus musculus
cttcagacattatctgacgaatctg

SEQ ID NO: 25512 - DNA, 25 bp, Mus musculus
cttcagacgcagagcgagcccttgc

SEQ ID NO: 25513 - DNA, 25 bp, Mus musculus
cttcagagccctatgcactggtgag

SEQ ID NO: 25514 - DNA, 25 bp, Mus musculus
cttcagaggattatcaccgtgatgg

SEQ ID NO: 25515 - DNA, 25 bp, Mus musculus
cttcagagtttgctacttctcctgg

SEQ ID NO: 25516 - DNA, 25 bp, Mus musculus
cttcagatagaagtgaaggtcacag

SEQ ID NO: 25517 - DNA, 25 bp, Mus musculus
cttcagatccactgggaggcccctg

SEQ ID NO: 25518 - DNA, 25 bp, Mus musculus
cttcagattttccagacatctcatg

SEQ ID NO: 25519 - DNA, 25 bp, Mus musculus
cttcagcaatatcctccagcactgt

SEQ ID NO: 25520 - DNA, 25 bp, Mus musculus
cttcagcagcccctggaggagtgcc

SEQ ID NO: 25521 - DNA, 25 bp, Mus musculus
cttcagcagcgctccaggaaagacc

SEQ ID NO: 25522 - DNA, 25 bp, Mus musculus
cttcagcaggatgagtgagcggcaa

SEQ ID NO: 25523 - DNA, 25 bp, Mus musculus
cttcagcattgccagaattttcaca

SEQ ID NO: 25524 - DNA, 25 bp, Mus musculus
cttcagcctattatcaaaacggaag

SEQ ID NO: 25525 - DNA, 25 bp, Mus musculus
cttcagcgtgctggataaccccatg

SEQ ID NO: 25526 - DNA, 25 bp, Mus musculus
cttcaggaatggaaagaaatctgtc

SEQ ID NO: 25527 - DNA, 25 bp, Mus musculus
cttcagggattgttgcattggagca

SEQ ID NO: 25528 - DNA, 25 bp, Mus musculus
cttcagtccagtgttcagagctgta

SEQ ID NO: 25529 - DNA, 25 bp, Mus musculus
cttcagtgaagggactatggtgtca

SEQ ID NO: 25530 - DNA, 25 bp, Mus musculus
cttcagtggtgttggtagtaaaatg

SEQ ID NO: 25531 - DNA, 25 bp, Mus musculus
cttcagtgtggttgagcagcactgc

SEQ ID NO: 25532 - DNA, 25 bp, Mus musculus
cttcagtttcggtggctggtgctct

SEQ ID NO: 25533 - DNA, 25 bp, Mus musculus
cttcatagtactcgagcgggcatta

SEQ ID NO: 25534 - DNA, 25 bp, Mus musculus
cttcatagtactggagcgggcatta

SEQ ID NO: 25535 - DNA, 25 bp, Mus musculus
cttcatcagggaacgggaccgtgca

SEQ ID NO: 25536 - DNA, 25 bp, Mus musculus
cttcatcatcctccctcttgggaga

SEQ ID NO: 25537 - DNA, 25 bp, Mus musculus
cttcatcatcctgcctcttgggaga

SEQ ID NO: 25538 - DNA, 25 bp, Mus musculus
cttcatccgtcatgacgtcagaggg

SEQ ID NO: 25539 - DNA, 25 bp, Mus musculus
cttcatcgccagcaagggagtcaag

SEQ ID NO: 25540 - DNA, 25 bp, Mus musculus
cttcatcgtctacactgaggccatt

SEQ ID NO: 25541 - DNA, 25 bp, Mus musculus
cttcatggtggacacactaagatcc

SEQ ID NO: 25542 - DNA, 25 bp, Mus musculus
cttcatggtggagcccatccagggt

SEQ ID NO: 25543 - DNA, 25 bp, Mus musculus
cttcatgtccaacaagcacgtgttt

SEQ ID NO: 25544 - DNA, 25 bp, Mus musculus
cttcatttgcatcaacactctggga

SEQ ID NO: 25545 - DNA, 25 bp, Mus musculus
cttccaagatgaaccatgccttctt

SEQ ID NO: 25546 - DNA, 25 bp, Mus musculus
cttccaaggtctcccggctgtttgc

SEQ ID NO: 25547 - DNA, 25 bp, Mus musculus
cttccacaagattaagattttaggg

SEQ ID NO: 25548 - DNA, 25 bp, Mus musculus
cttccaccagtctggaagaatgccc

SEQ ID NO: 25549 - DNA, 25 bp, Mus musculus
cttccagcctgtacctccttggagt

SEQ ID NO: 25550 - DNA, 25 bp, Mus musculus
cttccagctggagcgccttgagcag

SEQ ID NO: 25551 - DNA, 25 bp, Mus musculus
cttccaggaacaggcggctactcag

SEQ ID NO: 25552 - DNA, 25 bp, Mus musculus
cttccaggagctgactgcctatcat

SEQ ID NO: 25553 - DNA, 25 bp, Mus musculus
cttccagtagaacgatagctccctc

SEQ ID NO: 25554 - DNA, 25 bp, Mus musculus
cttccagtaggacggaaatcctgca

SEQ ID NO: 25555 - DNA, 25 bp, Mus musculus
cttccagtgcttcagccgctgtcat

SEQ ID NO: 25556 - DNA, 25 bp, Mus musculus
cttccatggtgaatacccagccaaa

SEQ ID NO: 25557 - DNA, 25 bp, Mus musculus
cttccatgtctcaactgaagaatgt

SEQ ID NO: 25558 - DNA, 25 bp, Mus musculus
cttccattggcccagtactgggatt

SEQ ID NO: 25559 - DNA, 25 bp, Mus musculus
cttcccaaaggacatgaagctattg

SEQ ID NO: 25560 - DNA, 25 bp, Mus musculus
cttcccaaataatctgctcttgcca

SEQ ID NO: 25561 - DNA, 25 bp, Mus musculus
cttcccaggaggtgtagatgtgagt

SEQ ID NO: 25562 - DNA, 25 bp, Mus musculus
cttcccagtggcacaggctgatggc

SEQ ID NO: 25563 - DNA, 25 bp, Mus musculus
cttccccaaggatccagtttacact

SEQ ID NO: 25564 - DNA, 25 bp, Mus musculus
cttccccactcctgcagagttggag

SEQ ID NO: 25565 - DNA, 25 bp, Mus musculus
cttccccagggcagtgcttattatg

SEQ ID NO: 25566 - DNA, 25 bp, Mus musculus
cttcccgaggaggtgtggagcatcc

SEQ ID NO: 25567 - DNA, 25 bp, Mus musculus
cttccctattcctgagcctgacggt

SEQ ID NO: 25568 - DNA, 25 bp, Mus musculus
cttccctgttgtgtggcacaagacg

SEQ ID NO: 25569 - DNA, 25 bp, Mus musculus
cttcccttcgcgtgcaaggctctga

SEQ ID NO: 25570 - DNA, 25 bp, Mus musculus
cttccggaacgccaaggaggcagat

SEQ ID NO: 25571 - DNA, 25 bp, Mus musculus
cttccggaataacaatgatgtcaaa

SEQ ID NO: 25572 - DNA, 25 bp, Mus musculus
cttccgtgggtttactcagctgcag

SEQ ID NO: 25573 - DNA, 25 bp, Mus musculus
cttcctaaacattatagtcaagtga

SEQ ID NO: 25574 - DNA, 25 bp, Mus musculus
cttcctaagaaagtgctgagataga

SEQ ID NO: 25575 - DNA, 25 bp, Mus musculus
cttcctaagtgaagacactcggagg

SEQ ID NO: 25576 - DNA, 25 bp, Mus musculus
cttcctagacagtcactgcgagtgt

SEQ ID NO: 25577 - DNA, 25 bp, Mus musculus
cttcctagatgttctggagagtgtg

SEQ ID NO: 25578 - DNA, 25 bp, Mus musculus
cttcctccagggatggtctgtaggc

SEQ ID NO: 25579 - DNA, 25 bp, Mus musculus
cttcctgaggacgtcagagaaaaac

SEQ ID NO: 25580 - DNA, 25 bp, Mus musculus
cttcctgagtgaataataatcctgc

SEQ ID NO: 25581 - DNA, 25 bp, Mus musculus
cttcctgatccgagagagcgagagc

SEQ ID NO: 25582 - DNA, 25 bp, Mus musculus
cttcctgatgggaaacaatgtcacg

SEQ ID NO: 25583 - DNA, 25 bp, Mus musculus
cttcctgccagtgattgggttggtg

SEQ ID NO: 25584 - DNA, 25 bp, Mus musculus
cttcctgcccatgaacctgtttgaa

SEQ ID NO: 25585 - DNA, 25 bp, Mus musculus
cttcctggactctaccttggaaact

SEQ ID NO: 25586 - DNA, 25 bp, Mus musculus
cttcctggatgtaagcacaggattg

SEQ ID NO: 25587 - DNA, 25 bp, Mus musculus
cttcctggcatgcacatgctctggc

SEQ ID NO: 25588 - DNA, 25 bp, Mus musculus
cttcctggtcatgcactacagagga

SEQ ID NO: 25589 - DNA, 25 bp, Mus musculus
cttcctggttctgctctgtggcctc

SEQ ID NO: 25590 - DNA, 25 bp, Mus musculus
cttcctgtccaaattagagtctgtg

SEQ ID NO: 25591 - DNA, 25 bp, Mus musculus
cttccttcagctataagagagctag

SEQ ID NO: 25592 - DNA, 25 bp, Mus musculus
cttcgaataagatccacaactgcag

SEQ ID NO: 25593 - DNA, 25 bp, Mus musculus
cttcgacagcatctgcaacaacaag

SEQ ID NO: 25594 - DNA, 25 bp, Mus musculus
cttcgaccttgcctctgtgtattgc

SEQ ID NO: 25595 - DNA, 25 bp, Mus musculus
cttcgacggaatccccagagagaag

SEQ ID NO: 25596 - DNA, 25 bp, Mus musculus
cttcgagactttgttaggagccacc

SEQ ID NO: 25597 - DNA, 25 bp, Mus musculus
cttcgagagagtcaccccagtactc

SEQ ID NO: 25598 - DNA, 25 bp, Mus musculus
cttcgagataccactgcagccatga

SEQ ID NO: 25599 - DNA, 25 bp, Mus musculus
cttcgagattcgtaccggaggccgg

SEQ ID NO: 25600 - DNA, 25 bp, Mus musculus
cttcgaggcgcttcctgtccggtga

SEQ ID NO: 25601 - DNA, 25 bp, Mus musculus
cttcgagggcatctacctgaagacc

SEQ ID NO: 25602 - DNA, 25 bp, Mus musculus
cttcgattggactgataggagatgg

SEQ ID NO: 25603 - DNA, 25 bp, Mus musculus
cttcgctgtagggaggagaaatgtc

SEQ ID NO: 25604 - DNA, 25 bp, Mus musculus
cttcgcttttggattacctggaaag

SEQ ID NO: 25605 - DNA, 25 bp, Mus musculus
cttcggacagcaggaggcaacgtcc

SEQ ID NO: 25606 - DNA, 25 bp, Mus musculus
cttcggagattataaccagtttgat

SEQ ID NO: 25607 - DNA, 25 bp, Mus musculus
cttcggcaatttccaaggcaaaatg

SEQ ID NO: 25608 - DNA, 25 bp, Mus musculus
cttcggcagaagcatgcccagcagc

SEQ ID NO: 25609 - DNA, 25 bp, Mus musculus
cttcgggaaaaacagcagattacgc

SEQ ID NO: 25610 - DNA, 25 bp, Mus musculus
cttcgggcctcgtcttcctacaggg

SEQ ID NO: 25611 - DNA, 25 bp, Mus musculus
cttcgtcagcactgccaaatatcaa

SEQ ID NO: 25612 - DNA, 25 bp, Mus musculus
cttcgtcctcatcgcactgcaggaa

SEQ ID NO: 25613 - DNA, 25 bp, Mus musculus
cttcgtctctcagggagaggtgtcc

SEQ ID NO: 25614 - DNA, 25 bp, Mus musculus
cttcgtgatgcgcagcgccagctcg

SEQ ID NO: 25615 - DNA, 25 bp, Mus musculus
cttcgtgatgcggagcgccagctcg

SEQ ID NO: 25616 - DNA, 25 bp, Mus musculus
cttcgtgcaccgattctctcacgga

SEQ ID NO: 25617 - DNA, 25 bp, Mus musculus
cttcgtggagatctgcaaacgggaa

SEQ ID NO: 25618 - DNA, 25 bp, Mus musculus
cttcgtgtatttcttcctgggcacc

SEQ ID NO: 25619 - DNA, 25 bp, Mus musculus
cttcgttagtgatgttgttatctcc

SEQ ID NO: 25620 - DNA, 25 bp, Mus musculus
cttctaaacctactggtcccagaga

SEQ ID NO: 25621 - DNA, 25 bp, Mus musculus
cttctaaggactacaacagtctcaa

SEQ ID NO: 25622 - DNA, 25 bp, Mus musculus
cttctaagtaaacggcggaagtgtg

SEQ ID NO: 25623 - DNA, 25 bp, Mus musculus
cttctacaccgtcttcatgttcgtg

SEQ ID NO: 25624 - DNA, 25 bp, Mus musculus
cttctacagcttgggatggccacag

SEQ ID NO: 25625 - DNA, 25 bp, Mus musculus
cttctacatgtaatcgcaaaactga

SEQ ID NO: 25626 - DNA, 25 bp, Mus musculus
cttctacatgtattcgcaaaactga

SEQ ID NO: 25627 - DNA, 25 bp, Mus musculus
cttctaccatgaacagctcgacttc

SEQ ID NO: 25628 - DNA, 25 bp, Mus musculus
cttctagagtggattcggcgcacca

SEQ ID NO: 25629 - DNA, 25 bp, Mus musculus
cttctatccgaaggaagaagagccc

SEQ ID NO: 25630 - DNA, 25 bp, Mus musculus
cttctatgagttccagcatctgtcc

SEQ ID NO: 25631 - DNA, 25 bp, Mus musculus
cttctatggcaacaagacttctgtg

SEQ ID NO: 25632 - DNA, 25 bp, Mus musculus
cttctcaagcagacctggtgtctcc

SEQ ID NO: 25633 - DNA, 25 bp, Mus musculus
cttctcagctcaccctggcagtggt

SEQ ID NO: 25634 - DNA, 25 bp, Mus musculus
cttctcaggatgatcctggcctatc

SEQ ID NO: 25635 - DNA, 25 bp, Mus musculus
cttctcagtggcagtctgttagcga

SEQ ID NO: 25636 - DNA, 25 bp, Mus musculus
cttctcatcaaaggtgggaagattg

SEQ ID NO: 25637 - DNA, 25 bp, Mus musculus
cttctccctgagtcacgctggaaaa

SEQ ID NO: 25638 - DNA, 25 bp, Mus musculus
cttctcctgtcaggccgggataact

SEQ ID NO: 25639 - DNA, 25 bp, Mus musculus
cttctcgcctgacagcctggcgagg

SEQ ID NO: 25640 - DNA, 25 bp, Mus musculus
cttctcggacctctattcagagtga

SEQ ID NO: 25641 - DNA, 25 bp, Mus musculus
cttctcggacctgtattcagagtga

SEQ ID NO: 25642 - DNA, 25 bp, Mus musculus
cttctctccacgataaaatggcaaa

SEQ ID NO: 25643 - DNA, 25 bp, Mus musculus
cttctgacactgagagctctatcat

SEQ ID NO: 25644 - DNA, 25 bp, Mus musculus
cttctgaccccatgccagtgttgta

SEQ ID NO: 25645 - DNA, 25 bp, Mus musculus
cttctgacccttctgttgataaaga

SEQ ID NO: 25646 - DNA, 25 bp, Mus musculus
cttctgacgaagacgagcgcttgtc

SEQ ID NO: 25647 - DNA, 25 bp, Mus musculus
cttctgagaggcaggagagctacat

SEQ ID NO: 25648 - DNA, 25 bp, Mus musculus
cttctgaggaactcttgactccggg

SEQ ID NO: 25649 - DNA, 25 bp, Mus musculus
cttctgatacccgtcagtcaggctg

SEQ ID NO: 25650 - DNA, 25 bp, Mus musculus
cttctgcagctaagaacagaggtgg

SEQ ID NO: 25651 - DNA, 25 bp, Mus musculus
cttctgccaaggtggctgtgaatgg

SEQ ID NO: 25652 - DNA, 25 bp, Mus musculus
cttctgcccaatctcttcctgagaa

SEQ ID NO: 25653 - DNA, 25 bp, Mus musculus
cttctgccgtggatgtaaagccagc

SEQ ID NO: 25654 - DNA, 25 bp, Mus musculus
cttctgcctcatcctgatgccagga

SEQ ID NO: 25655 - DNA, 25 bp, Mus musculus
cttctgctgatgacaagaatcggcg

SEQ ID NO: 25656 - DNA, 25 bp, Mus musculus
cttctggagcactgcggcgtgtgtc

SEQ ID NO: 25657 - DNA, 25 bp, Mus musculus
cttctgggaaagctatacgtacaat

SEQ ID NO: 25658 - DNA, 25 bp, Mus musculus
cttctggtgtcattaacggaccttc

SEQ ID NO: 25659 - DNA, 25 bp, Mus musculus
cttctgtcatgagaaataagctgaa

SEQ ID NO: 25660 - DNA, 25 bp, Mus musculus
cttctgtctgaggtacacaaaggag

SEQ ID NO: 25661 - DNA, 25 bp, Mus musculus
cttctgtctggacgacacgtcctgt

SEQ ID NO: 25662 - DNA, 25 bp, Mus musculus
cttctgtctggaggacacgtcctgt

SEQ ID NO: 25663 - DNA, 25 bp, Mus musculus
cttctgtgaagggaagtggatttcc

SEQ ID NO: 25664 - DNA, 25 bp, Mus musculus
cttctgtgacagtggctgctgtatt

SEQ ID NO: 25665 - DNA, 25 bp, Mus musculus
cttctgtgagcatatggctctggtc

SEQ ID NO: 25666 - DNA, 25 bp, Mus musculus
cttctgtggcctccagattgcgacc

SEQ ID NO: 25667 - DNA, 25 bp, Mus musculus
cttctgtggctgtggaggatgcctt

SEQ ID NO: 25668 - DNA, 25 bp, Mus musculus
cttctgttctgatggcttctaactc

SEQ ID NO: 25669 - DNA, 25 bp, Mus musculus
cttcttaaccagcaataacttacag

SEQ ID NO: 25670 - DNA, 25 bp, Mus musculus
cttcttagccagcttgatgtttaaa

SEQ ID NO: 25671 - DNA, 25 bp, Mus musculus
cttcttcacaaaatcattgatggct

SEQ ID NO: 25672 - DNA, 25 bp, Mus musculus
cttcttcagctgacaagccttatga

SEQ ID NO: 25673 - DNA, 25 bp, Mus musculus
cttcttcgtgatgagtgattacaga

SEQ ID NO: 25674 - DNA, 25 bp, Mus musculus
cttcttgggctatggcatagactat

SEQ ID NO: 25675 - DNA, 25 bp, Mus musculus
cttcttgtctcagagagcagtagag

SEQ ID NO: 25676 - DNA, 25 bp, Mus musculus
cttctttccggcatcgcaggacacg

SEQ ID NO: 25677 - DNA, 25 bp, Mus musculus
cttctttctgcaggctgctcatcag

SEQ ID NO: 25678 - DNA, 25 bp, Mus musculus
cttctttgggatggtgagcattggc

SEQ ID NO: 25679 - DNA, 25 bp, Mus musculus
cttcttttggagacgtgctagagag

SEQ ID NO: 25680 - DNA, 25 bp, Mus musculus
cttctttttagatgaatggcggaaa

SEQ ID NO: 25681 - DNA, 25 bp, Mus musculus
cttgaaaatcttcgatactctgtgg

SEQ ID NO: 25682 - DNA, 25 bp, Mus musculus
cttgaaaatcttggatactctgtgg

SEQ ID NO: 25683 - DNA, 25 bp, Mus musculus
cttgaaaggcttaggccttctatag

SEQ ID NO: 25684 - DNA, 25 bp, Mus musculus
cttgaaaggtgctctggagtcttcc

SEQ ID NO: 25685 - DNA, 25 bp, Mus musculus
cttgaaattctcaacaggactgaga

SEQ ID NO: 25686 - DNA, 25 bp, Mus musculus
cttgaacaaagtggacggacccgat

SEQ ID NO: 25687 - DNA, 25 bp, Mus musculus
cttgaacaagaaaactctggaggca

SEQ ID NO: 25688 - DNA, 25 bp, Mus musculus
cttgaacttgctgtgaggctcaggt

SEQ ID NO: 25689 - DNA, 25 bp, Mus musculus
cttgaagaaacagtcggaagacatc

SEQ ID NO: 25690 - DNA, 25 bp, Mus musculus
cttgaagaagactttaatgttgcac

SEQ ID NO: 25691 - DNA, 25 bp, Mus musculus
cttgaagacttcttcgtgatgagtg

SEQ ID NO: 25692 - DNA, 25 bp, Mus musculus
cttgaagagattatgagaagaacca

SEQ ID NO: 25693 - DNA, 25 bp, Mus musculus
cttgaagcgcactgtgcccaccggg

SEQ ID NO: 25694 - DNA, 25 bp, Mus musculus
cttgaaggtaaagaggaagcattga

SEQ ID NO: 25695 - DNA, 25 bp, Mus musculus
cttgaaggtcttgccctggactgga

SEQ ID NO: 25696 - DNA, 25 bp, Mus musculus
cttgaagtcaatggcccaaaatgac

SEQ ID NO: 25697 - DNA, 25 bp, Mus musculus
cttgaagtcactggaggctcaggct

SEQ ID NO: 25698 - DNA, 25 bp, Mus musculus
cttgaattaaggttgattgtgagcc

SEQ ID NO: 25699 - DNA, 25 bp, Mus musculus
cttgaatttaggacagtcctcctcc

SEQ ID NO: 25700 - DNA, 25 bp, Mus musculus
cttgacaaaagtaagctgaagccag

SEQ ID NO: 25701 - DNA, 25 bp, Mus musculus
cttgacaagaacaaactacaggcga

SEQ ID NO: 25702 - DNA, 25 bp, Mus musculus
cttgacagtgctgagcgggaacgac

SEQ ID NO: 25703 - DNA, 25 bp, Mus musculus
cttgacccctgggtgttttgcatag

SEQ ID NO: 25704 - DNA, 25 bp, Mus musculus
cttgacccgttctcttcctggcatg

SEQ ID NO: 25705 - DNA, 25 bp, Mus musculus
cttgaccctgaacttagatgattat

SEQ ID NO: 25706 - DNA, 25 bp, Mus musculus
cttgaccgcatgctcagcagcagct

SEQ ID NO: 25707 - DNA, 25 bp, Mus musculus
cttgacggatagtggcatccaggct

SEQ ID NO: 25708 - DNA, 25 bp, Mus musculus
cttgactccattcatacgatcacag

SEQ ID NO: 25709 - DNA, 25 bp, Mus musculus
cttgacttctatggtattcagcctg

SEQ ID NO: 25710 - DNA, 25 bp, Mus musculus
cttgagactctttgatgacctggcc

SEQ ID NO: 25711 - DNA, 25 bp, Mus musculus
cttgagcaagttccagttaaaaaat

SEQ ID NO: 25712 - DNA, 25 bp, Mus musculus
cttgagcaccaagaacaccattctg

SEQ ID NO: 25713 - DNA, 25 bp, Mus musculus
cttgagcactgggatccacagaaca

SEQ ID NO: 25714 - DNA, 25 bp, Mus musculus
cttgagcagcggcaaaatttggtat

SEQ ID NO: 25715 - DNA, 25 bp, Mus musculus
cttgagcagcgggaaaatttggtat

SEQ ID NO: 25716 - DNA, 25 bp, Mus musculus
cttgagcagcggtgacaagatccga

SEQ ID NO: 25717 - DNA, 25 bp, Mus musculus
cttgaggaatatctcagagctgttc

SEQ ID NO: 25718 - DNA, 25 bp, Mus musculus
cttgaggaggacaggcacagcatcg

SEQ ID NO: 25719 - DNA, 25 bp, Mus musculus
cttgaggagtaccacgcagaagaag

SEQ ID NO: 25720 - DNA, 25 bp, Mus musculus
cttgaggagtacgacgcagaagaag

SEQ ID NO: 25721 - DNA, 25 bp, Mus musculus
cttgaggctgaataatatgatggtc

SEQ ID NO: 25722 - DNA, 25 bp, Mus musculus
cttgagtcgtggtgtgcgtctgacc

SEQ ID NO: 25723 - DNA, 25 bp, Mus musculus
cttgagtgctctgcagcatgtgtgg

SEQ ID NO: 25724 - DNA, 25 bp, Mus musculus
cttgataccaaacacttaaggaggg

SEQ ID NO: 25725 - DNA, 25 bp, Mus musculus
cttgatcagtgatccttcacgttgg

SEQ ID NO: 25726 - DNA, 25 bp, Mus musculus
cttgatgatgcagctggcccgagag

SEQ ID NO: 25727 - DNA, 25 bp, Mus musculus
cttgatgggaccttgcgtctttgct

SEQ ID NO: 25728 - DNA, 25 bp, Mus musculus
cttgatgtcaagtgcttagctgtgc

SEQ ID NO: 25729 - DNA, 25 bp, Mus musculus
cttgattctgcaccgcctgtctctg

SEQ ID NO: 25730 - DNA, 25 bp, Mus musculus
cttgattggcatgtggcaaacacag

SEQ ID NO: 25731 - DNA, 25 bp, Mus musculus
cttgattgggatgctggcggccata

SEQ ID NO: 25732 - DNA, 25 bp, Mus musculus
cttgatttgactgagcgagactatt

SEQ ID NO: 25733 - DNA, 25 bp, Mus musculus
cttgatttgtagctgatgatgatcc

SEQ ID NO: 25734 - DNA, 25 bp, Mus musculus
cttgcaagggcagctgccagagaca

SEQ ID NO: 25735 - DNA, 25 bp, Mus musculus
cttgcactacaaagggcccagcagg

SEQ ID NO: 25736 - DNA, 25 bp, Mus musculus
cttgcactcaaggaatggaagactg

SEQ ID NO: 25737 - DNA, 25 bp, Mus musculus
cttgcagaaatcacgctggatcccc

SEQ ID NO: 25738 - DNA, 25 bp, Mus musculus
cttgcagagagtacttttataaacc

SEQ ID NO: 25739 - DNA, 25 bp, Mus musculus
cttgcagagagttcttttataaacc

SEQ ID NO: 25740 - DNA, 25 bp, Mus musculus
cttgcagaggcagccagagaccgga

SEQ ID NO: 25741 - DNA, 25 bp, Mus musculus
cttgcagagtagttgggatagtcta

SEQ ID NO: 25742 - DNA, 25 bp, Mus musculus
cttgcagatacagcgctaggaaaag

SEQ ID NO: 25743 - DNA, 25 bp, Mus musculus
cttgcagcagacactgatggatgag

SEQ ID NO: 25744 - DNA, 25 bp, Mus musculus
cttgcaggatctcctcccatcttga

SEQ ID NO: 25745 - DNA, 25 bp, Mus musculus
cttgcagggcatgccggtccggaac

SEQ ID NO: 25746 - DNA, 25 bp, Mus musculus
cttgcagtctgcttgtccctgtgtc

SEQ ID NO: 25747 - DNA, 25 bp, Mus musculus
cttgcatcaagatcaggcctgaagt

SEQ ID NO: 25748 - DNA, 25 bp, Mus musculus
cttgccaaagggtcagaatgttacc

SEQ ID NO: 25749 - DNA, 25 bp, Mus musculus
cttgccacagaatgaagatccatat

SEQ ID NO: 25750 - DNA, 25 bp, Mus musculus
cttgccacatcaggttcccaggtgg

SEQ ID NO: 25751 - DNA, 25 bp, Mus musculus
cttgccacggtgaaggtagaagatg

SEQ ID NO: 25752 - DNA, 25 bp, Mus musculus
cttgccactccctactgaataaagc

SEQ ID NO: 25753 - DNA, 25 bp, Mus musculus
cttgccacttccatgcttcggaaag

SEQ ID NO: 25754 - DNA, 25 bp, Mus musculus
cttgcccagaaacacttgagcagtg

SEQ ID NO: 25755 - DNA, 25 bp, Mus musculus
cttgcccagcccctgctgtgatgga

SEQ ID NO: 25756 - DNA, 25 bp, Mus musculus
cttgccgctgtggaaacgaggttgt

SEQ ID NO: 25757 - DNA, 25 bp, Mus musculus
cttgccgtcactaagccatacttgg

SEQ ID NO: 25758 - DNA, 25 bp, Mus musculus
cttgcctacggaagtgaaggagttt

SEQ ID NO: 25759 - DNA, 25 bp, Mus musculus
cttgcctatgccagacacagggctg

SEQ ID NO: 25760 - DNA, 25 bp, Mus musculus
cttgcctcagtgaaaggagtattca

SEQ ID NO: 25761 - DNA, 25 bp, Mus musculus
cttgcctctgtgtattgctttctga

SEQ ID NO: 25762 - DNA, 25 bp, Mus musculus
cttgcctgctggaagtctgttttgg

SEQ ID NO: 25763 - DNA, 25 bp, Mus musculus
cttgcctgtaactcaacaaatgaca

SEQ ID NO: 25764 - DNA, 25 bp, Mus musculus
cttgccttaaacaagtcacgtcaag

SEQ ID NO: 25765 - DNA, 25 bp, Mus musculus
cttgccttcaaaatggatggtcacc

SEQ ID NO: 25766 - DNA, 25 bp, Mus musculus
cttgccttcgttccaaattgccaga

SEQ ID NO: 25767 - DNA, 25 bp, Mus musculus
cttgccttgtgttgttgatgtgaga

SEQ ID NO: 25768 - DNA, 25 bp, Mus musculus
cttgcgacgggcttttcaaggtctt

SEQ ID NO: 25769 - DNA, 25 bp, Mus musculus
cttgcgatgaagagttttcagattc

SEQ ID NO: 25770 - DNA, 25 bp, Mus musculus
cttgcgtgggcaccataccacctat

SEQ ID NO: 25771 - DNA, 25 bp, Mus musculus
cttgcgtgggcagcataccacctat

SEQ ID NO: 25772 - DNA, 25 bp, Mus musculus
cttgcgtgggcgtcctatgatcaga

SEQ ID NO: 25773 - DNA, 25 bp, Mus musculus
cttgctaataacatccatccttctg

SEQ ID NO: 25774 - DNA, 25 bp, Mus musculus
cttgctcagcgtcatgctgccggga

SEQ ID NO: 25775 - DNA, 25 bp, Mus musculus
cttgctcagtcaccattgtccaaac

SEQ ID NO: 25776 - DNA, 25 bp, Mus musculus
cttgctcggcgctatggccttaagg

SEQ ID NO: 25777 - DNA, 25 bp, Mus musculus
cttgctcttgagctttctgcactaa

SEQ ID NO: 25778 - DNA, 25 bp, Mus musculus
cttgctgaagacctctgcaatcgag

SEQ ID NO: 25779 - DNA, 25 bp, Mus musculus
cttgctgacggcagctaccgctaaa

SEQ ID NO: 25780 - DNA, 25 bp, Mus musculus
cttgctgactctggagggatgctca

SEQ ID NO: 25781 - DNA, 25 bp, Mus musculus
cttgctgagtacatggattccagtc

SEQ ID NO: 25782 - DNA, 25 bp, Mus musculus
cttgctgcaactgcagtaggtggtg

SEQ ID NO: 25783 - DNA, 25 bp, Mus musculus
cttgctggacagatgcagccacaga

SEQ ID NO: 25784 - DNA, 25 bp, Mus musculus
cttgctggttctggcgcctgctggt

SEQ ID NO: 25785 - DNA, 25 bp, Mus musculus
cttgctgtggagtgtacagtcatcc

SEQ ID NO: 25786 - DNA, 25 bp, Mus musculus
cttgcttaataaagttgactctgac

SEQ ID NO: 25787 - DNA, 25 bp, Mus musculus
cttgcttactcgagatcgcctgcct

SEQ ID NO: 25788 - DNA, 25 bp, Mus musculus
cttgcttgcttactcgagatcgcct

SEQ ID NO: 25789 - DNA, 25 bp, Mus musculus
cttgctttggattcagaagccatcc

SEQ ID NO: 25790 - DNA, 25 bp, Mus musculus
cttgctttgttggtgattgtatcgc

SEQ ID NO: 25791 - DNA, 25 bp, Mus musculus
cttgcttttccagagcagaaaagaa

SEQ ID NO: 25792 - DNA, 25 bp, Mus musculus
cttggaacagtttgtctgtgcacac

SEQ ID NO: 25793 - DNA, 25 bp, Mus musculus
cttggaacatggaggtgagtgtcct

SEQ ID NO: 25794 - DNA, 25 bp, Mus musculus
cttggaacctgaccgtccagaggta

SEQ ID NO: 25795 - DNA, 25 bp, Mus musculus
cttggaagctacttaatacggaaca

SEQ ID NO: 25796 - DNA, 25 bp, Mus musculus
cttggaagtgttttgcacagatgac

SEQ ID NO: 25797 - DNA, 25 bp, Mus musculus
cttggaagttgagggagactcagac

SEQ ID NO: 25798 - DNA, 25 bp, Mus musculus
cttggaatacaaaggaggaggcaaa

SEQ ID NO: 25799 - DNA, 25 bp, Mus musculus
cttggaatctatccctgcaggacag

SEQ ID NO: 25800 - DNA, 25 bp, Mus musculus
cttggaatctgaagtcacactggcc

SEQ ID NO: 25801 - DNA, 25 bp, Mus musculus
cttggacaacagcacaccagcgaag

SEQ ID NO: 25802 - DNA, 25 bp, Mus musculus
cttggacaagctccctctgtggcct

SEQ ID NO: 25803 - DNA, 25 bp, Mus musculus
cttggacacgggtcctggaagtgat

SEQ ID NO: 25804 - DNA, 25 bp, Mus musculus
cttggacagagctgttattgagcat

SEQ ID NO: 25805 - DNA, 25 bp, Mus musculus
cttggacatcctcttgtttgccaga

SEQ ID NO: 25806 - DNA, 25 bp, Mus musculus
cttggaccttgtgtgggacccctga

SEQ ID NO: 25807 - DNA, 25 bp, Mus musculus
cttggacgccaagtcactgtgtgct

SEQ ID NO: 25808 - DNA, 25 bp, Mus musculus
cttggactatacgacactgcaggac

SEQ ID NO: 25809 - DNA, 25 bp, Mus musculus
cttggactgactcttaagatgcaga

SEQ ID NO: 25810 - DNA, 25 bp, Mus musculus
cttggactgactgttaagatgcaga

SEQ ID NO: 25811 - DNA, 25 bp, Mus musculus
cttggactgggcactacagcagcga

SEQ ID NO: 25812 - DNA, 25 bp, Mus musculus
cttggagacttggacacgggtcctg

SEQ ID NO: 25813 - DNA, 25 bp, Mus musculus
cttggagcactcaccgggagctgtg

SEQ ID NO: 25814 - DNA, 25 bp, Mus musculus
cttggagcactgaaggttggcacca

SEQ ID NO: 25815 - DNA, 25 bp, Mus musculus
cttggagctcggaaggtccagagca

SEQ ID NO: 25816 - DNA, 25 bp, Mus musculus
cttggaggaaacaatgccattattg

SEQ ID NO: 25817 - DNA, 25 bp, Mus musculus
cttggaggtgaagtgtcctgcttag

SEQ ID NO: 25818 - DNA, 25 bp, Mus musculus
cttggatagctcaataccatccctg

SEQ ID NO: 25819 - DNA, 25 bp, Mus musculus
cttggatctcagtcaatggagtgtg

SEQ ID NO: 25820 - DNA, 25 bp, Mus musculus
cttggattctttatgcagctgagga

SEQ ID NO: 25821 - DNA, 25 bp, Mus musculus
cttggcaaatggtccacagagacaa

SEQ ID NO: 25822 - DNA, 25 bp, Mus musculus
cttggcaaccatggctcaagaggtg

SEQ ID NO: 25823 - DNA, 25 bp, Mus musculus
cttggcagatagaaacgtctgggca

SEQ ID NO: 25824 - DNA, 25 bp, Mus musculus
cttggcagatcttacagagcagcag

SEQ ID NO: 25825 - DNA, 25 bp, Mus musculus
cttggcagttgatgatatagaaaca

SEQ ID NO: 25826 - DNA, 25 bp, Mus musculus
cttggcatccaagatacgatgggca

SEQ ID NO: 25827 - DNA, 25 bp, Mus musculus
cttggcatcccagaaacaatttctc

SEQ ID NO: 25828 - DNA, 25 bp, Mus musculus
cttggcatctggctcatttgtaaac

SEQ ID NO: 25829 - DNA, 25 bp, Mus musculus
cttggcatggcctgttagtgctccc

SEQ ID NO: 25830 - DNA, 25 bp, Mus musculus
cttggccattggcaacgagttgaac

SEQ ID NO: 25831 - DNA, 25 bp, Mus musculus
cttggcccgaatcttcacttctgtt

SEQ ID NO: 25832 - DNA, 25 bp, Mus musculus
cttggccgacaggaatggggcactt

SEQ ID NO: 25833 - DNA, 25 bp, Mus musculus
cttggcctgctgtcgtttagttgat

SEQ ID NO: 25834 - DNA, 25 bp, Mus musculus
cttggccttcccagcagtggccttg

SEQ ID NO: 25835 - DNA, 25 bp, Mus musculus
cttggccttctcgtgtcctgtctga

SEQ ID NO: 25836 - DNA, 25 bp, Mus musculus
cttggccttgcgctgggcccgcata

SEQ ID NO: 25837 - DNA, 25 bp, Mus musculus
cttggcgaagttactttcaatggag

SEQ ID NO: 25838 - DNA, 25 bp, Mus musculus
cttggctccatagcagggctgggta

SEQ ID NO: 25839 - DNA, 25 bp, Mus musculus
cttggctcctaccaaggccttggaa

SEQ ID NO: 25840 - DNA, 25 bp, Mus musculus
cttggctctgaagttcatactcgca

SEQ ID NO: 25841 - DNA, 25 bp, Mus musculus
cttggctctgggacctagaatggga

SEQ ID NO: 25842 - DNA, 25 bp, Mus musculus
cttggcttggagtctgaagtcttgc

SEQ ID NO: 25843 - DNA, 25 bp, Mus musculus
cttgggaaaatactggatgacctcg

SEQ ID NO: 25844 - DNA, 25 bp, Mus musculus
cttgggaaaatagtggatgacctcg

SEQ ID NO: 25845 - DNA, 25 bp, Mus musculus
cttgggaacctagctgatgataggg

SEQ ID NO: 25846 - DNA, 25 bp, Mus musculus
cttgggaatcagtaaaccatggcat

SEQ ID NO: 25847 - DNA, 25 bp, Mus musculus
cttgggagaattaatggagcaatga

SEQ ID NO: 25848 - DNA, 25 bp, Mus musculus
cttgggagaatttatggagcaatga

SEQ ID NO: 25849 - DNA, 25 bp, Mus musculus
cttgggccccatgaaactgctcttt

SEQ ID NO: 25850 - DNA, 25 bp, Mus musculus
cttgggctatggcatagactataca

SEQ ID NO: 25851 - DNA, 25 bp, Mus musculus
cttgggcttacgagatcatgtggca

SEQ ID NO: 25852 - DNA, 25 bp, Mus musculus
cttgggcttacgtgatcatgtggca

SEQ ID NO: 25853 - DNA, 25 bp, Mus musculus
cttgggctttggcagtggtcatttc

SEQ ID NO: 25854 - DNA, 25 bp, Mus musculus
cttgggtatggatgaactttctgag

SEQ ID NO: 25855 - DNA, 25 bp, Mus musculus
cttgggtccgaaatccagaactgtc

SEQ ID NO: 25856 - DNA, 25 bp, Mus musculus
cttgggtcctccgtgagagcaacaa

SEQ ID NO: 25857 - DNA, 25 bp, Mus musculus
cttgggtctattaaatcatcaccag

SEQ ID NO: 25858 - DNA, 25 bp, Mus musculus
cttgggtgcaactgaaagagcaaga

SEQ ID NO: 25859 - DNA, 25 bp, Mus musculus
cttgggtgcattcagcctttggtga

SEQ ID NO: 25860 - DNA, 25 bp, Mus musculus
cttgggtggccttctttgccagcaa

SEQ ID NO: 25861 - DNA, 25 bp, Mus musculus
cttgggttttggcagcctgatcgct

SEQ ID NO: 25862 - DNA, 25 bp, Mus musculus
cttggtaagcgaaacagactcagat

SEQ ID NO: 25863 - DNA, 25 bp, Mus musculus
cttggtaggagtttgctaagaggcc

SEQ ID NO: 25864 - DNA, 25 bp, Mus musculus
cttggtcccctgcaaaaccttatag

SEQ ID NO: 25865 - DNA, 25 bp, Mus musculus
cttggtgaacatccagaaaacccac

SEQ ID NO: 25866 - DNA, 25 bp, Mus musculus
cttggtgagcaagactggcaagcac

SEQ ID NO: 25867 - DNA, 25 bp, Mus musculus
cttggttacgaacggagcgaatgtc

SEQ ID NO: 25868 - DNA, 25 bp, Mus musculus
cttggttcccatggactcgccagga

SEQ ID NO: 25869 - DNA, 25 bp, Mus musculus
cttggttcttgaaaaacattctgga

SEQ ID NO: 25870 - DNA, 25 bp, Mus musculus
cttggttggaggcagtgatacacct

SEQ ID NO: 25871 - DNA, 25 bp, Mus musculus
cttgtaagcaaacctgccattggtc

SEQ ID NO: 25872 - DNA, 25 bp, Mus musculus
cttgtaagttctactgaaacatgac

SEQ ID NO: 25873 - DNA, 25 bp, Mus musculus
cttgtacaggttgggagatgcagcc

SEQ ID NO: 25874 - DNA, 25 bp, Mus musculus
cttgtacatgctcacatcaagttga

SEQ ID NO: 25875 - DNA, 25 bp, Mus musculus
cttgtacatgctgacatcaagttga

SEQ ID NO: 25876 - DNA, 25 bp, Mus musculus
cttgtaccacgagctgatgaagcat

SEQ ID NO: 25877 - DNA, 25 bp, Mus musculus
cttgtaccctggcatacagtttgaa

SEQ ID NO: 25878 - DNA, 25 bp, Mus musculus
cttgtattgcagtacaacttgggac

SEQ ID NO: 25879 - DNA, 25 bp, Mus musculus
cttgtcagggcctgagaaccgctcc

SEQ ID NO: 25880 - DNA, 25 bp, Mus musculus
cttgtcagtctgagttacgtcgtga

SEQ ID NO: 25881 - DNA, 25 bp, Mus musculus
cttgtcatcctttggagaattacag

SEQ ID NO: 25882 - DNA, 25 bp, Mus musculus
cttgtcatctgccagtgcccctgtg

SEQ ID NO: 25883 - DNA, 25 bp, Mus musculus
cttgtccacggaacaccaataagag

SEQ ID NO: 25884 - DNA, 25 bp, Mus musculus
cttgtccatggaaaagaagctcgac

SEQ ID NO: 25885 - DNA, 25 bp, Mus musculus
cttgtcccaaaagcccaagtattca

SEQ ID NO: 25886 - DNA, 25 bp, Mus musculus
cttgtcccctcttccatgcttatga

SEQ ID NO: 25887 - DNA, 25 bp, Mus musculus
cttgtccgcatcatcagtatccttg

SEQ ID NO: 25888 - DNA, 25 bp, Mus musculus
cttgtcctaggaagaaagggagcga

SEQ ID NO: 25889 - DNA, 25 bp, Mus musculus
cttgtcctggccctgggattccttg

SEQ ID NO: 25890 - DNA, 25 bp, Mus musculus
cttgtccttcaggatgcttcggcag

SEQ ID NO: 25891 - DNA, 25 bp, Mus musculus
cttgtcgcgcgggtttatgagagca

SEQ ID NO: 25892 - DNA, 25 bp, Mus musculus
cttgtcggctgtctcttcaccatag

SEQ ID NO: 25893 - DNA, 25 bp, Mus musculus
cttgtctatagtaggaaatgttgca

SEQ ID NO: 25894 - DNA, 25 bp, Mus musculus
cttgtctatgaagccctcagctggc

SEQ ID NO: 25895 - DNA, 25 bp, Mus musculus
cttgtctcagagagcagtagagatg

SEQ ID NO: 25896 - DNA, 25 bp, Mus musculus
cttgtctcgaggatctgtgggagcc

SEQ ID NO: 25897 - DNA, 25 bp, Mus musculus
cttgtctctaacacaccagtgggtc

SEQ ID NO: 25898 - DNA, 25 bp, Mus musculus
cttgtgaagcttggaagttgcaaac

SEQ ID NO: 25899 - DNA, 25 bp, Mus musculus
cttgtgagtttgaagactgcctggt

SEQ ID NO: 25900 - DNA, 25 bp, Mus musculus
cttgtgctatgcctgtaatgaaggg

SEQ ID NO: 25901 - DNA, 25 bp, Mus musculus
cttgtgctgaccagtgatcagtcct

SEQ ID NO: 25902 - DNA, 25 bp, Mus musculus
cttgtggtactctggactgcaggac

SEQ ID NO: 25903 - DNA, 25 bp, Mus musculus
cttgtggttcttaatcagcctttgg

SEQ ID NO: 25904 - DNA, 25 bp, Mus musculus
cttgtgtcggcagttgttgaatatg

SEQ ID NO: 25905 - DNA, 25 bp, Mus musculus
cttgtgtgaacccaaaacttcctgg

SEQ ID NO: 25906 - DNA, 25 bp, Mus musculus
cttgtgtgaaccgaaaacttcctgg

SEQ ID NO: 25907 - DNA, 25 bp, Mus musculus
cttgtgtgcctttgatcagcgctgc

SEQ ID NO: 25908 - DNA, 25 bp, Mus musculus
cttgtgtggcaaactgtggaaagat

SEQ ID NO: 25909 - DNA, 25 bp, Mus musculus
cttgtgttaaggcaaaaggccaagg

SEQ ID NO: 25910 - DNA, 25 bp, Mus musculus
cttgtgttggaagatggatgactca

SEQ ID NO: 25911 - DNA, 25 bp, Mus musculus
cttgtgtttggtgctgctcgttggc

SEQ ID NO: 25912 - DNA, 25 bp, Mus musculus
cttgttcctaggtggacacaccact

SEQ ID NO: 25913 - DNA, 25 bp, Mus musculus
cttgttctacgccatccccagtgaa

SEQ ID NO: 25914 - DNA, 25 bp, Mus musculus
cttgttgatgaggtttggtgtgtta

SEQ ID NO: 25915 - DNA, 25 bp, Mus musculus
cttgttggagcttggaggaaacaat

SEQ ID NO: 25916 - DNA, 25 bp, Mus musculus
cttgttgtcatgcattgcaagaggg

SEQ ID NO: 25917 - DNA, 25 bp, Mus musculus
cttgttgtttctggtcccggtctca

SEQ ID NO: 25918 - DNA, 25 bp, Mus musculus
cttgtttaaattcttggtcatcgga

SEQ ID NO: 25919 - DNA, 25 bp, Mus musculus
cttgtttaaattgttggtcatcgga

SEQ ID NO: 25920 - DNA, 25 bp, Mus musculus
cttgtttagcttcttcagtagctga

SEQ ID NO: 25921 - DNA, 25 bp, Mus musculus
cttgtttttgtgtcactggcaggta

SEQ ID NO: 25922 - DNA, 25 bp, Mus musculus
ctttaaaacaagaattgccaactgg

SEQ ID NO: 25923 - DNA, 25 bp, Mus musculus
ctttaaaagcaaaactctgctgggc

SEQ ID NO: 25924 - DNA, 25 bp, Mus musculus
ctttaaagaataagcaagagttgtg

SEQ ID NO: 25925 - DNA, 25 bp, Mus musculus
ctttaaagaggaacagctgctggca

SEQ ID NO: 25926 - DNA, 25 bp, Mus musculus
ctttaaatgggaataaaggatagcg

SEQ ID NO: 25927 - DNA, 25 bp, Mus musculus
ctttaaccatgcacacaaggtggcc

SEQ ID NO: 25928 - DNA, 25 bp, Mus musculus
ctttaagtggagtggagaaaactca

SEQ ID NO: 25929 - DNA, 25 bp, Mus musculus
ctttacacaagtcctcaactaggga

SEQ ID NO: 25930 - DNA, 25 bp, Mus musculus
ctttacactagccaaaagaggagag

SEQ ID NO: 25931 - DNA, 25 bp, Mus musculus
ctttacagagcggtgatgagagaaa

SEQ ID NO: 25932 - DNA, 25 bp, Mus musculus
ctttaccacgtaatatgcaccagtg

SEQ ID NO: 25933 - DNA, 25 bp, Mus musculus
ctttacctgtgtgcgggaacccagg

SEQ ID NO: 25934 - DNA, 25 bp, Mus musculus
ctttacgtggcagctgggagatgct

SEQ ID NO: 25935 - DNA, 25 bp, Mus musculus
ctttacttcgaaaagaagagcgagc

SEQ ID NO: 25936 - DNA, 25 bp, Mus musculus
ctttagcacacatgtttgagcgcat

SEQ ID NO: 25937 - DNA, 25 bp, Mus musculus
ctttagtcccgctaagtctgtctct

SEQ ID NO: 25938 - DNA, 25 bp, Mus musculus
ctttatatggccaaggagaacttcc

SEQ ID NO: 25939 - DNA, 25 bp, Mus musculus
ctttatcgtgagtaacatccagctg

SEQ ID NO: 25940 - DNA, 25 bp, Mus musculus
ctttatctgcagtaggttcccttga

SEQ ID NO: 25941 - DNA, 25 bp, Mus musculus
ctttatgcaaacagacgggacttga

SEQ ID NO: 25942 - DNA, 25 bp, Mus musculus
ctttatggagatggcggacagactg

SEQ ID NO: 25943 - DNA, 25 bp, Mus musculus
ctttcaactacctgactgggcactc

SEQ ID NO: 25944 - DNA, 25 bp, Mus musculus
ctttcaatactaagggtcttatgcg

SEQ ID NO: 25945 - DNA, 25 bp, Mus musculus
ctttcacaagtttgtggctcctgaa

SEQ ID NO: 25946 - DNA, 25 bp, Mus musculus
ctttcaccaagtgggtcaacaaaca

SEQ ID NO: 25947 - DNA, 25 bp, Mus musculus
ctttcaccatgggtgtcattggtgg

SEQ ID NO: 25948 - DNA, 25 bp, Mus musculus
ctttcacctcagaatagtgctgcct

SEQ ID NO: 25949 - DNA, 25 bp, Mus musculus
ctttcacctgattaagatcattggg

SEQ ID NO: 25950 - DNA, 25 bp, Mus musculus
ctttcactgaactcagaacttgctg

SEQ ID NO: 25951 - DNA, 25 bp, Mus musculus
ctttcagacttggtctatacactgg

SEQ ID NO: 25952 - DNA, 25 bp, Mus musculus
ctttcagatgaagcctggcggccca

SEQ ID NO: 25953 - DNA, 25 bp, Mus musculus
ctttcagccctaacaccctattgga

SEQ ID NO: 25954 - DNA, 25 bp, Mus musculus
ctttcagctgggaatagagttcgac

SEQ ID NO: 25955 - DNA, 25 bp, Mus musculus
ctttcaggaacgtcaagcccatcag

SEQ ID NO: 25956 - DNA, 25 bp, Mus musculus
ctttcagggctggaagcttggatac

SEQ ID NO: 25957 - DNA, 25 bp, Mus musculus
ctttcaggtggtgtgccttcaggca

SEQ ID NO: 25958 - DNA, 25 bp, Mus musculus
ctttcagtggaagaggtagaagcag

SEQ ID NO: 25959 - DNA, 25 bp, Mus musculus
ctttcagttctcaagccattccaga

SEQ ID NO: 25960 - DNA, 25 bp, Mus musculus
ctttcataaacaactaggaagtata

SEQ ID NO: 25961 - DNA, 25 bp, Mus musculus
ctttcataaaggcatcggacagtgg

SEQ ID NO: 25962 - DNA, 25 bp, Mus musculus
ctttcataattccaggccgaaccag

SEQ ID NO: 25963 - DNA, 25 bp, Mus musculus
ctttcatgctttggagatcggatac

SEQ ID NO: 25964 - DNA, 25 bp, Mus musculus
ctttccaagaccaggcatctatatt

SEQ ID NO: 25965 - DNA, 25 bp, Mus musculus
ctttccaagtggagactcgttcatg

SEQ ID NO: 25966 - DNA, 25 bp, Mus musculus
ctttccaccatagaaaaggactcta

SEQ ID NO: 25967 - DNA, 25 bp, Mus musculus
ctttccagttatgaagctccaggtg

SEQ ID NO: 25968 - DNA, 25 bp, Mus musculus
ctttccccaagtcaaaagcagagct

SEQ ID NO: 25969 - DNA, 25 bp, Mus musculus
ctttccccaagtgaaaagcagagct

SEQ ID NO: 25970 - DNA, 25 bp, Mus musculus
ctttccccagcaataaactggtctc

SEQ ID NO: 25971 - DNA, 25 bp, Mus musculus
ctttccctacagagatgatataatg

SEQ ID NO: 25972 - DNA, 25 bp, Mus musculus
ctttccctgcaaggctgcagagctt

SEQ ID NO: 25973 - DNA, 25 bp, Mus musculus
ctttccctgcccagatggccaagca

SEQ ID NO: 25974 - DNA, 25 bp, Mus musculus
ctttcctacagagaagggtgggttg

SEQ ID NO: 25975 - DNA, 25 bp, Mus musculus
ctttcctatcccagagagttttgtc

SEQ ID NO: 25976 - DNA, 25 bp, Mus musculus
ctttcctcactgatgagagttccct

SEQ ID NO: 25977 - DNA, 25 bp, Mus musculus
ctttcctccatgcagcagttcaagt

SEQ ID NO: 25978 - DNA, 25 bp, Mus musculus
ctttcctccggaaggtggcgccaca

SEQ ID NO: 25979 - DNA, 25 bp, Mus musculus
ctttccttccaagggttagctgagt

SEQ ID NO: 25980 - DNA, 25 bp, Mus musculus
ctttccttgagcaagttccagttaa

SEQ ID NO: 25981 - DNA, 25 bp, Mus musculus
ctttcgaaaatagtgcggatgcgga

SEQ ID NO: 25982 - DNA, 25 bp, Mus musculus
ctttcgaaatatcatagtagccatg

SEQ ID NO: 25983 - DNA, 25 bp, Mus musculus
ctttctacacagtgtggcatctgct

SEQ ID NO: 25984 - DNA, 25 bp, Mus musculus
ctttctacctcttgtcatctgccag

SEQ ID NO: 25985 - DNA, 25 bp, Mus musculus
ctttctacgtcttaaggcagagact

SEQ ID NO: 25986 - DNA, 25 bp, Mus musculus
ctttctagattctgaagctggtgga

SEQ ID NO: 25987 - DNA, 25 bp, Mus musculus
ctttctagtagggaggccagcagcg

SEQ ID NO: 25988 - DNA, 25 bp, Mus musculus
ctttctccacctaccatgtgctagg

SEQ ID NO: 25989 - DNA, 25 bp, Mus musculus
ctttctctaagctgaaggtggagat

SEQ ID NO: 25990 - DNA, 25 bp, Mus musculus
ctttctctctactgtaggaggagct

SEQ ID NO: 25991 - DNA, 25 bp, Mus musculus
ctttctctggcacccaagcagacag

SEQ ID NO: 25992 - DNA, 25 bp, Mus musculus
ctttctgcctgagagcgtggctgtg

SEQ ID NO: 25993 - DNA, 25 bp, Mus musculus
ctttctgctgctggtagggatttaa

SEQ ID NO: 25994 - DNA, 25 bp, Mus musculus
ctttctgcttctggtgtgttgaggt

SEQ ID NO: 25995 - DNA, 25 bp, Mus musculus
ctttctggtgttggtgacaggctgc

SEQ ID NO: 25996 - DNA, 25 bp, Mus musculus
ctttctgttgagcagcccaccgtct

SEQ ID NO: 25997 - DNA, 25 bp, Mus musculus
ctttctgttttgcacagccgtgttg

SEQ ID NO: 25998 - DNA, 25 bp, Mus musculus
ctttctgttttggacagccgtgttg

SEQ ID NO: 25999 - DNA, 25 bp, Mus musculus
ctttgaaaagctgcggctgacatta

SEQ ID NO: 26000 - DNA, 25 bp, Mus musculus
ctttgaacacaagcacaatattcgg

SEQ ID NO: 26001 - DNA, 25 bp, Mus musculus
ctttgaacatgctggcccgtccctt

SEQ ID NO: 26002 - DNA, 25 bp, Mus musculus
ctttgaagaaatcgacagggatggc

SEQ ID NO: 26003 - DNA, 25 bp, Mus musculus
ctttgaagatggtcagcccgtgcag

SEQ ID NO: 26004 - DNA, 25 bp, Mus musculus
ctttgaaggagagtacacacatcac

SEQ ID NO: 26005 - DNA, 25 bp, Mus musculus
ctttgaagtgggagcccagttggaa

SEQ ID NO: 26006 - DNA, 25 bp, Mus musculus
ctttgaagtttcaacattagtggga

SEQ ID NO: 26007 - DNA, 25 bp, Mus musculus
ctttgaagtttctacattagtggga

SEQ ID NO: 26008 - DNA, 25 bp, Mus musculus
ctttgacatgcaagaggttgttctg

SEQ ID NO: 26009 - DNA, 25 bp, Mus musculus
ctttgacgacgcagtggaagaacgg

SEQ ID NO: 26010 - DNA, 25 bp, Mus musculus
ctttgacgatggtgagatgaacaga

SEQ ID NO: 26011 - DNA, 25 bp, Mus musculus
ctttgagaaacctgtggtcatgaag

SEQ ID NO: 26012 - DNA, 25 bp, Mus musculus
ctttgagagcaggagcacatttccc

SEQ ID NO: 26013 - DNA, 25 bp, Mus musculus
ctttgagagctacctggcagttgcc

SEQ ID NO: 26014 - DNA, 25 bp, Mus musculus
ctttgagaggaaggttacagttaga

SEQ ID NO: 26015 - DNA, 25 bp, Mus musculus
ctttgagatcaatgaggcctttgca

SEQ ID NO: 26016 - DNA, 25 bp, Mus musculus
ctttgagatcgctcagggcaggctg

SEQ ID NO: 26017 - DNA, 25 bp, Mus musculus
ctttgagccttcactgtctgttgga

SEQ ID NO: 26018 - DNA, 25 bp, Mus musculus
ctttgaggaagaatgcctggagttt

SEQ ID NO: 26019 - DNA, 25 bp, Mus musculus
ctttgaggacctctgcctgcttttg

SEQ ID NO: 26020 - DNA, 25 bp, Mus musculus
ctttgaggaggtagccccttgcacc

SEQ ID NO: 26021 - DNA, 25 bp, Mus musculus
ctttgaggaggttgccccttgcacc

SEQ ID NO: 26022 - DNA, 25 bp, Mus musculus
ctttgagtgtggtgcgttcaatcct

SEQ ID NO: 26023 - DNA, 25 bp, Mus musculus
ctttgatagaccctgtgtacgggca

SEQ ID NO: 26024 - DNA, 25 bp, Mus musculus
ctttgatccggccaatggcaagttc

SEQ ID NO: 26025 - DNA, 25 bp, Mus musculus
ctttgatgaatgtgagagcggagaa

SEQ ID NO: 26026 - DNA, 25 bp, Mus musculus
ctttgatgacctggccatgtttgtc

SEQ ID NO: 26027 - DNA, 25 bp, Mus musculus
ctttgatgactcctgccttgacccg

SEQ ID NO: 26028 - DNA, 25 bp, Mus musculus
ctttgatgaggaggacacaaaagga

SEQ ID NO: 26029 - DNA, 25 bp, Mus musculus
ctttgatgatcttccgcctgctgcc

SEQ ID NO: 26030 - DNA, 25 bp, Mus musculus
ctttgatggccatggcataaggagc

SEQ ID NO: 26031 - DNA, 25 bp, Mus musculus
ctttgatgtgctgagcttcacggca

SEQ ID NO: 26032 - DNA, 25 bp, Mus musculus
ctttgattaagaagaatgaaggact

SEQ ID NO: 26033 - DNA, 25 bp, Mus musculus
ctttgcaagtgtgcactaagtaagc

SEQ ID NO: 26034 - DNA, 25 bp, Mus musculus
ctttgcagggcccagttgatggcct

SEQ ID NO: 26035 - DNA, 25 bp, Mus musculus
ctttgccaaaggtcgctcccagttc

SEQ ID NO: 26036 - DNA, 25 bp, Mus musculus
ctttgctcaagcaccagtgggacct

SEQ ID NO: 26037 - DNA, 25 bp, Mus musculus
ctttgctccgctgcttggattacag

SEQ ID NO: 26038 - DNA, 25 bp, Mus musculus
ctttgctgcagttcatcttccttcc

SEQ ID NO: 26039 - DNA, 25 bp, Mus musculus
ctttgctgcgtgatgaggatcggct

SEQ ID NO: 26040 - DNA, 25 bp, Mus musculus
ctttgctggcactgcccccagttgt

SEQ ID NO: 26041 - DNA, 25 bp, Mus musculus
ctttggaagccatttaatcagggaa

SEQ ID NO: 26042 - DNA, 25 bp, Mus musculus
ctttggactatgagcagcagaggtt

SEQ ID NO: 26043 - DNA, 25 bp, Mus musculus
ctttggagacggctgttttccagac

SEQ ID NO: 26044 - DNA, 25 bp, Mus musculus
ctttggagagtctgcccagtgctta

SEQ ID NO: 26045 - DNA, 25 bp, Mus musculus
ctttggagatcggatacagggacat

SEQ ID NO: 26046 - DNA, 25 bp, Mus musculus
ctttggaggagactacaatgagctg

SEQ ID NO: 26047 - DNA, 25 bp, Mus musculus
ctttggagggcctggataaccagga

SEQ ID NO: 26048 - DNA, 25 bp, Mus musculus
ctttggatgccagtgtgagttgtca

SEQ ID NO: 26049 - DNA, 25 bp, Mus musculus
ctttggatggatgaatggcctgaga

SEQ ID NO: 26050 - DNA, 25 bp, Mus musculus
ctttggcaccgacaggagactcctg

SEQ ID NO: 26051 - DNA, 25 bp, Mus musculus
ctttggcaggaaatgggacccatac

SEQ ID NO: 26052 - DNA, 25 bp, Mus musculus
ctttggcctggccagggatatcaac

SEQ ID NO: 26053 - DNA, 25 bp, Mus musculus
ctttggcctggtggactcagagaag

SEQ ID NO: 26054 - DNA, 25 bp, Mus musculus
ctttggctgcatcccttgtggtctt

SEQ ID NO: 26055 - DNA, 25 bp, Mus musculus
ctttggctgcatgccttgtggtctt

SEQ ID NO: 26056 - DNA, 25 bp, Mus musculus
ctttgggaatggcaagaacagcagt

SEQ ID NO: 26057 - DNA, 25 bp, Mus musculus
ctttgggagaaggaatcataactga

SEQ ID NO: 26058 - DNA, 25 bp, Mus musculus
ctttgggatttgttgtgatctgcgc

SEQ ID NO: 26059 - DNA, 25 bp, Mus musculus
ctttgggcgacctgctatgaaggca

SEQ ID NO: 26060 - DNA, 25 bp, Mus musculus
ctttgggctcaatccatgatcgttg

SEQ ID NO: 26061 - DNA, 25 bp, Mus musculus
ctttggtcttctaagtcttctgtga

SEQ ID NO: 26062 - DNA, 25 bp, Mus musculus
ctttggtggccccaaaggacatgac

SEQ ID NO: 26063 - DNA, 25 bp, Mus musculus
ctttggtgtacatgaggaaagcaca

SEQ ID NO: 26064 - DNA, 25 bp, Mus musculus
ctttgtagaattggaggtgagcaac

SEQ ID NO: 26065 - DNA, 25 bp, Mus musculus
ctttgtagagagagaagctagtgag

SEQ ID NO: 26066 - DNA, 25 bp, Mus musculus
ctttgtcctacttccagaatgccca

SEQ ID NO: 26067 - DNA, 25 bp, Mus musculus
ctttgtcctggagtgtcctttttgg

SEQ ID NO: 26068 - DNA, 25 bp, Mus musculus
ctttgtctagaaagaatcgcaccgc

SEQ ID NO: 26069 - DNA, 25 bp, Mus musculus
ctttgtctagaatgaatcgcaccgc

SEQ ID NO: 26070 - DNA, 25 bp, Mus musculus
ctttgtctgttgctgcctctgcgta

SEQ ID NO: 26071 - DNA, 25 bp, Mus musculus
ctttgtgcccacctgggatttgtcg

SEQ ID NO: 26072 - DNA, 25 bp, Mus musculus
ctttgtggaagccactgctctgcac

SEQ ID NO: 26073 - DNA, 25 bp, Mus musculus
ctttgtggacgctggcaatgctttc

SEQ ID NO: 26074 - DNA, 25 bp, Mus musculus
ctttgtggccctcaagagtgtgaga

SEQ ID NO: 26075 - DNA, 25 bp, Mus musculus
ctttgtggctctccctgcggtcata

SEQ ID NO: 26076 - DNA, 25 bp, Mus musculus
ctttgtggctctgcctgcggtcata

SEQ ID NO: 26077 - DNA, 25 bp, Mus musculus
ctttgtgggataaacccaactgttg

SEQ ID NO: 26078 - DNA, 25 bp, Mus musculus
ctttgtggtcgtggtctgcctggca

SEQ ID NO: 26079 - DNA, 25 bp, Mus musculus
ctttgtgtggaggttcatgactgca

SEQ ID NO: 26080 - DNA, 25 bp, Mus musculus
ctttgtgtgttctacctgtcgggcc

SEQ ID NO: 26081 - DNA, 25 bp, Mus musculus
ctttgttttgccattctctacagca

SEQ ID NO: 26082 - DNA, 25 bp, Mus musculus
cttttaaaatgcaagttcttccaga

SEQ ID NO: 26083 - DNA, 25 bp, Mus musculus
cttttaacacaagggagcccgtgat

SEQ ID NO: 26084 - DNA, 25 bp, Mus musculus
cttttaagccatggcctatcagtta

SEQ ID NO: 26085 - DNA, 25 bp, Mus musculus
cttttagaaaaagatccttatgcac

SEQ ID NO: 26086 - DNA, 25 bp, Mus musculus
cttttaggaagagcaccatatccaa

SEQ ID NO: 26087 - DNA, 25 bp, Mus musculus
cttttatccatgacccaagatgact

SEQ ID NO: 26088 - DNA, 25 bp, Mus musculus
cttttatgacagtgctcctagtggg

SEQ ID NO: 26089 - DNA, 25 bp, Mus musculus
cttttattcagcaggaagatggatg

SEQ ID NO: 26090 - DNA, 25 bp, Mus musculus
cttttcaagtatagtggtctgctac

SEQ ID NO: 26091 - DNA, 25 bp, Mus musculus
cttttcaagtattgtggtctgctac

SEQ ID NO: 26092 - DNA, 25 bp, Mus musculus
cttttcagaccaagcttatcccaca

SEQ ID NO: 26093 - DNA, 25 bp, Mus musculus
cttttcagtaaacaacgaaggcgag

SEQ ID NO: 26094 - DNA, 25 bp, Mus musculus
cttttcagtatgtgctctgtgctgc

SEQ ID NO: 26095 - DNA, 25 bp, Mus musculus
cttttcatgcagattgaggctcttt

SEQ ID NO: 26096 - DNA, 25 bp, Mus musculus
cttttccggaatggacggaagctga

SEQ ID NO: 26097 - DNA, 25 bp, Mus musculus
cttttctactttggtgatgaccaac

SEQ ID NO: 26098 - DNA, 25 bp, Mus musculus
cttttctgctacaatgggtagcttc

SEQ ID NO: 26099 - DNA, 25 bp, Mus musculus
cttttctgtgttacagtgccctggt

SEQ ID NO: 26100 - DNA, 25 bp, Mus musculus
cttttcttacagctcctgggtctac

SEQ ID NO: 26101 - DNA, 25 bp, Mus musculus
cttttgaaactctacaagatcggca

SEQ ID NO: 26102 - DNA, 25 bp, Mus musculus
cttttgaaatcctgtcatgcagtgt

SEQ ID NO: 26103 - DNA, 25 bp, Mus musculus
cttttgattgaaagggacagcctgt

SEQ ID NO: 26104 - DNA, 25 bp, Mus musculus
cttttgctccagacagtcccaggtg

SEQ ID NO: 26105 - DNA, 25 bp, Mus musculus
cttttggagacgtgctagagagtga

SEQ ID NO: 26106 - DNA, 25 bp, Mus musculus
cttttggataagaaagctagcccca

SEQ ID NO: 26107 - DNA, 25 bp, Mus musculus
cttttggatgatttagataccgttc

SEQ ID NO: 26108 - DNA, 25 bp, Mus musculus
cttttgttggaaatgaccttcacgg

SEQ ID NO: 26109 - DNA, 25 bp, Mus musculus
ctttttaaagcgagaatcattcatt

SEQ ID NO: 26110 - DNA, 25 bp, Mus musculus
ctttttatgtccaggagtcctgcac

SEQ ID NO: 26111 - DNA, 25 bp, Mus musculus
ctttttatgtcctggagtcctgcac

SEQ ID NO: 26112 - DNA, 25 bp, Mus musculus
ctttttcagctatcaagaattccat

SEQ ID NO: 26113 - DNA, 25 bp, Mus musculus
ctttttccatttggtctcgtggcaa

SEQ ID NO: 26114 - DNA, 25 bp, Mus musculus
ctttttccggaaaatgtaatgcaga

SEQ ID NO: 26115 - DNA, 25 bp, Mus musculus
ctttttcctgcaatacagtggatac

SEQ ID NO: 26116 - DNA, 25 bp, Mus musculus
gaaaaaacacttggtcacaacccag

SEQ ID NO: 26117 - DNA, 25 bp, Mus musculus
gaaaaaacagtgctcggaaagcatc

SEQ ID NO: 26118 - DNA, 25 bp, Mus musculus
gaaaaaacccacaccgaggtcacag

SEQ ID NO: 26119 - DNA, 25 bp, Mus musculus
gaaaaaactccagaacagattatgc

SEQ ID NO: 26120 - DNA, 25 bp, Mus musculus
gaaaaaactccgctcttccgtcata

SEQ ID NO: 26121 - DNA, 25 bp, Mus musculus
gaaaaaactctctacttaatcatgg

SEQ ID NO: 26122 - DNA, 25 bp, Mus musculus
gaaaaaagatctctatgcacggatg

SEQ ID NO: 26123 - DNA, 25 bp, Mus musculus
gaaaaaagcaaggaaagttccagag

SEQ ID NO: 26124 - DNA, 25 bp, Mus musculus
gaaaaaaggcaacatggatgagacc

SEQ ID NO: 26125 - DNA, 25 bp, Mus musculus
gaaaaaatcagtcagctctatggag

SEQ ID NO: 26126 - DNA, 25 bp, Mus musculus
gaaaaaatcccaaacgtgctcttct

SEQ ID NO: 26127 - DNA, 25 bp, Mus musculus
gaaaaaatgggaggcgcgacaagta

SEQ ID NO: 26128 - DNA, 25 bp, Mus musculus
gaaaaaatttttgacatgttgaaga

SEQ ID NO: 26129 - DNA, 25 bp, Mus musculus
gaaaaacaacttaactgcagatatc

SEQ ID NO: 26130 - DNA, 25 bp, Mus musculus
gaaaaacaagaattacgtcattgag

SEQ ID NO: 26131 - DNA, 25 bp, Mus musculus
gaaaaacaagcctcctgagcacgtt

SEQ ID NO: 26132 - DNA, 25 bp, Mus musculus
gaaaaacaatttgaactgtcagaac

SEQ ID NO: 26133 - DNA, 25 bp, Mus musculus
gaaaaacagcagattacgcctttga

SEQ ID NO: 26134 - DNA, 25 bp, Mus musculus
gaaaaacagccacaaaagcccagtg

SEQ ID NO: 26135 - DNA, 25 bp, Mus musculus
gaaaaacagccagaaaagcccagtg

SEQ ID NO: 26136 - DNA, 25 bp, Mus musculus
gaaaaacatccagatgcagccaacc

SEQ ID NO: 26137 - DNA, 25 bp, Mus musculus
gaaaaacattagcagggtatatcat

SEQ ID NO: 26138 - DNA, 25 bp, Mus musculus
gaaaaacattaggagggtatatcat

SEQ ID NO: 26139 - DNA, 25 bp, Mus musculus
gaaaaaccaccgaccatggccagct

SEQ ID NO: 26140 - DNA, 25 bp, Mus musculus
gaaaaaccaccgtccatggccagct

SEQ ID NO: 26141 - DNA, 25 bp, Mus musculus
gaaaaacccctattcccatcgagag

SEQ ID NO: 26142 - DNA, 25 bp, Mus musculus
gaaaaacgcaccgtgaattcagtaa

SEQ ID NO: 26143 - DNA, 25 bp, Mus musculus
gaaaaacgggatctgccaactacac

SEQ ID NO: 26144 - DNA, 25 bp, Mus musculus
gaaaaactagcccagaagaactgaa

SEQ ID NO: 26145 - DNA, 25 bp, Mus musculus
gaaaaactgccacaggaattgcttc

SEQ ID NO: 26146 - DNA, 25 bp, Mus musculus
gaaaaactgctgacagatcgaaaag

SEQ ID NO: 26147 - DNA, 25 bp, Mus musculus
gaaaaactgctgtcagatcgaaaag

SEQ ID NO: 26148 - DNA, 25 bp, Mus musculus
gaaaaagaactcctgtccgtggtga

SEQ ID NO: 26149 - DNA, 25 bp, Mus musculus
gaaaaagaagtgaaggcagagcaac

SEQ ID NO: 26150 - DNA, 25 bp, Mus musculus
gaaaaagacagtgagcgacgaggct

SEQ ID NO: 26151 - DNA, 25 bp, Mus musculus
gaaaaagacattcacacttatacca

SEQ ID NO: 26152 - DNA, 25 bp, Mus musculus
gaaaaagaggcctcaaagaacgaag

SEQ ID NO: 26153 - DNA, 25 bp, Mus musculus
gaaaaagagttgtcaccctcaaact

SEQ ID NO: 26154 - DNA, 25 bp, Mus musculus
gaaaaagatccttatgcacttgatg

SEQ ID NO: 26155 - DNA, 25 bp, Mus musculus
gaaaaagcaataaggagaaggttgc

SEQ ID NO: 26156 - DNA, 25 bp, Mus musculus
gaaaaagcaatatggagaaggttgc

SEQ ID NO: 26157 - DNA, 25 bp, Mus musculus
gaaaaagcagtgaaagaagacggac

SEQ ID NO: 26158 - DNA, 25 bp, Mus musculus
gaaaaagcagttgatcctaagacac

SEQ ID NO: 26159 - DNA, 25 bp, Mus musculus
gaaaaagctgcttataagactcacg

SEQ ID NO: 26160 - DNA, 25 bp, Mus musculus
gaaaaaggcaatacttgatcgactg

SEQ ID NO: 26161 - DNA, 25 bp, Mus musculus
gaaaaaggcatcaggccatggtgca

SEQ ID NO: 26162 - DNA, 25 bp, Mus musculus
gaaaaaggcttcagcttgggagaga

SEQ ID NO: 26163 - DNA, 25 bp, Mus musculus
gaaaaagtcatatttcccacgttgt

SEQ ID NO: 26164 - DNA, 25 bp, Mus musculus
gaaaaagtcgctctaattcttggtc

SEQ ID NO: 26165 - DNA, 25 bp, Mus musculus
gaaaaagtgctagggatccccgcct

SEQ ID NO: 26166 - DNA, 25 bp, Mus musculus
gaaaaatacatgcatggaacaaaac

SEQ ID NO: 26167 - DNA, 25 bp, Mus musculus
gaaaaatacgaaactcttgagtgcc

SEQ ID NO: 26168 - DNA, 25 bp, Mus musculus
gaaaaatagcctcacggttgtccag

SEQ ID NO: 26169 - DNA, 25 bp, Mus musculus
gaaaaatatctatgcgaaaaccaag

SEQ ID NO: 26170 - DNA, 25 bp, Mus musculus
gaaaaatcgaagcagcaggagtgcc

SEQ ID NO: 26171 - DNA, 25 bp, Mus musculus
gaaaaatcttgcttgatgtctcatg

SEQ ID NO: 26172 - DNA, 25 bp, Mus musculus
gaaaaatgccaactgaaaggtgtca

SEQ ID NO: 26173 - DNA, 25 bp, Mus musculus
gaaaaatgccatacctcaaacagga

SEQ ID NO: 26174 - DNA, 25 bp, Mus musculus
gaaaaatgcctctttccaagtgact

SEQ ID NO: 26175 - DNA, 25 bp, Mus musculus
gaaaaatggccattgtccatctaga

SEQ ID NO: 26176 - DNA, 25 bp, Mus musculus
gaaaaatggctacaaactttctagc

SEQ ID NO: 26177 - DNA, 25 bp, Mus musculus
gaaaacaaaggagaccagcatggga

SEQ ID NO: 26178 - DNA, 25 bp, Mus musculus
gaaaacaacacaggctatatcaacg

SEQ ID NO: 26179 - DNA, 25 bp, Mus musculus
gaaaacaagaaaggtgctggaagaa

SEQ ID NO: 26180 - DNA, 25 bp, Mus musculus
gaaaacaagcctgtatttttccagc

SEQ ID NO: 26181 - DNA, 25 bp, Mus musculus
gaaaacaagggaggagaggacaaat

SEQ ID NO: 26182 - DNA, 25 bp, Mus musculus
gaaaacaatcagatgaatgtctacc

SEQ ID NO: 26183 - DNA, 25 bp, Mus musculus
gaaaacacacacctgaagggaatga

SEQ ID NO: 26184 - DNA, 25 bp, Mus musculus
gaaaacacagaaagggcatctctcc

SEQ ID NO: 26185 - DNA, 25 bp, Mus musculus
gaaaacaccataattctgcaacagc

SEQ ID NO: 26186 - DNA, 25 bp, Mus musculus
gaaaacaccattgaaggagagccgg

SEQ ID NO: 26187 - DNA, 25 bp, Mus musculus
gaaaacagaaagataattgaagccc

SEQ ID NO: 26188 - DNA, 25 bp, Mus musculus
gaaaacagaagtacttcaccagttc

SEQ ID NO: 26189 - DNA, 25 bp, Mus musculus
gaaaacagatggtgtgtacgatccc

SEQ ID NO: 26190 - DNA, 25 bp, Mus musculus
gaaaacagcacatgtgaaaccagac

SEQ ID NO: 26191 - DNA, 25 bp, Mus musculus
gaaaacagcttgaatcccttgacct

SEQ ID NO: 26192 - DNA, 25 bp, Mus musculus
gaaaacaggacagtactccggcatg

SEQ ID NO: 26193 - DNA, 25 bp, Mus musculus
gaaaacatcgattgccattgacaca

SEQ ID NO: 26194 - DNA, 25 bp, Mus musculus
gaaaacatctcagtagcagctcacc

SEQ ID NO: 26195 - DNA, 25 bp, Mus musculus
gaaaacatggagaaaatggagccaa

SEQ ID NO: 26196 - DNA, 25 bp, Mus musculus
gaaaacatggcgcactgtgagtttc

SEQ ID NO: 26197 - DNA, 25 bp, Mus musculus
gaaaacatttatatcagacatagca

SEQ ID NO: 26198 - DNA, 25 bp, Mus musculus
gaaaacattttacattggtggacat

SEQ ID NO: 26199 - DNA, 25 bp, Mus musculus
gaaaaccaccagaccaaggagactg

SEQ ID NO: 26200 - DNA, 25 bp, Mus musculus
gaaaaccagcaactattgcctgttc

SEQ ID NO: 26201 - DNA, 25 bp, Mus musculus
gaaaaccagcaagtattgcctgttc

SEQ ID NO: 26202 - DNA, 25 bp, Mus musculus
gaaaaccaggcacagaatagatcct

SEQ ID NO: 26203 - DNA, 25 bp, Mus musculus
gaaaaccaggtgttaccatatatac

SEQ ID NO: 26204 - DNA, 25 bp, Mus musculus
gaaaaccagtcaggcagctttgctg

SEQ ID NO: 26205 - DNA, 25 bp, Mus musculus
gaaaaccagtgaatctgggcctatg

SEQ ID NO: 26206 - DNA, 25 bp, Mus musculus
gaaaaccagtggagaagtgtccact

SEQ ID NO: 26207 - DNA, 25 bp, Mus musculus
gaaaacccagcaattttcaggtcct

SEQ ID NO: 26208 - DNA, 25 bp, Mus musculus
gaaaacccaggacgaacaatttgca

SEQ ID NO: 26209 - DNA, 25 bp, Mus musculus
gaaaacccaggtcactgcgactttg

SEQ ID NO: 26210 - DNA, 25 bp, Mus musculus
gaaaaccgagaaaaaatgaagcaga

SEQ ID NO: 26211 - DNA, 25 bp, Mus musculus
gaaaacctatcctctctacatgaat

SEQ ID NO: 26212 - DNA, 25 bp, Mus musculus
gaaaaccttgctcagaagcttccaa

SEQ ID NO: 26213 - DNA, 25 bp, Mus musculus
gaaaacgaccacgtctccaagatga

SEQ ID NO: 26214 - DNA, 25 bp, Mus musculus
gaaaacgcaaacgagggaagcgaga

SEQ ID NO: 26215 - DNA, 25 bp, Mus musculus
gaaaacgcagaattgagcaggatct

SEQ ID NO: 26216 - DNA, 25 bp, Mus musculus
gaaaacgctgtcttctagacaggta

SEQ ID NO: 26217 - DNA, 25 bp, Mus musculus
gaaaacggaatgtccatacaaaatg

SEQ ID NO: 26218 - DNA, 25 bp, Mus musculus
gaaaacggctcaaagatgagggtga

SEQ ID NO: 26219 - DNA, 25 bp, Mus musculus
gaaaacggtgacgaacaacttgaag

SEQ ID NO: 26220 - DNA, 25 bp, Mus musculus
gaaaacgtcacccagctgttgcagt

SEQ ID NO: 26221 - DNA, 25 bp, Mus musculus
gaaaacgtcttttgtggaagaagag

SEQ ID NO: 26222 - DNA, 25 bp, Mus musculus
gaaaacgtgcccagaagcagatgtt

SEQ ID NO: 26223 - DNA, 25 bp, Mus musculus
gaaaacgtggacagtagagaagccc

SEQ ID NO: 26224 - DNA, 25 bp, Mus musculus
gaaaactcagggtcttcttccatct

SEQ ID NO: 26225 - DNA, 25 bp, Mus musculus
gaaaactcatatgctcggtgtgcaa

SEQ ID NO: 26226 - DNA, 25 bp, Mus musculus
gaaaactcccggagccagaggtgaa

SEQ ID NO: 26227 - DNA, 25 bp, Mus musculus
gaaaactcgagtacaggcaggcaat

SEQ ID NO: 26228 - DNA, 25 bp, Mus musculus
gaaaactctcacaagtcaagcgata

SEQ ID NO: 26229 - DNA, 25 bp, Mus musculus
gaaaactgaaatcatatattgctga

SEQ ID NO: 26230 - DNA, 25 bp, Mus musculus
gaaaactgaagcaggctaccgagcc

SEQ ID NO: 26231 - DNA, 25 bp, Mus musculus
gaaaactgatatatatgtcaccagc

SEQ ID NO: 26232 - DNA, 25 bp, Mus musculus
gaaaactgcaactgccgtatggtgc

SEQ ID NO: 26233 - DNA, 25 bp, Mus musculus
gaaaactgtggacggctactgagaa

SEQ ID NO: 26234 - DNA, 25 bp, Mus musculus
gaaaacttattatgcctgtgctccc

SEQ ID NO: 26235 - DNA, 25 bp, Mus musculus
gaaaacttcgcacttgtagactcca

SEQ ID NO: 26236 - DNA, 25 bp, Mus musculus
gaaaacttgccgaaattgtttgcgc

SEQ ID NO: 26237 - DNA, 25 bp, Mus musculus
gaaaacttgctgcaactgcagtagg

SEQ ID NO: 26238 - DNA, 25 bp, Mus musculus
gaaaagaaagctgcaggaggtgtac

SEQ ID NO: 26239 - DNA, 25 bp, Mus musculus
gaaaagaactccctggtcttccagc

SEQ ID NO: 26240 - DNA, 25 bp, Mus musculus
gaaaagaactgtcgaagcttgagaa

SEQ ID NO: 26241 - DNA, 25 bp, Mus musculus
gaaaagaagaccagatgataatgag

SEQ ID NO: 26242 - DNA, 25 bp, Mus musculus
gaaaagaagcactttcctgcccaca

SEQ ID NO: 26243 - DNA, 25 bp, Mus musculus
gaaaagaaggcgatcattattagcc

SEQ ID NO: 26244 - DNA, 25 bp, Mus musculus
gaaaagaagggattatgaatccaga

SEQ ID NO: 26245 - DNA, 25 bp, Mus musculus
gaaaagaatttcctacgccagaagc

SEQ ID NO: 26246 - DNA, 25 bp, Mus musculus
gaaaagacaactgtagcctaccacg

SEQ ID NO: 26247 - DNA, 25 bp, Mus musculus
gaaaagacagtgtagtcctgcaaaa

SEQ ID NO: 26248 - DNA, 25 bp, Mus musculus
gaaaagacatccctgggcaggcatc

SEQ ID NO: 26249 - DNA, 25 bp, Mus musculus
gaaaagacatggtcatcctagagaa

SEQ ID NO: 26250 - DNA, 25 bp, Mus musculus
gaaaagaccaaagctgacaaactcc

SEQ ID NO: 26251 - DNA, 25 bp, Mus musculus
gaaaagacccgctggcttaacactc

SEQ ID NO: 26252 - DNA, 25 bp, Mus musculus
gaaaagacgaacatacttctgcggt

SEQ ID NO: 26253 - DNA, 25 bp, Mus musculus
gaaaagactgataccctggaacatg

SEQ ID NO: 26254 - DNA, 25 bp, Mus musculus
gaaaagaggctatatccaggtgcca

SEQ ID NO: 26255 - DNA, 25 bp, Mus musculus
gaaaagagggtctttgccaactcct

SEQ ID NO: 26256 - DNA, 25 bp, Mus musculus
gaaaagaggttcaaattggaccact

SEQ ID NO: 26257 - DNA, 25 bp, Mus musculus
gaaaagagtagagataagaaagccc

SEQ ID NO: 26258 - DNA, 25 bp, Mus musculus
gaaaagatagaagcctctcgaaatg

SEQ ID NO: 26259 - DNA, 25 bp, Mus musculus
gaaaagatcgaattctagagcacct

SEQ ID NO: 26260 - DNA, 25 bp, Mus musculus
gaaaagatcgtgcactgtcacaagg

SEQ ID NO: 26261 - DNA, 25 bp, Mus musculus
gaaaagattcgtcgtctcgagctgg

SEQ ID NO: 26262 - DNA, 25 bp, Mus musculus
gaaaagatttatcccacagccactg

SEQ ID NO: 26263 - DNA, 25 bp, Mus musculus
gaaaagcaaaaccacctcttagctg

SEQ ID NO: 26264 - DNA, 25 bp, Mus musculus
gaaaagcaagcacaggaagatcctg

SEQ ID NO: 26265 - DNA, 25 bp, Mus musculus
gaaaagcagtgagagcgtaaaagat

SEQ ID NO: 26266 - DNA, 25 bp, Mus musculus
gaaaagcattcctggcttctcaaga

SEQ ID NO: 26267 - DNA, 25 bp, Mus musculus
gaaaagccaaattagaaatcaagga

SEQ ID NO: 26268 - DNA, 25 bp, Mus musculus
gaaaagccagttcaagcgttgggaa

SEQ ID NO: 26269 - DNA, 25 bp, Mus musculus
gaaaagccagttcggaatactcaca

SEQ ID NO: 26270 - DNA, 25 bp, Mus musculus
gaaaagccagttgggaatactcaca

SEQ ID NO: 26271 - DNA, 25 bp, Mus musculus
gaaaagcccctccttactgtgacat

SEQ ID NO: 26272 - DNA, 25 bp, Mus musculus
gaaaagccgaagttcgaggacacag

SEQ ID NO: 26273 - DNA, 25 bp, Mus musculus
gaaaagccggatgaaataaccaaag

SEQ ID NO: 26274 - DNA, 25 bp, Mus musculus
gaaaagcgaatgcttatgaaatttc

SEQ ID NO: 26275 - DNA, 25 bp, Mus musculus
gaaaagcgcgagtagattcggacgc

SEQ ID NO: 26276 - DNA, 25 bp, Mus musculus
gaaaagctcacatgtaaatcgattg

SEQ ID NO: 26277 - DNA, 25 bp, Mus musculus
gaaaagctgacagagttcgtggcag

SEQ ID NO: 26278 - DNA, 25 bp, Mus musculus
gaaaagctgctagctccattgacca

SEQ ID NO: 26279 - DNA, 25 bp, Mus musculus
gaaaagctggaacctcaaggccctc

SEQ ID NO: 26280 - DNA, 25 bp, Mus musculus
gaaaagctggaagctcaaggccctc

SEQ ID NO: 26281 - DNA, 25 bp, Mus musculus
gaaaagcttcgagatgtcattgccc

SEQ ID NO: 26282 - DNA, 25 bp, Mus musculus
gaaaaggaaaagactcgaccaagat

SEQ ID NO: 26283 - DNA, 25 bp, Mus musculus
gaaaaggaagatggtaaagctatac

SEQ ID NO: 26284 - DNA, 25 bp, Mus musculus
gaaaaggacctgttgctggctgctg

SEQ ID NO: 26285 - DNA, 25 bp, Mus musculus
gaaaaggacctttgccagagacttg

SEQ ID NO: 26286 - DNA, 25 bp, Mus musculus
gaaaaggagcgcaaggcaactctgc

SEQ ID NO: 26287 - DNA, 25 bp, Mus musculus
gaaaaggagcttgcctctcagcaag

SEQ ID NO: 26288 - DNA, 25 bp, Mus musculus
gaaaaggaggcattgatttcccagc

SEQ ID NO: 26289 - DNA, 25 bp, Mus musculus
gaaaaggatacagcagatcttattc

SEQ ID NO: 26290 - DNA, 25 bp, Mus musculus
gaaaaggatgtactatggtggccac

SEQ ID NO: 26291 - DNA, 25 bp, Mus musculus
gaaaaggcaaatccggtaagcctgg

SEQ ID NO: 26292 - DNA, 25 bp, Mus musculus
gaaaaggcaccactgaaagtacttg

SEQ ID NO: 26293 - DNA, 25 bp, Mus musculus
gaaaaggccagctgatcgcagggat

SEQ ID NO: 26294 - DNA, 25 bp, Mus musculus
gaaaaggcccttcccgaaatgcgcg

SEQ ID NO: 26295 - DNA, 25 bp, Mus musculus
gaaaaggcctactggttctggaagg

SEQ ID NO: 26296 - DNA, 25 bp, Mus musculus
gaaaaggctctaaagaaacacaagg

SEQ ID NO: 26297 - DNA, 25 bp, Mus musculus
gaaaaggctggcatatattatatga

SEQ ID NO: 26298 - DNA, 25 bp, Mus musculus
gaaaaggtcaaagcgagtgtcatcc

SEQ ID NO: 26299 - DNA, 25 bp, Mus musculus
gaaaaggtgaagctcctgtttgaag

SEQ ID NO: 26300 - DNA, 25 bp, Mus musculus
gaaaaggtgctagccaggaggagga

SEQ ID NO: 26301 - DNA, 25 bp, Mus musculus
gaaaagtagtccacattgagcaggg

SEQ ID NO: 26302 - DNA, 25 bp, Mus musculus
gaaaagtataaagtgaaagacagga

SEQ ID NO: 26303 - DNA, 25 bp, Mus musculus
gaaaagtcaaacactaagctgatcg

SEQ ID NO: 26304 - DNA, 25 bp, Mus musculus
gaaaagtcaatcgaacagactcaga

SEQ ID NO: 26305 - DNA, 25 bp, Mus musculus
gaaaagtcatgaaaaatgtgtctga

SEQ ID NO: 26306 - DNA, 25 bp, Mus musculus
gaaaagtcattccagtttggaggcc

SEQ ID NO: 26307 - DNA, 25 bp, Mus musculus
gaaaagtcattcgagtttggaggcc

SEQ ID NO: 26308 - DNA, 25 bp, Mus musculus
gaaaagtccattgtgtaccttgtca

SEQ ID NO: 26309 - DNA, 25 bp, Mus musculus
gaaaagtcggattacaagatcaacc

SEQ ID NO: 26310 - DNA, 25 bp, Mus musculus
gaaaagtgaatttgcaaatctgaga

SEQ ID NO: 26311 - DNA, 25 bp, Mus musculus
gaaaagtgacttcagattttccttc

SEQ ID NO: 26312 - DNA, 25 bp, Mus musculus
gaaaagtgcaagaaacttcaatctg

SEQ ID NO: 26313 - DNA, 25 bp, Mus musculus
gaaaagtgccgctctgctttgtaga

SEQ ID NO: 26314 - DNA, 25 bp, Mus musculus
gaaaagtggattcttgcctggcccg

SEQ ID NO: 26315 - DNA, 25 bp, Mus musculus
gaaaagttcattgttgagggcttaa

SEQ ID NO: 26316 - DNA, 25 bp, Mus musculus
gaaaagtttaaggagtgccagaggc

SEQ ID NO: 26317 - DNA, 25 bp, Mus musculus
gaaaatactcaagggccatgcaagc

SEQ ID NO: 26318 - DNA, 25 bp, Mus musculus
gaaaatactcggaaaagaatcttgt

SEQ ID NO: 26319 - DNA, 25 bp, Mus musculus
gaaaatagggaagaagtgagcctca

SEQ ID NO: 26320 - DNA, 25 bp, Mus musculus
gaaaatatccaactaccgcacacat

SEQ ID NO: 26321 - DNA, 25 bp, Mus musculus
gaaaatattaacaatgcagcctctg

SEQ ID NO: 26322 - DNA, 25 bp, Mus musculus
gaaaatattctggatgctcgcctcc

SEQ ID NO: 26323 - DNA, 25 bp, Mus musculus
gaaaatcaaagtcggtgaagtcagg

SEQ ID NO: 26324 - DNA, 25 bp, Mus musculus
gaaaatcaagaaaatcaaagtcgtc

SEQ ID NO: 26325 - DNA, 25 bp, Mus musculus
gaaaatcaagaatatcaaagtcgtc

SEQ ID NO: 26326 - DNA, 25 bp, Mus musculus
gaaaatcacagagttttgccaccgc

SEQ ID NO: 26327 - DNA, 25 bp, Mus musculus
gaaaatcagaggctccttaaagata

SEQ ID NO: 26328 - DNA, 25 bp, Mus musculus
gaaaatcagctcaccaggctgtgac

SEQ ID NO: 26329 - DNA, 25 bp, Mus musculus
gaaaatcattcgtggtttctgtcac

SEQ ID NO: 26330 - DNA, 25 bp, Mus musculus
gaaaatccattctcttgaagaactc

SEQ ID NO: 26331 - DNA, 25 bp, Mus musculus
gaaaatcccaggctcatatagcttc

SEQ ID NO: 26332 - DNA, 25 bp, Mus musculus
gaaaatcctccataggaatggcctg

SEQ ID NO: 26333 - DNA, 25 bp, Mus musculus
gaaaatcctttcatgttataagcca

SEQ ID NO: 26334 - DNA, 25 bp, Mus musculus
gaaaatcgagaaggtgcgggtcctc

SEQ ID NO: 26335 - DNA, 25 bp, Mus musculus
gaaaatcgtgccgatgcctggcata

SEQ ID NO: 26336 - DNA, 25 bp, Mus musculus
gaaaatctacgtatgttaccacatg

SEQ ID NO: 26337 - DNA, 25 bp, Mus musculus
gaaaatctcccgaggagctgtatac

SEQ ID NO: 26338 - DNA, 25 bp, Mus musculus
gaaaatctggttctcttgcactaat

SEQ ID NO: 26339 - DNA, 25 bp, Mus musculus
gaaaatcttcaaagccaaccacccg

SEQ ID NO: 26340 - DNA, 25 bp, Mus musculus
gaaaatgaaacgataccaagttgga

SEQ ID NO: 26341 - DNA, 25 bp, Mus musculus
gaaaatgaaacggaggaagcaagat

SEQ ID NO: 26342 - DNA, 25 bp, Mus musculus
gaaaatgagacatctccaccgcgaa

SEQ ID NO: 26343 - DNA, 25 bp, Mus musculus
gaaaatgcattctggacccgctact

SEQ ID NO: 26344 - DNA, 25 bp, Mus musculus
gaaaatgccgtggttcaagactatg

SEQ ID NO: 26345 - DNA, 25 bp, Mus musculus
gaaaatgcgcaaggtcacagacagg

SEQ ID NO: 26346 - DNA, 25 bp, Mus musculus
gaaaatgcgtatcacatggaagccg

SEQ ID NO: 26347 - DNA, 25 bp, Mus musculus
gaaaatgctgttcgccaaaatggac

SEQ ID NO: 26348 - DNA, 25 bp, Mus musculus
gaaaatgctttcctcagtgagttta

SEQ ID NO: 26349 - DNA, 25 bp, Mus musculus
gaaaatggaaaaagtgctagggatc

SEQ ID NO: 26350 - DNA, 25 bp, Mus musculus
gaaaatggaaaagctgtcttcaacc

SEQ ID NO: 26351 - DNA, 25 bp, Mus musculus
gaaaatggagactatacatatgtgg

SEQ ID NO: 26352 - DNA, 25 bp, Mus musculus
gaaaatggagcattcctagcagagg

SEQ ID NO: 26353 - DNA, 25 bp, Mus musculus
gaaaatggagccaataaacactttg

SEQ ID NO: 26354 - DNA, 25 bp, Mus musculus
gaaaatggattctcttgatggaaac

SEQ ID NO: 26355 - DNA, 25 bp, Mus musculus
gaaaatggcaacctcctgcgatcgg

SEQ ID NO: 26356 - DNA, 25 bp, Mus musculus
gaaaatggcagagacggaagctacc

SEQ ID NO: 26357 - DNA, 25 bp, Mus musculus
gaaaatggccaattcgttacgagga

SEQ ID NO: 26358 - DNA, 25 bp, Mus musculus
gaaaatggctttgaatcatggtgaa

SEQ ID NO: 26359 - DNA, 25 bp, Mus musculus
gaaaatggtaaatttcagagctgga

SEQ ID NO: 26360 - DNA, 25 bp, Mus musculus
gaaaatggtctgtctctctaggcgc

SEQ ID NO: 26361 - DNA, 25 bp, Mus musculus
gaaaatgtaactgtgacaaagaaca

SEQ ID NO: 26362 - DNA, 25 bp, Mus musculus
gaaaatgtacctcagtgtcaagcct

SEQ ID NO: 26363 - DNA, 25 bp, Mus musculus
gaaaatgtagaatgggaaactaaca

SEQ ID NO: 26364 - DNA, 25 bp, Mus musculus
gaaaatgtcagccacccataagccc

SEQ ID NO: 26365 - DNA, 25 bp, Mus musculus
gaaaatgtggccacctactttactt

SEQ ID NO: 26366 - DNA, 25 bp, Mus musculus
gaaaatgtggcctcctactttactt

SEQ ID NO: 26367 - DNA, 25 bp, Mus musculus
gaaaatgttgaatgagcagctacag

SEQ ID NO: 26368 - DNA, 25 bp, Mus musculus
gaaaatgttgtttcaaacatggctg

SEQ ID NO: 26369 - DNA, 25 bp, Mus musculus
gaaaatgtttattccaggagcagac

SEQ ID NO: 26370 - DNA, 25 bp, Mus musculus
gaaaattaatttggacgaagcagag

SEQ ID NO: 26371 - DNA, 25 bp, Mus musculus
gaaaattatccattttactggcact

SEQ ID NO: 26372 - DNA, 25 bp, Mus musculus
gaaaattcaatgtggcaagaacaga

SEQ ID NO: 26373 - DNA, 25 bp, Mus musculus
gaaaattctgaacctgttactaaca

SEQ ID NO: 26374 - DNA, 25 bp, Mus musculus
gaaaattgacattccgtctgtcttt

SEQ ID NO: 26375 - DNA, 25 bp, Mus musculus
gaaaattgatcttggtactacctac

SEQ ID NO: 26376 - DNA, 25 bp, Mus musculus
gaaaattgcacagcaggcagctaag

SEQ ID NO: 26377 - DNA, 25 bp, Mus musculus
gaaaattggttattgttagactcac

SEQ ID NO: 26378 - DNA, 25 bp, Mus musculus
gaaaattgtcaacgtggaccagtgg

SEQ ID NO: 26379 - DNA, 25 bp, Mus musculus
gaaaattgtcaaggtggaccagtgg

SEQ ID NO: 26380 - DNA, 25 bp, Mus musculus
gaaaattgtcggtgatctggcctcc

SEQ ID NO: 26381 - DNA, 25 bp, Mus musculus
gaaaattgtgccaaagcctacatac

SEQ ID NO: 26382 - DNA, 25 bp, Mus musculus
gaaacaaaattgacaggacagatgc

SEQ ID NO: 26383 - DNA, 25 bp, Mus musculus
gaaacaaaccgcaccctgagagttg

SEQ ID NO: 26384 - DNA, 25 bp, Mus musculus
gaaacaaagcgatgagcttgccctg

SEQ ID NO: 26385 - DNA, 25 bp, Mus musculus
gaaacaaatgtgacatggaagatga

SEQ ID NO: 26386 - DNA, 25 bp, Mus musculus
gaaacaacaaatactggtaacagag

SEQ ID NO: 26387 - DNA, 25 bp, Mus musculus
gaaacaacacgtatgctgaacccca

SEQ ID NO: 26388 - DNA, 25 bp, Mus musculus
gaaacaagcctgtgaaatacaaaaa

SEQ ID NO: 26389 - DNA, 25 bp, Mus musculus
gaaacaaggaccattgctgtcgact

SEQ ID NO: 26390 - DNA, 25 bp, Mus musculus
gaaacaaggcttctgtaaggaccct

SEQ ID NO: 26391 - DNA, 25 bp, Mus musculus
gaaacaagttttctgaagtcaggta

SEQ ID NO: 26392 - DNA, 25 bp, Mus musculus
gaaacaagttttgtgaagtcaggta

SEQ ID NO: 26393 - DNA, 25 bp, Mus musculus
gaaacaatatccaacgtgccaattc

SEQ ID NO: 26394 - DNA, 25 bp, Mus musculus
gaaacaatcccttggcaagagcgca

SEQ ID NO: 26395 - DNA, 25 bp, Mus musculus
gaaacaatgaatcagaaaagcccag

SEQ ID NO: 26396 - DNA, 25 bp, Mus musculus
gaaacaatgaggagatttgcaagga

SEQ ID NO: 26397 - DNA, 25 bp, Mus musculus
gaaacaatggcttcatctggatagg

SEQ ID NO: 26398 - DNA, 25 bp, Mus musculus
gaaacaatttctcctagaaatcgcc

SEQ ID NO: 26399 - DNA, 25 bp, Mus musculus
gaaacacagcgagcagatcttgact

SEQ ID NO: 26400 - DNA, 25 bp, Mus musculus
gaaacacctcgggagccaaactact

SEQ ID NO: 26401 - DNA, 25 bp, Mus musculus
gaaacacctgcaaaaatacatgcgt

SEQ ID NO: 26402 - DNA, 25 bp, Mus musculus
gaaacacctgcatggtttagagaca

SEQ ID NO: 26403 - DNA, 25 bp, Mus musculus
gaaacacctgtgtcagctgcagcaa

SEQ ID NO: 26404 - DNA, 25 bp, Mus musculus
gaaacaccttaaagaacacagttca

SEQ ID NO: 26405 - DNA, 25 bp, Mus musculus
gaaacacgtgcactccctggttgcc

SEQ ID NO: 26406 - DNA, 25 bp, Mus musculus
gaaacactaaagactggacctcaag

SEQ ID NO: 26407 - DNA, 25 bp, Mus musculus
gaaacactcatccagaaacagacca

SEQ ID NO: 26408 - DNA, 25 bp, Mus musculus
gaaacacttgagcagtgtctcccga

SEQ ID NO: 26409 - DNA, 25 bp, Mus musculus
gaaacagaaggttttccctgtgctg

SEQ ID NO: 26410 - DNA, 25 bp, Mus musculus
gaaacagacatcataatgtggtccc

SEQ ID NO: 26411 - DNA, 25 bp, Mus musculus
gaaacagacatcttaatgtggtccc

SEQ ID NO: 26412 - DNA, 25 bp, Mus musculus
gaaacagactcgatgataatcatag

SEQ ID NO: 26413 - DNA, 25 bp, Mus musculus
gaaacagcaacgattgtcagccaat

SEQ ID NO: 26414 - DNA, 25 bp, Mus musculus
gaaacagcaagtgaaggcaagaaat

SEQ ID NO: 26415 - DNA, 25 bp, Mus musculus
gaaacagcactagaacgcgaagccc

SEQ ID NO: 26416 - DNA, 25 bp, Mus musculus
gaaacagcctgtggactgtctggac

SEQ ID NO: 26417 - DNA, 25 bp, Mus musculus
gaaacagctacaacagcataaccag

SEQ ID NO: 26418 - DNA, 25 bp, Mus musculus
gaaacagctgtgaatcccgtggaca

SEQ ID NO: 26419 - DNA, 25 bp, Mus musculus
gaaacaggaacaatctcttcaagtg

SEQ ID NO: 26420 - DNA, 25 bp, Mus musculus
gaaacaggagagaccttgcagaaat

SEQ ID NO: 26421 - DNA, 25 bp, Mus musculus
gaaacaggagctaagtgggcaatta

SEQ ID NO: 26422 - DNA, 25 bp, Mus musculus
gaaacaggaggtatactacctaatt

SEQ ID NO: 26423 - DNA, 25 bp, Mus musculus
gaaacaggaggtttactacctaatt

SEQ ID NO: 26424 - DNA, 25 bp, Mus musculus
gaaacaggagtgtatggactccaag

SEQ ID NO: 26425 - DNA, 25 bp, Mus musculus
gaaacagggcgcaaagtctgcagag

SEQ ID NO: 26426 - DNA, 25 bp, Mus musculus
gaaacagggtgatgacggctctgaa

SEQ ID NO: 26427 - DNA, 25 bp, Mus musculus
gaaacaggtgaattctggtaattac

SEQ ID NO: 26428 - DNA, 25 bp, Mus musculus
gaaacagtcggaagacatcaccctg

SEQ ID NO: 26429 - DNA, 25 bp, Mus musculus
gaaacagtgccagtcaggatcgaaa

SEQ ID NO: 26430 - DNA, 25 bp, Mus musculus
gaaacagttactgttctcccaggag

SEQ ID NO: 26431 - DNA, 25 bp, Mus musculus
gaaacagttctgtgtgaacaccctg

SEQ ID NO: 26432 - DNA, 25 bp, Mus musculus
gaaacagtttacagtcatcacatgt

SEQ ID NO: 26433 - DNA, 25 bp, Mus musculus
gaaacatcagttctatcttgtggga

SEQ ID NO: 26434 - DNA, 25 bp, Mus musculus
gaaacatcatcccactgtgactcag

SEQ ID NO: 26435 - DNA, 25 bp, Mus musculus
gaaacatctcttccttcttcaaaaa

SEQ ID NO: 26436 - DNA, 25 bp, Mus musculus
gaaacatctgcagatctcccaggag

SEQ ID NO: 26437 - DNA, 25 bp, Mus musculus
gaaacatgttgatcctgtcattagc

SEQ ID NO: 26438 - DNA, 25 bp, Mus musculus
gaaacattcaagttccactttaaga

SEQ ID NO: 26439 - DNA, 25 bp, Mus musculus
gaaacattcagtgggagagccggac

SEQ ID NO: 26440 - DNA, 25 bp, Mus musculus
gaaacattcgaagcgggattatacc

SEQ ID NO: 26441 - DNA, 25 bp, Mus musculus
gaaacatttgcttcccatgtggagg

SEQ ID NO: 26442 - DNA, 25 bp, Mus musculus
gaaacatttgtattccacaagacca

SEQ ID NO: 26443 - DNA, 25 bp, Mus musculus
gaaaccaaatttgactctggttcag

SEQ ID NO: 26444 - DNA, 25 bp, Mus musculus
gaaaccaacaattaatgttccaagt

SEQ ID NO: 26445 - DNA, 25 bp, Mus musculus
gaaaccaacatgctgattctgacca

SEQ ID NO: 26446 - DNA, 25 bp, Mus musculus
gaaaccaacctcagcaagatggtga

SEQ ID NO: 26447 - DNA, 25 bp, Mus musculus
gaaaccaactacacgctacatgtgg

SEQ ID NO: 26448 - DNA, 25 bp, Mus musculus
gaaaccaattttggcctttaatgat

SEQ ID NO: 26449 - DNA, 25 bp, Mus musculus
gaaaccacagtagtctgggacaagg

SEQ ID NO: 26450 - DNA, 25 bp, Mus musculus
gaaaccacctcgaaggcagggaggc

SEQ ID NO: 26451 - DNA, 25 bp, Mus musculus
gaaaccacttatcctgggcagactc

SEQ ID NO: 26452 - DNA, 25 bp, Mus musculus
gaaaccagacctcatcgatgttgat

SEQ ID NO: 26453 - DNA, 25 bp, Mus musculus
gaaaccagatcaagttatcaaagag

SEQ ID NO: 26454 - DNA, 25 bp, Mus musculus
gaaaccagatttctcatcagccgaa

SEQ ID NO: 26455 - DNA, 25 bp, Mus musculus
gaaaccagctggaccaatagcagca

SEQ ID NO: 26456 - DNA, 25 bp, Mus musculus
gaaaccagtctctttgaaactgaag

SEQ ID NO: 26457 - DNA, 25 bp, Mus musculus
gaaaccagtgagctcaaggaggcta

SEQ ID NO: 26458 - DNA, 25 bp, Mus musculus
gaaaccagtgaggaccccgaagttg

SEQ ID NO: 26459 - DNA, 25 bp, Mus musculus
gaaaccagttggaagtcatacttga

SEQ ID NO: 26460 - DNA, 25 bp, Mus musculus
gaaaccatcacacagttcctgcgag

SEQ ID NO: 26461 - DNA, 25 bp, Mus musculus
gaaaccatccttggcttcacaggag

SEQ ID NO: 26462 - DNA, 25 bp, Mus musculus
gaaaccattctttagctcgtcatgc

SEQ ID NO: 26463 - DNA, 25 bp, Mus musculus
gaaaccattgattccagagttaagg

SEQ ID NO: 26464 - DNA, 25 bp, Mus musculus
gaaaccattgctctgaaactccgat

SEQ ID NO: 26465 - DNA, 25 bp, Mus musculus
gaaacccaacgagaagacacaagtg

SEQ ID NO: 26466 - DNA, 25 bp, Mus musculus
gaaacccaccttcacctacaagtgg

SEQ ID NO: 26467 - DNA, 25 bp, Mus musculus
gaaacccagacttgagaaaactaag

SEQ ID NO: 26468 - DNA, 25 bp, Mus musculus
gaaacccagaggtggattatttcta

SEQ ID NO: 26469 - DNA, 25 bp, Mus musculus
gaaaccccactagcaagtattaccg

SEQ ID NO: 26470 - DNA, 25 bp, Mus musculus
gaaaccccgccccaattaagcaatg

SEQ ID NO: 26471 - DNA, 25 bp, Mus musculus
gaaacccgacattgtgttctttggg

SEQ ID NO: 26472 - DNA, 25 bp, Mus musculus
gaaacccgccctgtacaattgcaat

SEQ ID NO: 26473 - DNA, 25 bp, Mus musculus
gaaaccctaaggctacttggagaga

SEQ ID NO: 26474 - DNA, 25 bp, Mus musculus
gaaaccctcacaatgatcgatttgt

SEQ ID NO: 26475 - DNA, 25 bp, Mus musculus
gaaaccctcccctgagttcttcaag

SEQ ID NO: 26476 - DNA, 25 bp, Mus musculus
gaaaccctcgactttagaagactgc

SEQ ID NO: 26477 - DNA, 25 bp, Mus musculus
gaaaccctctgttccaagagctgct

SEQ ID NO: 26478 - DNA, 25 bp, Mus musculus
gaaaccctgaggaaagtggactctg

SEQ ID NO: 26479 - DNA, 25 bp, Mus musculus
gaaaccctgatcacagggaaatggg

SEQ ID NO: 26480 - DNA, 25 bp, Mus musculus
gaaaccctttcacctttcacatcta

SEQ ID NO: 26481 - DNA, 25 bp, Mus musculus
gaaaccctttcagctttcacatcta

SEQ ID NO: 26482 - DNA, 25 bp, Mus musculus
gaaacccttttgactatctgaatgg

SEQ ID NO: 26483 - DNA, 25 bp, Mus musculus
gaaaccgaaggagtatcagatgtgg

SEQ ID NO: 26484 - DNA, 25 bp, Mus musculus
gaaaccgacctggactgcatttttg

SEQ ID NO: 26485 - DNA, 25 bp, Mus musculus
gaaaccgtgtacaacagcggcgaca

SEQ ID NO: 26486 - DNA, 25 bp, Mus musculus
gaaacctaggaagagtgggcaccaa

SEQ ID NO: 26487 - DNA, 25 bp, Mus musculus
gaaacctcaaggatgaacaggagaa

SEQ ID NO: 26488 - DNA, 25 bp, Mus musculus
gaaacctcaggacacttcagggata

SEQ ID NO: 26489 - DNA, 25 bp, Mus musculus
gaaacctcatcgtctggcacgtgcg

SEQ ID NO: 26490 - DNA, 25 bp, Mus musculus
gaaacctctagaacaagtaatcacg

SEQ ID NO: 26491 - DNA, 25 bp, Mus musculus
gaaacctctgtttggacaactgaag

SEQ ID NO: 26492 - DNA, 25 bp, Mus musculus
gaaacctgagcaacattaaggcttt

SEQ ID NO: 26493 - DNA, 25 bp, Mus musculus
gaaacctgagctttaattgtgccaa

SEQ ID NO: 26494 - DNA, 25 bp, Mus musculus
gaaacctgaggtttgcattgaagca

SEQ ID NO: 26495 - DNA, 25 bp, Mus musculus
gaaacctgatacctaaaattttgca

SEQ ID NO: 26496 - DNA, 25 bp, Mus musculus
gaaacctgatacgtaaaattttgca

SEQ ID NO: 26497 - DNA, 25 bp, Mus musculus
gaaacctgcattattagaaaggaga

SEQ ID NO: 26498 - DNA, 25 bp, Mus musculus
gaaacctggcccagaaccaaatgta

SEQ ID NO: 26499 - DNA, 25 bp, Mus musculus
gaaacctgggtcttccgcaggattg

SEQ ID NO: 26500 - DNA, 25 bp, Mus musculus
gaaacctggtccatttgggagtcag

SEQ ID NO: 26501 - DNA, 25 bp, Mus musculus
gaaaccttcaggaatttggctgcca

SEQ ID NO: 26502 - DNA, 25 bp, Mus musculus
gaaacctttcagatgcagcgactaa

SEQ ID NO: 26503 - DNA, 25 bp, Mus musculus
gaaacctttccgacgataggacctg

SEQ ID NO: 26504 - DNA, 25 bp, Mus musculus
gaaacctttgcccaccttatagtgc

SEQ ID NO: 26505 - DNA, 25 bp, Mus musculus
gaaacgagattatagaagcacccat

SEQ ID NO: 26506 - DNA, 25 bp, Mus musculus
gaaacgaggagctcagaacagagag

SEQ ID NO: 26507 - DNA, 25 bp, Mus musculus
gaaacgatgaatgaagtcctcgata

SEQ ID NO: 26508 - DNA, 25 bp, Mus musculus
gaaacgcctttattttatgacctgg

SEQ ID NO: 26509 - DNA, 25 bp, Mus musculus
gaaacgcgaatgtcaacctgagcaa

SEQ ID NO: 26510 - DNA, 25 bp, Mus musculus
gaaacgctgaacgattctcaagggc

SEQ ID NO: 26511 - DNA, 25 bp, Mus musculus
gaaacgctgcagtaatgtcaatgtg

SEQ ID NO: 26512 - DNA, 25 bp, Mus musculus
gaaacggactctgtggtcagctcgg

SEQ ID NO: 26513 - DNA, 25 bp, Mus musculus
gaaacggagccaatgaagggttcca

SEQ ID NO: 26514 - DNA, 25 bp, Mus musculus
gaaacggccagtcttctcttgagga

SEQ ID NO: 26515 - DNA, 25 bp, Mus musculus
gaaacgggaaatacagacttctgaa

SEQ ID NO: 26516 - DNA, 25 bp, Mus musculus
gaaacggttacgattatggccagtg

SEQ ID NO: 26517 - DNA, 25 bp, Mus musculus
gaaacgtatgctttccttccaaggg

SEQ ID NO: 26518 - DNA, 25 bp, Mus musculus
gaaacgtctgagagctgaaaaccca

SEQ ID NO: 26519 - DNA, 25 bp, Mus musculus
gaaacgtctgagtgctgaaaaccca

SEQ ID NO: 26520 - DNA, 25 bp, Mus musculus
gaaacgtcttgtggcatggctttgc

SEQ ID NO: 26521 - DNA, 25 bp, Mus musculus
gaaacgtggaaaaactgtttggatg

SEQ ID NO: 26522 - DNA, 25 bp, Mus musculus
gaaacgtgtacttgaagttcagtga

SEQ ID NO: 26523 - DNA, 25 bp, Mus musculus
gaaacgttatcatgtggctggacca

SEQ ID NO: 26524 - DNA, 25 bp, Mus musculus
gaaacgttcccggtgctttctgaag

SEQ ID NO: 26525 - DNA, 25 bp, Mus musculus
gaaacgttgaaagtcacttattggc

SEQ ID NO: 26526 - DNA, 25 bp, Mus musculus
gaaactaatgtagctggaatcagca

SEQ ID NO: 26527 - DNA, 25 bp, Mus musculus
gaaactacactcctccagcctagag

SEQ ID NO: 26528 - DNA, 25 bp, Mus musculus
gaaactacctgcgtatgttccgagg

SEQ ID NO: 26529 - DNA, 25 bp, Mus musculus
gaaactagatccattactcctgaag

SEQ ID NO: 26530 - DNA, 25 bp, Mus musculus
gaaactagatcctttactcctgaag

SEQ ID NO: 26531 - DNA, 25 bp, Mus musculus
gaaactatcgaagggctcgcagagc

SEQ ID NO: 26532 - DNA, 25 bp, Mus musculus
gaaactatcttctatgaggtgactg

SEQ ID NO: 26533 - DNA, 25 bp, Mus musculus
gaaactcaaagttacagacattctg

SEQ ID NO: 26534 - DNA, 25 bp, Mus musculus
gaaactcacacggtctggaagcaac

SEQ ID NO: 26535 - DNA, 25 bp, Mus musculus
gaaactcacccgtccaggtctgtgg

SEQ ID NO: 26536 - DNA, 25 bp, Mus musculus
gaaactcagcaaagtccctgatgac

SEQ ID NO: 26537 - DNA, 25 bp, Mus musculus
gaaactcagcacagctcagtccact

SEQ ID NO: 26538 - DNA, 25 bp, Mus musculus
gaaactcaggtcttgctttgcataa

SEQ ID NO: 26539 - DNA, 25 bp, Mus musculus
gaaactccaaacagggcttgcgatg

SEQ ID NO: 26540 - DNA, 25 bp, Mus musculus
gaaactccaaagagcttcacgtctg

SEQ ID NO: 26541 - DNA, 25 bp, Mus musculus
gaaactccaatcagatcgcctctca

SEQ ID NO: 26542 - DNA, 25 bp, Mus musculus
gaaactccacccaaaagcaaacttg

SEQ ID NO: 26543 - DNA, 25 bp, Mus musculus
gaaactctacaagatcggcattccc

SEQ ID NO: 26544 - DNA, 25 bp, Mus musculus
gaaactctcagccttggaccttaag

SEQ ID NO: 26545 - DNA, 25 bp, Mus musculus
gaaactctgccaggaaaggatgaga

SEQ ID NO: 26546 - DNA, 25 bp, Mus musculus
gaaactcttgagtgcctgaactcag

SEQ ID NO: 26547 - DNA, 25 bp, Mus musculus
gaaactcttgggtgaagacaaatgg

SEQ ID NO: 26548 - DNA, 25 bp, Mus musculus
gaaactgaaacaaaccatttcctct

SEQ ID NO: 26549 - DNA, 25 bp, Mus musculus
gaaactgacagccacaaggtgacca

SEQ ID NO: 26550 - DNA, 25 bp, Mus musculus
gaaactgactgtctacctgtggaag

SEQ ID NO: 26551 - DNA, 25 bp, Mus musculus
gaaactgaggaatagtatgagaaac

SEQ ID NO: 26552 - DNA, 25 bp, Mus musculus
gaaactgagtggtggcatcttttaa

SEQ ID NO: 26553 - DNA, 25 bp, Mus musculus
gaaactgatctcagaactggatgat

SEQ ID NO: 26554 - DNA, 25 bp, Mus musculus
gaaactgatggtgttgatgaaaagc

SEQ ID NO: 26555 - DNA, 25 bp, Mus musculus
gaaactgattggtattggctgtggt

SEQ ID NO: 26556 - DNA, 25 bp, Mus musculus
gaaactgcactggaagggacaatgg

SEQ ID NO: 26557 - DNA, 25 bp, Mus musculus
gaaactgccttaacaaacgagtggg

SEQ ID NO: 26558 - DNA, 25 bp, Mus musculus
gaaactgctaccttgtcctctacac

SEQ ID NO: 26559 - DNA, 25 bp, Mus musculus
gaaactgctccctggtgctatacca

SEQ ID NO: 26560 - DNA, 25 bp, Mus musculus
gaaactgctgtacaaagaagttaaa

SEQ ID NO: 26561 - DNA, 25 bp, Mus musculus
gaaactggaagggaagacaggacat

SEQ ID NO: 26562 - DNA, 25 bp, Mus musculus
gaaactggacagtgagctaggccgt

SEQ ID NO: 26563 - DNA, 25 bp, Mus musculus
gaaactggacataagccagcagctc

SEQ ID NO: 26564 - DNA, 25 bp, Mus musculus
gaaactggacattagccagcagctc

SEQ ID NO: 26565 - DNA, 25 bp, Mus musculus
gaaactggaccaacaaccggcttaa

SEQ ID NO: 26566 - DNA, 25 bp, Mus musculus
gaaactggaccatcaaccggcttaa

SEQ ID NO: 26567 - DNA, 25 bp, Mus musculus
gaaactggagactccttcagataac

SEQ ID NO: 26568 - DNA, 25 bp, Mus musculus
gaaactggccagattggaattcgaa

SEQ ID NO: 26569 - DNA, 25 bp, Mus musculus
gaaactgggccgtgtggcgctactt

SEQ ID NO: 26570 - DNA, 25 bp, Mus musculus
gaaactgggctcacctggaccaact

SEQ ID NO: 26571 - DNA, 25 bp, Mus musculus
gaaactggtgcatgacatgagccac

SEQ ID NO: 26572 - DNA, 25 bp, Mus musculus
gaaactgtattctggacaaagacta

SEQ ID NO: 26573 - DNA, 25 bp, Mus musculus
gaaactgtccacacacactggatgg

SEQ ID NO: 26574 - DNA, 25 bp, Mus musculus
gaaactgtccctgacatcagttacc

SEQ ID NO: 26575 - DNA, 25 bp, Mus musculus
gaaactgtcctcatttcaagagccc

SEQ ID NO: 26576 - DNA, 25 bp, Mus musculus
gaaactgtcttctatgaggtgactg

SEQ ID NO: 26577 - DNA, 25 bp, Mus musculus
gaaactgtgctgaggaagagcagtc

SEQ ID NO: 26578 - DNA, 25 bp, Mus musculus
gaaactgttacagaaggagcacctc

SEQ ID NO: 26579 - DNA, 25 bp, Mus musculus
gaaactgtttcagcttgtgttggaa

SEQ ID NO: 26580 - DNA, 25 bp, Mus musculus
gaaacttactctgagtactaggctg

SEQ ID NO: 26581 - DNA, 25 bp, Mus musculus
gaaacttcaaagtgccagggcggtg

SEQ ID NO: 26582 - DNA, 25 bp, Mus musculus
gaaacttcaatctgccaatgtgcaa

SEQ ID NO: 26583 - DNA, 25 bp, Mus musculus
gaaacttcacggaggccacaacctt

SEQ ID NO: 26584 - DNA, 25 bp, Mus musculus
gaaacttccaggactttgactgtca

SEQ ID NO: 26585 - DNA, 25 bp, Mus musculus
gaaacttccatggtgaatacccagc

SEQ ID NO: 26586 - DNA, 25 bp, Mus musculus
gaaacttccccagctgaagttgcag

SEQ ID NO: 26587 - DNA, 25 bp, Mus musculus
gaaacttgaagtgggatggcaggac

SEQ ID NO: 26588 - DNA, 25 bp, Mus musculus
gaaacttgaatacaaaaggcaagct

SEQ ID NO: 26589 - DNA, 25 bp, Mus musculus
gaaacttgaggaaagcggtcgagaa

SEQ ID NO: 26590 - DNA, 25 bp, Mus musculus
gaaacttggacagctcaatattgat

SEQ ID NO: 26591 - DNA, 25 bp, Mus musculus
gaaacttggagagtggaatgagaaa

SEQ ID NO: 26592 - DNA, 25 bp, Mus musculus
gaaactttgtggaagccactgctct

SEQ ID NO: 26593 - DNA, 25 bp, Mus musculus
gaaagaaaccccactagcaagtatt

SEQ ID NO: 26594 - DNA, 25 bp, Mus musculus
gaaagaaacctgttagccataagac

SEQ ID NO: 26595 - DNA, 25 bp, Mus musculus
gaaagaaagactccatcagctgttg

SEQ ID NO: 26596 - DNA, 25 bp, Mus musculus
gaaagaaagcctgaactgcccagtg

SEQ ID NO: 26597 - DNA, 25 bp, Mus musculus
gaaagaaagttcgagaaattcaagc

SEQ ID NO: 26598 - DNA, 25 bp, Mus musculus
gaaagaaagtttctgaagagatgga

SEQ ID NO: 26599 - DNA, 25 bp, Mus musculus
gaaagaaatcacaaactgtttaaag

SEQ ID NO: 26600 - DNA, 25 bp, Mus musculus
gaaagaacacatcgagaacttgagt

SEQ ID NO: 26601 - DNA, 25 bp, Mus musculus
gaaagaacacattgcctgcctcagg

SEQ ID NO: 26602 - DNA, 25 bp, Mus musculus
gaaagaacacctggtttagagccaa

SEQ ID NO: 26603 - DNA, 25 bp, Mus musculus
gaaagaacatagctgacctcagagc

SEQ ID NO: 26604 - DNA, 25 bp, Mus musculus
gaaagaacatatgagcttggcctgc

SEQ ID NO: 26605 - DNA, 25 bp, Mus musculus
gaaagaaccaatatcaaacaagagt

SEQ ID NO: 26606 - DNA, 25 bp, Mus musculus
gaaagaacctgaagaagacctccca

SEQ ID NO: 26607 - DNA, 25 bp, Mus musculus
gaaagaactaagagcaccgaagcca

SEQ ID NO: 26608 - DNA, 25 bp, Mus musculus
gaaagaactgcgaagctgatgtcat

SEQ ID NO: 26609 - DNA, 25 bp, Mus musculus
gaaagaactttccaatgtccgatgt

SEQ ID NO: 26610 - DNA, 25 bp, Mus musculus
gaaagaactttcgaatgtccgatgt

SEQ ID NO: 26611 - DNA, 25 bp, Mus musculus
gaaagaagagataccggagttcagc

SEQ ID NO: 26612 - DNA, 25 bp, Mus musculus
gaaagaagattcattccagagacaa

SEQ ID NO: 26613 - DNA, 25 bp, Mus musculus
gaaagaagcagcacttccatctaca

SEQ ID NO: 26614 - DNA, 25 bp, Mus musculus
gaaagaagcccacttcccagtggat

SEQ ID NO: 26615 - DNA, 25 bp, Mus musculus
gaaagaagcccagttcccagtggat

SEQ ID NO: 26616 - DNA, 25 bp, Mus musculus
gaaagaagcggtgaaccactgatat

SEQ ID NO: 26617 - DNA, 25 bp, Mus musculus
gaaagaagcttttagagagtgagaa

SEQ ID NO: 26618 - DNA, 25 bp, Mus musculus
gaaagaagggcagttaactgccagg

SEQ ID NO: 26619 - DNA, 25 bp, Mus musculus
gaaagaagtttgactacagggcctt

SEQ ID NO: 26620 - DNA, 25 bp, Mus musculus
gaaagaatctgagtccactcagaag

SEQ ID NO: 26621 - DNA, 25 bp, Mus musculus
gaaagaatcttagtcctgctactgg

SEQ ID NO: 26622 - DNA, 25 bp, Mus musculus
gaaagaatgaagaataagcgtcagg

SEQ ID NO: 26623 - DNA, 25 bp, Mus musculus
gaaagaatgtttgagtgaactaagc

SEQ ID NO: 26624 - DNA, 25 bp, Mus musculus
gaaagaattgcttctcatgatgaca

SEQ ID NO: 26625 - DNA, 25 bp, Mus musculus
gaaagaatttctcaagggtcaagtg

SEQ ID NO: 26626 - DNA, 25 bp, Mus musculus
gaaagacaaaaagttaactgacacg

SEQ ID NO: 26627 - DNA, 25 bp, Mus musculus
gaaagacaaggtctacagctacctg

SEQ ID NO: 26628 - DNA, 25 bp, Mus musculus
gaaagacagccccatataaaaacgt

SEQ ID NO: 26629 - DNA, 25 bp, Mus musculus
gaaagacaggacgaagcatccgaaa

SEQ ID NO: 26630 - DNA, 25 bp, Mus musculus
gaaagacatgccaggaaagacagca

SEQ ID NO: 26631 - DNA, 25 bp, Mus musculus
gaaagaccaagaagtgccgtggagc

SEQ ID NO: 26632 - DNA, 25 bp, Mus musculus
gaaagaccacagttgcctccttgct

SEQ ID NO: 26633 - DNA, 25 bp, Mus musculus
gaaagaccaggtatgatcgcctctc

SEQ ID NO: 26634 - DNA, 25 bp, Mus musculus
gaaagacccacaggtgacctcagag

SEQ ID NO: 26635 - DNA, 25 bp, Mus musculus
gaaagacctcgatcccaacaacgtt

SEQ ID NO: 26636 - DNA, 25 bp, Mus musculus
gaaagacctggtggcttcccatcac

SEQ ID NO: 26637 - DNA, 25 bp, Mus musculus
gaaagacctgtaccttctgcaagaa

SEQ ID NO: 26638 - DNA, 25 bp, Mus musculus
gaaagacgaagctgatgcggatctc

SEQ ID NO: 26639 - DNA, 25 bp, Mus musculus
gaaagactactcaggatttgcagga

SEQ ID NO: 26640 - DNA, 25 bp, Mus musculus
gaaagactcgttgaatccatatccc

SEQ ID NO: 26641 - DNA, 25 bp, Mus musculus
gaaagactgctcagcaccatgccta

SEQ ID NO: 26642 - DNA, 25 bp, Mus musculus
gaaagactggacacaccagggcatt

SEQ ID NO: 26643 - DNA, 25 bp, Mus musculus
gaaagactggattctgggaagtttg

SEQ ID NO: 26644 - DNA, 25 bp, Mus musculus
gaaagactgggaactgcaggtgcac

SEQ ID NO: 26645 - DNA, 25 bp, Mus musculus
gaaagacttctttctgcaggctgct

SEQ ID NO: 26646 - DNA, 25 bp, Mus musculus
gaaagagaaactcagcctcctaagg

SEQ ID NO: 26647 - DNA, 25 bp, Mus musculus
gaaagagaacacgttcccttccacg

SEQ ID NO: 26648 - DNA, 25 bp, Mus musculus
gaaagagaacagaacggcttccata

SEQ ID NO: 26649 - DNA, 25 bp, Mus musculus
gaaagagaagaattcccctgctggg

SEQ ID NO: 26650 - DNA, 25 bp, Mus musculus
gaaagagacggacaacaccaaacca

SEQ ID NO: 26651 - DNA, 25 bp, Mus musculus
gaaagagagcagatttcctctcgtc

SEQ ID NO: 26652 - DNA, 25 bp, Mus musculus
gaaagagatgaagaatggcctctcc

SEQ ID NO: 26653 - DNA, 25 bp, Mus musculus
gaaagagatggacaccccagactca

SEQ ID NO: 26654 - DNA, 25 bp, Mus musculus
gaaagagatgtcatcatgagggaat

SEQ ID NO: 26655 - DNA, 25 bp, Mus musculus
gaaagagatgtcatttctgacagcc

SEQ ID NO: 26656 - DNA, 25 bp, Mus musculus
gaaagagcaccaggcctatgtgttc

SEQ ID NO: 26657 - DNA, 25 bp, Mus musculus
gaaagagccaggaaggtgctgaatc

SEQ ID NO: 26658 - DNA, 25 bp, Mus musculus
gaaagagcccttgggaaattattat

SEQ ID NO: 26659 - DNA, 25 bp, Mus musculus
gaaagagccgttcagccggcgccca

SEQ ID NO: 26660 - DNA, 25 bp, Mus musculus
gaaagagccgttgagccggcgccca

SEQ ID NO: 26661 - DNA, 25 bp, Mus musculus
gaaagagctaaagctgcttcgacat

SEQ ID NO: 26662 - DNA, 25 bp, Mus musculus
gaaagaggacaccacctttgatgag

SEQ ID NO: 26663 - DNA, 25 bp, Mus musculus
gaaagaggacctagcttgtatctga

SEQ ID NO: 26664 - DNA, 25 bp, Mus musculus
gaaagaggaccttgcttgtatctga

SEQ ID NO: 26665 - DNA, 25 bp, Mus musculus
gaaagaggcaaattcgacttctccg

SEQ ID NO: 26666 - DNA, 25 bp, Mus musculus
gaaagaggccgagaacgccatcgtt

SEQ ID NO: 26667 - DNA, 25 bp, Mus musculus
gaaagagttcaaatgcgagaactgc

SEQ ID NO: 26668 - DNA, 25 bp, Mus musculus
gaaagagttcgacatcagtcagcag

SEQ ID NO: 26669 - DNA, 25 bp, Mus musculus
gaaagataacagagaccaggcctgg

SEQ ID NO: 26670 - DNA, 25 bp, Mus musculus
gaaagatcccaaagactgggctgct

SEQ ID NO: 26671 - DNA, 25 bp, Mus musculus
gaaagatctaaaggagctgtcagac

SEQ ID NO: 26672 - DNA, 25 bp, Mus musculus
gaaagatctataccccaatggagta

SEQ ID NO: 26673 - DNA, 25 bp, Mus musculus
gaaagatgaagctcgggctggttaa

SEQ ID NO: 26674 - DNA, 25 bp, Mus musculus
gaaagatgcatccatccacctaagc

SEQ ID NO: 26675 - DNA, 25 bp, Mus musculus
gaaagatgcctactatcagactctt

SEQ ID NO: 26676 - DNA, 25 bp, Mus musculus
gaaagattatcttcatcgatacaga

SEQ ID NO: 26677 - DNA, 25 bp, Mus musculus
gaaagattgctgatatacgacctgg

SEQ ID NO: 26678 - DNA, 25 bp, Mus musculus
gaaagattgctgttatacgacctgg

SEQ ID NO: 26679 - DNA, 25 bp, Mus musculus
gaaagatttgcccctgaggacttct

SEQ ID NO: 26680 - DNA, 25 bp, Mus musculus
gaaagcaaatagaggaagaagatct

SEQ ID NO: 26681 - DNA, 25 bp, Mus musculus
gaaagcaagcgaagatgcacatctc

SEQ ID NO: 26682 - DNA, 25 bp, Mus musculus
gaaagcaagcgaatgccgccttcct

SEQ ID NO: 26683 - DNA, 25 bp, Mus musculus
gaaagcaagctttggatgagttcta

SEQ ID NO: 26684 - DNA, 25 bp, Mus musculus
gaaagcaagtcaaggagaaatgaat

SEQ ID NO: 26685 - DNA, 25 bp, Mus musculus
gaaagcaatctggatcagaactgtg

SEQ ID NO: 26686 - DNA, 25 bp, Mus musculus
gaaagcaattgagacgcaaccaaac

SEQ ID NO: 26687 - DNA, 25 bp, Mus musculus
gaaagcacagacagtgtggcctctg

SEQ ID NO: 26688 - DNA, 25 bp, Mus musculus
gaaagcacatcgactgtatccttac

SEQ ID NO: 26689 - DNA, 25 bp, Mus musculus
gaaagcacatcgtctgtatccttac

SEQ ID NO: 26690 - DNA, 25 bp, Mus musculus
gaaagcagagcgcacatttgcatgg

SEQ ID NO: 26691 - DNA, 25 bp, Mus musculus
gaaagcagcttgaagcctatgagcc

SEQ ID NO: 26692 - DNA, 25 bp, Mus musculus
gaaagcataccgtcttctcccatga

SEQ ID NO: 26693 - DNA, 25 bp, Mus musculus
gaaagcatcgtacctttggagaaag

SEQ ID NO: 26694 - DNA, 25 bp, Mus musculus
gaaagcatctattgttaaaaacctg

SEQ ID NO: 26695 - DNA, 25 bp, Mus musculus
gaaagcatcttacctatgccatgtc

SEQ ID NO: 26696 - DNA, 25 bp, Mus musculus
gaaagcatgggattttttaccaagg

SEQ ID NO: 26697 - DNA, 25 bp, Mus musculus
gaaagcattaatggctgcagaggat

SEQ ID NO: 26698 - DNA, 25 bp, Mus musculus
gaaagcattcaacgccaggttccca

SEQ ID NO: 26699 - DNA, 25 bp, Mus musculus
gaaagcattggtctcatctgtccgt

SEQ ID NO: 26700 - DNA, 25 bp, Mus musculus
gaaagccaagtacgatagcctgcag

SEQ ID NO: 26701 - DNA, 25 bp, Mus musculus
gaaagccacagtcagtgggaactac

SEQ ID NO: 26702 - DNA, 25 bp, Mus musculus
gaaagccacagtgagtgggaactac

SEQ ID NO: 26703 - DNA, 25 bp, Mus musculus
gaaagccacatttagggctatcacc

SEQ ID NO: 26704 - DNA, 25 bp, Mus musculus
gaaagccagaagaagtggatgatga

SEQ ID NO: 26705 - DNA, 25 bp, Mus musculus
gaaagccagtgtaactccttcaaga

SEQ ID NO: 26706 - DNA, 25 bp, Mus musculus
gaaagccagtttgtaggcacggcct

SEQ ID NO: 26707 - DNA, 25 bp, Mus musculus
gaaagccatcaccaagtcgggcctc

SEQ ID NO: 26708 - DNA, 25 bp, Mus musculus
gaaagccattaaagaccaactgcag

SEQ ID NO: 26709 - DNA, 25 bp, Mus musculus
gaaagccctaggtgtgaagctgcca

SEQ ID NO: 26710 - DNA, 25 bp, Mus musculus
gaaagccctcatgaaggctgtggcg

SEQ ID NO: 26711 - DNA, 25 bp, Mus musculus
gaaagccgagaatcagcagccatct

SEQ ID NO: 26712 - DNA, 25 bp, Mus musculus
gaaagccgagcccaaaaagatgaag

SEQ ID NO: 26713 - DNA, 25 bp, Mus musculus
gaaagccgagtcacaataaactcct

SEQ ID NO: 26714 - DNA, 25 bp, Mus musculus
gaaagccggttcttgcgaaagactc

SEQ ID NO: 26715 - DNA, 25 bp, Mus musculus
gaaagcctatgatgcctacggacca

SEQ ID NO: 26716 - DNA, 25 bp, Mus musculus
gaaagcctcctacagctcgggctac

SEQ ID NO: 26717 - DNA, 25 bp, Mus musculus
gaaagcctgtcctggtataaagacg

SEQ ID NO: 26718 - DNA, 25 bp, Mus musculus
gaaagccttgtaccctggcatacag

SEQ ID NO: 26719 - DNA, 25 bp, Mus musculus
gaaagcgatggcagtcaccagtgac

SEQ ID NO: 26720 - DNA, 25 bp, Mus musculus
gaaagcgcaagctggctatcctgaa

SEQ ID NO: 26721 - DNA, 25 bp, Mus musculus
gaaagcgcactgcattcgggagcct

SEQ ID NO: 26722 - DNA, 25 bp, Mus musculus
gaaagcgccccaggatggcattgtt

SEQ ID NO: 26723 - DNA, 25 bp, Mus musculus
gaaagcgcttcacgctgcagggctt

SEQ ID NO: 26724 - DNA, 25 bp, Mus musculus
gaaagcggctatattcccttcacca

SEQ ID NO: 26725 - DNA, 25 bp, Mus musculus
gaaagcggttacgtgtctgagcacc

SEQ ID NO: 26726 - DNA, 25 bp, Mus musculus
gaaagcgtggaaagaagcacaagaa

SEQ ID NO: 26727 - DNA, 25 bp, Mus musculus
gaaagcgtgtttgcaaatgtcccag

SEQ ID NO: 26728 - DNA, 25 bp, Mus musculus
gaaagctatacgtacaatggcaagg

SEQ ID NO: 26729 - DNA, 25 bp, Mus musculus
gaaagctctgttcacctacccgaaa

SEQ ID NO: 26730 - DNA, 25 bp, Mus musculus
gaaagctcttctcttgtcttcaaaa

SEQ ID NO: 26731 - DNA, 25 bp, Mus musculus
gaaagctgcaggaggtgtacacgtt

SEQ ID NO: 26732 - DNA, 25 bp, Mus musculus
gaaagctgcccttctggaaagacag

SEQ ID NO: 26733 - DNA, 25 bp, Mus musculus
gaaagctgctcagactgcctgctca

SEQ ID NO: 26734 - DNA, 25 bp, Mus musculus
gaaagctgggctgagtcttaaggac

SEQ ID NO: 26735 - DNA, 25 bp, Mus musculus
gaaagctgggtagttttccgaagat

SEQ ID NO: 26736 - DNA, 25 bp, Mus musculus
gaaagctggtttcatccgccatacc

SEQ ID NO: 26737 - DNA, 25 bp, Mus musculus
gaaagctgtggagagttgctcagaa

SEQ ID NO: 26738 - DNA, 25 bp, Mus musculus
gaaagcttacgtcatggagcacagg

SEQ ID NO: 26739 - DNA, 25 bp, Mus musculus
gaaagcttccctaggccaaaaagag

SEQ ID NO: 26740 - DNA, 25 bp, Mus musculus
gaaagcttcgtctgaaagacttaat

SEQ ID NO: 26741 - DNA, 25 bp, Mus musculus
gaaagcttgaagtcgcaagtctcct

SEQ ID NO: 26742 - DNA, 25 bp, Mus musculus
gaaagcttggacatactgcagctgc

SEQ ID NO: 26743 - DNA, 25 bp, Mus musculus
gaaaggaaaactcatcataccaggt

SEQ ID NO: 26744 - DNA, 25 bp, Mus musculus
gaaaggaacagtgactcttcgggcc

SEQ ID NO: 26745 - DNA, 25 bp, Mus musculus
gaaaggaagatgtataccgaggccc

SEQ ID NO: 26746 - DNA, 25 bp, Mus musculus
gaaaggaagtggtttctatgtttct

SEQ ID NO: 26747 - DNA, 25 bp, Mus musculus
gaaaggaatagtcgaaccgatcaca

SEQ ID NO: 26748 - DNA, 25 bp, Mus musculus
gaaaggaattatatggagcaaaact

SEQ ID NO: 26749 - DNA, 25 bp, Mus musculus
gaaaggacatcttacctttgatgct

SEQ ID NO: 26750 - DNA, 25 bp, Mus musculus
gaaaggacattgaaaatccacaggc

SEQ ID NO: 26751 - DNA, 25 bp, Mus musculus
gaaaggactctgctgtgaacagcca

SEQ ID NO: 26752 - DNA, 25 bp, Mus musculus
gaaaggactctggtgtgaacagcca

SEQ ID NO: 26753 - DNA, 25 bp, Mus musculus
gaaaggagagtgttgcgcacagtcc

SEQ ID NO: 26754 - DNA, 25 bp, Mus musculus
gaaaggaggcaacacatctcagtct

SEQ ID NO: 26755 - DNA, 25 bp, Mus musculus
gaaaggaggcaagacatctcagtct

SEQ ID NO: 26756 - DNA, 25 bp, Mus musculus
gaaaggaggtcttcaagaatgtcca

SEQ ID NO: 26757 - DNA, 25 bp, Mus musculus
gaaaggagtccagataatgaagacc

SEQ ID NO: 26758 - DNA, 25 bp, Mus musculus
gaaaggagttaaagggcaagctcaa

SEQ ID NO: 26759 - DNA, 25 bp, Mus musculus
gaaaggatggcgtccttcgggcact

SEQ ID NO: 26760 - DNA, 25 bp, Mus musculus
gaaaggcagcagtcctagctgaagt

SEQ ID NO: 26761 - DNA, 25 bp, Mus musculus
gaaaggcaggaacaggtctctcact

SEQ ID NO: 26762 - DNA, 25 bp, Mus musculus
gaaaggcaggaagaggtctctcact

SEQ ID NO: 26763 - DNA, 25 bp, Mus musculus
gaaaggcatatgagaaggcagataa

SEQ ID NO: 26764 - DNA, 25 bp, Mus musculus
gaaaggcatctgaccatgcagaatg

SEQ ID NO: 26765 - DNA, 25 bp, Mus musculus
gaaaggccataatatttctgaagga

SEQ ID NO: 26766 - DNA, 25 bp, Mus musculus
gaaaggcccaggctaatgaacagag

SEQ ID NO: 26767 - DNA, 25 bp, Mus musculus
gaaaggcccattctgtttataactt

SEQ ID NO: 26768 - DNA, 25 bp, Mus musculus
gaaaggccccgctacagtagaagag

SEQ ID NO: 26769 - DNA, 25 bp, Mus musculus
gaaaggcctggaagaagaatttcta

SEQ ID NO: 26770 - DNA, 25 bp, Mus musculus
gaaaggcctgtgtcagaaatgcgtc

SEQ ID NO: 26771 - DNA, 25 bp, Mus musculus
gaaaggcgagttccagattcttctt

SEQ ID NO: 26772 - DNA, 25 bp, Mus musculus
gaaaggcgcaaaggaaattgctgaa

SEQ ID NO: 26773 - DNA, 25 bp, Mus musculus
gaaaggcgtgtttcctctgtataaa

SEQ ID NO: 26774 - DNA, 25 bp, Mus musculus
gaaaggctaacgtggcattcctacc

SEQ ID NO: 26775 - DNA, 25 bp, Mus musculus
gaaaggctatgacctgcgtgtcgat

SEQ ID NO: 26776 - DNA, 25 bp, Mus musculus
gaaaggctcttcattgtctcttctg

SEQ ID NO: 26777 - DNA, 25 bp, Mus musculus
gaaaggcttgaaacagtgcggttcc

SEQ ID NO: 26778 - DNA, 25 bp, Mus musculus
gaaagggaaaaatggctgacaaggc

SEQ ID NO: 26779 - DNA, 25 bp, Mus musculus
gaaagggaaaggaagcgccttagca

SEQ ID NO: 26780 - DNA, 25 bp, Mus musculus
gaaagggaacaagagcccgtcacct

SEQ ID NO: 26781 - DNA, 25 bp, Mus musculus
gaaagggaaccacaaatgcgcctag

SEQ ID NO: 26782 - DNA, 25 bp, Mus musculus
gaaagggaaccagaaatgcgcctag

SEQ ID NO: 26783 - DNA, 25 bp, Mus musculus
gaaagggaagattttccacatcgac

SEQ ID NO: 26784 - DNA, 25 bp, Mus musculus
gaaagggcatctctcctccaagcca

SEQ ID NO: 26785 - DNA, 25 bp, Mus musculus
gaaagggccactcacgtcaaaagag

SEQ ID NO: 26786 - DNA, 25 bp, Mus musculus
gaaagggcccacgtttcaaggcagt

SEQ ID NO: 26787 - DNA, 25 bp, Mus musculus
gaaagggccgcgcactccgagtcca

SEQ ID NO: 26788 - DNA, 25 bp, Mus musculus
gaaagggttgtttctcacagacaag

SEQ ID NO: 26789 - DNA, 25 bp, Mus musculus
gaaaggtacatgaagcaggccattg

SEQ ID NO: 26790 - DNA, 25 bp, Mus musculus
gaaaggtactgctctgaggtctccc

SEQ ID NO: 26791 - DNA, 25 bp, Mus musculus
gaaaggtcaatttacagcgcaagat

SEQ ID NO: 26792 - DNA, 25 bp, Mus musculus
gaaaggtctagctcccgaggtggcc

SEQ ID NO: 26793 - DNA, 25 bp, Mus musculus
gaaaggtgcctcctggcctaccttc

SEQ ID NO: 26794 - DNA, 25 bp, Mus musculus
gaaaggtggtgcacatcaacgttgc

SEQ ID NO: 26795 - DNA, 25 bp, Mus musculus
gaaaggtgtcaattaatgagttcct

SEQ ID NO: 26796 - DNA, 25 bp, Mus musculus
gaaaggtgtcttaaggcatcgtctc

SEQ ID NO: 26797 - DNA, 25 bp, Mus musculus
gaaaggttaccaagtgacaaggtgt

SEQ ID NO: 26798 - DNA, 25 bp, Mus musculus
gaaaggttggaagacctgtttgata

SEQ ID NO: 26799 - DNA, 25 bp, Mus musculus
gaaagtaacgtgaaagactccagct

SEQ ID NO: 26800 - DNA, 25 bp, Mus musculus
gaaagtaagaaaggtgcctcctggc

SEQ ID NO: 26801 - DNA, 25 bp, Mus musculus
gaaagtaagagctggagtccggcac

SEQ ID NO: 26802 - DNA, 25 bp, Mus musculus
gaaagtacactgtggatcgggtcct

SEQ ID NO: 26803 - DNA, 25 bp, Mus musculus
gaaagtacatcacagctcttaagaa

SEQ ID NO: 26804 - DNA, 25 bp, Mus musculus
gaaagtagacaccatgacaaaagag

SEQ ID NO: 26805 - DNA, 25 bp, Mus musculus
gaaagtagatcctgctcacagaatc

SEQ ID NO: 26806 - DNA, 25 bp, Mus musculus
gaaagtagtaggtcgaatgtgcatc

SEQ ID NO: 26807 - DNA, 25 bp, Mus musculus
gaaagtcaagaaatcagttaaatgc

SEQ ID NO: 26808 - DNA, 25 bp, Mus musculus
gaaagtcacctacgtggcactactg

SEQ ID NO: 26809 - DNA, 25 bp, Mus musculus
gaaagtcactggatttacacaaggc

SEQ ID NO: 26810 - DNA, 25 bp, Mus musculus
gaaagtcactggttttacacaaggc

SEQ ID NO: 26811 - DNA, 25 bp, Mus musculus
gaaagtcacttattggcccctgctg

SEQ ID NO: 26812 - DNA, 25 bp, Mus musculus
gaaagtcagaagcacgcagccttaa

SEQ ID NO: 26813 - DNA, 25 bp, Mus musculus
gaaagtcattgaaagccgagcccaa

SEQ ID NO: 26814 - DNA, 25 bp, Mus musculus
gaaagtccggaaggtctgtgactca

SEQ ID NO: 26815 - DNA, 25 bp, Mus musculus
gaaagtcctcaaagtagcagcaact

SEQ ID NO: 26816 - DNA, 25 bp, Mus musculus
gaaagtcgtcttccacttgcacgaa

SEQ ID NO: 26817 - DNA, 25 bp, Mus musculus
gaaagtctgtatactctgtgtgagc

SEQ ID NO: 26818 - DNA, 25 bp, Mus musculus
gaaagtcttctgagtctcacaggac

SEQ ID NO: 26819 - DNA, 25 bp, Mus musculus
gaaagtgaactgaaactattttggt

SEQ ID NO: 26820 - DNA, 25 bp, Mus musculus
gaaagtgaactgtaactattttggt

SEQ ID NO: 26821 - DNA, 25 bp, Mus musculus
gaaagtgagcaagcacctgctgtgt

SEQ ID NO: 26822 - DNA, 25 bp, Mus musculus
gaaagtgctgattgtaggagcaccc

SEQ ID NO: 26823 - DNA, 25 bp, Mus musculus
gaaagtggacaaggccacccatgta

SEQ ID NO: 26824 - DNA, 25 bp, Mus musculus
gaaagtggacacattgtcaaatgcc

SEQ ID NO: 26825 - DNA, 25 bp, Mus musculus
gaaagtggcatctgagaaagtgcag

SEQ ID NO: 26826 - DNA, 25 bp, Mus musculus
gaaagtggctatatagtcattcaaa

SEQ ID NO: 26827 - DNA, 25 bp, Mus musculus
gaaagtgggacaccagatgacagtc

SEQ ID NO: 26828 - DNA, 25 bp, Mus musculus
gaaagtgtacagataactgcagagc

SEQ ID NO: 26829 - DNA, 25 bp, Mus musculus
gaaagtgtgcagtattgacctggag

SEQ ID NO: 26830 - DNA, 25 bp, Mus musculus
gaaagttacaggactttgaagcaac

SEQ ID NO: 26831 - DNA, 25 bp, Mus musculus
gaaagttacaggtctttgaagcaac

SEQ ID NO: 26832 - DNA, 25 bp, Mus musculus
gaaagttaccacttcattgtgtaaa

SEQ ID NO: 26833 - DNA, 25 bp, Mus musculus
gaaagttagccacgagtaacgtctg

SEQ ID NO: 26834 - DNA, 25 bp, Mus musculus
gaaagttagccaggagtaacgtctg

SEQ ID NO: 26835 - DNA, 25 bp, Mus musculus
gaaagttcgagaaattcaagccgcc

SEQ ID NO: 26836 - DNA, 25 bp, Mus musculus
gaaagttctcaagtttgcttgtaag

SEQ ID NO: 26837 - DNA, 25 bp, Mus musculus
gaaagttctgccatctgcctgtccc

SEQ ID NO: 26838 - DNA, 25 bp, Mus musculus
gaaagttctgccttctgcctgtccc

SEQ ID NO: 26839 - DNA, 25 bp, Mus musculus
gaaagttgacaaccatacctgcagg

SEQ ID NO: 26840 - DNA, 25 bp, Mus musculus
gaaagttgctgctaagatggcccct

SEQ ID NO: 26841 - DNA, 25 bp, Mus musculus
gaaagttgtcctggaaaatcggagg

SEQ ID NO: 26842 - DNA, 25 bp, Mus musculus
gaaagttgttcaagtttatgcagac

SEQ ID NO: 26843 - DNA, 25 bp, Mus musculus
gaaagtttgcaaaccctggtagaag

SEQ ID NO: 26844 - DNA, 25 bp, Mus musculus
gaaataaaggccacagaaccacaaa

SEQ ID NO: 26845 - DNA, 25 bp, Mus musculus
gaaataaatgccttgcagtgggaaa

SEQ ID NO: 26846 - DNA, 25 bp, Mus musculus
gaaataacaaagattctgagcagcc

SEQ ID NO: 26847 - DNA, 25 bp, Mus musculus
gaaataacagtattcagtctcggct

SEQ ID NO: 26848 - DNA, 25 bp, Mus musculus
gaaataacagtccaacagctaatgg

SEQ ID NO: 26849 - DNA, 25 bp, Mus musculus
gaaataaccaaagatgaatggatgg

SEQ ID NO: 26850 - DNA, 25 bp, Mus musculus
gaaataaccaagataatgagcaccc

SEQ ID NO: 26851 - DNA, 25 bp, Mus musculus
gaaataagcttggtagacgttgtga

SEQ ID NO: 26852 - DNA, 25 bp, Mus musculus
gaaataatgaggacgtttctatcat

SEQ ID NO: 26853 - DNA, 25 bp, Mus musculus
gaaatacagcgtaactattccctgg

SEQ ID NO: 26854 - DNA, 25 bp, Mus musculus
gaaatacatttctgtgaggcacgac

SEQ ID NO: 26855 - DNA, 25 bp, Mus musculus
gaaataccggcccaaatactgcggc

SEQ ID NO: 26856 - DNA, 25 bp, Mus musculus
gaaataccggccgaaatactgcggc

SEQ ID NO: 26857 - DNA, 25 bp, Mus musculus
gaaatacctcgatatccccaagatg

SEQ ID NO: 26858 - DNA, 25 bp, Mus musculus
gaaatacgagtttttccagagaagg

SEQ ID NO: 26859 - DNA, 25 bp, Mus musculus
gaaatacgattatgataacctgccc

SEQ ID NO: 26860 - DNA, 25 bp, Mus musculus
gaaatacgcaagcaactgctcattc

SEQ ID NO: 26861 - DNA, 25 bp, Mus musculus
gaaatacttcgagctgtgcctggca

SEQ ID NO: 26862 - DNA, 25 bp, Mus musculus
gaaatagacttcgtaaagatcaact

SEQ ID NO: 26863 - DNA, 25 bp, Mus musculus
gaaatagcaggacctccagacacac

SEQ ID NO: 26864 - DNA, 25 bp, Mus musculus
gaaatagcccacacttacaaggccg

SEQ ID NO: 26865 - DNA, 25 bp, Mus musculus
gaaataggaaagacactggcagaga

SEQ ID NO: 26866 - DNA, 25 bp, Mus musculus
gaaataggacaagttcacaacggcc

SEQ ID NO: 26867 - DNA, 25 bp, Mus musculus
gaaatagtctctggatccttgcatg

SEQ ID NO: 26868 - DNA, 25 bp, Mus musculus
gaaatagttggctttaggtcatctc

SEQ ID NO: 26869 - DNA, 25 bp, Mus musculus
gaaatatacactgtgaaattccaga

SEQ ID NO: 26870 - DNA, 25 bp, Mus musculus
gaaatatcaggatcaataacttgcc

SEQ ID NO: 26871 - DNA, 25 bp, Mus musculus
gaaatatccaaaccccatgaacccg

SEQ ID NO: 26872 - DNA, 25 bp, Mus musculus
gaaatatcctgagcgctacacaagt

SEQ ID NO: 26873 - DNA, 25 bp, Mus musculus
gaaatatcctgatgcgcagactgcc

SEQ ID NO: 26874 - DNA, 25 bp, Mus musculus
gaaatatcctgttgggccatggctg

SEQ ID NO: 26875 - DNA, 25 bp, Mus musculus
gaaatatctggtgaggtgacactgg

SEQ ID NO: 26876 - DNA, 25 bp, Mus musculus
gaaatatgccgccttcactaggata

SEQ ID NO: 26877 - DNA, 25 bp, Mus musculus
gaaatatggataactcgctgctcag

SEQ ID NO: 26878 - DNA, 25 bp, Mus musculus
gaaatatggatctagcctccagcca

SEQ ID NO: 26879 - DNA, 25 bp, Mus musculus
gaaatatgttagtggaatctccaga

SEQ ID NO: 26880 - DNA, 25 bp, Mus musculus
gaaatattcttctgggtgaggatgg

SEQ ID NO: 26881 - DNA, 25 bp, Mus musculus
gaaatcaaaccccaatcctctggaa

SEQ ID NO: 26882 - DNA, 25 bp, Mus musculus
gaaatcaaactccagaggctgtctc

SEQ ID NO: 26883 - DNA, 25 bp, Mus musculus
gaaatcaaccaactccaggtcaatg

SEQ ID NO: 26884 - DNA, 25 bp, Mus musculus
gaaatcaaccaagtccaggtcaatg

SEQ ID NO: 26885 - DNA, 25 bp, Mus musculus
gaaatcaacgagaccaccttatacc

SEQ ID NO: 26886 - DNA, 25 bp, Mus musculus
gaaatcaattccacgaattttggag

SEQ ID NO: 26887 - DNA, 25 bp, Mus musculus
gaaatcacaccagaggacggagagg

SEQ ID NO: 26888 - DNA, 25 bp, Mus musculus
gaaatcactactgctaatggcgaag

SEQ ID NO: 26889 - DNA, 25 bp, Mus musculus
gaaatcactcacgagtctccatcag

SEQ ID NO: 26890 - DNA, 25 bp, Mus musculus
gaaatcagagctctttggccttaaa

SEQ ID NO: 26891 - DNA, 25 bp, Mus musculus
gaaatcagaggagatgtaaccatag

SEQ ID NO: 26892 - DNA, 25 bp, Mus musculus
gaaatcagatctacccagaggatgg

SEQ ID NO: 26893 - DNA, 25 bp, Mus musculus
gaaatcagcagaaatggtgtcaacc

SEQ ID NO: 26894 - DNA, 25 bp, Mus musculus
gaaatcagcctctgggaacggctgg

SEQ ID NO: 26895 - DNA, 25 bp, Mus musculus
gaaatcaggaggctacctctgcccc

SEQ ID NO: 26896 - DNA, 25 bp, Mus musculus
gaaatcagtaatttagccggctttg

SEQ ID NO: 26897 - DNA, 25 bp, Mus musculus
gaaatcagtgacttcctgaggcatg

SEQ ID NO: 26898 - DNA, 25 bp, Mus musculus
gaaatcataaaccacgaggatccta

SEQ ID NO: 26899 - DNA, 25 bp, Mus musculus
gaaatcatctaaaagcctctttgca

SEQ ID NO: 26900 - DNA, 25 bp, Mus musculus
gaaatcatctaatagcctctttgca

SEQ ID NO: 26901 - DNA, 25 bp, Mus musculus
gaaatcattcactgctgtctgtcag

SEQ ID NO: 26902 - DNA, 25 bp, Mus musculus
gaaatccaaccttcggtccctggct

SEQ ID NO: 26903 - DNA, 25 bp, Mus musculus
gaaatccatgttcgcgattggcttt

SEQ ID NO: 26904 - DNA, 25 bp, Mus musculus
gaaatccatgtttcacacgcagatg

SEQ ID NO: 26905 - DNA, 25 bp, Mus musculus
gaaatcccaaccaaggcaagaaggg

SEQ ID NO: 26906 - DNA, 25 bp, Mus musculus
gaaatcccaggaggcctatgagatg

SEQ ID NO: 26907 - DNA, 25 bp, Mus musculus
gaaatccgagaaatctatggccaga

SEQ ID NO: 26908 - DNA, 25 bp, Mus musculus
gaaatccggctcattgattatgaga

SEQ ID NO: 26909 - DNA, 25 bp, Mus musculus
gaaatcctatgaaccccaggaggac

SEQ ID NO: 26910 - DNA, 25 bp, Mus musculus
gaaatcctcaaggattcaaccaggg

SEQ ID NO: 26911 - DNA, 25 bp, Mus musculus
gaaatcctcggtagctgagcaggcc

SEQ ID NO: 26912 - DNA, 25 bp, Mus musculus
gaaatcctcttctgtgtattctctg

SEQ ID NO: 26913 - DNA, 25 bp, Mus musculus
gaaatcctgcatttcatagacaagg

SEQ ID NO: 26914 - DNA, 25 bp, Mus musculus
gaaatcctgtcatgcagtgtcccaa

SEQ ID NO: 26915 - DNA, 25 bp, Mus musculus
gaaatcggatctatgtctcaagaga

SEQ ID NO: 26916 - DNA, 25 bp, Mus musculus
gaaatcggatctttgtctcaagaga

SEQ ID NO: 26917 - DNA, 25 bp, Mus musculus
gaaatcggcaaaaggctcagctaag

SEQ ID NO: 26918 - DNA, 25 bp, Mus musculus
gaaatcggcaacacggaagctgatt

SEQ ID NO: 26919 - DNA, 25 bp, Mus musculus
gaaatcggctcaacagagataacct

SEQ ID NO: 26920 - DNA, 25 bp, Mus musculus
gaaatcggctgaaacagcctgtgga

SEQ ID NO: 26921 - DNA, 25 bp, Mus musculus
gaaatcggtagtaatggttatcata

SEQ ID NO: 26922 - DNA, 25 bp, Mus musculus
gaaatcgtgccaaatgggataacat

SEQ ID NO: 26923 - DNA, 25 bp, Mus musculus
gaaatcgttctccaagactctcagc

SEQ ID NO: 26924 - DNA, 25 bp, Mus musculus
gaaatctacattgctccctcaggcg

SEQ ID NO: 26925 - DNA, 25 bp, Mus musculus
gaaatctactatcgttgaacttggg

SEQ ID NO: 26926 - DNA, 25 bp, Mus musculus
gaaatctccaccaaggaagtcccca

SEQ ID NO: 26927 - DNA, 25 bp, Mus musculus
gaaatctccccgagcagacaactac

SEQ ID NO: 26928 - DNA, 25 bp, Mus musculus
gaaatctcccctacccgaaggatgt

SEQ ID NO: 26929 - DNA, 25 bp, Mus musculus
gaaatctccttttgggcttctggtg

SEQ ID NO: 26930 - DNA, 25 bp, Mus musculus
gaaatctctcagagtgattccctgg

SEQ ID NO: 26931 - DNA, 25 bp, Mus musculus
gaaatctgccaaagacttgcctcct

SEQ ID NO: 26932 - DNA, 25 bp, Mus musculus
gaaatctgcctaaggatgtttgagt

SEQ ID NO: 26933 - DNA, 25 bp, Mus musculus
gaaatctgcctatggatgtttgagt

SEQ ID NO: 26934 - DNA, 25 bp, Mus musculus
gaaatctgtcatccagcttgacctt

SEQ ID NO: 26935 - DNA, 25 bp, Mus musculus
gaaatctgtcatgcagcttgacctt

SEQ ID NO: 26936 - DNA, 25 bp, Mus musculus
gaaatctgtgacctcagtggtgacc

SEQ ID NO: 26937 - DNA, 25 bp, Mus musculus
gaaatctgtggtcatcctggtgcct

SEQ ID NO: 26938 - DNA, 25 bp, Mus musculus
gaaatcttagaacatcaggacttac

SEQ ID NO: 26939 - DNA, 25 bp, Mus musculus
gaaatcttagaagatcaggacttac

SEQ ID NO: 26940 - DNA, 25 bp, Mus musculus
gaaatcttcaaaactgtacacgcag

SEQ ID NO: 26941 - DNA, 25 bp, Mus musculus
gaaatcttggcagtttcctggtcac

SEQ ID NO: 26942 - DNA, 25 bp, Mus musculus
gaaatcttggtaagcgaaacagact

SEQ ID NO: 26943 - DNA, 25 bp, Mus musculus
gaaatctttctggaatacctgtcct

SEQ ID NO: 26944 - DNA, 25 bp, Mus musculus
gaaatgaaagatgcctactatcaga

SEQ ID NO: 26945 - DNA, 25 bp, Mus musculus
gaaatgaaagcctctctttgggcca

SEQ ID NO: 26946 - DNA, 25 bp, Mus musculus
gaaatgaaatgggagttcactagct

SEQ ID NO: 26947 - DNA, 25 bp, Mus musculus
gaaatgaactgcataatcttctaga

SEQ ID NO: 26948 - DNA, 25 bp, Mus musculus
gaaatgaagcgaacgctccaaaccc

SEQ ID NO: 26949 - DNA, 25 bp, Mus musculus
gaaatgaagcggcagaaaatacaga

SEQ ID NO: 26950 - DNA, 25 bp, Mus musculus
gaaatgaaggacctattgagaggca

SEQ ID NO: 26951 - DNA, 25 bp, Mus musculus
gaaatgaatcatgattttcaagctc

SEQ ID NO: 26952 - DNA, 25 bp, Mus musculus
gaaatgaattgaccaggagaagact

SEQ ID NO: 26953 - DNA, 25 bp, Mus musculus
gaaatgacacagcaggacacagctc

SEQ ID NO: 26954 - DNA, 25 bp, Mus musculus
gaaatgactatgctgatcttccaga

SEQ ID NO: 26955 - DNA, 25 bp, Mus musculus
gaaatgagacgaaggagcgccaagt

SEQ ID NO: 26956 - DNA, 25 bp, Mus musculus
gaaatgagacgatggagcgccaagt

SEQ ID NO: 26957 - DNA, 25 bp, Mus musculus
gaaatgatcagtagcaccagtgttt

SEQ ID NO: 26958 - DNA, 25 bp, Mus musculus
gaaatgatcctggatgaaaatgcta

SEQ ID NO: 26959 - DNA, 25 bp, Mus musculus
gaaatgattaaagataagctaaaag

SEQ ID NO: 26960 - DNA, 25 bp, Mus musculus
gaaatgcaaagtccttcgcaagcct

SEQ ID NO: 26961 - DNA, 25 bp, Mus musculus
gaaatgcagagacaggtctcgtgta

SEQ ID NO: 26962 - DNA, 25 bp, Mus musculus
gaaatgccagatgtagaaattgaca

SEQ ID NO: 26963 - DNA, 25 bp, Mus musculus
gaaatgccaggaacaaaaagacacc

SEQ ID NO: 26964 - DNA, 25 bp, Mus musculus
gaaatgccaggagtgtcgacttcgc

SEQ ID NO: 26965 - DNA, 25 bp, Mus musculus
gaaatgccatgggaaacaaggtgat

SEQ ID NO: 26966 - DNA, 25 bp, Mus musculus
gaaatgcccctactgtcctgatcgt

SEQ ID NO: 26967 - DNA, 25 bp, Mus musculus
gaaatgcctaaatgaccacttggag

SEQ ID NO: 26968 - DNA, 25 bp, Mus musculus
gaaatgcctctgaagaatgttttta

SEQ ID NO: 26969 - DNA, 25 bp, Mus musculus
gaaatgcgtggacctggttatccag

SEQ ID NO: 26970 - DNA, 25 bp, Mus musculus
gaaatgctactgcaagccacagcgg

SEQ ID NO: 26971 - DNA, 25 bp, Mus musculus
gaaatgctccagaaatggactgcct

SEQ ID NO: 26972 - DNA, 25 bp, Mus musculus
gaaatgctctatggccgcataggct

SEQ ID NO: 26973 - DNA, 25 bp, Mus musculus
gaaatgctctgacttttgccaagat

SEQ ID NO: 26974 - DNA, 25 bp, Mus musculus
gaaatgctggtttgctacagtgttt

SEQ ID NO: 26975 - DNA, 25 bp, Mus musculus
gaaatgcttattcgtactcctatta

SEQ ID NO: 26976 - DNA, 25 bp, Mus musculus
gaaatgcttcctggagtccttcacc

SEQ ID NO: 26977 - DNA, 25 bp, Mus musculus
gaaatgctttacacacctgaaccaa

SEQ ID NO: 26978 - DNA, 25 bp, Mus musculus
gaaatgctttgagcctcagcttctc

SEQ ID NO: 26979 - DNA, 25 bp, Mus musculus
gaaatggaagatcttcctggagaga

SEQ ID NO: 26980 - DNA, 25 bp, Mus musculus
gaaatggaagctgaaacttattgca

SEQ ID NO: 26981 - DNA, 25 bp, Mus musculus
gaaatggaatcttcgtcggaaccgt

SEQ ID NO: 26982 - DNA, 25 bp, Mus musculus
gaaatggacacacaacaaaagaacc

SEQ ID NO: 26983 - DNA, 25 bp, Mus musculus
gaaatggacacagaacaaaagaacc

SEQ ID NO: 26984 - DNA, 25 bp, Mus musculus
gaaatggactgccttattaggcttc

SEQ ID NO: 26985 - DNA, 25 bp, Mus musculus
gaaatggacttaattttacagcagg

SEQ ID NO: 26986 - DNA, 25 bp, Mus musculus
gaaatggagactgcagaagacttgt

SEQ ID NO: 26987 - DNA, 25 bp, Mus musculus
gaaatggagagagtatttgtgctga

SEQ ID NO: 26988 - DNA, 25 bp, Mus musculus
gaaatggaggtgagagtttcacagc

SEQ ID NO: 26989 - DNA, 25 bp, Mus musculus
gaaatggaggtgcttcatctacgga

SEQ ID NO: 26990 - DNA, 25 bp, Mus musculus
gaaatggagttagtgagccaccatg

SEQ ID NO: 26991 - DNA, 25 bp, Mus musculus
gaaatggagttcctatcctcccaag

SEQ ID NO: 26992 - DNA, 25 bp, Mus musculus
gaaatggatccagaatatgaagaga

SEQ ID NO: 26993 - DNA, 25 bp, Mus musculus
gaaatggattcgagtcaaccgcaga

SEQ ID NO: 26994 - DNA, 25 bp, Mus musculus
gaaatggccaactcacctgatgcag

SEQ ID NO: 26995 - DNA, 25 bp, Mus musculus
gaaatggccagagtttttgacagac

SEQ ID NO: 26996 - DNA, 25 bp, Mus musculus
gaaatggccgctctacttgagcacc

SEQ ID NO: 26997 - DNA, 25 bp, Mus musculus
gaaatggccgtcaatttgtccaaag

SEQ ID NO: 26998 - DNA, 25 bp, Mus musculus
gaaatggcgattgagacgctgcaaa

SEQ ID NO: 26999 - DNA, 25 bp, Mus musculus
gaaatggctatcgaagccacacgaa

SEQ ID NO: 27000 - DNA, 25 bp, Mus musculus
gaaatggctcttccccacgtccatg

SEQ ID NO: 27001 - DNA, 25 bp, Mus musculus
gaaatggctgcagtcccgagctgtg

SEQ ID NO: 27002 - DNA, 25 bp, Mus musculus
gaaatgggagaaacccttccagagg

SEQ ID NO: 27003 - DNA, 25 bp, Mus musculus
gaaatggtgaagaaactccacacag

SEQ ID NO: 27004 - DNA, 25 bp, Mus musculus
gaaatggtgcatgggaaattgttca

SEQ ID NO: 27005 - DNA, 25 bp, Mus musculus
gaaatggttgttcctccagaaggct

SEQ ID NO: 27006 - DNA, 25 bp, Mus musculus
gaaatggtttgccacaaaatcctct

SEQ ID NO: 27007 - DNA, 25 bp, Mus musculus
gaaatgtacactaccactgacgggc

SEQ ID NO: 27008 - DNA, 25 bp, Mus musculus
gaaatgtataccaaagcttctttca

SEQ ID NO: 27009 - DNA, 25 bp, Mus musculus
gaaatgtatcctcccacctagctgg

SEQ ID NO: 27010 - DNA, 25 bp, Mus musculus
gaaatgtatcctgccacctagctgg

SEQ ID NO: 27011 - DNA, 25 bp, Mus musculus
gaaatgtatctcatccagcctgaca

SEQ ID NO: 27012 - DNA, 25 bp, Mus musculus
gaaatgtcaagcttctgaggcagat

SEQ ID NO: 27013 - DNA, 25 bp, Mus musculus
gaaatgtctctttttgacctcagag

SEQ ID NO: 27014 - DNA, 25 bp, Mus musculus
gaaatgtcttgcctcctgcctgctc

SEQ ID NO: 27015 - DNA, 25 bp, Mus musculus
gaaatgtggaacactggattggcca

SEQ ID NO: 27016 - DNA, 25 bp, Mus musculus
gaaatgtggaatcccttaggcttgg

SEQ ID NO: 27017 - DNA, 25 bp, Mus musculus
gaaatgtggactccgcacccaggca

SEQ ID NO: 27018 - DNA, 25 bp, Mus musculus
gaaatgtgtcatccctatggcccag

SEQ ID NO: 27019 - DNA, 25 bp, Mus musculus
gaaatgtgtctccacaaatgaagcc

SEQ ID NO: 27020 - DNA, 25 bp, Mus musculus
gaaatgtgttctcctcagatgcggc

SEQ ID NO: 27021 - DNA, 25 bp, Mus musculus
gaaatgtgttttccattatgtggag

SEQ ID NO: 27022 - DNA, 25 bp, Mus musculus
gaaatgttcacaaactccgtctgta

SEQ ID NO: 27023 - DNA, 25 bp, Mus musculus
gaaatgttcattgtactgtgtccaa

SEQ ID NO: 27024 - DNA, 25 bp, Mus musculus
gaaatgttgcagattcccaaggctt

SEQ ID NO: 27025 - DNA, 25 bp, Mus musculus
gaaatgttgggaagaatgtcaagat

SEQ ID NO: 27026 - DNA, 25 bp, Mus musculus
gaaatgttgtttcgccagtgaaaaa

SEQ ID NO: 27027 - DNA, 25 bp, Mus musculus
gaaattaagcgagagacagaaccca

SEQ ID NO: 27028 - DNA, 25 bp, Mus musculus
gaaattacaaaactggactcctcta

SEQ ID NO: 27029 - DNA, 25 bp, Mus musculus
gaaattaccccagatccagaagatc

SEQ ID NO: 27030 - DNA, 25 bp, Mus musculus
gaaattactgtgactactgcccatg

SEQ ID NO: 27031 - DNA, 25 bp, Mus musculus
gaaattagaaggatgggagctgcgt

SEQ ID NO: 27032 - DNA, 25 bp, Mus musculus
gaaattagaatttcctggtcagaat

SEQ ID NO: 27033 - DNA, 25 bp, Mus musculus
gaaattagagataggcacttctgag

SEQ ID NO: 27034 - DNA, 25 bp, Mus musculus
gaaattagagattggcacttctgag

SEQ ID NO: 27035 - DNA, 25 bp, Mus musculus
gaaattatatttccttcagagcaga

SEQ ID NO: 27036 - DNA, 25 bp, Mus musculus
gaaattatatttgcttcagagcaga

SEQ ID NO: 27037 - DNA, 25 bp, Mus musculus
gaaattatcctttatttggctgcaa

SEQ ID NO: 27038 - DNA, 25 bp, Mus musculus
gaaattatctttgtgtcctctctgg

SEQ ID NO: 27039 - DNA, 25 bp, Mus musculus
gaaattcaagccatgagccaatgca

SEQ ID NO: 27040 - DNA, 25 bp, Mus musculus
gaaattcaggctggtactggatcct

SEQ ID NO: 27041 - DNA, 25 bp, Mus musculus
gaaattcagtcttcagggtctcaag

SEQ ID NO: 27042 - DNA, 25 bp, Mus musculus
gaaattcagttatcaaccacagcat

SEQ ID NO: 27043 - DNA, 25 bp, Mus musculus
gaaattcatcagctgcactaaagca

SEQ ID NO: 27044 - DNA, 25 bp, Mus musculus
gaaattcatcaggatccactttgga

SEQ ID NO: 27045 - DNA, 25 bp, Mus musculus
gaaattcccaaagagcagtggatga

SEQ ID NO: 27046 - DNA, 25 bp, Mus musculus
gaaattccctgatgatcaggctcag

SEQ ID NO: 27047 - DNA, 25 bp, Mus musculus
gaaattcctggcactttaccaaact

SEQ ID NO: 27048 - DNA, 25 bp, Mus musculus
gaaattcctggtccattcacagcag

SEQ ID NO: 27049 - DNA, 25 bp, Mus musculus
gaaattccttcaagcccgagtggtg

SEQ ID NO: 27050 - DNA, 25 bp, Mus musculus
gaaattcgagatgcaatgatggcaa

SEQ ID NO: 27051 - DNA, 25 bp, Mus musculus
gaaattcgatagcaggctttttgtt

SEQ ID NO: 27052 - DNA, 25 bp, Mus musculus
gaaattctcaacaggactgagaagt

SEQ ID NO: 27053 - DNA, 25 bp, Mus musculus
gaaattctccagcaaaactccaaga

SEQ ID NO: 27054 - DNA, 25 bp, Mus musculus
gaaattctgagtcacccctgggtgt

SEQ ID NO: 27055 - DNA, 25 bp, Mus musculus
gaaattctttatccagcttgcccac

SEQ ID NO: 27056 - DNA, 25 bp, Mus musculus
gaaattgaacctgagccagagcctc

SEQ ID NO: 27057 - DNA, 25 bp, Mus musculus
gaaattgaagaaatagtattcccta

SEQ ID NO: 27058 - DNA, 25 bp, Mus musculus
gaaattgaagaattagtattcccta

SEQ ID NO: 27059 - DNA, 25 bp, Mus musculus
gaaattgaagaattcgagagcaact

SEQ ID NO: 27060 - DNA, 25 bp, Mus musculus
gaaattgaccacagcacagtacaga

SEQ ID NO: 27061 - DNA, 25 bp, Mus musculus
gaaattgagcaggtggacatgctag

SEQ ID NO: 27062 - DNA, 25 bp, Mus musculus
gaaattgatctaaagccagtctgca

SEQ ID NO: 27063 - DNA, 25 bp, Mus musculus
gaaattgatgagctgacccggatct

SEQ ID NO: 27064 - DNA, 25 bp, Mus musculus
gaaattgattcagaaattgcagccc

SEQ ID NO: 27065 - DNA, 25 bp, Mus musculus
gaaattgcaccaatcaacttaaaag

SEQ ID NO: 27066 - DNA, 25 bp, Mus musculus
gaaattgcagccctacgatcagagc

SEQ ID NO: 27067 - DNA, 25 bp, Mus musculus
gaaattgcccattcttgctgaagct

SEQ ID NO: 27068 - DNA, 25 bp, Mus musculus
gaaattgctcgagactccatcaacc

SEQ ID NO: 27069 - DNA, 25 bp, Mus musculus
gaaattgctgaaggtttcccgagac

SEQ ID NO: 27070 - DNA, 25 bp, Mus musculus
gaaattgcttaaggaactttccagg

SEQ ID NO: 27071 - DNA, 25 bp, Mus musculus
gaaattggcgctttcgagctgaact

SEQ ID NO: 27072 - DNA, 25 bp, Mus musculus
gaaattgggaacgaactggatgaac

SEQ ID NO: 27073 - DNA, 25 bp, Mus musculus
gaaattgggagaacagaacactgaa

SEQ ID NO: 27074 - DNA, 25 bp, Mus musculus
gaaattgggcaagaaaccatgactg

SEQ ID NO: 27075 - DNA, 25 bp, Mus musculus
gaaattgtaaatggttctcgaagct

SEQ ID NO: 27076 - DNA, 25 bp, Mus musculus
gaaattgtcaatatctgtgagaaga

SEQ ID NO: 27077 - DNA, 25 bp, Mus musculus
gaaattgtgcattcccaggagttgc

SEQ ID NO: 27078 - DNA, 25 bp, Mus musculus
gaaattgttcctgatcccaggaagc

SEQ ID NO: 27079 - DNA, 25 bp, Mus musculus
gaaatttacaagagttttcggccag

SEQ ID NO: 27080 - DNA, 25 bp, Mus musculus
gaaatttcaagcatgcatcttctat

SEQ ID NO: 27081 - DNA, 25 bp, Mus musculus
gaaatttcaatatacacagctccat

SEQ ID NO: 27082 - DNA, 25 bp, Mus musculus
gaaatttcagtcgatgacggcccat

SEQ ID NO: 27083 - DNA, 25 bp, Mus musculus
gaaatttcttggtccctcctgagaa

SEQ ID NO: 27084 - DNA, 25 bp, Mus musculus
gaaatttgcaaaagcctacaatctg

SEQ ID NO: 27085 - DNA, 25 bp, Mus musculus
gaaatttgctgatcttaggcatcga

SEQ ID NO: 27086 - DNA, 25 bp, Mus musculus
gaaatttgggaaggacgtgaagatt

SEQ ID NO: 27087 - DNA, 25 bp, Mus musculus
gaaattttacactgaagatggtaac

SEQ ID NO: 27088 - DNA, 25 bp, Mus musculus
gaacaaaaatattaatgaggccatg

SEQ ID NO: 27089 - DNA, 25 bp, Mus musculus
gaacaaaactgtagaggactcccca

SEQ ID NO: 27090 - DNA, 25 bp, Mus musculus
gaacaaaatgctggctagggctgct

SEQ ID NO: 27091 - DNA, 25 bp, Mus musculus
gaacaaacatcagatatgatgacag

SEQ ID NO: 27092 - DNA, 25 bp, Mus musculus
gaacaaacatgtcgaattcttccgc

SEQ ID NO: 27093 - DNA, 25 bp, Mus musculus
gaacaaacatgtggaattcttccgc

SEQ ID NO: 27094 - DNA, 25 bp, Mus musculus
gaacaaactacaggcgattgccaac

SEQ ID NO: 27095 - DNA, 25 bp, Mus musculus
gaacaaagactcctatctgatcctg

SEQ ID NO: 27096 - DNA, 25 bp, Mus musculus
gaacaaagcctttctgaggccatgg

SEQ ID NO: 27097 - DNA, 25 bp, Mus musculus
gaacaaataaggcagaccagtgagg

SEQ ID NO: 27098 - DNA, 25 bp, Mus musculus
gaacaaatgcgcatccacgctgagg

SEQ ID NO: 27099 - DNA, 25 bp, Mus musculus
gaacaacaaccagcagaacgctgct

SEQ ID NO: 27100 - DNA, 25 bp, Mus musculus
gaacaacaatacacaacacaaaaag

SEQ ID NO: 27101 - DNA, 25 bp, Mus musculus
gaacaacacatcttgcagtcttaaa

SEQ ID NO: 27102 - DNA, 25 bp, Mus musculus
gaacaacactctaagcatcgaacca

SEQ ID NO: 27103 - DNA, 25 bp, Mus musculus
gaacaacaggtacaccgcctgctgc

SEQ ID NO: 27104 - DNA, 25 bp, Mus musculus
gaacaacatatttctgtccacaggg

SEQ ID NO: 27105 - DNA, 25 bp, Mus musculus
gaacaaccacattatggaacaacag

SEQ ID NO: 27106 - DNA, 25 bp, Mus musculus
gaacaacccctttctctaagctgaa

SEQ ID NO: 27107 - DNA, 25 bp, Mus musculus
gaacaacggttctacgggtccatgg

SEQ ID NO: 27108 - DNA, 25 bp, Mus musculus
gaacaactccgaataggcccgtgtt

SEQ ID NO: 27109 - DNA, 25 bp, Mus musculus
gaacaactgtgagtgacaccacctg

SEQ ID NO: 27110 - DNA, 25 bp, Mus musculus
gaacaacttgaagtcactggaggct

SEQ ID NO: 27111 - DNA, 25 bp, Mus musculus
gaacaagaagtcagatggcggtgtc

SEQ ID NO: 27112 - DNA, 25 bp, Mus musculus
gaacaagacccgaaggaaattctgc

SEQ ID NO: 27113 - DNA, 25 bp, Mus musculus
gaacaagactcaggtttgggtgttt

SEQ ID NO: 27114 - DNA, 25 bp, Mus musculus
gaacaagagaagttaccacatgtgt

SEQ ID NO: 27115 - DNA, 25 bp, Mus musculus
gaacaagagctggatatcaagaaga

SEQ ID NO: 27116 - DNA, 25 bp, Mus musculus
gaacaagatacaaaaagacaaggca

SEQ ID NO: 27117 - DNA, 25 bp, Mus musculus
gaacaagcagttcttcgctatggaa

SEQ ID NO: 27118 - DNA, 25 bp, Mus musculus
gaacaagcccctgtatcagatgcgg

SEQ ID NO: 27119 - DNA, 25 bp, Mus musculus
gaacaagctgacctatctgggatca

SEQ ID NO: 27120 - DNA, 25 bp, Mus musculus
gaacaaggacccagaggtgatcgtg

SEQ ID NO: 27121 - DNA, 25 bp, Mus musculus
gaacaaggatcagcaggtagcctgg

SEQ ID NO: 27122 - DNA, 25 bp, Mus musculus
gaacaaggccctgcagagcatggct

SEQ ID NO: 27123 - DNA, 25 bp, Mus musculus
gaacaaggcgtgtatggactaccca

SEQ ID NO: 27124 - DNA, 25 bp, Mus musculus
gaacaaggctacgataggccttatg

SEQ ID NO: 27125 - DNA, 25 bp, Mus musculus
gaacaaggctagacttcaccatgtg

SEQ ID NO: 27126 - DNA, 25 bp, Mus musculus
gaacaagggactgatatgggacaca

SEQ ID NO: 27127 - DNA, 25 bp, Mus musculus
gaacaaggtcagcactaagaggcct

SEQ ID NO: 27128 - DNA, 25 bp, Mus musculus
gaacaagtaatcacggcaacagcaa

SEQ ID NO: 27129 - DNA, 25 bp, Mus musculus
gaacaagtacctccctcatgacaac

SEQ ID NO: 27130 - DNA, 25 bp, Mus musculus
gaacaagtagctgctgtccgggaag

SEQ ID NO: 27131 - DNA, 25 bp, Mus musculus
gaacaagtgataaaagaaatcaacc

SEQ ID NO: 27132 - DNA, 25 bp, Mus musculus
gaacaagtgatataagaaatcaacc

SEQ ID NO: 27133 - DNA, 25 bp, Mus musculus
gaacaagtggtcaaccaagcccctc

SEQ ID NO: 27134 - DNA, 25 bp, Mus musculus
gaacaagttcctggcccgttatgta

SEQ ID NO: 27135 - DNA, 25 bp, Mus musculus
gaacaagttgaaggcaatgtcttcc

SEQ ID NO: 27136 - DNA, 25 bp, Mus musculus
gaacaagttgatctggagacaagtg

SEQ ID NO: 27137 - DNA, 25 bp, Mus musculus
gaacaataaaaggacttcagccaca

SEQ ID NO: 27138 - DNA, 25 bp, Mus musculus
gaacaatatgcaagccgaggttaca

SEQ ID NO: 27139 - DNA, 25 bp, Mus musculus
gaacaatccctggaccctagtaggg

SEQ ID NO: 27140 - DNA, 25 bp, Mus musculus
gaacaatctccaggaagatctcttt

SEQ ID NO: 27141 - DNA, 25 bp, Mus musculus
gaacaatgaggtcccttttcttcct

SEQ ID NO: 27142 - DNA, 25 bp, Mus musculus
gaacaatgccgctgtggtccatgga

SEQ ID NO: 27143 - DNA, 25 bp, Mus musculus
gaacaatggcccaagtagcagtgac

SEQ ID NO: 27144 - DNA, 25 bp, Mus musculus
gaacaattaccagccctactaaagg

SEQ ID NO: 27145 - DNA, 25 bp, Mus musculus
gaacaattggatttcatgatggaga

SEQ ID NO: 27146 - DNA, 25 bp, Mus musculus
gaacaatttgcagctacatccacac

SEQ ID NO: 27147 - DNA, 25 bp, Mus musculus
gaacacaacttcgtctacaggcctg

SEQ ID NO: 27148 - DNA, 25 bp, Mus musculus
gaacacaagacgacctgggacccta

SEQ ID NO: 27149 - DNA, 25 bp, Mus musculus
gaacacaatggctacccttctgaag

SEQ ID NO: 27150 - DNA, 25 bp, Mus musculus
gaacacactgcactcaagggcaagt

SEQ ID NO: 27151 - DNA, 25 bp, Mus musculus
gaacacagaaggctccttccattgc

SEQ ID NO: 27152 - DNA, 25 bp, Mus musculus
gaacacagaagggtccttccattgc

SEQ ID NO: 27153 - DNA, 25 bp, Mus musculus
gaacacagattcacaaacgtcacgg

SEQ ID NO: 27154 - DNA, 25 bp, Mus musculus
gaacacaggtggactttagaggccg

SEQ ID NO: 27155 - DNA, 25 bp, Mus musculus
gaacacagtggccatcagcagaaga

SEQ ID NO: 27156 - DNA, 25 bp, Mus musculus
gaacacatatctagcctcatcaaac

SEQ ID NO: 27157 - DNA, 25 bp, Mus musculus
gaacacatcgagaacttgagtggct

SEQ ID NO: 27158 - DNA, 25 bp, Mus musculus
gaacacattgcctgcctcaggaatg

SEQ ID NO: 27159 - DNA, 25 bp, Mus musculus
gaacacatttcgcttgcgcacagag

SEQ ID NO: 27160 - DNA, 25 bp, Mus musculus
gaacaccaaaaacctgctatacatt

SEQ ID NO: 27161 - DNA, 25 bp, Mus musculus
gaacaccaagcgagattgcaaaaag

SEQ ID NO: 27162 - DNA, 25 bp, Mus musculus
gaacaccacggcaagtagctgctcg

SEQ ID NO: 27163 - DNA, 25 bp, Mus musculus
gaacaccagactgataagagtgcag

SEQ ID NO: 27164 - DNA, 25 bp, Mus musculus
gaacacccaaggcaaaagtatacaa

SEQ ID NO: 27165 - DNA, 25 bp, Mus musculus
gaacaccctcatcatctacctagaa

SEQ ID NO: 27166 - DNA, 25 bp, Mus musculus
gaacaccctcatgtttcatttgtga

SEQ ID NO: 27167 - DNA, 25 bp, Mus musculus
gaacaccctctgtccaatgacagca

SEQ ID NO: 27168 - DNA, 25 bp, Mus musculus
gaacaccgggaaactggagaccagc

SEQ ID NO: 27169 - DNA, 25 bp, Mus musculus
gaacacctcactgggaaacattgcc

SEQ ID NO: 27170 - DNA, 25 bp, Mus musculus
gaacacctggtttagagccaaatgg

SEQ ID NO: 27171 - DNA, 25 bp, Mus musculus
gaacactaaagcaggcctgtgatct

SEQ ID NO: 27172 - DNA, 25 bp, Mus musculus
gaacactggatagaactcagaacag

SEQ ID NO: 27173 - DNA, 25 bp, Mus musculus
gaacactggattggccatgagaact

SEQ ID NO: 27174 - DNA, 25 bp, Mus musculus
gaacactgggatgacacctgtgccc

SEQ ID NO: 27175 - DNA, 25 bp, Mus musculus
gaacactggtagaaagccagccctg

SEQ ID NO: 27176 - DNA, 25 bp, Mus musculus
gaacactggtagtaagccagccctg

SEQ ID NO: 27177 - DNA, 25 bp, Mus musculus
gaacactgtaatgctcagaagggcc

SEQ ID NO: 27178 - DNA, 25 bp, Mus musculus
gaacactgttcttcaccggcaggag

SEQ ID NO: 27179 - DNA, 25 bp, Mus musculus
gaacacttgacctggtggaaacacc

SEQ ID NO: 27180 - DNA, 25 bp, Mus musculus
gaacacttgttcagttatcacgacc

SEQ ID NO: 27181 - DNA, 25 bp, Mus musculus
gaacactttcatcgtgctgtcagtg

SEQ ID NO: 27182 - DNA, 25 bp, Mus musculus
gaacagaaaaattcaacgccaagat

SEQ ID NO: 27183 - DNA, 25 bp, Mus musculus
gaacagaaaagatttatcccacagc

SEQ ID NO: 27184 - DNA, 25 bp, Mus musculus
gaacagaaagacagatacagttgct

SEQ ID NO: 27185 - DNA, 25 bp, Mus musculus
gaacagaaataggaaagacactggc

SEQ ID NO: 27186 - DNA, 25 bp, Mus musculus
gaacagaaatgaagctcctgggtga

SEQ ID NO: 27187 - DNA, 25 bp, Mus musculus
gaacagaacaaaatgctggctaggg

SEQ ID NO: 27188 - DNA, 25 bp, Mus musculus
gaacagaacgacatattatcaaaag

SEQ ID NO: 27189 - DNA, 25 bp, Mus musculus
gaacagaagcgtagctcttcaaaga

SEQ ID NO: 27190 - DNA, 25 bp, Mus musculus
gaacagaagctcctacgcaagggac

SEQ ID NO: 27191 - DNA, 25 bp, Mus musculus
gaacagaaggcggaacacatgacta

SEQ ID NO: 27192 - DNA, 25 bp, Mus musculus
gaacagaagttctgaggttaatgca

SEQ ID NO: 27193 - DNA, 25 bp, Mus musculus
gaacagaagttgtctggatctggag

SEQ ID NO: 27194 - DNA, 25 bp, Mus musculus
gaacagacaagtcttagaagccagt

SEQ ID NO: 27195 - DNA, 25 bp, Mus musculus
gaacagacaccttctgagagcagag

SEQ ID NO: 27196 - DNA, 25 bp, Mus musculus
gaacagacctaatgcccgcaatgcc

SEQ ID NO: 27197 - DNA, 25 bp, Mus musculus
gaacagacctatcacccagcttgaa

SEQ ID NO: 27198 - DNA, 25 bp, Mus musculus
gaacagacctttggcttggagtcga

SEQ ID NO: 27199 - DNA, 25 bp, Mus musculus
gaacagacgccaaggatctcacctg

SEQ ID NO: 27200 - DNA, 25 bp, Mus musculus
gaacagactctggaagctattgcag

SEQ ID NO: 27201 - DNA, 25 bp, Mus musculus
gaacagacttaaaagataagcaggg

SEQ ID NO: 27202 - DNA, 25 bp, Mus musculus
gaacagagaacctgtacagttggaa

SEQ ID NO: 27203 - DNA, 25 bp, Mus musculus
gaacagagaggagacaaagcaagtc

SEQ ID NO: 27204 - DNA, 25 bp, Mus musculus
gaacagagccttccaggtgctaatg

SEQ ID NO: 27205 - DNA, 25 bp, Mus musculus
gaacagagtcgaggcgctttctccc

SEQ ID NO: 27206 - DNA, 25 bp, Mus musculus
gaacagagtctgtcattcaccgggc

SEQ ID NO: 27207 - DNA, 25 bp, Mus musculus
gaacagagtgctgagaccacacaga

SEQ ID NO: 27208 - DNA, 25 bp, Mus musculus
gaacagatactgaataaaatggata

SEQ ID NO: 27209 - DNA, 25 bp, Mus musculus
gaacagatagcacaccaagctgtgg

SEQ ID NO: 27210 - DNA, 25 bp, Mus musculus
gaacagatataaggacatactgcca

SEQ ID NO: 27211 - DNA, 25 bp, Mus musculus
gaacagatcagtggaggacaggaat

SEQ ID NO: 27212 - DNA, 25 bp, Mus musculus
gaacagatggcttccccagatcaca

SEQ ID NO: 27213 - DNA, 25 bp, Mus musculus
gaacagatggcttttgacccaagca

SEQ ID NO: 27214 - DNA, 25 bp, Mus musculus
gaacagatggtatccagatgcctta

SEQ ID NO: 27215 - DNA, 25 bp, Mus musculus
gaacagatgtctggcagtaccatca

SEQ ID NO: 27216 - DNA, 25 bp, Mus musculus
gaacagattataccattctctcggc

SEQ ID NO: 27217 - DNA, 25 bp, Mus musculus
gaacagcaaatcaacagtgcagtgg

SEQ ID NO: 27218 - DNA, 25 bp, Mus musculus
gaacagcaaccacacaggctacgat

SEQ ID NO: 27219 - DNA, 25 bp, Mus musculus
gaacagcacatcttcgtggaatgag

SEQ ID NO: 27220 - DNA, 25 bp, Mus musculus
gaacagcagactctgtccattgcaa

SEQ ID NO: 27221 - DNA, 25 bp, Mus musculus
gaacagcagctgaactcatggctgg

SEQ ID NO: 27222 - DNA, 25 bp, Mus musculus
gaacagcagtatattctttacacaa

SEQ ID NO: 27223 - DNA, 25 bp, Mus musculus
gaacagcctcctgggaacacatcaa

SEQ ID NO: 27224 - DNA, 25 bp, Mus musculus
gaacagccttcatgaaaaatcagtt

SEQ ID NO: 27225 - DNA, 25 bp, Mus musculus
gaacagctagttcagctacttcttg

SEQ ID NO: 27226 - DNA, 25 bp, Mus musculus
gaacagctgactcattagtagagag

SEQ ID NO: 27227 - DNA, 25 bp, Mus musculus
gaacagcttaatcaggcaaaccagt

SEQ ID NO: 27228 - DNA, 25 bp, Mus musculus
gaacagcttcagagacagtttaagt

SEQ ID NO: 27229 - DNA, 25 bp, Mus musculus
gaacaggaaacgagtgatgctgacc

SEQ ID NO: 27230 - DNA, 25 bp, Mus musculus
gaacaggaaatgaaaaaggattggc

SEQ ID NO: 27231 - DNA, 25 bp, Mus musculus
gaacaggaagccagccaacgagctc

SEQ ID NO: 27232 - DNA, 25 bp, Mus musculus
gaacaggaatcaggcatttggaatg

SEQ ID NO: 27233 - DNA, 25 bp, Mus musculus
gaacaggactggcttgcactttggt

SEQ ID NO: 27234 - DNA, 25 bp, Mus musculus
gaacaggagaaagtccggcctgtga

SEQ ID NO: 27235 - DNA, 25 bp, Mus musculus
gaacaggagtcgagcccttgagcaa

SEQ ID NO: 27236 - DNA, 25 bp, Mus musculus
gaacaggcggctactcaggtggaaa

SEQ ID NO: 27237 - DNA, 25 bp, Mus musculus
gaacaggctccatcaggtgcaaagg

SEQ ID NO: 27238 - DNA, 25 bp, Mus musculus
gaacagggatgaactacatgaaagt

SEQ ID NO: 27239 - DNA, 25 bp, Mus musculus
gaacagggcagttcaggcattgaga

SEQ ID NO: 27240 - DNA, 25 bp, Mus musculus
gaacagggggcaccaagctctttgc

SEQ ID NO: 27241 - DNA, 25 bp, Mus musculus
gaacaggtagtgtccgtgcggctct

SEQ ID NO: 27242 - DNA, 25 bp, Mus musculus
gaacaggtgggcaactccccggaga

SEQ ID NO: 27243 - DNA, 25 bp, Mus musculus
gaacaggttcctgtatgtaggcggt

SEQ ID NO: 27244 - DNA, 25 bp, Mus musculus
gaacagtacactggaaagctccgaa

SEQ ID NO: 27245 - DNA, 25 bp, Mus musculus
gaacagtagagtaccctcctctgga

SEQ ID NO: 27246 - DNA, 25 bp, Mus musculus
gaacagtagagttccctcctctgga

SEQ ID NO: 27247 - DNA, 25 bp, Mus musculus
gaacagtatcgaggaacggcgcatc

SEQ ID NO: 27248 - DNA, 25 bp, Mus musculus
gaacagtatgcagtgtaagagcaga

SEQ ID NO: 27249 - DNA, 25 bp, Mus musculus
gaacagtcagcaaaaccattggtcc

SEQ ID NO: 27250 - DNA, 25 bp, Mus musculus
gaacagtcagcaagggagcaagaca

SEQ ID NO: 27251 - DNA, 25 bp, Mus musculus
gaacagtcttcaagagagccttgat

SEQ ID NO: 27252 - DNA, 25 bp, Mus musculus
gaacagtcttcatttgtgatacaca

SEQ ID NO: 27253 - DNA, 25 bp, Mus musculus
gaacagtgcaaccatttgcaagcca

SEQ ID NO: 27254 - DNA, 25 bp, Mus musculus
gaacagtgcaacgatttgcaagcca

SEQ ID NO: 27255 - DNA, 25 bp, Mus musculus
gaacagttaactggaagaccaaaca

SEQ ID NO: 27256 - DNA, 25 bp, Mus musculus
gaacagttacaaaaagtccatttca

SEQ ID NO: 27257 - DNA, 25 bp, Mus musculus
gaacagttccagagacttgcaaatg

SEQ ID NO: 27258 - DNA, 25 bp, Mus musculus
gaacagttgtcatggaagtcaggcc

SEQ ID NO: 27259 - DNA, 25 bp, Mus musculus
gaacagtttccactccagaaagtcc

SEQ ID NO: 27260 - DNA, 25 bp, Mus musculus
gaacagtttctcaaggtgaatggat

SEQ ID NO: 27261 - DNA, 25 bp, Mus musculus
gaacagtttgcttccagcctccctt

SEQ ID NO: 27262 - DNA, 25 bp, Mus musculus
gaacataatttcacacgtcccaatg

SEQ ID NO: 27263 - DNA, 25 bp, Mus musculus
gaacatacagcagcgacacatagtc

SEQ ID NO: 27264 - DNA, 25 bp, Mus musculus
gaacatacttctgcggtacctgcac

SEQ ID NO: 27265 - DNA, 25 bp, Mus musculus
gaacatatgacctgattccagcctt

SEQ ID NO: 27266 - DNA, 25 bp, Mus musculus
gaacatcaaaatcccaatgaaacca

SEQ ID NO: 27267 - DNA, 25 bp, Mus musculus
gaacatcaacagagaccaaaaggat

SEQ ID NO: 27268 - DNA, 25 bp, Mus musculus
gaacatcaccttgggtccgaaatcc

SEQ ID NO: 27269 - DNA, 25 bp, Mus musculus
gaacatcagaactacgcctaaacat

SEQ ID NO: 27270 - DNA, 25 bp, Mus musculus
gaacatcaggactgtatgtccttta

SEQ ID NO: 27271 - DNA, 25 bp, Mus musculus
gaacatcatcccattgagaacccca

SEQ ID NO: 27272 - DNA, 25 bp, Mus musculus
gaacatcctggatagtgaccaccgt

SEQ ID NO: 27273 - DNA, 25 bp, Mus musculus
gaacatccttcgcagtgtggctgtc

SEQ ID NO: 27274 - DNA, 25 bp, Mus musculus
gaacatcggctcatcgacgacatgg

SEQ ID NO: 27275 - DNA, 25 bp, Mus musculus
gaacatcgtctcctgaaaacttcca

SEQ ID NO: 27276 - DNA, 25 bp, Mus musculus
gaacatctacagacaaaggagagcc

SEQ ID NO: 27277 - DNA, 25 bp, Mus musculus
gaacatctcggcagacaatgaagct

SEQ ID NO: 27278 - DNA, 25 bp, Mus musculus
gaacatctgagtaaccttttcctta

SEQ ID NO: 27279 - DNA, 25 bp, Mus musculus
gaacatctgtgtttgatcgccttgg

SEQ ID NO: 27280 - DNA, 25 bp, Mus musculus
gaacatcttattaaacagactgact

SEQ ID NO: 27281 - DNA, 25 bp, Mus musculus
gaacatgaagtacccctctcttgga

SEQ ID NO: 27282 - DNA, 25 bp, Mus musculus
gaacatgaagtagccctctcttgga

SEQ ID NO: 27283 - DNA, 25 bp, Mus musculus
gaacatgacattctctagtagctga

SEQ ID NO: 27284 - DNA, 25 bp, Mus musculus
gaacatgacttatggaacctctcct

SEQ ID NO: 27285 - DNA, 25 bp, Mus musculus
gaacatgagcagctcaaggcccgat

SEQ ID NO: 27286 - DNA, 25 bp, Mus musculus
gaacatgattggcatgacaccaaca

SEQ ID NO: 27287 - DNA, 25 bp, Mus musculus
gaacatgcaagccatccttgatgca

SEQ ID NO: 27288 - DNA, 25 bp, Mus musculus
gaacatgccgcataaatgaaatcag

SEQ ID NO: 27289 - DNA, 25 bp, Mus musculus
gaacatggatttttgcagagaagca

SEQ ID NO: 27290 - DNA, 25 bp, Mus musculus
gaacatgtatgctgtgcagacgctg

SEQ ID NO: 27291 - DNA, 25 bp, Mus musculus
gaacatgtgcaacattgacgtcacc

SEQ ID NO: 27292 - DNA, 25 bp, Mus musculus
gaacatgtgtaactgaaggctggct

SEQ ID NO: 27293 - DNA, 25 bp, Mus musculus
gaacattaccaggaagtgcacactg

SEQ ID NO: 27294 - DNA, 25 bp, Mus musculus
gaacattagaagagtagaaaatgcg

SEQ ID NO: 27295 - DNA, 25 bp, Mus musculus
gaacattctgtcatacttggacgcc

SEQ ID NO: 27296 - DNA, 25 bp, Mus musculus
gaacattgaccttcctgactgcaga

SEQ ID NO: 27297 - DNA, 25 bp, Mus musculus
gaacattgtgtaggcggaactcgag

SEQ ID NO: 27298 - DNA, 25 bp, Mus musculus
gaacatttacacatatccgtgcatt

SEQ ID NO: 27299 - DNA, 25 bp, Mus musculus
gaacatttacgcttcggtcatcgct

SEQ ID NO: 27300 - DNA, 25 bp, Mus musculus
gaacatttcagaacaaggctagact

SEQ ID NO: 27301 - DNA, 25 bp, Mus musculus
gaacatttgctttctccgagggcaa

SEQ ID NO: 27302 - DNA, 25 bp, Mus musculus
gaacattttagagcatctcgagcaa

SEQ ID NO: 27303 - DNA, 25 bp, Mus musculus
gaacattttaggagcgtttctggaa

SEQ ID NO: 27304 - DNA, 25 bp, Mus musculus
gaaccaaagactttggacatgccag

SEQ ID NO: 27305 - DNA, 25 bp, Mus musculus
gaaccaaagtatgagaacccgacta

SEQ ID NO: 27306 - DNA, 25 bp, Mus musculus
gaaccaaatggaatggcttctgagg

SEQ ID NO: 27307 - DNA, 25 bp, Mus musculus
gaaccaagggacatcggacttctta

SEQ ID NO: 27308 - DNA, 25 bp, Mus musculus
gaaccaagggacttcggacttctta

SEQ ID NO: 27309 - DNA, 25 bp, Mus musculus
gaaccaatatcaaacaagagtgata

SEQ ID NO: 27310 - DNA, 25 bp, Mus musculus
gaaccaatctcttccggagtcccag

SEQ ID NO: 27311 - DNA, 25 bp, Mus musculus
gaaccaatggtcagaaacgaaaaag

SEQ ID NO: 27312 - DNA, 25 bp, Mus musculus
gaaccacaaaactgccacctgattg

SEQ ID NO: 27313 - DNA, 25 bp, Mus musculus
gaaccacaagggtttatgaatattc

SEQ ID NO: 27314 - DNA, 25 bp, Mus musculus
gaaccacagaatgagataatccacc

SEQ ID NO: 27315 - DNA, 25 bp, Mus musculus
gaaccacatcctccaaacagactga

SEQ ID NO: 27316 - DNA, 25 bp, Mus musculus
gaaccaccaatggagattgctgccg

SEQ ID NO: 27317 - DNA, 25 bp, Mus musculus
gaaccacccatcaggtgcacttagt

SEQ ID NO: 27318 - DNA, 25 bp, Mus musculus
gaaccacctggaagtcgtcaggtta

SEQ ID NO: 27319 - DNA, 25 bp, Mus musculus
gaaccacgagggtcatgaagatgat

SEQ ID NO: 27320 - DNA, 25 bp, Mus musculus
gaaccacggcccagcgagtgggaca

SEQ ID NO: 27321 - DNA, 25 bp, Mus musculus
gaaccactcgctggagatgactctg

SEQ ID NO: 27322 - DNA, 25 bp, Mus musculus
gaaccactcgtagagtcagaggaca

SEQ ID NO: 27323 - DNA, 25 bp, Mus musculus
gaaccacttaggaagcatctagagg

SEQ ID NO: 27324 - DNA, 25 bp, Mus musculus
gaaccagaacgctcagggggacaag

SEQ ID NO: 27325 - DNA, 25 bp, Mus musculus
gaaccagactgctgtgagagaagag

SEQ ID NO: 27326 - DNA, 25 bp, Mus musculus
gaaccagagtccagcgattgtccaa

SEQ ID NO: 27327 - DNA, 25 bp, Mus musculus
gaaccagagtctgagaaagatgatg

SEQ ID NO: 27328 - DNA, 25 bp, Mus musculus
gaaccagagtgactggtatcttgga

SEQ ID NO: 27329 - DNA, 25 bp, Mus musculus
gaaccagagtgagtggtatcttgga

SEQ ID NO: 27330 - DNA, 25 bp, Mus musculus
gaaccagagtttgccatgccagcat

SEQ ID NO: 27331 - DNA, 25 bp, Mus musculus
gaaccagatgcaatatctcagccca

SEQ ID NO: 27332 - DNA, 25 bp, Mus musculus
gaaccagcacacgtttgaggctcgg

SEQ ID NO: 27333 - DNA, 25 bp, Mus musculus
gaaccagcctacagatgactcatgc

SEQ ID NO: 27334 - DNA, 25 bp, Mus musculus
gaaccagcggcagaaccgcaagtgt

SEQ ID NO: 27335 - DNA, 25 bp, Mus musculus
gaaccagctgcagatccaggaggag

SEQ ID NO: 27336 - DNA, 25 bp, Mus musculus
gaaccaggagcaaccatgaaacttg

SEQ ID NO: 27337 - DNA, 25 bp, Mus musculus
gaaccaggatatccggctgctgcag

SEQ ID NO: 27338 - DNA, 25 bp, Mus musculus
gaaccagggtcggagacctccgatg

SEQ ID NO: 27339 - DNA, 25 bp, Mus musculus
gaaccagggtgtctgtgtccgcttt

SEQ ID NO: 27340 - DNA, 25 bp, Mus musculus
gaaccagggtgtgtgtgtccgcttt

SEQ ID NO: 27341 - DNA, 25 bp, Mus musculus
gaaccataggccctggcctgccttg

SEQ ID NO: 27342 - DNA, 25 bp, Mus musculus
gaaccatcagcgttggagtagatgc

SEQ ID NO: 27343 - DNA, 25 bp, Mus musculus
gaaccatctgctcctcaatggacaa

SEQ ID NO: 27344 - DNA, 25 bp, Mus musculus
gaaccatgacttctgctgaggtgaa

SEQ ID NO: 27345 - DNA, 25 bp, Mus musculus
gaaccatgagctgtacatgcgccgc

SEQ ID NO: 27346 - DNA, 25 bp, Mus musculus
gaaccatgccggatctcctactact

SEQ ID NO: 27347 - DNA, 25 bp, Mus musculus
gaaccatggaggagtgtatgcagaa

SEQ ID NO: 27348 - DNA, 25 bp, Mus musculus
gaaccatggcttaatcaaatcatgc

SEQ ID NO: 27349 - DNA, 25 bp, Mus musculus
gaaccatttgtaaccctggacctcg

SEQ ID NO: 27350 - DNA, 25 bp, Mus musculus
gaacccaactcaattaacatcacag

SEQ ID NO: 27351 - DNA, 25 bp, Mus musculus
gaacccaactcatttaacatcacag

SEQ ID NO: 27352 - DNA, 25 bp, Mus musculus
gaacccaactgtagcagcaagaacc

SEQ ID NO: 27353 - DNA, 25 bp, Mus musculus
gaacccaaggatgacaatttgccca

SEQ ID NO: 27354 - DNA, 25 bp, Mus musculus
gaacccaagttttacagcagccaca

SEQ ID NO: 27355 - DNA, 25 bp, Mus musculus
gaacccaatggcctgcagagtctga

SEQ ID NO: 27356 - DNA, 25 bp, Mus musculus
gaacccaatttttcctgcccgcatt

SEQ ID NO: 27357 - DNA, 25 bp, Mus musculus
gaacccacacatgaggaggacctca

SEQ ID NO: 27358 - DNA, 25 bp, Mus musculus
gaacccacacatgttttcggaagga

SEQ ID NO: 27359 - DNA, 25 bp, Mus musculus
gaacccagaagtgaagagcagacga

SEQ ID NO: 27360 - DNA, 25 bp, Mus musculus
gaacccagataatgacacacgtcca

SEQ ID NO: 27361 - DNA, 25 bp, Mus musculus
gaacccagatctgcacaacgcagag

SEQ ID NO: 27362 - DNA, 25 bp, Mus musculus
gaacccagcggtggcatttccagaa

SEQ ID NO: 27363 - DNA, 25 bp, Mus musculus
gaacccagctcaagctgatgggcct

SEQ ID NO: 27364 - DNA, 25 bp, Mus musculus
gaacccagctcatgctgatgggcct

SEQ ID NO: 27365 - DNA, 25 bp, Mus musculus
gaacccagtccctgttcttgaccag

SEQ ID NO: 27366 - DNA, 25 bp, Mus musculus
gaacccagtgacaatggacctcttt

SEQ ID NO: 27367 - DNA, 25 bp, Mus musculus
gaacccagtgtccagcaagaattgc

SEQ ID NO: 27368 - DNA, 25 bp, Mus musculus
gaacccagtgtcgagcaagaattgc

SEQ ID NO: 27369 - DNA, 25 bp, Mus musculus
gaacccatgtcttcttgttgatgca

SEQ ID NO: 27370 - DNA, 25 bp, Mus musculus
gaaccccagtctagaactgagatag

SEQ ID NO: 27371 - DNA, 25 bp, Mus musculus
gaaccccattgccttagattttcag

SEQ ID NO: 27372 - DNA, 25 bp, Mus musculus
gaaccccgccgcagtgtttcacagt

SEQ ID NO: 27373 - DNA, 25 bp, Mus musculus
gaaccccggcaatgccatctactat

SEQ ID NO: 27374 - DNA, 25 bp, Mus musculus
gaaccccgtcttgtaaaggtgacag

SEQ ID NO: 27375 - DNA, 25 bp, Mus musculus
gaacccctggtcatggataacctgg

SEQ ID NO: 27376 - DNA, 25 bp, Mus musculus
gaacccgaggttctggatatttgac

SEQ ID NO: 27377 - DNA, 25 bp, Mus musculus
gaacccgatcttcaacgagactctg

SEQ ID NO: 27378 - DNA, 25 bp, Mus musculus
gaacccggaaagacatgccaggaaa

SEQ ID NO: 27379 - DNA, 25 bp, Mus musculus
gaacccggataataaagaatttgct

SEQ ID NO: 27380 - DNA, 25 bp, Mus musculus
gaacccggatgatggagatattttt

SEQ ID NO: 27381 - DNA, 25 bp, Mus musculus
gaacccgggaggagcacccatacag

SEQ ID NO: 27382 - DNA, 25 bp, Mus musculus
gaaccctactactttgaagactgtg

SEQ ID NO: 27383 - DNA, 25 bp, Mus musculus
gaaccctctgctaaaactgtcttcg

SEQ ID NO: 27384 - DNA, 25 bp, Mus musculus
gaaccctgacccagaatgagatggt

SEQ ID NO: 27385 - DNA, 25 bp, Mus musculus
gaaccctgctatctgctgagaaaca

SEQ ID NO: 27386 - DNA, 25 bp, Mus musculus
gaaccctgtccacatcagctgtcca

SEQ ID NO: 27387 - DNA, 25 bp, Mus musculus
gaaccctgtgtgataaaaggaagag

SEQ ID NO: 27388 - DNA, 25 bp, Mus musculus
gaaccgaaatggatggaacgtggaa

SEQ ID NO: 27389 - DNA, 25 bp, Mus musculus
gaaccgaagcaccaagaggaagacc

SEQ ID NO: 27390 - DNA, 25 bp, Mus musculus
gaaccgaatgcacaagtgtcaagac

SEQ ID NO: 27391 - DNA, 25 bp, Mus musculus
gaaccgaatttctccaatgctctcc

SEQ ID NO: 27392 - DNA, 25 bp, Mus musculus
gaaccgactcatcatgaactaccta

SEQ ID NO: 27393 - DNA, 25 bp, Mus musculus
gaaccgagaggagccttccagatac

SEQ ID NO: 27394 - DNA, 25 bp, Mus musculus
gaaccgagtacttctgcctggctga

SEQ ID NO: 27395 - DNA, 25 bp, Mus musculus
gaaccgcatccgagtaatggaactc

SEQ ID NO: 27396 - DNA, 25 bp, Mus musculus
gaaccgcgtgctcatgtccaacatg

SEQ ID NO: 27397 - DNA, 25 bp, Mus musculus
gaaccgctgatgcttaagatcccca

SEQ ID NO: 27398 - DNA, 25 bp, Mus musculus
gaaccgctgttttagagacaagcac

SEQ ID NO: 27399 - DNA, 25 bp, Mus musculus
gaaccggatctactcgactcccttt

SEQ ID NO: 27400 - DNA, 25 bp, Mus musculus
gaaccggatggcttttattatctgg

SEQ ID NO: 27401 - DNA, 25 bp, Mus musculus
gaaccggtcctatgagcgtttggga

SEQ ID NO: 27402 - DNA, 25 bp, Mus musculus
gaaccggtctgtctatgcattgccc

SEQ ID NO: 27403 - DNA, 25 bp, Mus musculus
gaaccggttgctggcatcgctggaa

SEQ ID NO: 27404 - DNA, 25 bp, Mus musculus
gaaccgtcctgctctctagctctga

SEQ ID NO: 27405 - DNA, 25 bp, Mus musculus
gaaccgtgactaccgggatgcacag

SEQ ID NO: 27406 - DNA, 25 bp, Mus musculus
gaaccgtgatgcctttcatatagtt

SEQ ID NO: 27407 - DNA, 25 bp, Mus musculus
gaacctaacactgaggaaggtggaa

SEQ ID NO: 27408 - DNA, 25 bp, Mus musculus
gaacctaacctttctggcagtgcag

SEQ ID NO: 27409 - DNA, 25 bp, Mus musculus
gaacctacgcgcagatctgtcgcct

SEQ ID NO: 27410 - DNA, 25 bp, Mus musculus
gaacctactatcattcgaagagcct

SEQ ID NO: 27411 - DNA, 25 bp, Mus musculus
gaacctacttcagctgtacatctgc

SEQ ID NO: 27412 - DNA, 25 bp, Mus musculus
gaacctagaagattctgcaaataaa

SEQ ID NO: 27413 - DNA, 25 bp, Mus musculus
gaacctagaagctgtcctgaactcc

SEQ ID NO: 27414 - DNA, 25 bp, Mus musculus
gaacctagtagctcacaaggacatt

SEQ ID NO: 27415 - DNA, 25 bp, Mus musculus
gaacctcaatgatgtcctggtcagc

SEQ ID NO: 27416 - DNA, 25 bp, Mus musculus
gaacctcaccgacaaaatcaagaaa

SEQ ID NO: 27417 - DNA, 25 bp, Mus musculus
gaacctcaccgagaaaatcaagaaa

SEQ ID NO: 27418 - DNA, 25 bp, Mus musculus
gaacctcatcgccacagtgttcgtg

SEQ ID NO: 27419 - DNA, 25 bp, Mus musculus
gaacctcattagtgccccactggtc

SEQ ID NO: 27420 - DNA, 25 bp, Mus musculus
gaacctccatgagccagaaagaggc

SEQ ID NO: 27421 - DNA, 25 bp, Mus musculus
gaacctcctggtggatgtcttctct

SEQ ID NO: 27422 - DNA, 25 bp, Mus musculus
gaacctcgacgtctatgaacagcaa

SEQ ID NO: 27423 - DNA, 25 bp, Mus musculus
gaacctcgcacaccaggagctgatt

SEQ ID NO: 27424 - DNA, 25 bp, Mus musculus
gaacctctcagtcaacagccactgg

SEQ ID NO: 27425 - DNA, 25 bp, Mus musculus
gaacctgaagaagacctcccagtcg

SEQ ID NO: 27426 - DNA, 25 bp, Mus musculus
gaacctgaagcaccagccaggaggt

SEQ ID NO: 27427 - DNA, 25 bp, Mus musculus
gaacctgaggccttcatttgtgttt

SEQ ID NO: 27428 - DNA, 25 bp, Mus musculus
gaacctgatgcagaccctcatggaa

SEQ ID NO: 27429 - DNA, 25 bp, Mus musculus
gaacctgcagagaccatacacagtg

SEQ ID NO: 27430 - DNA, 25 bp, Mus musculus
gaacctgcagttccactcaatgccg

SEQ ID NO: 27431 - DNA, 25 bp, Mus musculus
gaacctgccaggtactgagtgaaga

SEQ ID NO: 27432 - DNA, 25 bp, Mus musculus
gaacctgcctcttcttggtggcgtg

SEQ ID NO: 27433 - DNA, 25 bp, Mus musculus
gaacctgcgtttagatttattgttg

SEQ ID NO: 27434 - DNA, 25 bp, Mus musculus
gaacctgctaagaatcggcctggcc

SEQ ID NO: 27435 - DNA, 25 bp, Mus musculus
gaacctgctcagtgtatccaacaca

SEQ ID NO: 27436 - DNA, 25 bp, Mus musculus
gaacctggaaaggattctctctgtg

SEQ ID NO: 27437 - DNA, 25 bp, Mus musculus
gaacctggctcaccggccgaggtct

SEQ ID NO: 27438 - DNA, 25 bp, Mus musculus
gaacctgggcaacacctgctacatg

SEQ ID NO: 27439 - DNA, 25 bp, Mus musculus
gaacctgtacagttggaaacattga

SEQ ID NO: 27440 - DNA, 25 bp, Mus musculus
gaacctgtctaggagctggcatgat

SEQ ID NO: 27441 - DNA, 25 bp, Mus musculus
gaacctgtcttttgattcgagcaca

SEQ ID NO: 27442 - DNA, 25 bp, Mus musculus
gaacctgtgatttctcatcaagtta

SEQ ID NO: 27443 - DNA, 25 bp, Mus musculus
gaacctgttcttcctgtttcctgcc

SEQ ID NO: 27444 - DNA, 25 bp, Mus musculus
gaacctgttggcctcaattactcca

SEQ ID NO: 27445 - DNA, 25 bp, Mus musculus
gaacctgtttgaacagttccagaga

SEQ ID NO: 27446 - DNA, 25 bp, Mus musculus
gaacctgttttcctgtctgtctgac

SEQ ID NO: 27447 - DNA, 25 bp, Mus musculus
gaaccttacagcactcgcccgtggg

SEQ ID NO: 27448 - DNA, 25 bp, Mus musculus
gaaccttacccaggcagttaaagag

SEQ ID NO: 27449 - DNA, 25 bp, Mus musculus
gaaccttcagaaagaagatggctcc

SEQ ID NO: 27450 - DNA, 25 bp, Mus musculus
gaaccttcagaacataatttacagg

SEQ ID NO: 27451 - DNA, 25 bp, Mus musculus
gaaccttcgcgagagccctagactg

SEQ ID NO: 27452 - DNA, 25 bp, Mus musculus
gaaccttctctgacaagttgtgaga

SEQ ID NO: 27453 - DNA, 25 bp, Mus musculus
gaaccttctgaaacagtattcccag

SEQ ID NO: 27454 - DNA, 25 bp, Mus musculus
gaaccttctgaagagcctaatcggc

SEQ ID NO: 27455 - DNA, 25 bp, Mus musculus
gaaccttctgcggaagatgcgggta

SEQ ID NO: 27456 - DNA, 25 bp, Mus musculus
gaaccttctgggatttccttctttg

SEQ ID NO: 27457 - DNA, 25 bp, Mus musculus
gaaccttgcctacataggtgccgta

SEQ ID NO: 27458 - DNA, 25 bp, Mus musculus
gaaccttgggtattgggagcatgca

SEQ ID NO: 27459 - DNA, 25 bp, Mus musculus
gaacctttggtgtacatgaggaaag

SEQ ID NO: 27460 - DNA, 25 bp, Mus musculus
gaacgaaaacatgaaaaaccaacag

SEQ ID NO: 27461 - DNA, 25 bp, Mus musculus
gaacgaaatgtttcgggagtcgcag

SEQ ID NO: 27462 - DNA, 25 bp, Mus musculus
gaacgaagagctctagaaagaagaa

SEQ ID NO: 27463 - DNA, 25 bp, Mus musculus
gaacgaagatgacctctctttcaag

SEQ ID NO: 27464 - DNA, 25 bp, Mus musculus
gaacgaagatgagctctctttcaag

SEQ ID NO: 27465 - DNA, 25 bp, Mus musculus
gaacgaagttcttcgtcaccagctt

SEQ ID NO: 27466 - DNA, 25 bp, Mus musculus
gaacgacacagtgtacttcactcta

SEQ ID NO: 27467 - DNA, 25 bp, Mus musculus
gaacgacagtatcacctgcggctct

SEQ ID NO: 27468 - DNA, 25 bp, Mus musculus
gaacgacagtatgacctgcggctct

SEQ ID NO: 27469 - DNA, 25 bp, Mus musculus
gaacgacatcgccatcatcaagttg

SEQ ID NO: 27470 - DNA, 25 bp, Mus musculus
gaacgacctggcctgttccacattc

SEQ ID NO: 27471 - DNA, 25 bp, Mus musculus
gaacgacgactgtcataccgtgcac

SEQ ID NO: 27472 - DNA, 25 bp, Mus musculus
gaacgacgaggctaatcgggccaaa

SEQ ID NO: 27473 - DNA, 25 bp, Mus musculus
gaacgactccgcaaagagagacaaa

SEQ ID NO: 27474 - DNA, 25 bp, Mus musculus
gaacgagagaagcatttccagaaag

SEQ ID NO: 27475 - DNA, 25 bp, Mus musculus
gaacgagtgagctcttcatgctcgg

SEQ ID NO: 27476 - DNA, 25 bp, Mus musculus
gaacgagtgtgacctcatgatggca

SEQ ID NO: 27477 - DNA, 25 bp, Mus musculus
gaacgagtgtgagctcatgatggca

SEQ ID NO: 27478 - DNA, 25 bp, Mus musculus
gaacgagttagtacaactcgagaaa

SEQ ID NO: 27479 - DNA, 25 bp, Mus musculus
gaacgagttcaagtacttccaaaga

SEQ ID NO: 27480 - DNA, 25 bp, Mus musculus
gaacgatgaagatctcctgcttcga

SEQ ID NO: 27481 - DNA, 25 bp, Mus musculus
gaacgatggagacacacttcagggt

SEQ ID NO: 27482 - DNA, 25 bp, Mus musculus
gaacgattcctttggtggtggctct

SEQ ID NO: 27483 - DNA, 25 bp, Mus musculus
gaacgattctcaagggctgggaaat

SEQ ID NO: 27484 - DNA, 25 bp, Mus musculus
gaacgattttgagcaggacttacca

SEQ ID NO: 27485 - DNA, 25 bp, Mus musculus
gaacgcacgtgctaacagcagcata

SEQ ID NO: 27486 - DNA, 25 bp, Mus musculus
gaacgccccgaagtactgtttacag

SEQ ID NO: 27487 - DNA, 25 bp, Mus musculus
gaacgcccggcatatctgctatttt

SEQ ID NO: 27488 - DNA, 25 bp, Mus musculus
gaacgcctgtacagagagatcagtg

SEQ ID NO: 27489 - DNA, 25 bp, Mus musculus
gaacgccttggaccttttcagacac

SEQ ID NO: 27490 - DNA, 25 bp, Mus musculus
gaacgctccctctttcttcgctttg

SEQ ID NO: 27491 - DNA, 25 bp, Mus musculus
gaacgctggaaagaggcaaatttag

SEQ ID NO: 27492 - DNA, 25 bp, Mus musculus
gaacgctggcagtggcctggatccc

SEQ ID NO: 27493 - DNA, 25 bp, Mus musculus
gaacgcttacgcagaatccatgcgg

SEQ ID NO: 27494 - DNA, 25 bp, Mus musculus
gaacgcttttaagaaatgcagatca

SEQ ID NO: 27495 - DNA, 25 bp, Mus musculus
gaacggaaactagaagcattgccac

SEQ ID NO: 27496 - DNA, 25 bp, Mus musculus
gaacggacactctttgaagtctctc

SEQ ID NO: 27497 - DNA, 25 bp, Mus musculus
gaacggacctcaggcttcacctagt

SEQ ID NO: 27498 - DNA, 25 bp, Mus musculus
gaacggactgcccacatctcagggc

SEQ ID NO: 27499 - DNA, 25 bp, Mus musculus
gaacggagtaacgagtctcacacag

SEQ ID NO: 27500 - DNA, 25 bp, Mus musculus
gaacggagtcaagcttgggcgccat

SEQ ID NO: 27501 - DNA, 25 bp, Mus musculus
gaacggagtcatcaccgtaacagat

SEQ ID NO: 27502 - DNA, 25 bp, Mus musculus
gaacggatagacaagcgggctctag

SEQ ID NO: 27503 - DNA, 25 bp, Mus musculus
gaacggatttccaaagcctttgctg

SEQ ID NO: 27504 - DNA, 25 bp, Mus musculus
gaacggcacgtcctttgacatccac

SEQ ID NO: 27505 - DNA, 25 bp, Mus musculus
gaacggcccttttgcatgtatgacg

SEQ ID NO: 27506 - DNA, 25 bp, Mus musculus
gaacggctgcagtacacctatgagg

SEQ ID NO: 27507 - DNA, 25 bp, Mus musculus
gaacggctggagtttgtcaatggct

SEQ ID NO: 27508 - DNA, 25 bp, Mus musculus
gaacgggattttccaacagaaactg

SEQ ID NO: 27509 - DNA, 25 bp, Mus musculus
gaacgggcagttgggagccttccca

SEQ ID NO: 27510 - DNA, 25 bp, Mus musculus
gaacgggcatgtttaaggaactctg

SEQ ID NO: 27511 - DNA, 25 bp, Mus musculus
gaacgggtgatcaacgaggagtaca

SEQ ID NO: 27512 - DNA, 25 bp, Mus musculus
gaacggtgtggacctcctaatgaag

SEQ ID NO: 27513 - DNA, 25 bp, Mus musculus
gaacgtcattccatctgtcccgata

SEQ ID NO: 27514 - DNA, 25 bp, Mus musculus
gaacgtcctttgcttttctgcggca

SEQ ID NO: 27515 - DNA, 25 bp, Mus musculus
gaacgtcctttggttttctgcggca

SEQ ID NO: 27516 - DNA, 25 bp, Mus musculus
gaacgtcgaagacgctttcatgcag

SEQ ID NO: 27517 - DNA, 25 bp, Mus musculus
gaacgtcgaagaggctttcatgcag

SEQ ID NO: 27518 - DNA, 25 bp, Mus musculus
gaacgtgaagagcacaactgtagca

SEQ ID NO: 27519 - DNA, 25 bp, Mus musculus
gaacgtggtggtagtaaccattcaa

SEQ ID NO: 27520 - DNA, 25 bp, Mus musculus
gaacgtggttcgcttcaccgggtct

SEQ ID NO: 27521 - DNA, 25 bp, Mus musculus
gaacgtgttccggtcgagtactggt

SEQ ID NO: 27522 - DNA, 25 bp, Mus musculus
gaacgttgcttgactgcctgccata

SEQ ID NO: 27523 - DNA, 25 bp, Mus musculus
gaacgtttccgtagcctcattccca

SEQ ID NO: 27524 - DNA, 25 bp, Mus musculus
gaacgtttgaagataattgcagagc

SEQ ID NO: 27525 - DNA, 25 bp, Mus musculus
gaacgtttgcggcatgtcatccctg

SEQ ID NO: 27526 - DNA, 25 bp, Mus musculus
gaactaaaaatccaactcctcataa

SEQ ID NO: 27527 - DNA, 25 bp, Mus musculus
gaactaaataaacgccttcatacca

SEQ ID NO: 27528 - DNA, 25 bp, Mus musculus
gaactaaatagcgatgtctctggaa

SEQ ID NO: 27529 - DNA, 25 bp, Mus musculus
gaactaaatgcctttgaagaatcaa

SEQ ID NO: 27530 - DNA, 25 bp, Mus musculus
gaactaaatggacttgctgtcaaac

SEQ ID NO: 27531 - DNA, 25 bp, Mus musculus
gaactaatgcttggtggcactgact

SEQ ID NO: 27532 - DNA, 25 bp, Mus musculus
gaactacattgagagcttcctgcca

SEQ ID NO: 27533 - DNA, 25 bp, Mus musculus
gaactaccagagagaaggaaaccag

SEQ ID NO: 27534 - DNA, 25 bp, Mus musculus
gaactaccagagtgaaggaaaccag

SEQ ID NO: 27535 - DNA, 25 bp, Mus musculus
gaactaccttaacgtcatcatggca

SEQ ID NO: 27536 - DNA, 25 bp, Mus musculus
gaactaccttatacagatggcgcgg

SEQ ID NO: 27537 - DNA, 25 bp, Mus musculus
gaactaccttattcagatggcgcgg

SEQ ID NO: 27538 - DNA, 25 bp, Mus musculus
gaactacggagtcacattccccatc

SEQ ID NO: 27539 - DNA, 25 bp, Mus musculus
gaactactcactacattaatttcag

SEQ ID NO: 27540 - DNA, 25 bp, Mus musculus
gaactactcacttcattaatttcag

SEQ ID NO: 27541 - DNA, 25 bp, Mus musculus
gaactactccttaaacttttgcctg

SEQ ID NO: 27542 - DNA, 25 bp, Mus musculus
gaactacttcggcaaaaccagaggg

SEQ ID NO: 27543 - DNA, 25 bp, Mus musculus
gaactactttgaacacaagcacaat

SEQ ID NO: 27544 - DNA, 25 bp, Mus musculus
gaactagaaaaatggatcccagagc

SEQ ID NO: 27545 - DNA, 25 bp, Mus musculus
gaactagattgcttaataaaaggaa

SEQ ID NO: 27546 - DNA, 25 bp, Mus musculus
gaactagcctcctatgatatgcagc

SEQ ID NO: 27547 - DNA, 25 bp, Mus musculus
gaactagttcaggatctagctcgaa

SEQ ID NO: 27548 - DNA, 25 bp, Mus musculus
gaactagttccctagaagacctttg

SEQ ID NO: 27549 - DNA, 25 bp, Mus musculus
gaactatacccagcatctggactgg

SEQ ID NO: 27550 - DNA, 25 bp, Mus musculus
gaactatcccctcaagatttattaa

SEQ ID NO: 27551 - DNA, 25 bp, Mus musculus
gaactatcctgaggacgtactggtg

SEQ ID NO: 27552 - DNA, 25 bp, Mus musculus
gaactatggcttctacggctgctac

SEQ ID NO: 27553 - DNA, 25 bp, Mus musculus
gaactatgtgagaagctccacgccc

SEQ ID NO: 27554 - DNA, 25 bp, Mus musculus
gaactcaaatcttcgacaagagcta

SEQ ID NO: 27555 - DNA, 25 bp, Mus musculus
gaactcaactgatgctctctgggat

SEQ ID NO: 27556 - DNA, 25 bp, Mus musculus
gaactcaacttgaggatctgggatg

SEQ ID NO: 27557 - DNA, 25 bp, Mus musculus
gaactcaacttgtggatctgggatg

SEQ ID NO: 27558 - DNA, 25 bp, Mus musculus
gaactcaatatgtgcctcttgccca

SEQ ID NO: 27559 - DNA, 25 bp, Mus musculus
gaactcacaccttttgatatgagca

SEQ ID NO: 27560 - DNA, 25 bp, Mus musculus
gaactcactgccacccgtaagaatg

SEQ ID NO: 27561 - DNA, 25 bp, Mus musculus
gaactcagaaccacagaaaacggag

SEQ ID NO: 27562 - DNA, 25 bp, Mus musculus
gaactcagagacattcaagcttcta

SEQ ID NO: 27563 - DNA, 25 bp, Mus musculus
gaactcagagggtagctcacacaca

SEQ ID NO: 27564 - DNA, 25 bp, Mus musculus
gaactcagcatttagaccgggttgt

SEQ ID NO: 27565 - DNA, 25 bp, Mus musculus
gaactcagccaccttcaagtcattt

SEQ ID NO: 27566 - DNA, 25 bp, Mus musculus
gaactcagcgagatcaccctgcctg

SEQ ID NO: 27567 - DNA, 25 bp, Mus musculus
gaactcagctgacctgctcaagggc

SEQ ID NO: 27568 - DNA, 25 bp, Mus musculus
gaactcaggaatctgctcaactgct

SEQ ID NO: 27569 - DNA, 25 bp, Mus musculus
gaactcagggagtgtctgagtcttc

SEQ ID NO: 27570 - DNA, 25 bp, Mus musculus
gaactcagtggctcctccatgattc

SEQ ID NO: 27571 - DNA, 25 bp, Mus musculus
gaactcatacctaggtacacgtgtg

SEQ ID NO: 27572 - DNA, 25 bp, Mus musculus
gaactcatctgaaaaactgccacag

SEQ ID NO: 27573 - DNA, 25 bp, Mus musculus
gaactcattcatcatccggtgcgca

SEQ ID NO: 27574 - DNA, 25 bp, Mus musculus
gaactcattcatctctcacagttga

SEQ ID NO: 27575 - DNA, 25 bp, Mus musculus
gaactccaagattccctcctgttgc

SEQ ID NO: 27576 - DNA, 25 bp, Mus musculus
gaactccaagctgaacagaagcaaa

SEQ ID NO: 27577 - DNA, 25 bp, Mus musculus
gaactccagataattggcacctacg

SEQ ID NO: 27578 - DNA, 25 bp, Mus musculus
gaactccagctttgaggccatcaac

SEQ ID NO: 27579 - DNA, 25 bp, Mus musculus
gaactccataaacggctaagccagg

SEQ ID NO: 27580 - DNA, 25 bp, Mus musculus
gaactccctccagctttaatgcaaa

SEQ ID NO: 27581 - DNA, 25 bp, Mus musculus
gaactccctggataagatcatagaa

SEQ ID NO: 27582 - DNA, 25 bp, Mus musculus
gaactccgaagggaaatcaagaggc

SEQ ID NO: 27583 - DNA, 25 bp, Mus musculus
gaactccgaggctgacttagagctg

SEQ ID NO: 27584 - DNA, 25 bp, Mus musculus
gaactccgcagaaaccaaggaaagc

SEQ ID NO: 27585 - DNA, 25 bp, Mus musculus
gaactcctgtccgtggtgattgccg

SEQ ID NO: 27586 - DNA, 25 bp, Mus musculus
gaactcctgttcttcacttcccggg

SEQ ID NO: 27587 - DNA, 25 bp, Mus musculus
gaactcgagtttgaacaaaagctct

SEQ ID NO: 27588 - DNA, 25 bp, Mus musculus
gaactcggaagctgagcagagcctt

SEQ ID NO: 27589 - DNA, 25 bp, Mus musculus
gaactcggagagtaacaagaggaag

SEQ ID NO: 27590 - DNA, 25 bp, Mus musculus
gaactctaaacacgaggcaacagaa

SEQ ID NO: 27591 - DNA, 25 bp, Mus musculus
gaactctatggaataagccgcggaa

SEQ ID NO: 27592 - DNA, 25 bp, Mus musculus
gaactctctcgagcccagaatgact

SEQ ID NO: 27593 - DNA, 25 bp, Mus musculus
gaactctgggactgctgttgcctat

SEQ ID NO: 27594 - DNA, 25 bp, Mus musculus
gaactcttcaggcacatatggaaga

SEQ ID NO: 27595 - DNA, 25 bp, Mus musculus
gaactcttcctagatgttctggaga

SEQ ID NO: 27596 - DNA, 25 bp, Mus musculus
gaactctttagaaaaacattaggag

SEQ ID NO: 27597 - DNA, 25 bp, Mus musculus
gaactctttagataaacattaggag

SEQ ID NO: 27598 - DNA, 25 bp, Mus musculus
gaactgaaagacctgctacaaactg

SEQ ID NO: 27599 - DNA, 25 bp, Mus musculus
gaactgaagacgctgcagactcaga

SEQ ID NO: 27600 - DNA, 25 bp, Mus musculus
gaactgaagtaagtaagagctctga

SEQ ID NO: 27601 - DNA, 25 bp, Mus musculus
gaactgaagtgatcgataatacttt

SEQ ID NO: 27602 - DNA, 25 bp, Mus musculus
gaactgaagttctaggcgcctgtga

SEQ ID NO: 27603 - DNA, 25 bp, Mus musculus
gaactgaattcaactacttcacaga

SEQ ID NO: 27604 - DNA, 25 bp, Mus musculus
gaactgacaagataactgttcctgc

SEQ ID NO: 27605 - DNA, 25 bp, Mus musculus
gaactgacagagctcaaatacctcc

SEQ ID NO: 27606 - DNA, 25 bp, Mus musculus
gaactgaccaatgatagcctgaccc

SEQ ID NO: 27607 - DNA, 25 bp, Mus musculus
gaactgacccagttgaaggctggcg

SEQ ID NO: 27608 - DNA, 25 bp, Mus musculus
gaactgacgtttgtggctggtcaag

SEQ ID NO: 27609 - DNA, 25 bp, Mus musculus
gaactgactccgagtaggaggaccc

SEQ ID NO: 27610 - DNA, 25 bp, Mus musculus
gaactgactccgtgtaggaggaccc

SEQ ID NO: 27611 - DNA, 25 bp, Mus musculus
gaactgactgattacagagggatcc

SEQ ID NO: 27612 - DNA, 25 bp, Mus musculus
gaactgactgcagatcccataggaa

SEQ ID NO: 27613 - DNA, 25 bp, Mus musculus
gaactgagcacaacagagaatgccc

SEQ ID NO: 27614 - DNA, 25 bp, Mus musculus
gaactgagtctgtctgcatgatgca

SEQ ID NO: 27615 - DNA, 25 bp, Mus musculus
gaactgataatgagcaagtaccgag

SEQ ID NO: 27616 - DNA, 25 bp, Mus musculus
gaactgatgtacatcaacgaggtag

SEQ ID NO: 27617 - DNA, 25 bp, Mus musculus
gaactgcaatccctttcttaaagtg

SEQ ID NO: 27618 - DNA, 25 bp, Mus musculus
gaactgccagtttgccgacgtgaaa

SEQ ID NO: 27619 - DNA, 25 bp, Mus musculus
gaactgcctcgtcatgtatgtcatc

SEQ ID NO: 27620 - DNA, 25 bp, Mus musculus
gaactgcgacgtgtgcgggttatcc

SEQ ID NO: 27621 - DNA, 25 bp, Mus musculus
gaactgcgagaagcatgtgattacc

SEQ ID NO: 27622 - DNA, 25 bp, Mus musculus
gaactgcggagtgtcatgaatactt

SEQ ID NO: 27623 - DNA, 25 bp, Mus musculus
gaactgctaaaagtatggaaaggac

SEQ ID NO: 27624 - DNA, 25 bp, Mus musculus
gaactgctgcactatttaatcggca

SEQ ID NO: 27625 - DNA, 25 bp, Mus musculus
gaactgcttcatgcaacagtcacag

SEQ ID NO: 27626 - DNA, 25 bp, Mus musculus
gaactggaaaaagaactcctgtccg

SEQ ID NO: 27627 - DNA, 25 bp, Mus musculus
gaactggaaacttcgagcgctctgc

SEQ ID NO: 27628 - DNA, 25 bp, Mus musculus
gaactggaaccctggcactttcttg

SEQ ID NO: 27629 - DNA, 25 bp, Mus musculus
gaactggaagaatgagataagtcct

SEQ ID NO: 27630 - DNA, 25 bp, Mus musculus
gaactggacagggaacgacagaaac

SEQ ID NO: 27631 - DNA, 25 bp, Mus musculus
gaactggagctgtccgaggccagca

SEQ ID NO: 27632 - DNA, 25 bp, Mus musculus
gaactggagtcatgctgctgtaaag

SEQ ID NO: 27633 - DNA, 25 bp, Mus musculus
gaactgggaaagacctcgatcccaa

SEQ ID NO: 27634 - DNA, 25 bp, Mus musculus
gaactgggactttgtgtgcggactc

SEQ ID NO: 27635 - DNA, 25 bp, Mus musculus
gaactgggagctaataaaatgctac

SEQ ID NO: 27636 - DNA, 25 bp, Mus musculus
gaactgggagtccactaagtttgaa

SEQ ID NO: 27637 - DNA, 25 bp, Mus musculus
gaactgggcaaggtcaagaaggaac

SEQ ID NO: 27638 - DNA, 25 bp, Mus musculus
gaactgggcatcaagtacattggga

SEQ ID NO: 27639 - DNA, 25 bp, Mus musculus
gaactggtccgtcattgaaaaccca

SEQ ID NO: 27640 - DNA, 25 bp, Mus musculus
gaactggtccgtgattgaaaaccca

SEQ ID NO: 27641 - DNA, 25 bp, Mus musculus
gaactggtgagcagactactccatt

SEQ ID NO: 27642 - DNA, 25 bp, Mus musculus
gaactggtgcagaaccatgctgacc

SEQ ID NO: 27643 - DNA, 25 bp, Mus musculus
gaactggtgtacagccagccggaga

SEQ ID NO: 27644 - DNA, 25 bp, Mus musculus
gaactggtgtccttaccagaagtcc

SEQ ID NO: 27645 - DNA, 25 bp, Mus musculus
gaactggttctctagaccatgctag

SEQ ID NO: 27646 - DNA, 25 bp, Mus musculus
gaactgtactctctgagagatgaga

SEQ ID NO: 27647 - DNA, 25 bp, Mus musculus
gaactgtactgagtggctttgcagg

SEQ ID NO: 27648 - DNA, 25 bp, Mus musculus
gaactgtatgaagacagccagctca

SEQ ID NO: 27649 - DNA, 25 bp, Mus musculus
gaactgtatgcagagccccatcaga

SEQ ID NO: 27650 - DNA, 25 bp, Mus musculus
gaactgtcagaacaaacacaattac

SEQ ID NO: 27651 - DNA, 25 bp, Mus musculus
gaactgtcatcatgtagtagccaga

SEQ ID NO: 27652 - DNA, 25 bp, Mus musculus
gaactgtccctaccgcgctcgagtg

SEQ ID NO: 27653 - DNA, 25 bp, Mus musculus
gaactgtctaacacggactggtatt

SEQ ID NO: 27654 - DNA, 25 bp, Mus musculus
gaactgtctcggttggtcagtgagc

SEQ ID NO: 27655 - DNA, 25 bp, Mus musculus
gaactgtggacaaacagagacacct

SEQ ID NO: 27656 - DNA, 25 bp, Mus musculus
gaactgtgggaatgtatgatttgcc

SEQ ID NO: 27657 - DNA, 25 bp, Mus musculus
gaactgttaacagatcgggtgaacc

SEQ ID NO: 27658 - DNA, 25 bp, Mus musculus
gaactgttcaggtctccctgccaca

SEQ ID NO: 27659 - DNA, 25 bp, Mus musculus
gaacttaatccctgccggtgctaca

SEQ ID NO: 27660 - DNA, 25 bp, Mus musculus
gaacttaattgaacagcttgaacaa

SEQ ID NO: 27661 - DNA, 25 bp, Mus musculus
gaacttaccacttgacatcactttg

SEQ ID NO: 27662 - DNA, 25 bp, Mus musculus
gaacttaccagtcatggataatcaa

SEQ ID NO: 27663 - DNA, 25 bp, Mus musculus
gaacttacccttgagtgtgacaccc

SEQ ID NO: 27664 - DNA, 25 bp, Mus musculus
gaacttacctcagaagaaagcaaaa

SEQ ID NO: 27665 - DNA, 25 bp, Mus musculus
gaacttactatttcctacctcagct

SEQ ID NO: 27666 - DNA, 25 bp, Mus musculus
gaacttagcaggacttgatgccgtt

SEQ ID NO: 27667 - DNA, 25 bp, Mus musculus
gaacttaggcaaaacgtataacatt

SEQ ID NO: 27668 - DNA, 25 bp, Mus musculus
gaacttagttcgtgtacattttggg

SEQ ID NO: 27669 - DNA, 25 bp, Mus musculus
gaacttattttgtagtccttgcttg

SEQ ID NO: 27670 - DNA, 25 bp, Mus musculus
gaacttcagacaaccatttcctctc

SEQ ID NO: 27671 - DNA, 25 bp, Mus musculus
gaacttcagatccactgggaggccc

SEQ ID NO: 27672 - DNA, 25 bp, Mus musculus
gaacttcagcaaacagaccatcgcg

SEQ ID NO: 27673 - DNA, 25 bp, Mus musculus
gaacttcagcctcactatctagcca

SEQ ID NO: 27674 - DNA, 25 bp, Mus musculus
gaacttcagcctgactatctagcca

SEQ ID NO: 27675 - DNA, 25 bp, Mus musculus
gaacttcaggaggtgcagatcaccg

SEQ ID NO: 27676 - DNA, 25 bp, Mus musculus
gaacttcatgaggtatcgtgcgccc

SEQ ID NO: 27677 - DNA, 25 bp, Mus musculus
gaacttccacaggagttacgagagc

SEQ ID NO: 27678 - DNA, 25 bp, Mus musculus
gaacttccataaatactctgtggcg

SEQ ID NO: 27679 - DNA, 25 bp, Mus musculus
gaacttccggaccttcttagaactg

SEQ ID NO: 27680 - DNA, 25 bp, Mus musculus
gaacttcctcaactcagacttgctg

SEQ ID NO: 27681 - DNA, 25 bp, Mus musculus
gaacttcctgtatacgtgggtacaa

SEQ ID NO: 27682 - DNA, 25 bp, Mus musculus
gaacttcgattggactgataggaga

SEQ ID NO: 27683 - DNA, 25 bp, Mus musculus
gaacttctagataaccaatggttga

SEQ ID NO: 27684 - DNA, 25 bp, Mus musculus
gaacttctcaggaggcacctctttg

SEQ ID NO: 27685 - DNA, 25 bp, Mus musculus
gaacttctgagaggagatgcacaca

SEQ ID NO: 27686 - DNA, 25 bp, Mus musculus
gaacttctgcagctaagaacagagg

SEQ ID NO: 27687 - DNA, 25 bp, Mus musculus
gaacttgaaacagagatatccagtc

SEQ ID NO: 27688 - DNA, 25 bp, Mus musculus
gaacttgaaaggtgctctggagtct

SEQ ID NO: 27689 - DNA, 25 bp, Mus musculus
gaacttgaagcgtctcaaagacaac

SEQ ID NO: 27690 - DNA, 25 bp, Mus musculus
gaacttgacctttctgaacttgatg

SEQ ID NO: 27691 - DNA, 25 bp, Mus musculus
gaacttgagatgtagatgaagcccc

SEQ ID NO: 27692 - DNA, 25 bp, Mus musculus
gaacttgagttctattatgatatcc

SEQ ID NO: 27693 - DNA, 25 bp, Mus musculus
gaacttgatttcttacgtggtgacc

SEQ ID NO: 27694 - DNA, 25 bp, Mus musculus
gaacttgcaactgtttgccgggact

SEQ ID NO: 27695 - DNA, 25 bp, Mus musculus
gaacttgcatcaagatcaggcctga

SEQ ID NO: 27696 - DNA, 25 bp, Mus musculus
gaacttgcggcaattagtgaaagaa

SEQ ID NO: 27697 - DNA, 25 bp, Mus musculus
gaacttgctctggttcaaaccaaga

SEQ ID NO: 27698 - DNA, 25 bp, Mus musculus
gaacttgggtcctccgtgagagcaa

SEQ ID NO: 27699 - DNA, 25 bp, Mus musculus
gaacttgtacacatgactgagtcag

SEQ ID NO: 27700 - DNA, 25 bp, Mus musculus
gaacttgtacacttgactgagtcag

SEQ ID NO: 27701 - DNA, 25 bp, Mus musculus
gaacttgtaccacgagctgatgaag

SEQ ID NO: 27702 - DNA, 25 bp, Mus musculus
gaacttgttgggtttgccatcgcca

SEQ ID NO: 27703 - DNA, 25 bp, Mus musculus
gaactttacaggcagtgccctgaaa

SEQ ID NO: 27704 - DNA, 25 bp, Mus musculus
gaactttccaatctccgatgtctgt

SEQ ID NO: 27705 - DNA, 25 bp, Mus musculus
gaactttccaatgtccgatgtctgt

SEQ ID NO: 27706 - DNA, 25 bp, Mus musculus
gaactttccgagtagtggcctctgc

SEQ ID NO: 27707 - DNA, 25 bp, Mus musculus
gaactttctccaagaacgtttgaag

SEQ ID NO: 27708 - DNA, 25 bp, Mus musculus
gaactttgacatctcagttgattcc

SEQ ID NO: 27709 - DNA, 25 bp, Mus musculus
gaactttgtcaagtggcttcaggaa

SEQ ID NO: 27710 - DNA, 25 bp, Mus musculus
gaactttgttgcctttgaagtgtgt

SEQ ID NO: 27711 - DNA, 25 bp, Mus musculus
gaacttttgcatctggaaagacgag

SEQ ID NO: 27712 - DNA, 25 bp, Mus musculus
gaagaaaaaactccagaacagatta

SEQ ID NO: 27713 - DNA, 25 bp, Mus musculus
gaagaaaaacctaaccagtgaccag

SEQ ID NO: 27714 - DNA, 25 bp, Mus musculus
gaagaaaacggctcaaagatgaggg

SEQ ID NO: 27715 - DNA, 25 bp, Mus musculus
gaagaaaagaatgggttcgcctggt

SEQ ID NO: 27716 - DNA, 25 bp, Mus musculus
gaagaaaagacctgccaaatggaga

SEQ ID NO: 27717 - DNA, 25 bp, Mus musculus
gaagaaaagatggagattcaggaga

SEQ ID NO: 27718 - DNA, 25 bp, Mus musculus
gaagaaaagcccctccttactgtga

SEQ ID NO: 27719 - DNA, 25 bp, Mus musculus
gaagaaaagggcattgagctggcct

SEQ ID NO: 27720 - DNA, 25 bp, Mus musculus
gaagaaaagtgacttcagattttcc

SEQ ID NO: 27721 - DNA, 25 bp, Mus musculus
gaagaaaatagtggcatcgtcacat

SEQ ID NO: 27722 - DNA, 25 bp, Mus musculus
gaagaaaatgtgaatgagcacagtg

SEQ ID NO: 27723 - DNA, 25 bp, Mus musculus
gaagaaaatgtggaagagccctaac

SEQ ID NO: 27724 - DNA, 25 bp, Mus musculus
gaagaaacaacacaggattccaaca

SEQ ID NO: 27725 - DNA, 25 bp, Mus musculus
gaagaaacagttaccagatgttcag

SEQ ID NO: 27726 - DNA, 25 bp, Mus musculus
gaagaaacagtttccagatgttcag

SEQ ID NO: 27727 - DNA, 25 bp, Mus musculus
gaagaaacctggctgatgaaagcag

SEQ ID NO: 27728 - DNA, 25 bp, Mus musculus
gaagaaacgactaaaaagctccaag

SEQ ID NO: 27729 - DNA, 25 bp, Mus musculus
gaagaaactccacacagcaacacca

SEQ ID NO: 27730 - DNA, 25 bp, Mus musculus
gaagaaactgctgtacaaagaagtt

SEQ ID NO: 27731 - DNA, 25 bp, Mus musculus
gaagaaagaaaacgcagaattgagc

SEQ ID NO: 27732 - DNA, 25 bp, Mus musculus
gaagaaagaagattcattccagaga

SEQ ID NO: 27733 - DNA, 25 bp, Mus musculus
gaagaaagagctaaaagctcgaaca

SEQ ID NO: 27734 - DNA, 25 bp, Mus musculus
gaagaaagaggacaccacctttgat

SEQ ID NO: 27735 - DNA, 25 bp, Mus musculus
gaagaaagatggtattccaggtgca

SEQ ID NO: 27736 - DNA, 25 bp, Mus musculus
gaagaaagccaagtacgatagcctg

SEQ ID NO: 27737 - DNA, 25 bp, Mus musculus
gaagaaagctgcagtgaggcaagaa

SEQ ID NO: 27738 - DNA, 25 bp, Mus musculus
gaagaaagctggatacagtaaacgg

SEQ ID NO: 27739 - DNA, 25 bp, Mus musculus
gaagaaaggctatgacctgcgtgtc

SEQ ID NO: 27740 - DNA, 25 bp, Mus musculus
gaagaaagggctgaaaaaagtcagg

SEQ ID NO: 27741 - DNA, 25 bp, Mus musculus
gaagaaagtaacgtgaaagactcca

SEQ ID NO: 27742 - DNA, 25 bp, Mus musculus
gaagaaagtaagaaaggtgcctcct

SEQ ID NO: 27743 - DNA, 25 bp, Mus musculus
gaagaaagtcatctctaccagcaga

SEQ ID NO: 27744 - DNA, 25 bp, Mus musculus
gaagaaatacctggccgcagccttc

SEQ ID NO: 27745 - DNA, 25 bp, Mus musculus
gaagaaatagccaactatgaagatg

SEQ ID NO: 27746 - DNA, 25 bp, Mus musculus
gaagaaatgaaagatgcctactatc

SEQ ID NO: 27747 - DNA, 25 bp, Mus musculus
gaagaaatgccagatgtagaaattg

SEQ ID NO: 27748 - DNA, 25 bp, Mus musculus
gaagaaatggaagacacagtctctg

SEQ ID NO: 27749 - DNA, 25 bp, Mus musculus
gaagaaatggacaagaaagtacact

SEQ ID NO: 27750 - DNA, 25 bp, Mus musculus
gaagaaatggttagccctgggatta

SEQ ID NO: 27751 - DNA, 25 bp, Mus musculus
gaagaaattacaacatcttgagttg

SEQ ID NO: 27752 - DNA, 25 bp, Mus musculus
gaagaaattgcacccaacatttccc

SEQ ID NO: 27753 - DNA, 25 bp, Mus musculus
gaagaaattgtcactctgcgccagg

SEQ ID NO: 27754 - DNA, 25 bp, Mus musculus
gaagaacaagttcaggtccaagaaa

SEQ ID NO: 27755 - DNA, 25 bp, Mus musculus
gaagaacacaatggctacccttctg

SEQ ID NO: 27756 - DNA, 25 bp, Mus musculus
gaagaacagactccaattcaaattt

SEQ ID NO: 27757 - DNA, 25 bp, Mus musculus
gaagaacaggaccttggattgacag

SEQ ID NO: 27758 - DNA, 25 bp, Mus musculus
gaagaacagttaagaataatggatc

SEQ ID NO: 27759 - DNA, 25 bp, Mus musculus
gaagaacattcagtggctatcctgc

SEQ ID NO: 27760 - DNA, 25 bp, Mus musculus
gaagaacattttagagcatctcgag

SEQ ID NO: 27761 - DNA, 25 bp, Mus musculus
gaagaaccaaccagcccaaacagaa

SEQ ID NO: 27762 - DNA, 25 bp, Mus musculus
gaagaacccataatcgtcgagaacg

SEQ ID NO: 27763 - DNA, 25 bp, Mus musculus
gaagaacccgagtcaaacacagtag

SEQ ID NO: 27764 - DNA, 25 bp, Mus musculus
gaagaaccctctgctaaaactgtct

SEQ ID NO: 27765 - DNA, 25 bp, Mus musculus
gaagaaccgcaaggatgctgaggaa

SEQ ID NO: 27766 - DNA, 25 bp, Mus musculus
gaagaacctcatgggcaactggaac

SEQ ID NO: 27767 - DNA, 25 bp, Mus musculus
gaagaacctgcagcatgagcgcatt

SEQ ID NO: 27768 - DNA, 25 bp, Mus musculus
gaagaacctggattttgagccactg

SEQ ID NO: 27769 - DNA, 25 bp, Mus musculus
gaagaacgctgtggagctggaactc

SEQ ID NO: 27770 - DNA, 25 bp, Mus musculus
gaagaacgtgtcctccacatgtgct

SEQ ID NO: 27771 - DNA, 25 bp, Mus musculus
gaagaactaaataaacgccttcata

SEQ ID NO: 27772 - DNA, 25 bp, Mus musculus
gaagaactctttaaagcagatacaa

SEQ ID NO: 27773 - DNA, 25 bp, Mus musculus
gaagaactgaaacaagcagagaaag

SEQ ID NO: 27774 - DNA, 25 bp, Mus musculus
gaagaactggcaaagcaggccatag

SEQ ID NO: 27775 - DNA, 25 bp, Mus musculus
gaagaacttcctgattacattatgg

SEQ ID NO: 27776 - DNA, 25 bp, Mus musculus
gaagaacttctttgtaaactacagg

SEQ ID NO: 27777 - DNA, 25 bp, Mus musculus
gaagaacttgaaaggtgctctggag

SEQ ID NO: 27778 - DNA, 25 bp, Mus musculus
gaagaacttggagctcttttagaga

SEQ ID NO: 27779 - DNA, 25 bp, Mus musculus
gaagaagaaattgtcactctgcgcc

SEQ ID NO: 27780 - DNA, 25 bp, Mus musculus
gaagaagaatctgcacggagacggc

SEQ ID NO: 27781 - DNA, 25 bp, Mus musculus
gaagaagacaatcggtcagaagcct

SEQ ID NO: 27782 - DNA, 25 bp, Mus musculus
gaagaagactctgagtccccactac

SEQ ID NO: 27783 - DNA, 25 bp, Mus musculus
gaagaagactgcctgaccttcaaag

SEQ ID NO: 27784 - DNA, 25 bp, Mus musculus
gaagaagatgaagcaagtttgcaat

SEQ ID NO: 27785 - DNA, 25 bp, Mus musculus
gaagaagatgccgtgcctggtctca

SEQ ID NO: 27786 - DNA, 25 bp, Mus musculus
gaagaagattcctttcacaagtttg

SEQ ID NO: 27787 - DNA, 25 bp, Mus musculus
gaagaagcaagaattcagtgacccg

SEQ ID NO: 27788 - DNA, 25 bp, Mus musculus
gaagaagcagtgatccaatgcggaa

SEQ ID NO: 27789 - DNA, 25 bp, Mus musculus
gaagaagcatcctggctaagtggct

SEQ ID NO: 27790 - DNA, 25 bp, Mus musculus
gaagaagccaagcaccatcaggctg

SEQ ID NO: 27791 - DNA, 25 bp, Mus musculus
gaagaagccaccatgtacacaggga

SEQ ID NO: 27792 - DNA, 25 bp, Mus musculus
gaagaagcccaagatccgtaggaag

SEQ ID NO: 27793 - DNA, 25 bp, Mus musculus
gaagaagcgctggaacagtatcgag

SEQ ID NO: 27794 - DNA, 25 bp, Mus musculus
gaagaagctgacagcaagagaggcc

SEQ ID NO: 27795 - DNA, 25 bp, Mus musculus
gaagaagctgattggctgacgagca

SEQ ID NO: 27796 - DNA, 25 bp, Mus musculus
gaagaagctgccctgatgagaaaga

SEQ ID NO: 27797 - DNA, 25 bp, Mus musculus
gaagaaggaaccactgctttcaaaa

SEQ ID NO: 27798 - DNA, 25 bp, Mus musculus
gaagaaggaagagataaagcagaga

SEQ ID NO: 27799 - DNA, 25 bp, Mus musculus
gaagaaggattccttggctgaaccg

SEQ ID NO: 27800 - DNA, 25 bp, Mus musculus
gaagaagggctatgcagacctgtac

SEQ ID NO: 27801 - DNA, 25 bp, Mus musculus
gaagaagggtttcactacctcgtgt

SEQ ID NO: 27802 - DNA, 25 bp, Mus musculus
gaagaaggtgtagagtttctcctga

SEQ ID NO: 27803 - DNA, 25 bp, Mus musculus
gaagaaggtttctccatccaggccc

SEQ ID NO: 27804 - DNA, 25 bp, Mus musculus
gaagaagtcaaaatctctcaaaaga

SEQ ID NO: 27805 - DNA, 25 bp, Mus musculus
gaagaagtgaatgcaatcacacaga

SEQ ID NO: 27806 - DNA, 25 bp, Mus musculus
gaagaagtgagcctcagcaatgctc

SEQ ID NO: 27807 - DNA, 25 bp, Mus musculus
gaagaagtgcctttctgggctgatg

SEQ ID NO: 27808 - DNA, 25 bp, Mus musculus
gaagaagtgcttacaagcaggcatg

SEQ ID NO: 27809 - DNA, 25 bp, Mus musculus
gaagaagtggaatgttctgcgccag

SEQ ID NO: 27810 - DNA, 25 bp, Mus musculus
gaagaagtgtgcagatgggattacc

SEQ ID NO: 27811 - DNA, 25 bp, Mus musculus
gaagaagtttcagtggcctgcaagt

SEQ ID NO: 27812 - DNA, 25 bp, Mus musculus
gaagaagtttggaattggactcaca

SEQ ID NO: 27813 - DNA, 25 bp, Mus musculus
gaagaataactgtcacctgtcatct

SEQ ID NO: 27814 - DNA, 25 bp, Mus musculus
gaagaataagcgtcaggatgtggat

SEQ ID NO: 27815 - DNA, 25 bp, Mus musculus
gaagaatagactgccttctgtccat

SEQ ID NO: 27816 - DNA, 25 bp, Mus musculus
gaagaatatccctgaagggtcccat

SEQ ID NO: 27817 - DNA, 25 bp, Mus musculus
gaagaatatcgaatatgcagcatca

SEQ ID NO: 27818 - DNA, 25 bp, Mus musculus
gaagaatcagggactatttttggaa

SEQ ID NO: 27819 - DNA, 25 bp, Mus musculus
gaagaatcccaaatgatgaagctga

SEQ ID NO: 27820 - DNA, 25 bp, Mus musculus
gaagaatcctgacgatttctctagg

SEQ ID NO: 27821 - DNA, 25 bp, Mus musculus
gaagaatcgaaaggctgtgtaatcc

SEQ ID NO: 27822 - DNA, 25 bp, Mus musculus
gaagaatctattgcaaagattggga

SEQ ID NO: 27823 - DNA, 25 bp, Mus musculus
gaagaatcttagacatctacctgag

SEQ ID NO: 27824 - DNA, 25 bp, Mus musculus
gaagaatcttggatccagaaatgtg

SEQ ID NO: 27825 - DNA, 25 bp, Mus musculus
gaagaatgctagagaattcatggga

SEQ ID NO: 27826 - DNA, 25 bp, Mus musculus
gaagaatgctggaaatgatggcaag

SEQ ID NO: 27827 - DNA, 25 bp, Mus musculus
gaagaatggacagaattgccctggc

SEQ ID NO: 27828 - DNA, 25 bp, Mus musculus
gaagaatggatctctgataaaacca

SEQ ID NO: 27829 - DNA, 25 bp, Mus musculus
gaagaatggcattccttctaacagg

SEQ ID NO: 27830 - DNA, 25 bp, Mus musculus
gaagaatggcctctcccgggattat

SEQ ID NO: 27831 - DNA, 25 bp, Mus musculus
gaagaatggttaaagggaatgacct

SEQ ID NO: 27832 - DNA, 25 bp, Mus musculus
gaagaatgttttaaatggagatgag

SEQ ID NO: 27833 - DNA, 25 bp, Mus musculus
gaagaatgtttttaatggagatgag

SEQ ID NO: 27834 - DNA, 25 bp, Mus musculus
gaagaattcactggaaacagcggaa

SEQ ID NO: 27835 - DNA, 25 bp, Mus musculus
gaagaattcgagagcaactctctga

SEQ ID NO: 27836 - DNA, 25 bp, Mus musculus
gaagaattgattttacctaacagga

SEQ ID NO: 27837 - DNA, 25 bp, Mus musculus
gaagaattgctatgggcatggaaga

SEQ ID NO: 27838 - DNA, 25 bp, Mus musculus
gaagaattgctgctagagatcagtc

SEQ ID NO: 27839 - DNA, 25 bp, Mus musculus
gaagaatttatattagattctcctg

SEQ ID NO: 27840 - DNA, 25 bp, Mus musculus
gaagacaaaagagaacgcagacagt

SEQ ID NO: 27841 - DNA, 25 bp, Mus musculus
gaagacaaaggctaccaaaagctgc

SEQ ID NO: 27842 - DNA, 25 bp, Mus musculus
gaagacaaatccaaatgccattaaa

SEQ ID NO: 27843 - DNA, 25 bp, Mus musculus
gaagacaaatccaaggacaatagtg

SEQ ID NO: 27844 - DNA, 25 bp, Mus musculus
gaagacaaccttgagaaggaggttc

SEQ ID NO: 27845 - DNA, 25 bp, Mus musculus
gaagacaagatgatttgattagttg

SEQ ID NO: 27846 - DNA, 25 bp, Mus musculus
gaagacaaggctggaagaccgagca

SEQ ID NO: 27847 - DNA, 25 bp, Mus musculus
gaagacaatccgtcagtcggatgag

SEQ ID NO: 27848 - DNA, 25 bp, Mus musculus
gaagacaatcggtcagaagcctggt

SEQ ID NO: 27849 - DNA, 25 bp, Mus musculus
gaagacaatctaatgggccagtggg

SEQ ID NO: 27850 - DNA, 25 bp, Mus musculus
gaagacaatctattgggccagtggg

SEQ ID NO: 27851 - DNA, 25 bp, Mus musculus
gaagacaattaacctgcagagcctc

SEQ ID NO: 27852 - DNA, 25 bp, Mus musculus
gaagacacacatctggcagtttcac

SEQ ID NO: 27853 - DNA, 25 bp, Mus musculus
gaagacaccctttctatcatgggaa

SEQ ID NO: 27854 - DNA, 25 bp, Mus musculus
gaagacacggcttctgaggcaggca

SEQ ID NO: 27855 - DNA, 25 bp, Mus musculus
gaagacagaacctgctggatgacct

SEQ ID NO: 27856 - DNA, 25 bp, Mus musculus
gaagacagagaggattgaatacccc

SEQ ID NO: 27857 - DNA, 25 bp, Mus musculus
gaagacagcaacagtcaggacagtg

SEQ ID NO: 27858 - DNA, 25 bp, Mus musculus
gaagacagcacttacacgtatgtca

SEQ ID NO: 27859 - DNA, 25 bp, Mus musculus
gaagacagcatgaacttcactccga

SEQ ID NO: 27860 - DNA, 25 bp, Mus musculus
gaagacagcattaaggactccctgg

SEQ ID NO: 27861 - DNA, 25 bp, Mus musculus
gaagacagcatttaggactccctgg

SEQ ID NO: 27862 - DNA, 25 bp, Mus musculus
gaagacagcgtccttcagccagtcc

SEQ ID NO: 27863 - DNA, 25 bp, Mus musculus
gaagacagcgtttatgtgttcaaag

SEQ ID NO: 27864 - DNA, 25 bp, Mus musculus
gaagacagctcagaagcttcaagtc

SEQ ID NO: 27865 - DNA, 25 bp, Mus musculus
gaagacagctgttaacaactgagaa

SEQ ID NO: 27866 - DNA, 25 bp, Mus musculus
gaagacaggaaagggtgagggtcac

SEQ ID NO: 27867 - DNA, 25 bp, Mus musculus
gaagacagggcctcccgggcagtct

SEQ ID NO: 27868 - DNA, 25 bp, Mus musculus
gaagacaggtggcagctctaagaac

SEQ ID NO: 27869 - DNA, 25 bp, Mus musculus
gaagacagtcaagcttgcgagcact

SEQ ID NO: 27870 - DNA, 25 bp, Mus musculus
gaagacagtcctgtttaacacaaag

SEQ ID NO: 27871 - DNA, 25 bp, Mus musculus
gaagacagtgtttcctcacggcctg

SEQ ID NO: 27872 - DNA, 25 bp, Mus musculus
gaagacataccattatgtgcccgaa

SEQ ID NO: 27873 - DNA, 25 bp, Mus musculus
gaagacatcgttacaaaacagctca

SEQ ID NO: 27874 - DNA, 25 bp, Mus musculus
gaagacatgacagacatatacaact

SEQ ID NO: 27875 - DNA, 25 bp, Mus musculus
gaagacatgccattcttgaagtggt

SEQ ID NO: 27876 - DNA, 25 bp, Mus musculus
gaagacatgctgcaggccctgaaag

SEQ ID NO: 27877 - DNA, 25 bp, Mus musculus
gaagacattctgtggcacaccagag

SEQ ID NO: 27878 - DNA, 25 bp, Mus musculus
gaagacattggcttccgctgtcgcc

SEQ ID NO: 27879 - DNA, 25 bp, Mus musculus
gaagacattggtcgcagtctcctga

SEQ ID NO: 27880 - DNA, 25 bp, Mus musculus
gaagacattgtcacccgaaacccca

SEQ ID NO: 27881 - DNA, 25 bp, Mus musculus
gaagacattgtctcccgaaacccca

SEQ ID NO: 27882 - DNA, 25 bp, Mus musculus
gaagacatttgttctttgttggact

SEQ ID NO: 27883 - DNA, 25 bp, Mus musculus
gaagaccaactagcaaaacatttga

SEQ ID NO: 27884 - DNA, 25 bp, Mus musculus
gaagaccaacttccgctgtgcactc

SEQ ID NO: 27885 - DNA, 25 bp, Mus musculus
gaagaccagcaagtccgggtcctgc

SEQ ID NO: 27886 - DNA, 25 bp, Mus musculus
gaagaccagtgtccaaagttcaggc

SEQ ID NO: 27887 - DNA, 25 bp, Mus musculus
gaagaccatccacctcggctttatg

SEQ ID NO: 27888 - DNA, 25 bp, Mus musculus
gaagaccatcccgatgagtacaaag

SEQ ID NO: 27889 - DNA, 25 bp, Mus musculus
gaagaccatgagctccatctttgcc

SEQ ID NO: 27890 - DNA, 25 bp, Mus musculus
gaagaccatggttttgaacagaagc

SEQ ID NO: 27891 - DNA, 25 bp, Mus musculus
gaagaccattataaaaatccctgga

SEQ ID NO: 27892 - DNA, 25 bp, Mus musculus
gaagacccaactgcaggctggaatg

SEQ ID NO: 27893 - DNA, 25 bp, Mus musculus
gaagacccacgcaaagagcctaaag

SEQ ID NO: 27894 - DNA, 25 bp, Mus musculus
gaagacccacgtgggacctgaagaa

SEQ ID NO: 27895 - DNA, 25 bp, Mus musculus
gaagacccagacgaggatttatccg

SEQ ID NO: 27896 - DNA, 25 bp, Mus musculus
gaagacccagccctatgacgtttac

SEQ ID NO: 27897 - DNA, 25 bp, Mus musculus
gaagacccagcttgttaataaaaga

SEQ ID NO: 27898 - DNA, 25 bp, Mus musculus
gaagacccgggcagctgcctttgta

SEQ ID NO: 27899 - DNA, 25 bp, Mus musculus
gaagacccgtttctatctaggctct

SEQ ID NO: 27900 - DNA, 25 bp, Mus musculus
gaagacccttggctctgggacctag

SEQ ID NO: 27901 - DNA, 25 bp, Mus musculus
gaagaccgctccatgattctgtagc

SEQ ID NO: 27902 - DNA, 25 bp, Mus musculus
gaagaccgtctctagcaatcaaggg

SEQ ID NO: 27903 - DNA, 25 bp, Mus musculus
gaagacctatctgcatttgagtcct

SEQ ID NO: 27904 - DNA, 25 bp, Mus musculus
gaagacctatcttctggcctgggag

SEQ ID NO: 27905 - DNA, 25 bp, Mus musculus
gaagacctcccagtcggtgttcatg

SEQ ID NO: 27906 - DNA, 25 bp, Mus musculus
gaagacctctcttgagaaggctgcc

SEQ ID NO: 27907 - DNA, 25 bp, Mus musculus
gaagacctgactgaattcctctgtg

SEQ ID NO: 27908 - DNA, 25 bp, Mus musculus
gaagacctgttggagaattcaaggc

SEQ ID NO: 27909 - DNA, 25 bp, Mus musculus
gaagacctgtttgatatgtgcagat

SEQ ID NO: 27910 - DNA, 25 bp, Mus musculus
gaagaccttcactgtcattgagaag

SEQ ID NO: 27911 - DNA, 25 bp, Mus musculus
gaagaccttcagaaagggtgagaga

SEQ ID NO: 27912 - DNA, 25 bp, Mus musculus
gaagacctttcggagatcactgacg

SEQ ID NO: 27913 - DNA, 25 bp, Mus musculus
gaagacgaacgggtcgtacctgctg

SEQ ID NO: 27914 - DNA, 25 bp, Mus musculus
gaagacgacctggatgatgatgtca

SEQ ID NO: 27915 - DNA, 25 bp, Mus musculus
gaagacgacctgtgtgtgccacagc

SEQ ID NO: 27916 - DNA, 25 bp, Mus musculus
gaagacgactcagacatcttacatg

SEQ ID NO: 27917 - DNA, 25 bp, Mus musculus
gaagacgactgaggctccctgttcc

SEQ ID NO: 27918 - DNA, 25 bp, Mus musculus
gaagacgatcatcctcatggaccct

SEQ ID NO: 27919 - DNA, 25 bp, Mus musculus
gaagacgatgtctgctaatgaacta

SEQ ID NO: 27920 - DNA, 25 bp, Mus musculus
gaagacgctgcagctgtctcggcag

SEQ ID NO: 27921 - DNA, 25 bp, Mus musculus
gaagacgctgttggccaaggcagta

SEQ ID NO: 27922 - DNA, 25 bp, Mus musculus
gaagacggacttttgttggaggcat

SEQ ID NO: 27923 - DNA, 25 bp, Mus musculus
gaagacggagataagctaaggatcc

SEQ ID NO: 27924 - DNA, 25 bp, Mus musculus
gaagacggcaccacgactaagtact

SEQ ID NO: 27925 - DNA, 25 bp, Mus musculus
gaagacgggcatgatggacacagac

SEQ ID NO: 27926 - DNA, 25 bp, Mus musculus
gaagacgtcagctttttggtcaata

SEQ ID NO: 27927 - DNA, 25 bp, Mus musculus
gaagacgtgaagctcttagccaggc

SEQ ID NO: 27928 - DNA, 25 bp, Mus musculus
gaagactaaaatagggcacagtggc

SEQ ID NO: 27929 - DNA, 25 bp, Mus musculus
gaagactaacttggccatgatgaac

SEQ ID NO: 27930 - DNA, 25 bp, Mus musculus
gaagactatcctggccaacggttcc

SEQ ID NO: 27931 - DNA, 25 bp, Mus musculus
gaagactatgaacgcctggccagtg

SEQ ID NO: 27932 - DNA, 25 bp, Mus musculus
gaagactccagcaaagtggtacccg

SEQ ID NO: 27933 - DNA, 25 bp, Mus musculus
gaagactcgggcctacaatggacag

SEQ ID NO: 27934 - DNA, 25 bp, Mus musculus
gaagactcgggcgtacaatggacag

SEQ ID NO: 27935 - DNA, 25 bp, Mus musculus
gaagactctgggatttatgcttgtg

SEQ ID NO: 27936 - DNA, 25 bp, Mus musculus
gaagactctgggttttatgcttgtg

SEQ ID NO: 27937 - DNA, 25 bp, Mus musculus
gaagactcttcaatcagctcatcaa

SEQ ID NO: 27938 - DNA, 25 bp, Mus musculus
gaagactgaaaattgtgtggccaaa

SEQ ID NO: 27939 - DNA, 25 bp, Mus musculus
gaagactgagaccatagagttctaa

SEQ ID NO: 27940 - DNA, 25 bp, Mus musculus
gaagactgagctgctgatgtcagtt

SEQ ID NO: 27941 - DNA, 25 bp, Mus musculus
gaagactgcaagatgaatgcagttc

SEQ ID NO: 27942 - DNA, 25 bp, Mus musculus
gaagactgccctgatggaggcaaat

SEQ ID NO: 27943 - DNA, 25 bp, Mus musculus
gaagactggcgcattgactcttgtg

SEQ ID NO: 27944 - DNA, 25 bp, Mus musculus
gaagactgggacaaacagccggtaa

SEQ ID NO: 27945 - DNA, 25 bp, Mus musculus
gaagactgtaaagaggtgtctgcta

SEQ ID NO: 27946 - DNA, 25 bp, Mus musculus
gaagactgtaataatggcgaacccc

SEQ ID NO: 27947 - DNA, 25 bp, Mus musculus
gaagactgtactatggaagttacac

SEQ ID NO: 27948 - DNA, 25 bp, Mus musculus
gaagactgtatgtcattggaacagg

SEQ ID NO: 27949 - DNA, 25 bp, Mus musculus
gaagactgtcaaccatcaacacatc

SEQ ID NO: 27950 - DNA, 25 bp, Mus musculus
gaagactgtcacgatttcacctttg

SEQ ID NO: 27951 - DNA, 25 bp, Mus musculus
gaagactgtctcagggacaaacagg

SEQ ID NO: 27952 - DNA, 25 bp, Mus musculus
gaagacttatcttcctttagtagaa

SEQ ID NO: 27953 - DNA, 25 bp, Mus musculus
gaagacttccaagactgttaccata

SEQ ID NO: 27954 - DNA, 25 bp, Mus musculus
gaagacttcctcactagcctggtgg

SEQ ID NO: 27955 - DNA, 25 bp, Mus musculus
gaagacttcttcgtgatgagtgatt

SEQ ID NO: 27956 - DNA, 25 bp, Mus musculus
gaagacttgaatctctttgcctatg

SEQ ID NO: 27957 - DNA, 25 bp, Mus musculus
gaagacttgattgcaattttgatat

SEQ ID NO: 27958 - DNA, 25 bp, Mus musculus
gaagacttggccttgtggttaacca

SEQ ID NO: 27959 - DNA, 25 bp, Mus musculus
gaagacttgttggacaagttcatga

SEQ ID NO: 27960 - DNA, 25 bp, Mus musculus
gaagactttaatgttgcactaggtg

SEQ ID NO: 27961 - DNA, 25 bp, Mus musculus
gaagactttacacccttctcgctat

SEQ ID NO: 27962 - DNA, 25 bp, Mus musculus
gaagactttaggaggattatgcaca

SEQ ID NO: 27963 - DNA, 25 bp, Mus musculus
gaagagaaaaaacagcgcggatttc

SEQ ID NO: 27964 - DNA, 25 bp, Mus musculus
gaagagaacaatgaccaagttacag

SEQ ID NO: 27965 - DNA, 25 bp, Mus musculus
gaagagaacaccattgccttccgac

SEQ ID NO: 27966 - DNA, 25 bp, Mus musculus
gaagagaacttatatgcaaagacag

SEQ ID NO: 27967 - DNA, 25 bp, Mus musculus
gaagagaagcccagtcttctgatga

SEQ ID NO: 27968 - DNA, 25 bp, Mus musculus
gaagagaaggaatcagagctctgga

SEQ ID NO: 27969 - DNA, 25 bp, Mus musculus
gaagagaaggacaaagccttcaagg

SEQ ID NO: 27970 - DNA, 25 bp, Mus musculus
gaagagaatcaatacactgacgctg

SEQ ID NO: 27971 - DNA, 25 bp, Mus musculus
gaagagacacttggatttcttggac

SEQ ID NO: 27972 - DNA, 25 bp, Mus musculus
gaagagacaggcttccagggccttc

SEQ ID NO: 27973 - DNA, 25 bp, Mus musculus
gaagagacccagaaagaaatggctg

SEQ ID NO: 27974 - DNA, 25 bp, Mus musculus
gaagagacctctgtggatgccggat

SEQ ID NO: 27975 - DNA, 25 bp, Mus musculus
gaagagacgcctgcagaagaacagc

SEQ ID NO: 27976 - DNA, 25 bp, Mus musculus
gaagagactcctgcagaatccgaaa

SEQ ID NO: 27977 - DNA, 25 bp, Mus musculus
gaagagactgaactgaagacgctgc

SEQ ID NO: 27978 - DNA, 25 bp, Mus musculus
gaagagacttattctgaggttggga

SEQ ID NO: 27979 - DNA, 25 bp, Mus musculus
gaagagagagtcatgagcctcagag

SEQ ID NO: 27980 - DNA, 25 bp, Mus musculus
gaagagagagttgtacgaaaagtcc

SEQ ID NO: 27981 - DNA, 25 bp, Mus musculus
gaagagagatatacgtgcagagggc

SEQ ID NO: 27982 - DNA, 25 bp, Mus musculus
gaagagagatgttgcagtggccata

SEQ ID NO: 27983 - DNA, 25 bp, Mus musculus
gaagagagattcctatagtgcaccg

SEQ ID NO: 27984 - DNA, 25 bp, Mus musculus
gaagagagcctgagacccaacttcc

SEQ ID NO: 27985 - DNA, 25 bp, Mus musculus
gaagagagcttctcccttttctgga

SEQ ID NO: 27986 - DNA, 25 bp, Mus musculus
gaagagagtacctttatcagctcca

SEQ ID NO: 27987 - DNA, 25 bp, Mus musculus
gaagagatcctcaaagatgtctcag

SEQ ID NO: 27988 - DNA, 25 bp, Mus musculus
gaagagatgaacgtcattccatctg

SEQ ID NO: 27989 - DNA, 25 bp, Mus musculus
gaagagatgatggtgtttgctgccc

SEQ ID NO: 27990 - DNA, 25 bp, Mus musculus
gaagagatgattcgcttagcaaact

SEQ ID NO: 27991 - DNA, 25 bp, Mus musculus
gaagagatggctgtgaatattctct

SEQ ID NO: 27992 - DNA, 25 bp, Mus musculus
gaagagattatgagaagaaccagga

SEQ ID NO: 27993 - DNA, 25 bp, Mus musculus
gaagagattccacgacattggcact

SEQ ID NO: 27994 - DNA, 25 bp, Mus musculus
gaagagattgttgacaactatctca

SEQ ID NO: 27995 - DNA, 25 bp, Mus musculus
gaagagcacaactgtagcagttcgt

SEQ ID NO: 27996 - DNA, 25 bp, Mus musculus
gaagagcagcctcctgttcgtaaag

SEQ ID NO: 27997 - DNA, 25 bp, Mus musculus
gaagagcaggaagacatacctgtac

SEQ ID NO: 27998 - DNA, 25 bp, Mus musculus
gaagagcagtgaggctattgctacc

SEQ ID NO: 27999 - DNA, 25 bp, Mus musculus
gaagagcatgaccatgcttcactag

SEQ ID NO: 28000 - DNA, 25 bp, Mus musculus
gaagagcattgtcctcctcacggcg

SEQ ID NO: 28001 - DNA, 25 bp, Mus musculus
gaagagcattgtgctcctcacggcg

SEQ ID NO: 28002 - DNA, 25 bp, Mus musculus
gaagagcccaacatcgacattcaca

SEQ ID NO: 28003 - DNA, 25 bp, Mus musculus
gaagagccctaacggaacgatccgg

SEQ ID NO: 28004 - DNA, 25 bp, Mus musculus
gaagagcctcttcgaggcccgagta

SEQ ID NO: 28005 - DNA, 25 bp, Mus musculus
gaagagcctgtcatgggcctcgact

SEQ ID NO: 28006 - DNA, 25 bp, Mus musculus
gaagagcgaccagctcactaggaac

SEQ ID NO: 28007 - DNA, 25 bp, Mus musculus
gaagagcgacttccatagccagatg

SEQ ID NO: 28008 - DNA, 25 bp, Mus musculus
gaagagcgagcaagtcttcttagtg

SEQ ID NO: 28009 - DNA, 25 bp, Mus musculus
gaagagcgggacttagagcgtctac

SEQ ID NO: 28010 - DNA, 25 bp, Mus musculus
gaagagcgggatcattgacttaaag

SEQ ID NO: 28011 - DNA, 25 bp, Mus musculus
gaagagctgatacggctcacccaaa

SEQ ID NO: 28012 - DNA, 25 bp, Mus musculus
gaagagcttccagtgaatacctcaa

SEQ ID NO: 28013 - DNA, 25 bp, Mus musculus
gaagagctttctggaactgacagag

SEQ ID NO: 28014 - DNA, 25 bp, Mus musculus
gaagaggaaaaatggccattgtcca

SEQ ID NO: 28015 - DNA, 25 bp, Mus musculus
gaagaggaaaccaacctcagcaaga

SEQ ID NO: 28016 - DNA, 25 bp, Mus musculus
gaagaggaagaaaagtcggattaca

SEQ ID NO: 28017 - DNA, 25 bp, Mus musculus
gaagaggaagtagtcccacctcggc

SEQ ID NO: 28018 - DNA, 25 bp, Mus musculus
gaagaggagctcatcaaagcccaga

SEQ ID NO: 28019 - DNA, 25 bp, Mus musculus
gaagaggatggtggtatatcagaca

SEQ ID NO: 28020 - DNA, 25 bp, Mus musculus
gaagaggattaagaaggaccaggac

SEQ ID NO: 28021 - DNA, 25 bp, Mus musculus
gaagaggcaaaacgcctccaccggg

SEQ ID NO: 28022 - DNA, 25 bp, Mus musculus
gaagaggcaagaggccctggagctc

SEQ ID NO: 28023 - DNA, 25 bp, Mus musculus
gaagaggcagaagtcatcaaccaaa

SEQ ID NO: 28024 - DNA, 25 bp, Mus musculus
gaagaggcattacatgccctgaaat

SEQ ID NO: 28025 - DNA, 25 bp, Mus musculus
gaagaggcattagatgccctgaaat

SEQ ID NO: 28026 - DNA, 25 bp, Mus musculus
gaagaggcattgaatcccatgtgag

SEQ ID NO: 28027 - DNA, 25 bp, Mus musculus
gaagaggccaccgagagaacaacca

SEQ ID NO: 28028 - DNA, 25 bp, Mus musculus
gaagaggccccgtccctcattcaat

SEQ ID NO: 28029 - DNA, 25 bp, Mus musculus
gaagaggctcccgagagtcctcaca

SEQ ID NO: 28030 - DNA, 25 bp, Mus musculus
gaagaggctgaaaagcaaggatgcc

SEQ ID NO: 28031 - DNA, 25 bp, Mus musculus
gaagaggctggataaaatactacat

SEQ ID NO: 28032 - DNA, 25 bp, Mus musculus
gaagaggctgtgtatagaaatatac

SEQ ID NO: 28033 - DNA, 25 bp, Mus musculus
gaagaggctttcatgcagtgtgcaa

SEQ ID NO: 28034 - DNA, 25 bp, Mus musculus
gaagaggctttcttgcagtgtgcaa

SEQ ID NO: 28035 - DNA, 25 bp, Mus musculus
gaagagggtgttctcagtgatccac

SEQ ID NO: 28036 - DNA, 25 bp, Mus musculus
gaagaggtagaagtatccttcctga

SEQ ID NO: 28037 - DNA, 25 bp, Mus musculus
gaagaggtcaacaagtttcatttaa

SEQ ID NO: 28038 - DNA, 25 bp, Mus musculus
gaagaggtcatgaaaattaaagcag

SEQ ID NO: 28039 - DNA, 25 bp, Mus musculus
gaagaggtcccctgcaacaaaccag

SEQ ID NO: 28040 - DNA, 25 bp, Mus musculus
gaagaggtcgcttttgatgagaaaa

SEQ ID NO: 28041 - DNA, 25 bp, Mus musculus
gaagaggtgactttcatctatcaga

SEQ ID NO: 28042 - DNA, 25 bp, Mus musculus
gaagaggttctggtgggcacatttt

SEQ ID NO: 28043 - DNA, 25 bp, Mus musculus
gaagagtcaagcagacatctctatg

SEQ ID NO: 28044 - DNA, 25 bp, Mus musculus
gaagagtcggtatttctggagacag

SEQ ID NO: 28045 - DNA, 25 bp, Mus musculus
gaagagtctgttgggagttttcact

SEQ ID NO: 28046 - DNA, 25 bp, Mus musculus
gaagagtcttgcaggatctcctccc

SEQ ID NO: 28047 - DNA, 25 bp, Mus musculus
gaagagtctttagacctctgctggg

SEQ ID NO: 28048 - DNA, 25 bp, Mus musculus
gaagagtgcaccgaaatgactgcga

SEQ ID NO: 28049 - DNA, 25 bp, Mus musculus
gaagagtgccaacgagaaagctgac

SEQ ID NO: 28050 - DNA, 25 bp, Mus musculus
gaagagtgccaaggagaaagctgac

SEQ ID NO: 28051 - DNA, 25 bp, Mus musculus
gaagagtgggaaatcaggaactttt

SEQ ID NO: 28052 - DNA, 25 bp, Mus musculus
gaagagtgtgaagatgtggaacatc

SEQ ID NO: 28053 - DNA, 25 bp, Mus musculus
gaagagtgtgtttgaggtaccaaga

SEQ ID NO: 28054 - DNA, 25 bp, Mus musculus
gaagagttacaagtgaattagcaat

SEQ ID NO: 28055 - DNA, 25 bp, Mus musculus
gaagagttcacaaggctttgcagag

SEQ ID NO: 28056 - DNA, 25 bp, Mus musculus
gaagagttctcaaaggaaaagtttg

SEQ ID NO: 28057 - DNA, 25 bp, Mus musculus
gaagagtttaatagcaaagaaagcc

SEQ ID NO: 28058 - DNA, 25 bp, Mus musculus
gaagagtttcctagcatgatcaggc

SEQ ID NO: 28059 - DNA, 25 bp, Mus musculus
gaagagtttgacgaactgtgttttg

SEQ ID NO: 28060 - DNA, 25 bp, Mus musculus
gaagagtttgccaactcgggatgca

SEQ ID NO: 28061 - DNA, 25 bp, Mus musculus
gaagataaacaaaactgacctgatt

SEQ ID NO: 28062 - DNA, 25 bp, Mus musculus
gaagataacctgtgggttaaaatga

SEQ ID NO: 28063 - DNA, 25 bp, Mus musculus
gaagataagacagctgaatgtcagc

SEQ ID NO: 28064 - DNA, 25 bp, Mus musculus
gaagataaggttttcaacactgcct

SEQ ID NO: 28065 - DNA, 25 bp, Mus musculus
gaagatacaaagctgtcagaacaga

SEQ ID NO: 28066 - DNA, 25 bp, Mus musculus
gaagatacaggcctttgccgagtgc

SEQ ID NO: 28067 - DNA, 25 bp, Mus musculus
gaagatacatgtccttctggaacag

SEQ ID NO: 28068 - DNA, 25 bp, Mus musculus
gaagataccattggatcacgggacc

SEQ ID NO: 28069 - DNA, 25 bp, Mus musculus
gaagatacttccaagatgaaccatg

SEQ ID NO: 28070 - DNA, 25 bp, Mus musculus
gaagatagaagaaagggctgaaaaa

SEQ ID NO: 28071 - DNA, 25 bp, Mus musculus
gaagatagacaattaggactacaag

SEQ ID NO: 28072 - DNA, 25 bp, Mus musculus
gaagatagactcataagcatcatag

SEQ ID NO: 28073 - DNA, 25 bp, Mus musculus
gaagatagcaggcactcctgggaca

SEQ ID NO: 28074 - DNA, 25 bp, Mus musculus
gaagatagcgggagtaacaccaatg

SEQ ID NO: 28075 - DNA, 25 bp, Mus musculus
gaagatatatcagcatgtgatcaac

SEQ ID NO: 28076 - DNA, 25 bp, Mus musculus
gaagatatcacggagtatcagagca

SEQ ID NO: 28077 - DNA, 25 bp, Mus musculus
gaagatatccgagcaactgaaaaag

SEQ ID NO: 28078 - DNA, 25 bp, Mus musculus
gaagatatgactccaggaccacaat

SEQ ID NO: 28079 - DNA, 25 bp, Mus musculus
gaagatattatctctagaagccact

SEQ ID NO: 28080 - DNA, 25 bp, Mus musculus
gaagatcaagtttgcctccttggag

SEQ ID NO: 28081 - DNA, 25 bp, Mus musculus
gaagatcacgacgttggctttccaa

SEQ ID NO: 28082 - DNA, 25 bp, Mus musculus
gaagatcactagtttggcttacgaa

SEQ ID NO: 28083 - DNA, 25 bp, Mus musculus
gaagatcagacacttttcaccatag

SEQ ID NO: 28084 - DNA, 25 bp, Mus musculus
gaagatcagacagttttcaccatag

SEQ ID NO: 28085 - DNA, 25 bp, Mus musculus
gaagatcaggagttagaagttcacc

SEQ ID NO: 28086 - DNA, 25 bp, Mus musculus
gaagatcatcgtgcacaccgtgcag

SEQ ID NO: 28087 - DNA, 25 bp, Mus musculus
gaagatccaacaactccctgaccat

SEQ ID NO: 28088 - DNA, 25 bp, Mus musculus
gaagatccaggagtacaatgtgctg

SEQ ID NO: 28089 - DNA, 25 bp, Mus musculus
gaagatccatattccacgttggtga

SEQ ID NO: 28090 - DNA, 25 bp, Mus musculus
gaagatccccgggaacatcaggcac

SEQ ID NO: 28091 - DNA, 25 bp, Mus musculus
gaagatccggattatggcctccgag

SEQ ID NO: 28092 - DNA, 25 bp, Mus musculus
gaagatcctagtttccaatggcaca

SEQ ID NO: 28093 - DNA, 25 bp, Mus musculus
gaagatcctataacatttgcaccat

SEQ ID NO: 28094 - DNA, 25 bp, Mus musculus
gaagatcctcaaaggcagctcaggt

SEQ ID NO: 28095 - DNA, 25 bp, Mus musculus
gaagatccttctccagaaaacagga

SEQ ID NO: 28096 - DNA, 25 bp, Mus musculus
gaagatcgccaaagccatgcgcaag

SEQ ID NO: 28097 - DNA, 25 bp, Mus musculus
gaagatctatgctatagtccaacag

SEQ ID NO: 28098 - DNA, 25 bp, Mus musculus
gaagatctcaacgactgggttgccg

SEQ ID NO: 28099 - DNA, 25 bp, Mus musculus
gaagatctccaagaagaatgcggcc

SEQ ID NO: 28100 - DNA, 25 bp, Mus musculus
gaagatctgacaaatacacctttga

SEQ ID NO: 28101 - DNA, 25 bp, Mus musculus
gaagatctgagcacagccagctata

SEQ ID NO: 28102 - DNA, 25 bp, Mus musculus
gaagatctggctctcttcttctatg

SEQ ID NO: 28103 - DNA, 25 bp, Mus musculus
gaagatctgggtgtcccgggaggag

SEQ ID NO: 28104 - DNA, 25 bp, Mus musculus
gaagatctggtttgacaagtttaaa

SEQ ID NO: 28105 - DNA, 25 bp, Mus musculus
gaagatcttgaagcttactgctgat

SEQ ID NO: 28106 - DNA, 25 bp, Mus musculus
gaagatgaactcacaccttttgata

SEQ ID NO: 28107 - DNA, 25 bp, Mus musculus
gaagatgaagcagtggataaaacta

SEQ ID NO: 28108 - DNA, 25 bp, Mus musculus
gaagatgaatgtgtgactcgagacg

SEQ ID NO: 28109 - DNA, 25 bp, Mus musculus
gaagatgaattccaaatccctggga

SEQ ID NO: 28110 - DNA, 25 bp, Mus musculus
gaagatgacacctttctaacagctc

SEQ ID NO: 28111 - DNA, 25 bp, Mus musculus
gaagatgacccgaccatattcagtg

SEQ ID NO: 28112 - DNA, 25 bp, Mus musculus
gaagatgacttggtatcggccttag

SEQ ID NO: 28113 - DNA, 25 bp, Mus musculus
gaagatgagatgcaaaacgagattt

SEQ ID NO: 28114 - DNA, 25 bp, Mus musculus
gaagatgagccttcccttggtaggc

SEQ ID NO: 28115 - DNA, 25 bp, Mus musculus
gaagatgagcgggttgtctcaaccg

SEQ ID NO: 28116 - DNA, 25 bp, Mus musculus
gaagatgaggagattaaaagactgc

SEQ ID NO: 28117 - DNA, 25 bp, Mus musculus
gaagatgatatcttcctcacggtga

SEQ ID NO: 28118 - DNA, 25 bp, Mus musculus
gaagatgatctactgctcccactgc

SEQ ID NO: 28119 - DNA, 25 bp, Mus musculus
gaagatgatctagtgctcccactgc

SEQ ID NO: 28120 - DNA, 25 bp, Mus musculus
gaagatgatgaagacctttccccag

SEQ ID NO: 28121 - DNA, 25 bp, Mus musculus
gaagatgattgggaaacataagaac

SEQ ID NO: 28122 - DNA, 25 bp, Mus musculus
gaagatgcaaatgagcctttgatag

SEQ ID NO: 28123 - DNA, 25 bp, Mus musculus
gaagatgcaagccaaccccatctgc

SEQ ID NO: 28124 - DNA, 25 bp, Mus musculus
gaagatgcacatctccagatggcaa

SEQ ID NO: 28125 - DNA, 25 bp, Mus musculus
gaagatgcacccctgctctgcagtt

SEQ ID NO: 28126 - DNA, 25 bp, Mus musculus
gaagatgcactctctcgtgtagctg

SEQ ID NO: 28127 - DNA, 25 bp, Mus musculus
gaagatgcagttgaacatgagcaga

SEQ ID NO: 28128 - DNA, 25 bp, Mus musculus
gaagatgcatcacctccataaataa

SEQ ID NO: 28129 - DNA, 25 bp, Mus musculus
gaagatgccagcgactgcatatgaa

SEQ ID NO: 28130 - DNA, 25 bp, Mus musculus
gaagatgctaactgtcttgctttga

SEQ ID NO: 28131 - DNA, 25 bp, Mus musculus
gaagatgctgagaggcacaaatact

SEQ ID NO: 28132 - DNA, 25 bp, Mus musculus
gaagatgcttcaggcagtatgtgtc

SEQ ID NO: 28133 - DNA, 25 bp, Mus musculus
gaagatggaagccatatatgtgaca

SEQ ID NO: 28134 - DNA, 25 bp, Mus musculus
gaagatggaagcctctggtcattca

SEQ ID NO: 28135 - DNA, 25 bp, Mus musculus
gaagatggacgacttcgagacccat

SEQ ID NO: 28136 - DNA, 25 bp, Mus musculus
gaagatggagaagcggctccacgct

SEQ ID NO: 28137 - DNA, 25 bp, Mus musculus
gaagatggcatttctgctgttaatg

SEQ ID NO: 28138 - DNA, 25 bp, Mus musculus
gaagatggctcctgagcaatgggaa

SEQ ID NO: 28139 - DNA, 25 bp, Mus musculus
gaagatggtcctcccacaaaacagg

SEQ ID NO: 28140 - DNA, 25 bp, Mus musculus
gaagatggtggaaaattcaccgtcg

SEQ ID NO: 28141 - DNA, 25 bp, Mus musculus
gaagatgtagtaaaccagtcaagtc

SEQ ID NO: 28142 - DNA, 25 bp, Mus musculus
gaagatgtatcaatgcacggccaag

SEQ ID NO: 28143 - DNA, 25 bp, Mus musculus
gaagatgtccttccagcggtgtgct

SEQ ID NO: 28144 - DNA, 25 bp, Mus musculus
gaagatgtctatctacaacctgaga

SEQ ID NO: 28145 - DNA, 25 bp, Mus musculus
gaagatgtctatgtacaacctgaga

SEQ ID NO: 28146 - DNA, 25 bp, Mus musculus
gaagatgtggaaaaagcgaagaaaa

SEQ ID NO: 28147 - DNA, 25 bp, Mus musculus
gaagatgtggccacgtgtcctagct

SEQ ID NO: 28148 - DNA, 25 bp, Mus musculus
gaagatgtggctgacatgaactact

SEQ ID NO: 28149 - DNA, 25 bp, Mus musculus
gaagatgttcccagaacagcagaaa

SEQ ID NO: 28150 - DNA, 25 bp, Mus musculus
gaagatgttgctggccgtgcaacgc

SEQ ID NO: 28151 - DNA, 25 bp, Mus musculus
gaagatgttgtggagacattgctac

SEQ ID NO: 28152 - DNA, 25 bp, Mus musculus
gaagattcagcagtgaacaaaacac

SEQ ID NO: 28153 - DNA, 25 bp, Mus musculus
gaagattcccaagaacagaacacgg

SEQ ID NO: 28154 - DNA, 25 bp, Mus musculus
gaagattccgctcgtactgagccga

SEQ ID NO: 28155 - DNA, 25 bp, Mus musculus
gaagattccgctggtactgagccga

SEQ ID NO: 28156 - DNA, 25 bp, Mus musculus
gaagattccttgaacagacaaagca

SEQ ID NO: 28157 - DNA, 25 bp, Mus musculus
gaagattcctttcacaagtttgtgg

SEQ ID NO: 28158 - DNA, 25 bp, Mus musculus
gaagattctccatctcctgaaggac

SEQ ID NO: 28159 - DNA, 25 bp, Mus musculus
gaagattctcctgctgtgcgtggca

SEQ ID NO: 28160 - DNA, 25 bp, Mus musculus
gaagattctgggattatggccgcat

SEQ ID NO: 28161 - DNA, 25 bp, Mus musculus
gaagattctggtcactggatcctct

SEQ ID NO: 28162 - DNA, 25 bp, Mus musculus
gaagattgatagtaaaactcctgag

SEQ ID NO: 28163 - DNA, 25 bp, Mus musculus
gaagattgatatcattaagcatcca

SEQ ID NO: 28164 - DNA, 25 bp, Mus musculus
gaagattgcaggagccattggtcca

SEQ ID NO: 28165 - DNA, 25 bp, Mus musculus
gaagattggattgatgtctctctcc

SEQ ID NO: 28166 - DNA, 25 bp, Mus musculus
gaagattggccaagcattccgtggt

SEQ ID NO: 28167 - DNA, 25 bp, Mus musculus
gaagattgtgaacgatgaccagtcc

SEQ ID NO: 28168 - DNA, 25 bp, Mus musculus
gaagattgtgagatcaagcaccttg

SEQ ID NO: 28169 - DNA, 25 bp, Mus musculus
gaagatttacagctgaagaaccaag

SEQ ID NO: 28170 - DNA, 25 bp, Mus musculus
gaagatttagaacgagtagtccaga

SEQ ID NO: 28171 - DNA, 25 bp, Mus musculus
gaagatttctaccagctggtggtgc

SEQ ID NO: 28172 - DNA, 25 bp, Mus musculus
gaagatttgcggagttttatcagct

SEQ ID NO: 28173 - DNA, 25 bp, Mus musculus
gaagattttagctgagagggtttta

SEQ ID NO: 28174 - DNA, 25 bp, Mus musculus
gaagattttctggactactgcctag

SEQ ID NO: 28175 - DNA, 25 bp, Mus musculus
gaagattttgattggagtcctggtg

SEQ ID NO: 28176 - DNA, 25 bp, Mus musculus
gaagattttggaaacctgcattccc

SEQ ID NO: 28177 - DNA, 25 bp, Mus musculus
gaagcaaaactttccaagactaaat

SEQ ID NO: 28178 - DNA, 25 bp, Mus musculus
gaagcaaaatttggaaaaggctgtt

SEQ ID NO: 28179 - DNA, 25 bp, Mus musculus
gaagcaaactccctcatctgtcctg

SEQ ID NO: 28180 - DNA, 25 bp, Mus musculus
gaagcaacatcagctctggatacag

SEQ ID NO: 28181 - DNA, 25 bp, Mus musculus
gaagcaacccatagaacccgggagg

SEQ ID NO: 28182 - DNA, 25 bp, Mus musculus
gaagcaacccgggaagagtccagtt

SEQ ID NO: 28183 - DNA, 25 bp, Mus musculus
gaagcaagaaaaccggaatacatat

SEQ ID NO: 28184 - DNA, 25 bp, Mus musculus
gaagcaagaaaagcggaatacatat

SEQ ID NO: 28185 - DNA, 25 bp, Mus musculus
gaagcaagaattcagtgacccgtcg

SEQ ID NO: 28186 - DNA, 25 bp, Mus musculus
gaagcaagaccacctgatgactttg

SEQ ID NO: 28187 - DNA, 25 bp, Mus musculus
gaagcaagactgcaacagttaaccg

SEQ ID NO: 28188 - DNA, 25 bp, Mus musculus
gaagcaagacttgaactcgccatga

SEQ ID NO: 28189 - DNA, 25 bp, Mus musculus
gaagcaagatgagttcaagcgtctg

SEQ ID NO: 28190 - DNA, 25 bp, Mus musculus
gaagcaagcccaaggtggttactac

SEQ ID NO: 28191 - DNA, 25 bp, Mus musculus
gaagcaagctgagcatgaacattga

SEQ ID NO: 28192 - DNA, 25 bp, Mus musculus
gaagcaatagcttcttaccgcacag

SEQ ID NO: 28193 - DNA, 25 bp, Mus musculus
gaagcaatccgcagcccttcagtta

SEQ ID NO: 28194 - DNA, 25 bp, Mus musculus
gaagcaatccgctgcccttcagtta

SEQ ID NO: 28195 - DNA, 25 bp, Mus musculus
gaagcacaaataggagacacattat

SEQ ID NO: 28196 - DNA, 25 bp, Mus musculus
gaagcacacctcctctctgaaggtg

SEQ ID NO: 28197 - DNA, 25 bp, Mus musculus
gaagcacatggacggactccgcacc

SEQ ID NO: 28198 - DNA, 25 bp, Mus musculus
gaagcacatggcagcggccagtgca

SEQ ID NO: 28199 - DNA, 25 bp, Mus musculus
gaagcacccacagactgccaagtgg

SEQ ID NO: 28200 - DNA, 25 bp, Mus musculus
gaagcaccttccagcaagtcacctg

SEQ ID NO: 28201 - DNA, 25 bp, Mus musculus
gaagcaccttccatgctgggcagct

SEQ ID NO: 28202 - DNA, 25 bp, Mus musculus
gaagcaccttgagatacacacagcc

SEQ ID NO: 28203 - DNA, 25 bp, Mus musculus
gaagcacggcgaaaaaatcttctca

SEQ ID NO: 28204 - DNA, 25 bp, Mus musculus
gaagcacggtcaccactgaagacgt

SEQ ID NO: 28205 - DNA, 25 bp, Mus musculus
gaagcacggtgcatctattcaagcc

SEQ ID NO: 28206 - DNA, 25 bp, Mus musculus
gaagcacgtctgtgatgcggctgaa

SEQ ID NO: 28207 - DNA, 25 bp, Mus musculus
gaagcacgtttcttttggatctctg

SEQ ID NO: 28208 - DNA, 25 bp, Mus musculus
gaagcactctcctgatctaatgagt

SEQ ID NO: 28209 - DNA, 25 bp, Mus musculus
gaagcactgaagcaacacaaaaccc

SEQ ID NO: 28210 - DNA, 25 bp, Mus musculus
gaagcactgagagaaagtgtacaga

SEQ ID NO: 28211 - DNA, 25 bp, Mus musculus
gaagcactgcatccttgatgtctca

SEQ ID NO: 28212 - DNA, 25 bp, Mus musculus
gaagcactggagactttagccactg

SEQ ID NO: 28213 - DNA, 25 bp, Mus musculus
gaagcactggcccattcagatttac

SEQ ID NO: 28214 - DNA, 25 bp, Mus musculus
gaagcagaaaagaatttgacggacc

SEQ ID NO: 28215 - DNA, 25 bp, Mus musculus
gaagcagaaagatataacagaaaac

SEQ ID NO: 28216 - DNA, 25 bp, Mus musculus
gaagcagagaaaatgttcaagggca

SEQ ID NO: 28217 - DNA, 25 bp, Mus musculus
gaagcagagaaggactgagcacaat

SEQ ID NO: 28218 - DNA, 25 bp, Mus musculus
gaagcagagactccaaagctcaaga

SEQ ID NO: 28219 - DNA, 25 bp, Mus musculus
gaagcagagccgcaaccccttggtc

SEQ ID NO: 28220 - DNA, 25 bp, Mus musculus
gaagcagagcggaagctgctgactt

SEQ ID NO: 28221 - DNA, 25 bp, Mus musculus
gaagcagagctatggaatcccaaca

SEQ ID NO: 28222 - DNA, 25 bp, Mus musculus
gaagcagagtgtgtacacaccaccg

SEQ ID NO: 28223 - DNA, 25 bp, Mus musculus
gaagcagatacttgtgaagtcattg

SEQ ID NO: 28224 - DNA, 25 bp, Mus musculus
gaagcagatcacttgctcacatgtc

SEQ ID NO: 28225 - DNA, 25 bp, Mus musculus
gaagcagatcgagaaggaatacact

SEQ ID NO: 28226 - DNA, 25 bp, Mus musculus
gaagcagatcgtcatggcaagagcc

SEQ ID NO: 28227 - DNA, 25 bp, Mus musculus
gaagcagatgtttcggaacctcaga

SEQ ID NO: 28228 - DNA, 25 bp, Mus musculus
gaagcagatttgaaggctgcagctg

SEQ ID NO: 28229 - DNA, 25 bp, Mus musculus
gaagcagcaattagatttaaagatc

SEQ ID NO: 28230 - DNA, 25 bp, Mus musculus
gaagcagcacgggagcaacaccttc

SEQ ID NO: 28231 - DNA, 25 bp, Mus musculus
gaagcagcacttccatctacaaaag

SEQ ID NO: 28232 - DNA, 25 bp, Mus musculus
gaagcagcagactttgtcatcggcc

SEQ ID NO: 28233 - DNA, 25 bp, Mus musculus
gaagcagcagctgattagagataat

SEQ ID NO: 28234 - DNA, 25 bp, Mus musculus
gaagcagcagtatgaacacaccgtg

SEQ ID NO: 28235 - DNA, 25 bp, Mus musculus
gaagcagccaattgagaacagtcct

SEQ ID NO: 28236 - DNA, 25 bp, Mus musculus
gaagcagccagtttaagtctctcca

SEQ ID NO: 28237 - DNA, 25 bp, Mus musculus
gaagcagcctgatggcatcgctgtg

SEQ ID NO: 28238 - DNA, 25 bp, Mus musculus
gaagcagctggttgctctcatccct

SEQ ID NO: 28239 - DNA, 25 bp, Mus musculus
gaagcaggaattcaacaaacgtccc

SEQ ID NO: 28240 - DNA, 25 bp, Mus musculus
gaagcaggaattgaagatctaagag

SEQ ID NO: 28241 - DNA, 25 bp, Mus musculus
gaagcaggactccatctactatgaa

SEQ ID NO: 28242 - DNA, 25 bp, Mus musculus
gaagcaggacttcagcaatgtcttg

SEQ ID NO: 28243 - DNA, 25 bp, Mus musculus
gaagcaggcagaattggtcttttgt

SEQ ID NO: 28244 - DNA, 25 bp, Mus musculus
gaagcaggtgtgcaacatgccttgc

SEQ ID NO: 28245 - DNA, 25 bp, Mus musculus
gaagcagtatgccaaggatttcagc

SEQ ID NO: 28246 - DNA, 25 bp, Mus musculus
gaagcagtgatccaatgcggaaaaa

SEQ ID NO: 28247 - DNA, 25 bp, Mus musculus
gaagcagtggtctcagctctcggac

SEQ ID NO: 28248 - DNA, 25 bp, Mus musculus
gaagcagtgtgagaagagaatccga

SEQ ID NO: 28249 - DNA, 25 bp, Mus musculus
gaagcagttcaccaaacaacccaag

SEQ ID NO: 28250 - DNA, 25 bp, Mus musculus
gaagcagtttctggtccaccacctg

SEQ ID NO: 28251 - DNA, 25 bp, Mus musculus
gaagcatatggccaaaattagagat

SEQ ID NO: 28252 - DNA, 25 bp, Mus musculus
gaagcatcatcgaataatcatccag

SEQ ID NO: 28253 - DNA, 25 bp, Mus musculus
gaagcatctttcatgatatggacag

SEQ ID NO: 28254 - DNA, 25 bp, Mus musculus
gaagcatgacatgctggacaaggag

SEQ ID NO: 28255 - DNA, 25 bp, Mus musculus
gaagcatgacgaccgagaccttcgt

SEQ ID NO: 28256 - DNA, 25 bp, Mus musculus
gaagcatgccattattgtgtccatc

SEQ ID NO: 28257 - DNA, 25 bp, Mus musculus
gaagcatgcgagatctatgccagag

SEQ ID NO: 28258 - DNA, 25 bp, Mus musculus
gaagcatttcggtcgtagggatctg

SEQ ID NO: 28259 - DNA, 25 bp, Mus musculus
gaagccaaacagttatttggacgct

SEQ ID NO: 28260 - DNA, 25 bp, Mus musculus
gaagccaacagagcagtaagcgcag

SEQ ID NO: 28261 - DNA, 25 bp, Mus musculus
gaagccaacttcatgtctgaaggca

SEQ ID NO: 28262 - DNA, 25 bp, Mus musculus
gaagccaagaaactgagtgtgtctc

SEQ ID NO: 28263 - DNA, 25 bp, Mus musculus
gaagccaagacacacaaaggtgatg

SEQ ID NO: 28264 - DNA, 25 bp, Mus musculus
gaagccaagagcttctgctctgtaa

SEQ ID NO: 28265 - DNA, 25 bp, Mus musculus
gaagccaagagtgaagcccagaaac

SEQ ID NO: 28266 - DNA, 25 bp, Mus musculus
gaagccaagagtgtactgattccag

SEQ ID NO: 28267 - DNA, 25 bp, Mus musculus
gaagccaaggcagaagtctaaccgc

SEQ ID NO: 28268 - DNA, 25 bp, Mus musculus
gaagccaagtcttctagctcttcat

SEQ ID NO: 28269 - DNA, 25 bp, Mus musculus
gaagccaatgcccacgagttcatca

SEQ ID NO: 28270 - DNA, 25 bp, Mus musculus
gaagccaatgttgatgccgccacaa

SEQ ID NO: 28271 - DNA, 25 bp, Mus musculus
gaagccaattagtagattttctgac

SEQ ID NO: 28272 - DNA, 25 bp, Mus musculus
gaagccacacgcagccttgtgtctg

SEQ ID NO: 28273 - DNA, 25 bp, Mus musculus
gaagccacacgctgccttgtgtctg

SEQ ID NO: 28274 - DNA, 25 bp, Mus musculus
gaagccaccaatgtttacttgatag

SEQ ID NO: 28275 - DNA, 25 bp, Mus musculus
gaagccaccatgtacacagggaaag

SEQ ID NO: 28276 - DNA, 25 bp, Mus musculus
gaagccacctctcaacagcatcttg

SEQ ID NO: 28277 - DNA, 25 bp, Mus musculus
gaagccacgcttacattcattcctg

SEQ ID NO: 28278 - DNA, 25 bp, Mus musculus
gaagccactggctcttcatcggcat

SEQ ID NO: 28279 - DNA, 25 bp, Mus musculus
gaagccacttcagaggaatttgagg

SEQ ID NO: 28280 - DNA, 25 bp, Mus musculus
gaagccacttgctagtagctactga

SEQ ID NO: 28281 - DNA, 25 bp, Mus musculus
gaagccagaaaacatcgttctgcag

SEQ ID NO: 28282 - DNA, 25 bp, Mus musculus
gaagccagaaactttccctcagctg

SEQ ID NO: 28283 - DNA, 25 bp, Mus musculus
gaagccagaggatctgagcgtcatc

SEQ ID NO: 28284 - DNA, 25 bp, Mus musculus
gaagccagatattggacctacaaat

SEQ ID NO: 28285 - DNA, 25 bp, Mus musculus
gaagccagcctttctcgttcctata

SEQ ID NO: 28286 - DNA, 25 bp, Mus musculus
gaagccagctctatcaggaggaagg

SEQ ID NO: 28287 - DNA, 25 bp, Mus musculus
gaagccaggagtgtacaccaaagtc

SEQ ID NO: 28288 - DNA, 25 bp, Mus musculus
gaagccagggccatgatgtagacac

SEQ ID NO: 28289 - DNA, 25 bp, Mus musculus
gaagccagggtatactatggtacca

SEQ ID NO: 28290 - DNA, 25 bp, Mus musculus
gaagccagtgaaatccaagccaagt

SEQ ID NO: 28291 - DNA, 25 bp, Mus musculus
gaagccagtgctggccaacataggg

SEQ ID NO: 28292 - DNA, 25 bp, Mus musculus
gaagccagtgctttatgagcagcag

SEQ ID NO: 28293 - DNA, 25 bp, Mus musculus
gaagccagttacatgaacctgcaga

SEQ ID NO: 28294 - DNA, 25 bp, Mus musculus
gaagccatatatgtgacatactggg

SEQ ID NO: 28295 - DNA, 25 bp, Mus musculus
gaagccatcactcctcagaaggcaa

SEQ ID NO: 28296 - DNA, 25 bp, Mus musculus
gaagccatcatctttgtcatcaaca

SEQ ID NO: 28297 - DNA, 25 bp, Mus musculus
gaagccatgcctctatcctgaagtg

SEQ ID NO: 28298 - DNA, 25 bp, Mus musculus
gaagccatggtttgcatcattgcca

SEQ ID NO: 28299 - DNA, 25 bp, Mus musculus
gaagccattcaataccggaagttca

SEQ ID NO: 28300 - DNA, 25 bp, Mus musculus
gaagccattcagttggatggagaaa

SEQ ID NO: 28301 - DNA, 25 bp, Mus musculus
gaagcccaagaagccggcaaggctc

SEQ ID NO: 28302 - DNA, 25 bp, Mus musculus
gaagcccaagaccatgaagctcagt

SEQ ID NO: 28303 - DNA, 25 bp, Mus musculus
gaagcccaagcagattaccatagaa

SEQ ID NO: 28304 - DNA, 25 bp, Mus musculus
gaagcccaattgcttggacctgcgc

SEQ ID NO: 28305 - DNA, 25 bp, Mus musculus
gaagcccacctaccactatttttgt

SEQ ID NO: 28306 - DNA, 25 bp, Mus musculus
gaagcccacctagcactatttttgt

SEQ ID NO: 28307 - DNA, 25 bp, Mus musculus
gaagcccagcgaaaagccattcagg

SEQ ID NO: 28308 - DNA, 25 bp, Mus musculus
gaagcccatgctaaagtaagatttt

SEQ ID NO: 28309 - DNA, 25 bp, Mus musculus
gaagccccgagaagctgaagttcgg

SEQ ID NO: 28310 - DNA, 25 bp, Mus musculus
gaagccccggattatttggccactg

SEQ ID NO: 28311 - DNA, 25 bp, Mus musculus
gaagcccctagtggacctgcagttt

SEQ ID NO: 28312 - DNA, 25 bp, Mus musculus
gaagcccctgagctcctacctggtt

SEQ ID NO: 28313 - DNA, 25 bp, Mus musculus
gaagcccctgttgtagatgaagccc

SEQ ID NO: 28314 - DNA, 25 bp, Mus musculus
gaagcccgacaccatcgaggtgcag

SEQ ID NO: 28315 - DNA, 25 bp, Mus musculus
gaagcccgtgggagacctgcttata

SEQ ID NO: 28316 - DNA, 25 bp, Mus musculus
gaagccctcaacgagaggcagtcca

SEQ ID NO: 28317 - DNA, 25 bp, Mus musculus
gaagccctcaatgaacgggagctgt

SEQ ID NO: 28318 - DNA, 25 bp, Mus musculus
gaagccctcccaaaggactatcggt

SEQ ID NO: 28319 - DNA, 25 bp, Mus musculus
gaagccctgccagctgaacacttga

SEQ ID NO: 28320 - DNA, 25 bp, Mus musculus
gaagccctttttgatagagtttaca

SEQ ID NO: 28321 - DNA, 25 bp, Mus musculus
gaagccgaagaaacctgtctgtggg

SEQ ID NO: 28322 - DNA, 25 bp, Mus musculus
gaagccgagattgcaaactatgagg

SEQ ID NO: 28323 - DNA, 25 bp, Mus musculus
gaagccgagcttgcagaaatcccag

SEQ ID NO: 28324 - DNA, 25 bp, Mus musculus
gaagccgcggcccatagtgccttgc

SEQ ID NO: 28325 - DNA, 25 bp, Mus musculus
gaagccgctcctcattcacatgttt

SEQ ID NO: 28326 - DNA, 25 bp, Mus musculus
gaagccgctgttgccaggacaaaca

SEQ ID NO: 28327 - DNA, 25 bp, Mus musculus
gaagcctaaaggaaccattgaatat

SEQ ID NO: 28328 - DNA, 25 bp, Mus musculus
gaagcctactgtaatacgaatccca

SEQ ID NO: 28329 - DNA, 25 bp, Mus musculus
gaagcctactgttatacgaatccca

SEQ ID NO: 28330 - DNA, 25 bp, Mus musculus
gaagcctagtagaactcccagccct

SEQ ID NO: 28331 - DNA, 25 bp, Mus musculus
gaagcctatttgatcttgatgaatg

SEQ ID NO: 28332 - DNA, 25 bp, Mus musculus
gaagcctccagcaaacaagtaccct

SEQ ID NO: 28333 - DNA, 25 bp, Mus musculus
gaagcctctcgaaatgaactgcata

SEQ ID NO: 28334 - DNA, 25 bp, Mus musculus
gaagcctgaacctaatgcagtcact

SEQ ID NO: 28335 - DNA, 25 bp, Mus musculus
gaagcctgaagattcaactgtccta

SEQ ID NO: 28336 - DNA, 25 bp, Mus musculus
gaagcctggctctctgattgtaatc

SEQ ID NO: 28337 - DNA, 25 bp, Mus musculus
gaagcctgtacagcggcctgcagag

SEQ ID NO: 28338 - DNA, 25 bp, Mus musculus
gaagcctgtagacagtggtgctcct

SEQ ID NO: 28339 - DNA, 25 bp, Mus musculus
gaagcctgtagagagtggtgctcct

SEQ ID NO: 28340 - DNA, 25 bp, Mus musculus
gaagcctgtcatgattgtgatagag

SEQ ID NO: 28341 - DNA, 25 bp, Mus musculus
gaagcctgtctgattttgggagtaa

SEQ ID NO: 28342 - DNA, 25 bp, Mus musculus
gaagcctgtctgcagttttcacaaa

SEQ ID NO: 28343 - DNA, 25 bp, Mus musculus
gaagccttacacctctttccaggag

SEQ ID NO: 28344 - DNA, 25 bp, Mus musculus
gaagccttacacgtctttccaggag

SEQ ID NO: 28345 - DNA, 25 bp, Mus musculus
gaagccttacggaggttctctcgtg

SEQ ID NO: 28346 - DNA, 25 bp, Mus musculus
gaagccttgccaagccagaaagggt

SEQ ID NO: 28347 - DNA, 25 bp, Mus musculus
gaagccttgccatgccagaaagggt

SEQ ID NO: 28348 - DNA, 25 bp, Mus musculus
gaagccttgcttatcttcctgcagc

SEQ ID NO: 28349 - DNA, 25 bp, Mus musculus
gaagccttgtactgccgttctcaca

SEQ ID NO: 28350 - DNA, 25 bp, Mus musculus
gaagccttgtgtaccactggcacca

SEQ ID NO: 28351 - DNA, 25 bp, Mus musculus
gaagcctttactgagaaatttctta

SEQ ID NO: 28352 - DNA, 25 bp, Mus musculus
gaagcctttgaccttgagtcgtgaa

SEQ ID NO: 28353 - DNA, 25 bp, Mus musculus
gaagccttttcaagagtacctggag

SEQ ID NO: 28354 - DNA, 25 bp, Mus musculus
gaagccttttggagatgtccctcgg

SEQ ID NO: 28355 - DNA, 25 bp, Mus musculus
gaagccttttggtgatgtccctcgg

SEQ ID NO: 28356 - DNA, 25 bp, Mus musculus
gaagcgaacgctccaaaccctggag

SEQ ID NO: 28357 - DNA, 25 bp, Mus musculus
gaagcgaagctctcccttctggaca

SEQ ID NO: 28358 - DNA, 25 bp, Mus musculus
gaagcgaatgcctgaagacttggat

SEQ ID NO: 28359 - DNA, 25 bp, Mus musculus
gaagcgacccctcgaggcaaccttt

SEQ ID NO: 28360 - DNA, 25 bp, Mus musculus
gaagcgatcacatcctataatcact

SEQ ID NO: 28361 - DNA, 25 bp, Mus musculus
gaagcgcaagcaacatggagacgtg

SEQ ID NO: 28362 - DNA, 25 bp, Mus musculus
gaagcgcaagcatcatggagacgtg

SEQ ID NO: 28363 - DNA, 25 bp, Mus musculus
gaagcgcagcctgtccatgtggcac

SEQ ID NO: 28364 - DNA, 25 bp, Mus musculus
gaagcgcatcctctatgccacctgg

SEQ ID NO: 28365 - DNA, 25 bp, Mus musculus
gaagcgccagttgcaggatgacttt

SEQ ID NO: 28366 - DNA, 25 bp, Mus musculus
gaagcgccttagcatccaggcagag

SEQ ID NO: 28367 - DNA, 25 bp, Mus musculus
gaagcgcgtgatggtagatgccaat

SEQ ID NO: 28368 - DNA, 25 bp, Mus musculus
gaagcgctaccaagcagccgctggg

SEQ ID NO: 28369 - DNA, 25 bp, Mus musculus
gaagcggaagctaagtgtgctacac

SEQ ID NO: 28370 - DNA, 25 bp, Mus musculus
gaagcggagccatgttgcacgatat

SEQ ID NO: 28371 - DNA, 25 bp, Mus musculus
gaagcggagtctttgttcccttcac

SEQ ID NO: 28372 - DNA, 25 bp, Mus musculus
gaagcggagttagatgaagaaaaga

SEQ ID NO: 28373 - DNA, 25 bp, Mus musculus
gaagcggctaaagaaacatgtggtg

SEQ ID NO: 28374 - DNA, 25 bp, Mus musculus
gaagcgggtccgaatctccctggcg

SEQ ID NO: 28375 - DNA, 25 bp, Mus musculus
gaagcggtgatctgtagcaccccag

SEQ ID NO: 28376 - DNA, 25 bp, Mus musculus
gaagcggttgaacacagactggcct

SEQ ID NO: 28377 - DNA, 25 bp, Mus musculus
gaagcgtagctcttcaaagaattgt

SEQ ID NO: 28378 - DNA, 25 bp, Mus musculus
gaagcgtcatgactaccttctgagt

SEQ ID NO: 28379 - DNA, 25 bp, Mus musculus
gaagcgtcgactgattcctgtcacc

SEQ ID NO: 28380 - DNA, 25 bp, Mus musculus
gaagcgtctaggtctcctgcaggag

SEQ ID NO: 28381 - DNA, 25 bp, Mus musculus
gaagcgtctcaaagacaacttgaag

SEQ ID NO: 28382 - DNA, 25 bp, Mus musculus
gaagctaaaaggagaacttgaaagc

SEQ ID NO: 28383 - DNA, 25 bp, Mus musculus
gaagctaaccagtctgcgtggctca

SEQ ID NO: 28384 - DNA, 25 bp, Mus musculus
gaagctacagctgcgctaccaggag

SEQ ID NO: 28385 - DNA, 25 bp, Mus musculus
gaagctaccattttgccctgagtgg

SEQ ID NO: 28386 - DNA, 25 bp, Mus musculus
gaagctactacacaggtgcagctgg

SEQ ID NO: 28387 - DNA, 25 bp, Mus musculus
gaagctactacagaggtgcagctgg

SEQ ID NO: 28388 - DNA, 25 bp, Mus musculus
gaagctacttaatacggaacatcaa

SEQ ID NO: 28389 - DNA, 25 bp, Mus musculus
gaagctatgcactggcaggctcttc

SEQ ID NO: 28390 - DNA, 25 bp, Mus musculus
gaagctattcttcttagtagcaagg

SEQ ID NO: 28391 - DNA, 25 bp, Mus musculus
gaagctattgcagacttaccaggag

SEQ ID NO: 28392 - DNA, 25 bp, Mus musculus
gaagctcaaaagcacagacagcagt

SEQ ID NO: 28393 - DNA, 25 bp, Mus musculus
gaagctcacagctgagtttgaggag

SEQ ID NO: 28394 - DNA, 25 bp, Mus musculus
gaagctcagagcctggtaccactgc

SEQ ID NO: 28395 - DNA, 25 bp, Mus musculus
gaagctcagtttaagaataagatca

SEQ ID NO: 28396 - DNA, 25 bp, Mus musculus
gaagctcattcaatgccttgctgag

SEQ ID NO: 28397 - DNA, 25 bp, Mus musculus
gaagctcattttaagactcgttgga

SEQ ID NO: 28398 - DNA, 25 bp, Mus musculus
gaagctccagcttgcactcttggcc

SEQ ID NO: 28399 - DNA, 25 bp, Mus musculus
gaagctccaggaaacagttgaaccg

SEQ ID NO: 28400 - DNA, 25 bp, Mus musculus
gaagctccaggtaacccgcgcattt

SEQ ID NO: 28401 - DNA, 25 bp, Mus musculus
gaagctccaggtacgcacaagagaa

SEQ ID NO: 28402 - DNA, 25 bp, Mus musculus
gaagctccaggttacccgcgcattt

SEQ ID NO: 28403 - DNA, 25 bp, Mus musculus
gaagctccaggttcgcacaagagaa

SEQ ID NO: 28404 - DNA, 25 bp, Mus musculus
gaagctccgataacgtctctgtcac

SEQ ID NO: 28405 - DNA, 25 bp, Mus musculus
gaagctccgggaacaagtgaattcc

SEQ ID NO: 28406 - DNA, 25 bp, Mus musculus
gaagctcctacgcaagggacagcat

SEQ ID NO: 28407 - DNA, 25 bp, Mus musculus
gaagctcctgtttgaagaccttgga

SEQ ID NO: 28408 - DNA, 25 bp, Mus musculus
gaagctcgccaagcataatatgtat

SEQ ID NO: 28409 - DNA, 25 bp, Mus musculus
gaagctcgctgtactgcgggagaaa

SEQ ID NO: 28410 - DNA, 25 bp, Mus musculus
gaagctcgggctggttaaatgactt

SEQ ID NO: 28411 - DNA, 25 bp, Mus musculus
gaagctcgggtgatgtgtgccccac

SEQ ID NO: 28412 - DNA, 25 bp, Mus musculus
gaagctcgttaactttcagcagagt

SEQ ID NO: 28413 - DNA, 25 bp, Mus musculus
gaagctcgttatccattgcaaagac

SEQ ID NO: 28414 - DNA, 25 bp, Mus musculus
gaagctctcccttctggacattcga

SEQ ID NO: 28415 - DNA, 25 bp, Mus musculus
gaagctctcgtagactgctataaac

SEQ ID NO: 28416 - DNA, 25 bp, Mus musculus
gaagctctgcagcacgtgccagtgc

SEQ ID NO: 28417 - DNA, 25 bp, Mus musculus
gaagctctgggcatcaaatacccag

SEQ ID NO: 28418 - DNA, 25 bp, Mus musculus
gaagctctggtttcagacggagtgt

SEQ ID NO: 28419 - DNA, 25 bp, Mus musculus
gaagctcttggaacagtttgtctgt

SEQ ID NO: 28420 - DNA, 25 bp, Mus musculus
gaagctgaaactccaatcagatcgc

SEQ ID NO: 28421 - DNA, 25 bp, Mus musculus
gaagctgaacatgcaagccatcctt

SEQ ID NO: 28422 - DNA, 25 bp, Mus musculus
gaagctgaacgatctctgcatgatg

SEQ ID NO: 28423 - DNA, 25 bp, Mus musculus
gaagctgacaatactgtcatgttta

SEQ ID NO: 28424 - DNA, 25 bp, Mus musculus
gaagctgacgtagcttctctgaaca

SEQ ID NO: 28425 - DNA, 25 bp, Mus musculus
gaagctgagagcctgaaggaaacct

SEQ ID NO: 28426 - DNA, 25 bp, Mus musculus
gaagctgagcagagccttcggctcc

SEQ ID NO: 28427 - DNA, 25 bp, Mus musculus
gaagctgatgcggatctcatcaatg

SEQ ID NO: 28428 - DNA, 25 bp, Mus musculus
gaagctgattacctgagttcacacc

SEQ ID NO: 28429 - DNA, 25 bp, Mus musculus
gaagctgcaagctgatctcaggcca

SEQ ID NO: 28430 - DNA, 25 bp, Mus musculus
gaagctgcaggtgaatggaagaaag

SEQ ID NO: 28431 - DNA, 25 bp, Mus musculus
gaagctgcattgaacgggagctgca

SEQ ID NO: 28432 - DNA, 25 bp, Mus musculus
gaagctgcccgctgtggtgactgct

SEQ ID NO: 28433 - DNA, 25 bp, Mus musculus
gaagctgccctcttacaggagtccc

SEQ ID NO: 28434 - DNA, 25 bp, Mus musculus
gaagctgctcagctggctctagaga

SEQ ID NO: 28435 - DNA, 25 bp, Mus musculus
gaagctgctctttgaatacctgagg

SEQ ID NO: 28436 - DNA, 25 bp, Mus musculus
gaagctgctgcacgattcactcttg

SEQ ID NO: 28437 - DNA, 25 bp, Mus musculus
gaagctggaagttctgatgttccat

SEQ ID NO: 28438 - DNA, 25 bp, Mus musculus
gaagctggagcttagaggcctcata

SEQ ID NO: 28439 - DNA, 25 bp, Mus musculus
gaagctggatctgggaaagagacaa

SEQ ID NO: 28440 - DNA, 25 bp, Mus musculus
gaagctggatgggaaccaggacctt

SEQ ID NO: 28441 - DNA, 25 bp, Mus musculus
gaagctggcagtatgcttgccacgg

SEQ ID NO: 28442 - DNA, 25 bp, Mus musculus
gaagctggcggatgagcagtcacac

SEQ ID NO: 28443 - DNA, 25 bp, Mus musculus
gaagctggctgtgcgatttcacagt

SEQ ID NO: 28444 - DNA, 25 bp, Mus musculus
gaagctgggcactttggagtcagtt

SEQ ID NO: 28445 - DNA, 25 bp, Mus musculus
gaagctggtatcaatgaagttccca

SEQ ID NO: 28446 - DNA, 25 bp, Mus musculus
gaagctggtatctatgaagttccca

SEQ ID NO: 28447 - DNA, 25 bp, Mus musculus
gaagctggtcaactactactcctgt

SEQ ID NO: 28448 - DNA, 25 bp, Mus musculus
gaagctggtttccatcaccctgatg

SEQ ID NO: 28449 - DNA, 25 bp, Mus musculus
gaagctggtttcgatcaccctgatg

SEQ ID NO: 28450 - DNA, 25 bp, Mus musculus
gaagctgtactgcatctacgtcgcg

SEQ ID NO: 28451 - DNA, 25 bp, Mus musculus
gaagctgtagcgatgtccctgcata

SEQ ID NO: 28452 - DNA, 25 bp, Mus musculus
gaagctgtagcgttgtccctgcata

SEQ ID NO: 28453 - DNA, 25 bp, Mus musculus
gaagctgtcacaattaattaaccct

SEQ ID NO: 28454 - DNA, 25 bp, Mus musculus
gaagctgtccatgacgtctttgatc

SEQ ID NO: 28455 - DNA, 25 bp, Mus musculus
gaagctgtccctgaaggtcctctaa

SEQ ID NO: 28456 - DNA, 25 bp, Mus musculus
gaagctgtcctgcacatgccaggtg

SEQ ID NO: 28457 - DNA, 25 bp, Mus musculus
gaagctgtccttgtatgtagctgat

SEQ ID NO: 28458 - DNA, 25 bp, Mus musculus
gaagctgtgacagcacactcctttg

SEQ ID NO: 28459 - DNA, 25 bp, Mus musculus
gaagctgtgatcctgcctaaagagg

SEQ ID NO: 28460 - DNA, 25 bp, Mus musculus
gaagctgtgcttatccctgttggca

SEQ ID NO: 28461 - DNA, 25 bp, Mus musculus
gaagctgtgtgtgttagcagctgaa

SEQ ID NO: 28462 - DNA, 25 bp, Mus musculus
gaagctgttccgacattactacgtc

SEQ ID NO: 28463 - DNA, 25 bp, Mus musculus
gaagctgttggagaaatcatgtcac

SEQ ID NO: 28464 - DNA, 25 bp, Mus musculus
gaagcttaaaatcccttggccctga

SEQ ID NO: 28465 - DNA, 25 bp, Mus musculus
gaagcttactgctgatgccaagttt

SEQ ID NO: 28466 - DNA, 25 bp, Mus musculus
gaagcttatggccaaacagaatgca

SEQ ID NO: 28467 - DNA, 25 bp, Mus musculus
gaagcttatttcagaagtctaggga

SEQ ID NO: 28468 - DNA, 25 bp, Mus musculus
gaagcttcatcacagaagtgaagcg

SEQ ID NO: 28469 - DNA, 25 bp, Mus musculus
gaagcttcatgaggctcgttttaag

SEQ ID NO: 28470 - DNA, 25 bp, Mus musculus
gaagcttccggtttgagcagccaag

SEQ ID NO: 28471 - DNA, 25 bp, Mus musculus
gaagcttcctggtgttctggctgga

SEQ ID NO: 28472 - DNA, 25 bp, Mus musculus
gaagcttcctgtccaaattagagtc

SEQ ID NO: 28473 - DNA, 25 bp, Mus musculus
gaagcttcgagaaaacatgttggac

SEQ ID NO: 28474 - DNA, 25 bp, Mus musculus
gaagcttcgattatgatctggatta

SEQ ID NO: 28475 - DNA, 25 bp, Mus musculus
gaagcttcgccctatgagcctgtga

SEQ ID NO: 28476 - DNA, 25 bp, Mus musculus
gaagcttctgtggaccacaagcaga

SEQ ID NO: 28477 - DNA, 25 bp, Mus musculus
gaagcttctgttctcctccgagaag

SEQ ID NO: 28478 - DNA, 25 bp, Mus musculus
gaagctttctacaaggtcttccatc

SEQ ID NO: 28479 - DNA, 25 bp, Mus musculus
gaaggaaaaggagcgcaaggcaact

SEQ ID NO: 28480 - DNA, 25 bp, Mus musculus
gaaggaaaatacaaccatgcggcct

SEQ ID NO: 28481 - DNA, 25 bp, Mus musculus
gaaggaaaatctctcagcgactctg

SEQ ID NO: 28482 - DNA, 25 bp, Mus musculus
gaaggaaacagcaaaggcaccttga

SEQ ID NO: 28483 - DNA, 25 bp, Mus musculus
gaaggaaaccagtgagctcaaggag

SEQ ID NO: 28484 - DNA, 25 bp, Mus musculus
gaaggaaacctttgaccctgagaag

SEQ ID NO: 28485 - DNA, 25 bp, Mus musculus
gaaggaaactcttaaggaggaagct

SEQ ID NO: 28486 - DNA, 25 bp, Mus musculus
gaaggaaagcaacacagtcttttca

SEQ ID NO: 28487 - DNA, 25 bp, Mus musculus
gaaggaaatggaacacctacatttc

SEQ ID NO: 28488 - DNA, 25 bp, Mus musculus
gaaggaaattccaggctgcctcttt

SEQ ID NO: 28489 - DNA, 25 bp, Mus musculus
gaaggaaattcctggctgcctcttt

SEQ ID NO: 28490 - DNA, 25 bp, Mus musculus
gaaggaaattgcacgaggcccgagc

SEQ ID NO: 28491 - DNA, 25 bp, Mus musculus
gaaggaagagttacaacaagacatg

SEQ ID NO: 28492 - DNA, 25 bp, Mus musculus
gaaggaagagtttcaacaagacatg

SEQ ID NO: 28493 - DNA, 25 bp, Mus musculus
gaaggaagattttggaaacctgcat

SEQ ID NO: 28494 - DNA, 25 bp, Mus musculus
gaaggaagcccctgccgggaagcac

SEQ ID NO: 28495 - DNA, 25 bp, Mus musculus
gaaggaaggagcttacatcttccag

SEQ ID NO: 28496 - DNA, 25 bp, Mus musculus
gaaggaagtgattgatgccctccga

SEQ ID NO: 28497 - DNA, 25 bp, Mus musculus
gaaggaagtgcatcttcatacacca

SEQ ID NO: 28498 - DNA, 25 bp, Mus musculus
gaaggaatacactcagaagcttgcc

SEQ ID NO: 28499 - DNA, 25 bp, Mus musculus
gaaggacaaagcaaaatctacctga

SEQ ID NO: 28500 - DNA, 25 bp, Mus musculus
gaaggacaaagccttcaaggaacag

SEQ ID NO: 28501 - DNA, 25 bp, Mus musculus
gaaggacacggtcaggattaacctc

SEQ ID NO: 28502 - DNA, 25 bp, Mus musculus
gaaggacagaacagggatgaactac

SEQ ID NO: 28503 - DNA, 25 bp, Mus musculus
gaaggacagacgaatacagttcaaa

SEQ ID NO: 28504 - DNA, 25 bp, Mus musculus
gaaggacatgcactctccgcatttc

SEQ ID NO: 28505 - DNA, 25 bp, Mus musculus
gaaggaccaccattgcatatccagg

SEQ ID NO: 28506 - DNA, 25 bp, Mus musculus
gaaggaccatgcacttatgaccaac

SEQ ID NO: 28507 - DNA, 25 bp, Mus musculus
gaaggacccaaacaggagacattca

SEQ ID NO: 28508 - DNA, 25 bp, Mus musculus
gaaggacccatccagaggcagagtt

SEQ ID NO: 28509 - DNA, 25 bp, Mus musculus
gaaggaccggtctgtgagcacttgt

SEQ ID NO: 28510 - DNA, 25 bp, Mus musculus
gaaggacctggtacagtctctgaag

SEQ ID NO: 28511 - DNA, 25 bp, Mus musculus
gaaggacgggcctgatcaccaggcc

SEQ ID NO: 28512 - DNA, 25 bp, Mus musculus
gaaggacgggctggccttcaatgca

SEQ ID NO: 28513 - DNA, 25 bp, Mus musculus
gaaggactaagactcagcacccgtt

SEQ ID NO: 28514 - DNA, 25 bp, Mus musculus
gaaggactcacattccatctctact

SEQ ID NO: 28515 - DNA, 25 bp, Mus musculus
gaaggactcctcctctggtgccaga

SEQ ID NO: 28516 - DNA, 25 bp, Mus musculus
gaaggactctatcccacatactata

SEQ ID NO: 28517 - DNA, 25 bp, Mus musculus
gaaggacttagactggtctgcatcc

SEQ ID NO: 28518 - DNA, 25 bp, Mus musculus
gaaggacttagagtggtctgcatcc

SEQ ID NO: 28519 - DNA, 25 bp, Mus musculus
gaaggacttagattttcagatgaat

SEQ ID NO: 28520 - DNA, 25 bp, Mus musculus
gaaggacttccagtatgtggaccgt

SEQ ID NO: 28521 - DNA, 25 bp, Mus musculus
gaaggagaacttctgccgcaatcca

SEQ ID NO: 28522 - DNA, 25 bp, Mus musculus
gaaggagaagcagattaagaaacaa

SEQ ID NO: 28523 - DNA, 25 bp, Mus musculus
gaaggagacactaaccagaagctac

SEQ ID NO: 28524 - DNA, 25 bp, Mus musculus
gaaggagactattgaacagaaaagg

SEQ ID NO: 28525 - DNA, 25 bp, Mus musculus
gaaggagagtacacacatcacaaag

SEQ ID NO: 28526 - DNA, 25 bp, Mus musculus
gaaggagattctataaaggcatatg

SEQ ID NO: 28527 - DNA, 25 bp, Mus musculus
gaaggagcctataagaactttttca

SEQ ID NO: 28528 - DNA, 25 bp, Mus musculus
gaaggagctcctttgtcacaccttg

SEQ ID NO: 28529 - DNA, 25 bp, Mus musculus
gaaggagctcttcaatgagaaatac

SEQ ID NO: 28530 - DNA, 25 bp, Mus musculus
gaaggagctgaatgccctctatgat

SEQ ID NO: 28531 - DNA, 25 bp, Mus musculus
gaaggagcttgcagaaatcacgctg

SEQ ID NO: 28532 - DNA, 25 bp, Mus musculus
gaaggagctttgacagcttttcgca

SEQ ID NO: 28533 - DNA, 25 bp, Mus musculus
gaaggaggaacagatcctggctcta

SEQ ID NO: 28534 - DNA, 25 bp, Mus musculus
gaaggaggatgcagcctatgactgc

SEQ ID NO: 28535 - DNA, 25 bp, Mus musculus
gaaggaggatgctgcctatgactgc

SEQ ID NO: 28536 - DNA, 25 bp, Mus musculus
gaaggaggccctcaacattattggg

SEQ ID NO: 28537 - DNA, 25 bp, Mus musculus
gaaggagggcaggtagcctttctcc

SEQ ID NO: 28538 - DNA, 25 bp, Mus musculus
gaaggaggtccagagcactgaagac

SEQ ID NO: 28539 - DNA, 25 bp, Mus musculus
gaaggaggtgcttggtcattccatt

SEQ ID NO: 28540 - DNA, 25 bp, Mus musculus
gaaggaggttctcatgactccaccc

SEQ ID NO: 28541 - DNA, 25 bp, Mus musculus
gaaggagtctacagagaattattct

SEQ ID NO: 28542 - DNA, 25 bp, Mus musculus
gaaggagtctctcgctctggtttcc

SEQ ID NO: 28543 - DNA, 25 bp, Mus musculus
gaaggagtctctggctctggtttcc

SEQ ID NO: 28544 - DNA, 25 bp, Mus musculus
gaaggagtcttcaccccggtgtgca

SEQ ID NO: 28545 - DNA, 25 bp, Mus musculus
gaaggagtgctcttattctccacag

SEQ ID NO: 28546 - DNA, 25 bp, Mus musculus
gaaggagtttaagcaggagcatcgc

SEQ ID NO: 28547 - DNA, 25 bp, Mus musculus
gaaggagtttatagactggatgcat

SEQ ID NO: 28548 - DNA, 25 bp, Mus musculus
gaaggataaggagcagaaacaaaca

SEQ ID NO: 28549 - DNA, 25 bp, Mus musculus
gaaggatatcaagcccgggctcaag

SEQ ID NO: 28550 - DNA, 25 bp, Mus musculus
gaaggatatccgaagtacagaaagc

SEQ ID NO: 28551 - DNA, 25 bp, Mus musculus
gaaggatatccgtagtacagaaagc

SEQ ID NO: 28552 - DNA, 25 bp, Mus musculus
gaaggatcatcgaatggcccctgtc

SEQ ID NO: 28553 - DNA, 25 bp, Mus musculus
gaaggatccctgtggccttctgata

SEQ ID NO: 28554 - DNA, 25 bp, Mus musculus
gaaggatcgagtaggcggctttcct

SEQ ID NO: 28555 - DNA, 25 bp, Mus musculus
gaaggatctgtcctctcggagtgaa

SEQ ID NO: 28556 - DNA, 25 bp, Mus musculus
gaaggatgacagctacgcaccaaag

SEQ ID NO: 28557 - DNA, 25 bp, Mus musculus
gaaggatgacatccagacaaagtcc

SEQ ID NO: 28558 - DNA, 25 bp, Mus musculus
gaaggatgagttaagtttctcagag

SEQ ID NO: 28559 - DNA, 25 bp, Mus musculus
gaaggatgagtttagtttctcagag

SEQ ID NO: 28560 - DNA, 25 bp, Mus musculus
gaaggatgcacgaatcccaaggtta

SEQ ID NO: 28561 - DNA, 25 bp, Mus musculus
gaaggatggaaaggaatatccacac

SEQ ID NO: 28562 - DNA, 25 bp, Mus musculus
gaaggatgggagctgcgtgaggaac

SEQ ID NO: 28563 - DNA, 25 bp, Mus musculus
gaaggattccttggctgaaccgtgt

SEQ ID NO: 28564 - DNA, 25 bp, Mus musculus
gaaggattgcggtgctgtccacatg

SEQ ID NO: 28565 - DNA, 25 bp, Mus musculus
gaaggattgtggtccctcctcacct

SEQ ID NO: 28566 - DNA, 25 bp, Mus musculus
gaaggatttctgcttaagtataccc

SEQ ID NO: 28567 - DNA, 25 bp, Mus musculus
gaaggatttttgatgatgtgtccag

SEQ ID NO: 28568 - DNA, 25 bp, Mus musculus
gaaggcaaaaccacctaagcttagt

SEQ ID NO: 28569 - DNA, 25 bp, Mus musculus
gaaggcaaaacctcctaagcttagt

SEQ ID NO: 28570 - DNA, 25 bp, Mus musculus
gaaggcaaacgagagaagatctgct

SEQ ID NO: 28571 - DNA, 25 bp, Mus musculus
gaaggcaaatacatgcagggactga

SEQ ID NO: 28572 - DNA, 25 bp, Mus musculus
gaaggcaatgtcttccctcttttcg

SEQ ID NO: 28573 - DNA, 25 bp, Mus musculus
gaaggcacaaatgcagaaccactcg

SEQ ID NO: 28574 - DNA, 25 bp, Mus musculus
gaaggcacagatggaattacaggac

SEQ ID NO: 28575 - DNA, 25 bp, Mus musculus
gaaggcacagtaacccctccagtat

SEQ ID NO: 28576 - DNA, 25 bp, Mus musculus
gaaggcaccaaccatgaaatcagca

SEQ ID NO: 28577 - DNA, 25 bp, Mus musculus
gaaggcaccggcagagtccacccat

SEQ ID NO: 28578 - DNA, 25 bp, Mus musculus
gaaggcaccggctgagtccacccat

SEQ ID NO: 28579 - DNA, 25 bp, Mus musculus
gaaggcacctgacttcccagatgag

SEQ ID NO: 28580 - DNA, 25 bp, Mus musculus
gaaggcacctgagttcccagatgag

SEQ ID NO: 28581 - DNA, 25 bp, Mus musculus
gaaggcacctttgggaaggtgtact

SEQ ID NO: 28582 - DNA, 25 bp, Mus musculus
gaaggcactacaaagtgttggacag

SEQ ID NO: 28583 - DNA, 25 bp, Mus musculus
gaaggcagataaaccaaaggcgaag

SEQ ID NO: 28584 - DNA, 25 bp, Mus musculus
gaaggcagcagaggtctacacccgg

SEQ ID NO: 28585 - DNA, 25 bp, Mus musculus
gaaggcagccttgtcagcctcacag

SEQ ID NO: 28586 - DNA, 25 bp, Mus musculus
gaaggcagcttctatactctagaga

SEQ ID NO: 28587 - DNA, 25 bp, Mus musculus
gaaggcaggcagtacttcgatttcc

SEQ ID NO: 28588 - DNA, 25 bp, Mus musculus
gaaggcatagttgcatgcagtgtgt

SEQ ID NO: 28589 - DNA, 25 bp, Mus musculus
gaaggcatcaagtatcgccggaatg

SEQ ID NO: 28590 - DNA, 25 bp, Mus musculus
gaaggcatccatctcagccagtctg

SEQ ID NO: 28591 - DNA, 25 bp, Mus musculus
gaaggcatcgatgagccgctggccc

SEQ ID NO: 28592 - DNA, 25 bp, Mus musculus
gaaggcatgacggtttgagctctcg

SEQ ID NO: 28593 - DNA, 25 bp, Mus musculus
gaaggcattattcctggagcaaaaa

SEQ ID NO: 28594 - DNA, 25 bp, Mus musculus
gaaggcattattgctggagcaaaaa

SEQ ID NO: 28595 - DNA, 25 bp, Mus musculus
gaaggccacgacaccaccactagtg

SEQ ID NO: 28596 - DNA, 25 bp, Mus musculus
gaaggccagcacgttcaatatttga

SEQ ID NO: 28597 - DNA, 25 bp, Mus musculus
gaaggccatagccacaatgcttaac

SEQ ID NO: 28598 - DNA, 25 bp, Mus musculus
gaaggccatcatgacttacgtgtcc

SEQ ID NO: 28599 - DNA, 25 bp, Mus musculus
gaaggccatgttagatgctgctctg

SEQ ID NO: 28600 - DNA, 25 bp, Mus musculus
gaaggccattgttcaaaagctccgc

SEQ ID NO: 28601 - DNA, 25 bp, Mus musculus
gaaggccccaacaacgtgcaactta

SEQ ID NO: 28602 - DNA, 25 bp, Mus musculus
gaaggccctcgagacattctggatg

SEQ ID NO: 28603 - DNA, 25 bp, Mus musculus
gaaggccctttattttgagtacaca

SEQ ID NO: 28604 - DNA, 25 bp, Mus musculus
gaaggcctgaaccagcctacagatg

SEQ ID NO: 28605 - DNA, 25 bp, Mus musculus
gaaggcctgactgttgatgacatca

SEQ ID NO: 28606 - DNA, 25 bp, Mus musculus
gaaggcctgcagttccttttagata

SEQ ID NO: 28607 - DNA, 25 bp, Mus musculus
gaaggcctttgtccaacaacttgtt

SEQ ID NO: 28608 - DNA, 25 bp, Mus musculus
gaaggcgaaggtctccttctccagc

SEQ ID NO: 28609 - DNA, 25 bp, Mus musculus
gaaggcgaagtgcaccaccattgaa

SEQ ID NO: 28610 - DNA, 25 bp, Mus musculus
gaaggcggcagttcactacacggtc

SEQ ID NO: 28611 - DNA, 25 bp, Mus musculus
gaaggcgtttccgtaaagaatatct

SEQ ID NO: 28612 - DNA, 25 bp, Mus musculus
gaaggctaagtatgtcctgctctgc

SEQ ID NO: 28613 - DNA, 25 bp, Mus musculus
gaaggctatccagagatacgtgcag

SEQ ID NO: 28614 - DNA, 25 bp, Mus musculus
gaaggctatggattgtaccctcgat

SEQ ID NO: 28615 - DNA, 25 bp, Mus musculus
gaaggctcctttagatgctcctgtg

SEQ ID NO: 28616 - DNA, 25 bp, Mus musculus
gaaggctccttttgatgctcctgtg

SEQ ID NO: 28617 - DNA, 25 bp, Mus musculus
gaaggctctacagagagtatatatg

SEQ ID NO: 28618 - DNA, 25 bp, Mus musculus
gaaggctctgagattcgactagcaa

SEQ ID NO: 28619 - DNA, 25 bp, Mus musculus
gaaggctctttcttgtggatatatc

SEQ ID NO: 28620 - DNA, 25 bp, Mus musculus
gaaggctgccgaagtgtcagtgact

SEQ ID NO: 28621 - DNA, 25 bp, Mus musculus
gaaggctgccttgactcctgtctgc

SEQ ID NO: 28622 - DNA, 25 bp, Mus musculus
gaaggctgctattgaaagagagtat

SEQ ID NO: 28623 - DNA, 25 bp, Mus musculus
gaaggctggaattccttgtccaaca

SEQ ID NO: 28624 - DNA, 25 bp, Mus musculus
gaaggctggagcattcacctgtctc

SEQ ID NO: 28625 - DNA, 25 bp, Mus musculus
gaaggctgggaacccgatgacaacc

SEQ ID NO: 28626 - DNA, 25 bp, Mus musculus
gaaggctggtgtctacaagctgaca

SEQ ID NO: 28627 - DNA, 25 bp, Mus musculus
gaaggctgtcacacacgtgggcatg

SEQ ID NO: 28628 - DNA, 25 bp, Mus musculus
gaaggctgtcccaggcaatagcttt

SEQ ID NO: 28629 - DNA, 25 bp, Mus musculus
gaaggctgtcgaacccttgtataca

SEQ ID NO: 28630 - DNA, 25 bp, Mus musculus
gaaggctgtgaaaaaatcagtcagc

SEQ ID NO: 28631 - DNA, 25 bp, Mus musculus
gaaggctgtttatttcgttcatcca

SEQ ID NO: 28632 - DNA, 25 bp, Mus musculus
gaaggcttaccagagttcacgacag

SEQ ID NO: 28633 - DNA, 25 bp, Mus musculus
gaaggcttcgcaggtccgaactgct

SEQ ID NO: 28634 - DNA, 25 bp, Mus musculus
gaaggcttgctcaggaagatccgga

SEQ ID NO: 28635 - DNA, 25 bp, Mus musculus
gaagggaaaaatgcaagggataaag

SEQ ID NO: 28636 - DNA, 25 bp, Mus musculus
gaagggaaactgtcgataacgctcg

SEQ ID NO: 28637 - DNA, 25 bp, Mus musculus
gaagggaaagcctcttaagaagctt

SEQ ID NO: 28638 - DNA, 25 bp, Mus musculus
gaagggaaatcaagaggctccaaga

SEQ ID NO: 28639 - DNA, 25 bp, Mus musculus
gaagggaagggtgtttctgaacact

SEQ ID NO: 28640 - DNA, 25 bp, Mus musculus
gaagggaatgctccaaacgacagct

SEQ ID NO: 28641 - DNA, 25 bp, Mus musculus
gaagggacagatcacaggtcaatca

SEQ ID NO: 28642 - DNA, 25 bp, Mus musculus
gaagggacagatgacaggtcaatca

SEQ ID NO: 28643 - DNA, 25 bp, Mus musculus
gaagggacccagaatcagggcaaaa

SEQ ID NO: 28644 - DNA, 25 bp, Mus musculus
gaagggactctcagaaagaagaggc

SEQ ID NO: 28645 - DNA, 25 bp, Mus musculus
gaagggacttctgcagaggaattgt

SEQ ID NO: 28646 - DNA, 25 bp, Mus musculus
gaagggagcggcagcagtgaaggat

SEQ ID NO: 28647 - DNA, 25 bp, Mus musculus
gaagggataaccttctgctttaagg

SEQ ID NO: 28648 - DNA, 25 bp, Mus musculus
gaagggatacacagttgggtttcag

SEQ ID NO: 28649 - DNA, 25 bp, Mus musculus
gaagggatcacagatgcagctacca

SEQ ID NO: 28650 - DNA, 25 bp, Mus musculus
gaagggatggaccaaatcaataagg

SEQ ID NO: 28651 - DNA, 25 bp, Mus musculus
gaagggatgttgtcagagccaagct

SEQ ID NO: 28652 - DNA, 25 bp, Mus musculus
gaagggattccaatgctggttaccc

SEQ ID NO: 28653 - DNA, 25 bp, Mus musculus
gaagggcaggtatgtcccctgtgca

SEQ ID NO: 28654 - DNA, 25 bp, Mus musculus
gaagggcagttaactgccagggacc

SEQ ID NO: 28655 - DNA, 25 bp, Mus musculus
gaagggccagatggaagccatcccc

SEQ ID NO: 28656 - DNA, 25 bp, Mus musculus
gaagggcccagcctttcgtagcagc

SEQ ID NO: 28657 - DNA, 25 bp, Mus musculus
gaagggctatgcagacctgtacagc

SEQ ID NO: 28658 - DNA, 25 bp, Mus musculus
gaagggctggaatatcttgacaaac

SEQ ID NO: 28659 - DNA, 25 bp, Mus musculus
gaagggctggattgatctccacaga

SEQ ID NO: 28660 - DNA, 25 bp, Mus musculus
gaagggcttcccctccgttctgagc

SEQ ID NO: 28661 - DNA, 25 bp, Mus musculus
gaagggcttgaaagtggaccagcaa

SEQ ID NO: 28662 - DNA, 25 bp, Mus musculus
gaagggtacactcggtttatcctga

SEQ ID NO: 28663 - DNA, 25 bp, Mus musculus
gaagggtcacgaggacatttgctcc

SEQ ID NO: 28664 - DNA, 25 bp, Mus musculus
gaagggtgacccagttatttataat

SEQ ID NO: 28665 - DNA, 25 bp, Mus musculus
gaagggttgcaaggttgtcatttgt

SEQ ID NO: 28666 - DNA, 25 bp, Mus musculus
gaaggtaattttgagactcctgaag

SEQ ID NO: 28667 - DNA, 25 bp, Mus musculus
gaaggtaggcaacactggttccctc

SEQ ID NO: 28668 - DNA, 25 bp, Mus musculus
gaaggtaggcaagactggttccctc

SEQ ID NO: 28669 - DNA, 25 bp, Mus musculus
gaaggtatcagtggctgatcgcctg

SEQ ID NO: 28670 - DNA, 25 bp, Mus musculus
gaaggtatcccatctgatccccaaa

SEQ ID NO: 28671 - DNA, 25 bp, Mus musculus
gaaggtatcgagacaactgtcatga

SEQ ID NO: 28672 - DNA, 25 bp, Mus musculus
gaaggtattagaaatcttggaactg

SEQ ID NO: 28673 - DNA, 25 bp, Mus musculus
gaaggtattagatatcttggaactg

SEQ ID NO: 28674 - DNA, 25 bp, Mus musculus
gaaggtcagctatctaatgattgcc

SEQ ID NO: 28675 - DNA, 25 bp, Mus musculus
gaaggtcatcgggtaattaatctgg

SEQ ID NO: 28676 - DNA, 25 bp, Mus musculus
gaaggtccccaaagcagctgccggg

SEQ ID NO: 28677 - DNA, 25 bp, Mus musculus
gaaggtccccaatgcagctgccggg

SEQ ID NO: 28678 - DNA, 25 bp, Mus musculus
gaaggtcctggaaacacctgcatgg

SEQ ID NO: 28679 - DNA, 25 bp, Mus musculus
gaaggtcggcatgcaaatccctcga

SEQ ID NO: 28680 - DNA, 25 bp, Mus musculus
gaaggtcttcctgtactgttctcca

SEQ ID NO: 28681 - DNA, 25 bp, Mus musculus
gaaggtgaaacctcagccgcccctg

SEQ ID NO: 28682 - DNA, 25 bp, Mus musculus
gaaggtgaagatgacacctttctaa

SEQ ID NO: 28683 - DNA, 25 bp, Mus musculus
gaaggtgaatcgctcctacactccc

SEQ ID NO: 28684 - DNA, 25 bp, Mus musculus
gaaggtgaccaggaagaatgccttt

SEQ ID NO: 28685 - DNA, 25 bp, Mus musculus
gaaggtgactctgattctcatagct

SEQ ID NO: 28686 - DNA, 25 bp, Mus musculus
gaaggtgcagctctccgtaaagacc

SEQ ID NO: 28687 - DNA, 25 bp, Mus musculus
gaaggtgccctgtaattctcagttg

SEQ ID NO: 28688 - DNA, 25 bp, Mus musculus
gaaggtgctggaactgtgcccatcc

SEQ ID NO: 28689 - DNA, 25 bp, Mus musculus
gaaggtggacggataactgacccca

SEQ ID NO: 28690 - DNA, 25 bp, Mus musculus
gaaggtggcccctgtgctgttattg

SEQ ID NO: 28691 - DNA, 25 bp, Mus musculus
gaaggtgggactggatgctacaaac

SEQ ID NO: 28692 - DNA, 25 bp, Mus musculus
gaaggtgggagtcaatcactttgac

SEQ ID NO: 28693 - DNA, 25 bp, Mus musculus
gaaggtgtcagaaggcctggaccat

SEQ ID NO: 28694 - DNA, 25 bp, Mus musculus
gaaggttaaaacttcagcagcccct

SEQ ID NO: 28695 - DNA, 25 bp, Mus musculus
gaaggttcagaactcacaaggaccc

SEQ ID NO: 28696 - DNA, 25 bp, Mus musculus
gaaggttccgcgaaagcgtcagtcg

SEQ ID NO: 28697 - DNA, 25 bp, Mus musculus
gaaggttcctaccaatgcctctgtc

SEQ ID NO: 28698 - DNA, 25 bp, Mus musculus
gaaggttcctacgaatgcctctgtc

SEQ ID NO: 28699 - DNA, 25 bp, Mus musculus
gaaggttcgcctcatgatcactgga

SEQ ID NO: 28700 - DNA, 25 bp, Mus musculus
gaaggttcttcatatggatcagaac

SEQ ID NO: 28701 - DNA, 25 bp, Mus musculus
gaaggttcttctgggactgcttggt

SEQ ID NO: 28702 - DNA, 25 bp, Mus musculus
gaaggttggcaccattttatctggg

SEQ ID NO: 28703 - DNA, 25 bp, Mus musculus
gaaggttgttgtcacggcaaaagcc

SEQ ID NO: 28704 - DNA, 25 bp, Mus musculus
gaaggttgtttttgcctcaccgaag

SEQ ID NO: 28705 - DNA, 25 bp, Mus musculus
gaaggtttccagtgcatactttatc

SEQ ID NO: 28706 - DNA, 25 bp, Mus musculus
gaaggtttcctctggatgctgccat

SEQ ID NO: 28707 - DNA, 25 bp, Mus musculus
gaaggtttggatacgagatgtgaaa

SEQ ID NO: 28708 - DNA, 25 bp, Mus musculus
gaagtaaaacttcgagatgaccagt

SEQ ID NO: 28709 - DNA, 25 bp, Mus musculus
gaagtaaaatcttgtcctaggaaga

SEQ ID NO: 28710 - DNA, 25 bp, Mus musculus
gaagtaaagagcgacccgactccct

SEQ ID NO: 28711 - DNA, 25 bp, Mus musculus
gaagtaacatacagagaagagaagc

SEQ ID NO: 28712 - DNA, 25 bp, Mus musculus
gaagtaaccagaaccctccaagctg

SEQ ID NO: 28713 - DNA, 25 bp, Mus musculus
gaagtaaccatcaagcgagggcctg

SEQ ID NO: 28714 - DNA, 25 bp, Mus musculus
gaagtaactcaagatgagcaagcta

SEQ ID NO: 28715 - DNA, 25 bp, Mus musculus
gaagtaactcatccaagttcaccag

SEQ ID NO: 28716 - DNA, 25 bp, Mus musculus
gaagtaaggtttcacttggccagtg

SEQ ID NO: 28717 - DNA, 25 bp, Mus musculus
gaagtaatgtcatgggctcaggaag

SEQ ID NO: 28718 - DNA, 25 bp, Mus musculus
gaagtacaaggctgtgtccatcagc

SEQ ID NO: 28719 - DNA, 25 bp, Mus musculus
gaagtacaccatcgtggtgtcagcc

SEQ ID NO: 28720 - DNA, 25 bp, Mus musculus
gaagtaccagctcaaatcccagtca

SEQ ID NO: 28721 - DNA, 25 bp, Mus musculus
gaagtaccccgagaagctcgttatc

SEQ ID NO: 28722 - DNA, 25 bp, Mus musculus
gaagtacgttctgtgataaaaaata

SEQ ID NO: 28723 - DNA, 25 bp, Mus musculus
gaagtagaacagaacaaaatgctgg

SEQ ID NO: 28724 - DNA, 25 bp, Mus musculus
gaagtagaacttctgcagctaagaa

SEQ ID NO: 28725 - DNA, 25 bp, Mus musculus
gaagtagaagcaggaattgaagatc

SEQ ID NO: 28726 - DNA, 25 bp, Mus musculus
gaagtagacacctgactgcttctgt

SEQ ID NO: 28727 - DNA, 25 bp, Mus musculus
gaagtagcactacaccctgtgaagg

SEQ ID NO: 28728 - DNA, 25 bp, Mus musculus
gaagtagcgaatgcctcagtcaggg

SEQ ID NO: 28729 - DNA, 25 bp, Mus musculus
gaagtagctgggatcaccgtctttc

SEQ ID NO: 28730 - DNA, 25 bp, Mus musculus
gaagtaggactgcaccatacacacc

SEQ ID NO: 28731 - DNA, 25 bp, Mus musculus
gaagtaggtatttggtcccttggag

SEQ ID NO: 28732 - DNA, 25 bp, Mus musculus
gaagtagtgaagaccacaggaagga

SEQ ID NO: 28733 - DNA, 25 bp, Mus musculus
gaagtagtgggagctgttgatatac

SEQ ID NO: 28734 - DNA, 25 bp, Mus musculus
gaagtatcaatcctatcggatttca

SEQ ID NO: 28735 - DNA, 25 bp, Mus musculus
gaagtatgagcggaccttcatggca

SEQ ID NO: 28736 - DNA, 25 bp, Mus musculus
gaagtatggagaaacggctaatgag

SEQ ID NO: 28737 - DNA, 25 bp, Mus musculus
gaagtatgtctccatctcagtgccc

SEQ ID NO: 28738 - DNA, 25 bp, Mus musculus
gaagtatgttggatgtttgaacacc

SEQ ID NO: 28739 - DNA, 25 bp, Mus musculus
gaagtattccaccagcctctatgcc

SEQ ID NO: 28740 - DNA, 25 bp, Mus musculus
gaagtattccagaaggctgtcacac

SEQ ID NO: 28741 - DNA, 25 bp, Mus musculus
gaagtattgggaagccctaaactcg

SEQ ID NO: 28742 - DNA, 25 bp, Mus musculus
gaagtatttgatgctttaatggtgg

SEQ ID NO: 28743 - DNA, 25 bp, Mus musculus
gaagtatttggtggaccactatcac

SEQ ID NO: 28744 - DNA, 25 bp, Mus musculus
gaagtattttattctccacggtcat

SEQ ID NO: 28745 - DNA, 25 bp, Mus musculus
gaagtattttcacatcagtgacagc

SEQ ID NO: 28746 - DNA, 25 bp, Mus musculus
gaagtcacagatccagccaaatgca

SEQ ID NO: 28747 - DNA, 25 bp, Mus musculus
gaagtcacaggagctaagatgttca

SEQ ID NO: 28748 - DNA, 25 bp, Mus musculus
gaagtcacatctagcatcctgtctg

SEQ ID NO: 28749 - DNA, 25 bp, Mus musculus
gaagtcacccttggataagatccag

SEQ ID NO: 28750 - DNA, 25 bp, Mus musculus
gaagtcacgcaacaagctgatactg

SEQ ID NO: 28751 - DNA, 25 bp, Mus musculus
gaagtcacttctagaagctccaggt

SEQ ID NO: 28752 - DNA, 25 bp, Mus musculus
gaagtcacttcttgaagctccaggt

SEQ ID NO: 28753 - DNA, 25 bp, Mus musculus
gaagtcagacatatgaaactgagga

SEQ ID NO: 28754 - DNA, 25 bp, Mus musculus
gaagtcaggtgaagagctttggaaa

SEQ ID NO: 28755 - DNA, 25 bp, Mus musculus
gaagtcatattggatacagatgagc

SEQ ID NO: 28756 - DNA, 25 bp, Mus musculus
gaagtcatgaattcagccgagagcc

SEQ ID NO: 28757 - DNA, 25 bp, Mus musculus
gaagtcattattctcacagagtacg

SEQ ID NO: 28758 - DNA, 25 bp, Mus musculus
gaagtcattattgtcacagagtacg

SEQ ID NO: 28759 - DNA, 25 bp, Mus musculus
gaagtcatttcagaactggccggac

SEQ ID NO: 28760 - DNA, 25 bp, Mus musculus
gaagtccaagtctatcattgacgaa

SEQ ID NO: 28761 - DNA, 25 bp, Mus musculus
gaagtccacggccttgatgcctatg

SEQ ID NO: 28762 - DNA, 25 bp, Mus musculus
gaagtccaggacacagaccgccaag

SEQ ID NO: 28763 - DNA, 25 bp, Mus musculus
gaagtccaggctagtcacctttgta

SEQ ID NO: 28764 - DNA, 25 bp, Mus musculus
gaagtccaggttcacaccagcaagc

SEQ ID NO: 28765 - DNA, 25 bp, Mus musculus
gaagtccaggttgacaccagcaagc

SEQ ID NO: 28766 - DNA, 25 bp, Mus musculus
gaagtccagtcttggctcacgttcc

SEQ ID NO: 28767 - DNA, 25 bp, Mus musculus
gaagtccctgaaaactatggtggaa

SEQ ID NO: 28768 - DNA, 25 bp, Mus musculus
gaagtcctacggcattatggagatt

SEQ ID NO: 28769 - DNA, 25 bp, Mus musculus
gaagtcctagaagtttctgaggccc

SEQ ID NO: 28770 - DNA, 25 bp, Mus musculus
gaagtcctcactgctttaagacaag

SEQ ID NO: 28771 - DNA, 25 bp, Mus musculus
gaagtcctcatcaccggcatatcag

SEQ ID NO: 28772 - DNA, 25 bp, Mus musculus
gaagtcctccctcaagctcatggct

SEQ ID NO: 28773 - DNA, 25 bp, Mus musculus
gaagtcctcgatatgtcagacgatg

SEQ ID NO: 28774 - DNA, 25 bp, Mus musculus
gaagtccttactggccatagtggag

SEQ ID NO: 28775 - DNA, 25 bp, Mus musculus
gaagtccttgcagagggattttgca

SEQ ID NO: 28776 - DNA, 25 bp, Mus musculus
gaagtcgaggaaaggccaacaatcc

SEQ ID NO: 28777 - DNA, 25 bp, Mus musculus
gaagtcgagttccagcgtgcaccta

SEQ ID NO: 28778 - DNA, 25 bp, Mus musculus
gaagtcgctgagaacttttcatccg

SEQ ID NO: 28779 - DNA, 25 bp, Mus musculus
gaagtcggacttcagaaaggacttt

SEQ ID NO: 28780 - DNA, 25 bp, Mus musculus
gaagtcggtgtgaagctgaacagac

SEQ ID NO: 28781 - DNA, 25 bp, Mus musculus
gaagtcggtgtgtatgaagccctga

SEQ ID NO: 28782 - DNA, 25 bp, Mus musculus
gaagtcgtcaccatgtgcgacctga

SEQ ID NO: 28783 - DNA, 25 bp, Mus musculus
gaagtcgtcaggttattctggacaa

SEQ ID NO: 28784 - DNA, 25 bp, Mus musculus
gaagtcgtcctaatgtgtcaggcca

SEQ ID NO: 28785 - DNA, 25 bp, Mus musculus
gaagtctaaagctaagccaaacggc

SEQ ID NO: 28786 - DNA, 25 bp, Mus musculus
gaagtctattagctcctgtcgccca

SEQ ID NO: 28787 - DNA, 25 bp, Mus musculus
gaagtctcagctgcagaatgaggaa

SEQ ID NO: 28788 - DNA, 25 bp, Mus musculus
gaagtctgaattccggccagtgagc

SEQ ID NO: 28789 - DNA, 25 bp, Mus musculus
gaagtctgacctgtttgagggttca

SEQ ID NO: 28790 - DNA, 25 bp, Mus musculus
gaagtctgatctgaacaagtagcaa

SEQ ID NO: 28791 - DNA, 25 bp, Mus musculus
gaagtctgcaatgaccccaaggtgc

SEQ ID NO: 28792 - DNA, 25 bp, Mus musculus
gaagtctggtccttgtgttccacac

SEQ ID NO: 28793 - DNA, 25 bp, Mus musculus
gaagtctgtactgctaactctgaga

SEQ ID NO: 28794 - DNA, 25 bp, Mus musculus
gaagtgaaattccaaaagacagaag

SEQ ID NO: 28795 - DNA, 25 bp, Mus musculus
gaagtgaaccatgaaggaccgatct

SEQ ID NO: 28796 - DNA, 25 bp, Mus musculus
gaagtgaagaatggcattccttcta

SEQ ID NO: 28797 - DNA, 25 bp, Mus musculus
gaagtgaagagcagacgaccagaag

SEQ ID NO: 28798 - DNA, 25 bp, Mus musculus
gaagtgaagctcattcaatgccttg

SEQ ID NO: 28799 - DNA, 25 bp, Mus musculus
gaagtgacaaaattggcatggtgga

SEQ ID NO: 28800 - DNA, 25 bp, Mus musculus
gaagtgacccgactcttgaccatgg

SEQ ID NO: 28801 - DNA, 25 bp, Mus musculus
gaagtgactggccacgctcatgtgc

SEQ ID NO: 28802 - DNA, 25 bp, Mus musculus
gaagtgagcctcagcaatgctctgc

SEQ ID NO: 28803 - DNA, 25 bp, Mus musculus
gaagtgaggatgcaagcaactccta

SEQ ID NO: 28804 - DNA, 25 bp, Mus musculus
gaagtgaggcaggaaaaccgagaaa

SEQ ID NO: 28805 - DNA, 25 bp, Mus musculus
gaagtgagtcacatgctggagtcca

SEQ ID NO: 28806 - DNA, 25 bp, Mus musculus
gaagtgataggagccgatttctaga

SEQ ID NO: 28807 - DNA, 25 bp, Mus musculus
gaagtgatcagcgagtactcccgca

SEQ ID NO: 28808 - DNA, 25 bp, Mus musculus
gaagtgatccaaatctggcccggta

SEQ ID NO: 28809 - DNA, 25 bp, Mus musculus
gaagtgatcccttgcaagatctgtg

SEQ ID NO: 28810 - DNA, 25 bp, Mus musculus
gaagtgatggttagagagtgtccac

SEQ ID NO: 28811 - DNA, 25 bp, Mus musculus
gaagtgattgatgccctccgagtga

SEQ ID NO: 28812 - DNA, 25 bp, Mus musculus
gaagtgattgctcaaggacctccct

SEQ ID NO: 28813 - DNA, 25 bp, Mus musculus
gaagtgcaatcaactctctagacgc

SEQ ID NO: 28814 - DNA, 25 bp, Mus musculus
gaagtgcaatgagaccgccaagtcc

SEQ ID NO: 28815 - DNA, 25 bp, Mus musculus
gaagtgcacacgaaggagcagatgc

SEQ ID NO: 28816 - DNA, 25 bp, Mus musculus
gaagtgcagcggcacctgcagactc

SEQ ID NO: 28817 - DNA, 25 bp, Mus musculus
gaagtgcatcttcatacaccaccac

SEQ ID NO: 28818 - DNA, 25 bp, Mus musculus
gaagtgcattgctattgagtgctac

SEQ ID NO: 28819 - DNA, 25 bp, Mus musculus
gaagtgccaaggataaggcctgaca

SEQ ID NO: 28820 - DNA, 25 bp, Mus musculus
gaagtgcccctagacacatggaact

SEQ ID NO: 28821 - DNA, 25 bp, Mus musculus
gaagtgccgctggagaaagaacata

SEQ ID NO: 28822 - DNA, 25 bp, Mus musculus
gaagtgcgtcctagtggacaaccag

SEQ ID NO: 28823 - DNA, 25 bp, Mus musculus
gaagtgcgtccttgtggacaaccag

SEQ ID NO: 28824 - DNA, 25 bp, Mus musculus
gaagtgcgtgtacacgtacatccag

SEQ ID NO: 28825 - DNA, 25 bp, Mus musculus
gaagtgctaaaacagttaacagaag

SEQ ID NO: 28826 - DNA, 25 bp, Mus musculus
gaagtgctaaaactgtccgggaatt

SEQ ID NO: 28827 - DNA, 25 bp, Mus musculus
gaagtgctctcccttccacctgaag

SEQ ID NO: 28828 - DNA, 25 bp, Mus musculus
gaagtgctcttgatccacttgctga

SEQ ID NO: 28829 - DNA, 25 bp, Mus musculus
gaagtgctgtatagagagcagttcg

SEQ ID NO: 28830 - DNA, 25 bp, Mus musculus
gaagtgctgtgatgtaggaaacaaa

SEQ ID NO: 28831 - DNA, 25 bp, Mus musculus
gaagtgcttaggagtctaccagaca

SEQ ID NO: 28832 - DNA, 25 bp, Mus musculus
gaagtgcttcttctcaggtctgcca

SEQ ID NO: 28833 - DNA, 25 bp, Mus musculus
gaagtgcttgaatgagttcctgggc

SEQ ID NO: 28834 - DNA, 25 bp, Mus musculus
gaagtgctttatgtcctctgcgtgc

SEQ ID NO: 28835 - DNA, 25 bp, Mus musculus
gaagtggaagcgcatgtgaatatca

SEQ ID NO: 28836 - DNA, 25 bp, Mus musculus
gaagtggaagcggatgtgaatatca

SEQ ID NO: 28837 - DNA, 25 bp, Mus musculus
gaagtggaatgttctgcgccagcga

SEQ ID NO: 28838 - DNA, 25 bp, Mus musculus
gaagtggaatttgaacccaggcagt

SEQ ID NO: 28839 - DNA, 25 bp, Mus musculus
gaagtggacatcaccatgtcggaag

SEQ ID NO: 28840 - DNA, 25 bp, Mus musculus
gaagtggacccctgtgacattgttg

SEQ ID NO: 28841 - DNA, 25 bp, Mus musculus
gaagtggacgtatatcccagttctc

SEQ ID NO: 28842 - DNA, 25 bp, Mus musculus
gaagtggaggaatggttcaccacac

SEQ ID NO: 28843 - DNA, 25 bp, Mus musculus
gaagtggaggaggagtagacagtga

SEQ ID NO: 28844 - DNA, 25 bp, Mus musculus
gaagtggcaatctgaggcaagctgt

SEQ ID NO: 28845 - DNA, 25 bp, Mus musculus
gaagtggccctcagtaacatcaaag

SEQ ID NO: 28846 - DNA, 25 bp, Mus musculus
gaagtggctccttctcagaattccg

SEQ ID NO: 28847 - DNA, 25 bp, Mus musculus
gaagtgggagcctcaattcaaccac

SEQ ID NO: 28848 - DNA, 25 bp, Mus musculus
gaagtgggatgaagcactacagcta

SEQ ID NO: 28849 - DNA, 25 bp, Mus musculus
gaagtgggtgccactgtcaaacctg

SEQ ID NO: 28850 - DNA, 25 bp, Mus musculus
gaagtgggtggagcatctgccagaa

SEQ ID NO: 28851 - DNA, 25 bp, Mus musculus
gaagtggtcaaggtcttggttacga

SEQ ID NO: 28852 - DNA, 25 bp, Mus musculus
gaagtggtcagctgcagacagttca

SEQ ID NO: 28853 - DNA, 25 bp, Mus musculus
gaagtggtgcccatgtcctttgctc

SEQ ID NO: 28854 - DNA, 25 bp, Mus musculus
gaagtggtggtctaaatgtcctgac

SEQ ID NO: 28855 - DNA, 25 bp, Mus musculus
gaagtggttgctccaaaatcacaaa

SEQ ID NO: 28856 - DNA, 25 bp, Mus musculus
gaagtggttttgactgcctcctcag

SEQ ID NO: 28857 - DNA, 25 bp, Mus musculus
gaagtggttttgtctgcctcctcag

SEQ ID NO: 28858 - DNA, 25 bp, Mus musculus
gaagtgtcctgccaaagcaagtgct

SEQ ID NO: 28859 - DNA, 25 bp, Mus musculus
gaagtgtctcccaacctctttgaag

SEQ ID NO: 28860 - DNA, 25 bp, Mus musculus
gaagtgtctctattcagcacaacgg

SEQ ID NO: 28861 - DNA, 25 bp, Mus musculus
gaagtgtcttcagtggcatccgttg

SEQ ID NO: 28862 - DNA, 25 bp, Mus musculus
gaagtgtgaagagaaacatcctagg

SEQ ID NO: 28863 - DNA, 25 bp, Mus musculus
gaagtgtgacccttgtacagttgtt

SEQ ID NO: 28864 - DNA, 25 bp, Mus musculus
gaagtgtgcagacaagttttgctcg

SEQ ID NO: 28865 - DNA, 25 bp, Mus musculus
gaagtgtgtgtgtctacctattatc

SEQ ID NO: 28866 - DNA, 25 bp, Mus musculus
gaagtgtgttcgtctcagcttctca

SEQ ID NO: 28867 - DNA, 25 bp, Mus musculus
gaagtgttgcacagtcttccagcag

SEQ ID NO: 28868 - DNA, 25 bp, Mus musculus
gaagtgttttgcacagatgacgacc

SEQ ID NO: 28869 - DNA, 25 bp, Mus musculus
gaagttaaagagatcgccactccta

SEQ ID NO: 28870 - DNA, 25 bp, Mus musculus
gaagttaaatagctatcccaaaggt

SEQ ID NO: 28871 - DNA, 25 bp, Mus musculus
gaagttaagactagaagaggatgct

SEQ ID NO: 28872 - DNA, 25 bp, Mus musculus
gaagttaagctgacagtacagaagg

SEQ ID NO: 28873 - DNA, 25 bp, Mus musculus
gaagttaagtcagataagctcccag

SEQ ID NO: 28874 - DNA, 25 bp, Mus musculus
gaagttaccacatgtgtgacctctg

SEQ ID NO: 28875 - DNA, 25 bp, Mus musculus
gaagttaccatagctgctcaaaaag

SEQ ID NO: 28876 - DNA, 25 bp, Mus musculus
gaagttactcatgaaaactcacccg

SEQ ID NO: 28877 - DNA, 25 bp, Mus musculus
gaagttactgccattcaagtctcac

SEQ ID NO: 28878 - DNA, 25 bp, Mus musculus
gaagttagacttctcagattggttg

SEQ ID NO: 28879 - DNA, 25 bp, Mus musculus
gaagttagacttgtcagattggttg

SEQ ID NO: 28880 - DNA, 25 bp, Mus musculus
gaagttagggtaccctcccattgcg

SEQ ID NO: 28881 - DNA, 25 bp, Mus musculus
gaagttattcagaggagctcagcta

SEQ ID NO: 28882 - DNA, 25 bp, Mus musculus
gaagttattccaggaatctgaaaga

SEQ ID NO: 28883 - DNA, 25 bp, Mus musculus
gaagttattccttgcgtctgaagta

SEQ ID NO: 28884 - DNA, 25 bp, Mus musculus
gaagttcaaacaccattgtgtctgg

SEQ ID NO: 28885 - DNA, 25 bp, Mus musculus
gaagttcacaataactgcggcatcg

SEQ ID NO: 28886 - DNA, 25 bp, Mus musculus
gaagttcacgcgagtgctgctcaca

SEQ ID NO: 28887 - DNA, 25 bp, Mus musculus
gaagttcaggagaatctcagcaggt

SEQ ID NO: 28888 - DNA, 25 bp, Mus musculus
gaagttcatactcgcatttgccatc

SEQ ID NO: 28889 - DNA, 25 bp, Mus musculus
gaagttcattagtgataaagatgcc

SEQ ID NO: 28890 - DNA, 25 bp, Mus musculus
gaagttccaattcaaaagatgtttg

SEQ ID NO: 28891 - DNA, 25 bp, Mus musculus
gaagttccagctgctcctgtgctga

SEQ ID NO: 28892 - DNA, 25 bp, Mus musculus
gaagttcccgttgcggatgaaggac

SEQ ID NO: 28893 - DNA, 25 bp, Mus musculus
gaagttccctataaggctggaaggc

SEQ ID NO: 28894 - DNA, 25 bp, Mus musculus
gaagttccggcagaaggcttccatc

SEQ ID NO: 28895 - DNA, 25 bp, Mus musculus
gaagttcctgacgtcatcaacagca

SEQ ID NO: 28896 - DNA, 25 bp, Mus musculus
gaagttcggcatagagaagaggcaa

SEQ ID NO: 28897 - DNA, 25 bp, Mus musculus
gaagttctctgggtagaccaacaga

SEQ ID NO: 28898 - DNA, 25 bp, Mus musculus
gaagttctcttctacaagaatttga

SEQ ID NO: 28899 - DNA, 25 bp, Mus musculus
gaagttctgcaatgaagctactgga

SEQ ID NO: 28900 - DNA, 25 bp, Mus musculus
gaagttctgcatcaaactcctggta

SEQ ID NO: 28901 - DNA, 25 bp, Mus musculus
gaagttctgcgatgcctccgaggat

SEQ ID NO: 28902 - DNA, 25 bp, Mus musculus
gaagttcttcccagcaagtgcagac

SEQ ID NO: 28903 - DNA, 25 bp, Mus musculus
gaagttcttcgtcaccagctttttg

SEQ ID NO: 28904 - DNA, 25 bp, Mus musculus
gaagttcttctgtctaaacaccagg

SEQ ID NO: 28905 - DNA, 25 bp, Mus musculus
gaagttctttcataaacaactagga

SEQ ID NO: 28906 - DNA, 25 bp, Mus musculus
gaagttgacgaaaggctatgctgac

SEQ ID NO: 28907 - DNA, 25 bp, Mus musculus
gaagttgactaaaggcgattttgtg

SEQ ID NO: 28908 - DNA, 25 bp, Mus musculus
gaagttgatattgactccctttgaa

SEQ ID NO: 28909 - DNA, 25 bp, Mus musculus
gaagttgatgatttgggccctgaag

SEQ ID NO: 28910 - DNA, 25 bp, Mus musculus
gaagttgctgattatgaagctacaa

SEQ ID NO: 28911 - DNA, 25 bp, Mus musculus
gaagttgcttcctacctcaagacaa

SEQ ID NO: 28912 - DNA, 25 bp, Mus musculus
gaagttggaatctcctgaccctggg

SEQ ID NO: 28913 - DNA, 25 bp, Mus musculus
gaagttggagcatgggttctacagc

SEQ ID NO: 28914 - DNA, 25 bp, Mus musculus
gaagttggccttcccattctggagt

SEQ ID NO: 28915 - DNA, 25 bp, Mus musculus
gaagttggcttccaccagtctggaa

SEQ ID NO: 28916 - DNA, 25 bp, Mus musculus
gaagttgtaagcaaaatagcccagt

SEQ ID NO: 28917 - DNA, 25 bp, Mus musculus
gaagttgtggtacatcttttgaaac

SEQ ID NO: 28918 - DNA, 25 bp, Mus musculus
gaagtttattatttaaacggagatg

SEQ ID NO: 28919 - DNA, 25 bp, Mus musculus
gaagtttcccagctctggtcagtgc

SEQ ID NO: 28920 - DNA, 25 bp, Mus musculus
gaagtttctctgaacctcttggaag

SEQ ID NO: 28921 - DNA, 25 bp, Mus musculus
gaagtttcttcttcccacattgaaa

SEQ ID NO: 28922 - DNA, 25 bp, Mus musculus
gaagtttgactacagggccttcgca

SEQ ID NO: 28923 - DNA, 25 bp, Mus musculus
gaagtttgatcaactgtaaggattt

SEQ ID NO: 28924 - DNA, 25 bp, Mus musculus
gaagtttgcagattccttaaatgaa

SEQ ID NO: 28925 - DNA, 25 bp, Mus musculus
gaagtttgcctccaggcttactgag

SEQ ID NO: 28926 - DNA, 25 bp, Mus musculus
gaagtttgctctcagtcaccaaaca

SEQ ID NO: 28927 - DNA, 25 bp, Mus musculus
gaagtttggaatttgtcaaatgcac

SEQ ID NO: 28928 - DNA, 25 bp, Mus musculus
gaagtttggcacctgcctatcggtg

SEQ ID NO: 28929 - DNA, 25 bp, Mus musculus
gaagtttggctacgtccttcctgat

SEQ ID NO: 28930 - DNA, 25 bp, Mus musculus
gaagtttgggcagtataacaaagaa

SEQ ID NO: 28931 - DNA, 25 bp, Mus musculus
gaagtttgtcattaagcccatcgac

SEQ ID NO: 28932 - DNA, 25 bp, Mus musculus
gaagtttttgatgtactggagaagc

SEQ ID NO: 28933 - DNA, 25 bp, Mus musculus
gaataaaaaggacgtttcagtgctt

SEQ ID NO: 28934 - DNA, 25 bp, Mus musculus
gaataaaagggtccctgctgccggt

SEQ ID NO: 28935 - DNA, 25 bp, Mus musculus
gaataaaagtgtccctctccatgaa

SEQ ID NO: 28936 - DNA, 25 bp, Mus musculus
gaataaaccaccacaggccattgtg

SEQ ID NO: 28937 - DNA, 25 bp, Mus musculus
gaataaacccaaggaagctatcaac

SEQ ID NO: 28938 - DNA, 25 bp, Mus musculus
gaataaaggcagacatgtggaaaca

SEQ ID NO: 28939 - DNA, 25 bp, Mus musculus
gaataacaacttgagtgacgagctg

SEQ ID NO: 28940 - DNA, 25 bp, Mus musculus
gaataacaatgatgtcaaaccgcag

SEQ ID NO: 28941 - DNA, 25 bp, Mus musculus
gaataacatggaacttgaagatgat

SEQ ID NO: 28942 - DNA, 25 bp, Mus musculus
gaataaccacagtcctcacgatgac

SEQ ID NO: 28943 - DNA, 25 bp, Mus musculus
gaataacctatatatcgccggacgc

SEQ ID NO: 28944 - DNA, 25 bp, Mus musculus
gaataaccttgccaacatcaaacgg

SEQ ID NO: 28945 - DNA, 25 bp, Mus musculus
gaataacttcctctcccggagacct

SEQ ID NO: 28946 - DNA, 25 bp, Mus musculus
gaataacttcctgtcccggagacct

SEQ ID NO: 28947 - DNA, 25 bp, Mus musculus
gaataacttgggagcaacaccagcc

SEQ ID NO: 28948 - DNA, 25 bp, Mus musculus
gaataaggaagtattctcaagtcac

SEQ ID NO: 28949 - DNA, 25 bp, Mus musculus
gaataaggaagttttctcaagtcac

SEQ ID NO: 28950 - DNA, 25 bp, Mus musculus
gaataaggccgagtgtacgaagcag

SEQ ID NO: 28951 - DNA, 25 bp, Mus musculus
gaataagtcctatgaatcgtccacc

SEQ ID NO: 28952 - DNA, 25 bp, Mus musculus
gaataatagtataacaaaggcccat

SEQ ID NO: 28953 - DNA, 25 bp, Mus musculus
gaataatagtattacaaaggcccat

SEQ ID NO: 28954 - DNA, 25 bp, Mus musculus
gaataatctccgtttctctacacag

SEQ ID NO: 28955 - DNA, 25 bp, Mus musculus
gaataatggatcagaccttgaaagc

SEQ ID NO: 28956 - DNA, 25 bp, Mus musculus
gaataatggccaacacttgttaggg

SEQ ID NO: 28957 - DNA, 25 bp, Mus musculus
gaataatggccatcacttgttaggg

SEQ ID NO: 28958 - DNA, 25 bp, Mus musculus
gaataatgtacgtttctctgcctac

SEQ ID NO: 28959 - DNA, 25 bp, Mus musculus
gaatacaaaggaggaggcaaagcaa

SEQ ID NO: 28960 - DNA, 25 bp, Mus musculus
gaatacaggaatgactacatgggct

SEQ ID NO: 28961 - DNA, 25 bp, Mus musculus
gaatacatggccctgagccctgtca

SEQ ID NO: 28962 - DNA, 25 bp, Mus musculus
gaatacattaaccaagatcctcagg

SEQ ID NO: 28963 - DNA, 25 bp, Mus musculus
gaataccaaccaactgacctcagta

SEQ ID NO: 28964 - DNA, 25 bp, Mus musculus
gaataccaatttgtggagcgcctgc

SEQ ID NO: 28965 - DNA, 25 bp, Mus musculus
gaataccagacggtgcagaggctca

SEQ ID NO: 28966 - DNA, 25 bp, Mus musculus
gaataccagagtccttccgtgggtc

SEQ ID NO: 28967 - DNA, 25 bp, Mus musculus
gaataccatcccaaagtcttgcggt

SEQ ID NO: 28968 - DNA, 25 bp, Mus musculus
gaataccattgttgctggaggtctt

SEQ ID NO: 28969 - DNA, 25 bp, Mus musculus
gaatacccagatgagctccagtgtg

SEQ ID NO: 28970 - DNA, 25 bp, Mus musculus
gaatacccagcttctggagagagtg

SEQ ID NO: 28971 - DNA, 25 bp, Mus musculus
gaatacccttttccaagccactcac

SEQ ID NO: 28972 - DNA, 25 bp, Mus musculus
gaatacctgttatacaccaggccct

SEQ ID NO: 28973 - DNA, 25 bp, Mus musculus
gaataccttccccatatacatggtg

SEQ ID NO: 28974 - DNA, 25 bp, Mus musculus
gaatacgacaactgggctcagcagg

SEQ ID NO: 28975 - DNA, 25 bp, Mus musculus
gaatacgacgaacaaggatatccga

SEQ ID NO: 28976 - DNA, 25 bp, Mus musculus
gaatacgacgaagaaggatatccga

SEQ ID NO: 28977 - DNA, 25 bp, Mus musculus
gaatacgagaaatatcctgagcgct

SEQ ID NO: 28978 - DNA, 25 bp, Mus musculus
gaatacggaggcaccatgacagatc

SEQ ID NO: 28979 - DNA, 25 bp, Mus musculus
gaatactaccgcaacaagcactcca

SEQ ID NO: 28980 - DNA, 25 bp, Mus musculus
gaatactgcctcattttggacacca

SEQ ID NO: 28981 - DNA, 25 bp, Mus musculus
gaatactgtttgacatgacggcaaa

SEQ ID NO: 28982 - DNA, 25 bp, Mus musculus
gaatactttgatctcagcatcacag

SEQ ID NO: 28983 - DNA, 25 bp, Mus musculus
gaatagaaatgtataccaaagcttc

SEQ ID NO: 28984 - DNA, 25 bp, Mus musculus
gaatagaccagaggcatcgcgccag

SEQ ID NO: 28985 - DNA, 25 bp, Mus musculus
gaatagagatgtttcgaaatatgca

SEQ ID NO: 28986 - DNA, 25 bp, Mus musculus
gaatagagttcgacgaggtgacagc

SEQ ID NO: 28987 - DNA, 25 bp, Mus musculus
gaatagatcctgatgccattcctag

SEQ ID NO: 28988 - DNA, 25 bp, Mus musculus
gaatagctgtgcatccaagggccag

SEQ ID NO: 28989 - DNA, 25 bp, Mus musculus
gaataggaccaaaatccataaagag

SEQ ID NO: 28990 - DNA, 25 bp, Mus musculus
gaataggagacaaggaccacagagg

SEQ ID NO: 28991 - DNA, 25 bp, Mus musculus
gaatagtaatcacacaggctacgat

SEQ ID NO: 28992 - DNA, 25 bp, Mus musculus
gaatagtccccaaggtgaattattg

SEQ ID NO: 28993 - DNA, 25 bp, Mus musculus
gaatagtgctgcctaaggacctgca

SEQ ID NO: 28994 - DNA, 25 bp, Mus musculus
gaatagttctgagtctaaaccagcc

SEQ ID NO: 28995 - DNA, 25 bp, Mus musculus
gaatagttggtaaatctggacaaga

SEQ ID NO: 28996 - DNA, 25 bp, Mus musculus
gaatagttggtgcaaacctgaagag

SEQ ID NO: 28997 - DNA, 25 bp, Mus musculus
gaatataaacataccaaaggctcta

SEQ ID NO: 28998 - DNA, 25 bp, Mus musculus
gaatatagagggaagtttatgctga

SEQ ID NO: 28999 - DNA, 25 bp, Mus musculus
gaatataggacagcaggcattacca

SEQ ID NO: 29000 - DNA, 25 bp, Mus musculus
gaatatatatccgatggcccgcagc

SEQ ID NO: 29001 - DNA, 25 bp, Mus musculus
gaatatatctcagacggtgaagaag

SEQ ID NO: 29002 - DNA, 25 bp, Mus musculus
gaatatcaatcccagcacagcaaat

SEQ ID NO: 29003 - DNA, 25 bp, Mus musculus
gaatatcagaagtgagctgagtgag

SEQ ID NO: 29004 - DNA, 25 bp, Mus musculus
gaatatcagtttcaacagaaggcgc

SEQ ID NO: 29005 - DNA, 25 bp, Mus musculus
gaatatcattatatggctgcccacg

SEQ ID NO: 29006 - DNA, 25 bp, Mus musculus
gaatatccatggaggtacggagcct

SEQ ID NO: 29007 - DNA, 25 bp, Mus musculus
gaatatcctggataagatggaacat

SEQ ID NO: 29008 - DNA, 25 bp, Mus musculus
gaatatcgatacaagaagtcttaag

SEQ ID NO: 29009 - DNA, 25 bp, Mus musculus
gaatatcgatactagaagtcttaag

SEQ ID NO: 29010 - DNA, 25 bp, Mus musculus
gaatatctcctgcaatgacaccctg

SEQ ID NO: 29011 - DNA, 25 bp, Mus musculus
gaatatctgctacccagtcttccta

SEQ ID NO: 29012 - DNA, 25 bp, Mus musculus
gaatatctggttattgctgacttaa

SEQ ID NO: 29013 - DNA, 25 bp, Mus musculus
gaatatgactgtctggccctgaacc

SEQ ID NO: 29014 - DNA, 25 bp, Mus musculus
gaatatgactgtgtggccctgaacc

SEQ ID NO: 29015 - DNA, 25 bp, Mus musculus
gaatatgagcagctgctgaatgtca

SEQ ID NO: 29016 - DNA, 25 bp, Mus musculus
gaatatgagtgatgacaaacccttt

SEQ ID NO: 29017 - DNA, 25 bp, Mus musculus
gaatatgcagcatcagtactggaag

SEQ ID NO: 29018 - DNA, 25 bp, Mus musculus
gaatatgcagcatgtgatgctacgt

SEQ ID NO: 29019 - DNA, 25 bp, Mus musculus
gaatatgcaggagtcccaggacacc

SEQ ID NO: 29020 - DNA, 25 bp, Mus musculus
gaatatggacattcttcagaaccca

SEQ ID NO: 29021 - DNA, 25 bp, Mus musculus
gaatatggatctggcagattctttc

SEQ ID NO: 29022 - DNA, 25 bp, Mus musculus
gaatatggtggctgactgttctgcc

SEQ ID NO: 29023 - DNA, 25 bp, Mus musculus
gaatatgtttgacaaactgaaccgt

SEQ ID NO: 29024 - DNA, 25 bp, Mus musculus
gaatattatctttaactcctgcccg

SEQ ID NO: 29025 - DNA, 25 bp, Mus musculus
gaatattcactcaagacgaaaggag

SEQ ID NO: 29026 - DNA, 25 bp, Mus musculus
gaatattctcttggactgaccccga

SEQ ID NO: 29027 - DNA, 25 bp, Mus musculus
gaatattctgacgtatcttgcccca

SEQ ID NO: 29028 - DNA, 25 bp, Mus musculus
gaatattctgtaatgatgactccat

SEQ ID NO: 29029 - DNA, 25 bp, Mus musculus
gaatattgggaagctgttgggccca

SEQ ID NO: 29030 - DNA, 25 bp, Mus musculus
gaatatttaccgcaagtcactgaag

SEQ ID NO: 29031 - DNA, 25 bp, Mus musculus
gaatatttataagaatcgtgaacct

SEQ ID NO: 29032 - DNA, 25 bp, Mus musculus
gaatcaaagaagagtcctcccttct

SEQ ID NO: 29033 - DNA, 25 bp, Mus musculus
gaatcaaatccttgtttaaatggtg

SEQ ID NO: 29034 - DNA, 25 bp, Mus musculus
gaatcaaattacgacccatctgagt

SEQ ID NO: 29035 - DNA, 25 bp, Mus musculus
gaatcaacaaaactgtggccatcca

SEQ ID NO: 29036 - DNA, 25 bp, Mus musculus
gaatcaacagtttgaaatggccaac

SEQ ID NO: 29037 - DNA, 25 bp, Mus musculus
gaatcaacgggaaaccaatcagccc

SEQ ID NO: 29038 - DNA, 25 bp, Mus musculus
gaatcaagaagggaacatcaccttg

SEQ ID NO: 29039 - DNA, 25 bp, Mus musculus
gaatcaagccaaggtgtctgtggat

SEQ ID NO: 29040 - DNA, 25 bp, Mus musculus
gaatcaaggcagtagccagaaggca

SEQ ID NO: 29041 - DNA, 25 bp, Mus musculus
gaatcaaggctatggcaactatgga

SEQ ID NO: 29042 - DNA, 25 bp, Mus musculus
gaatcaatctactcaaaagctcagg

SEQ ID NO: 29043 - DNA, 25 bp, Mus musculus
gaatcacaggccgatgactgcggtg

SEQ ID NO: 29044 - DNA, 25 bp, Mus musculus
gaatcacagtagttgcggcaggaga

SEQ ID NO: 29045 - DNA, 25 bp, Mus musculus
gaatcacccacttgcaatctgttcc

SEQ ID NO: 29046 - DNA, 25 bp, Mus musculus
gaatcaccctacttcacaccttatg

SEQ ID NO: 29047 - DNA, 25 bp, Mus musculus
gaatcacgaatgtggtcaccaagcc

SEQ ID NO: 29048 - DNA, 25 bp, Mus musculus
gaatcacggctgtactcttgggtgt

SEQ ID NO: 29049 - DNA, 25 bp, Mus musculus
gaatcactgagattctgatgaacag

SEQ ID NO: 29050 - DNA, 25 bp, Mus musculus
gaatcactgcagtttaactcctccc

SEQ ID NO: 29051 - DNA, 25 bp, Mus musculus
gaatcactggtattatcgagacctg

SEQ ID NO: 29052 - DNA, 25 bp, Mus musculus
gaatcacttggaccttgcttcacga

SEQ ID NO: 29053 - DNA, 25 bp, Mus musculus
gaatcagacggcaagacgagaggcc

SEQ ID NO: 29054 - DNA, 25 bp, Mus musculus
gaatcagacggctagacgagaggcc

SEQ ID NO: 29055 - DNA, 25 bp, Mus musculus
gaatcagactacactaacaatgttg

SEQ ID NO: 29056 - DNA, 25 bp, Mus musculus
gaatcagactactctaacaatgttg

SEQ ID NO: 29057 - DNA, 25 bp, Mus musculus
gaatcagagttcaatcagaacaacg

SEQ ID NO: 29058 - DNA, 25 bp, Mus musculus
gaatcagcaccagtgctcatggaga

SEQ ID NO: 29059 - DNA, 25 bp, Mus musculus
gaatcagcggcctcctcttcattta

SEQ ID NO: 29060 - DNA, 25 bp, Mus musculus
gaatcagctgatgacaacaaacgtg

SEQ ID NO: 29061 - DNA, 25 bp, Mus musculus
gaatcagctgctgcaagagcgactg

SEQ ID NO: 29062 - DNA, 25 bp, Mus musculus
gaatcagcttctcctggagcgacag

SEQ ID NO: 29063 - DNA, 25 bp, Mus musculus
gaatcagctttgaagtgggagccca

SEQ ID NO: 29064 - DNA, 25 bp, Mus musculus
gaatcaggagatgctgctgagtgta

SEQ ID NO: 29065 - DNA, 25 bp, Mus musculus
gaatcaggcctgagctctagtgctt

SEQ ID NO: 29066 - DNA, 25 bp, Mus musculus
gaatcagtaaaccatggcatctaag

SEQ ID NO: 29067 - DNA, 25 bp, Mus musculus
gaatcagtggtgcagaccctacagg

SEQ ID NO: 29068 - DNA, 25 bp, Mus musculus
gaatcagtggtggagaccctacagg

SEQ ID NO: 29069 - DNA, 25 bp, Mus musculus
gaatcataagcgaaacagcacactg

SEQ ID NO: 29070 - DNA, 25 bp, Mus musculus
gaatcatagcaagccatctacacgt

SEQ ID NO: 29071 - DNA, 25 bp, Mus musculus
gaatcatcagaagatcccgatggag

SEQ ID NO: 29072 - DNA, 25 bp, Mus musculus
gaatcatcagctaattccctgaaag

SEQ ID NO: 29073 - DNA, 25 bp, Mus musculus
gaatcatcagggtctggaatcctta

SEQ ID NO: 29074 - DNA, 25 bp, Mus musculus
gaatcatgattttcaagctcttgca

SEQ ID NO: 29075 - DNA, 25 bp, Mus musculus
gaatcatgcacagggatgtgaaacc

SEQ ID NO: 29076 - DNA, 25 bp, Mus musculus
gaatcatggactgttattatatgcc

SEQ ID NO: 29077 - DNA, 25 bp, Mus musculus
gaatcattaatcagtctaggtcagc

SEQ ID NO: 29078 - DNA, 25 bp, Mus musculus
gaatcattccacatattccgagatg

SEQ ID NO: 29079 - DNA, 25 bp, Mus musculus
gaatcattgaacactctcaagcttt

SEQ ID NO: 29080 - DNA, 25 bp, Mus musculus
gaatccaaaatgctacaaagaagta

SEQ ID NO: 29081 - DNA, 25 bp, Mus musculus
gaatccaaacgctttgtgcagtggc

SEQ ID NO: 29082 - DNA, 25 bp, Mus musculus
gaatccaacgcccacaatgaggtgg

SEQ ID NO: 29083 - DNA, 25 bp, Mus musculus
gaatccaagcccacagaaaacgagg

SEQ ID NO: 29084 - DNA, 25 bp, Mus musculus
gaatccacactagctctaatgagag

SEQ ID NO: 29085 - DNA, 25 bp, Mus musculus
gaatccacagaaggagagcaggccg

SEQ ID NO: 29086 - DNA, 25 bp, Mus musculus
gaatccagagattccgcaccagtgg

SEQ ID NO: 29087 - DNA, 25 bp, Mus musculus
gaatccagagcttatgaatcacaga

SEQ ID NO: 29088 - DNA, 25 bp, Mus musculus
gaatccagccgattcgggaggatgt

SEQ ID NO: 29089 - DNA, 25 bp, Mus musculus
gaatccagtggcacggatgcccact

SEQ ID NO: 29090 - DNA, 25 bp, Mus musculus
gaatccagtttcttgtgtatcagat

SEQ ID NO: 29091 - DNA, 25 bp, Mus musculus
gaatccatgcggaatctctgctcct

SEQ ID NO: 29092 - DNA, 25 bp, Mus musculus
gaatccatggtccatgcagacacaa

SEQ ID NO: 29093 - DNA, 25 bp, Mus musculus
gaatcccagaaacggaatacagagg

SEQ ID NO: 29094 - DNA, 25 bp, Mus musculus
gaatccccaggaacagactctggaa

SEQ ID NO: 29095 - DNA, 25 bp, Mus musculus
gaatcccgagctcttcattaaaccc

SEQ ID NO: 29096 - DNA, 25 bp, Mus musculus
gaatcccgcctaagagtgggacagg

SEQ ID NO: 29097 - DNA, 25 bp, Mus musculus
gaatcccgcctatgagtgggacagg

SEQ ID NO: 29098 - DNA, 25 bp, Mus musculus
gaatccctccgagtgtaagaggcaa

SEQ ID NO: 29099 - DNA, 25 bp, Mus musculus
gaatccctcttcagtatggaagcca

SEQ ID NO: 29100 - DNA, 25 bp, Mus musculus
gaatccctggatacagaggctggca

SEQ ID NO: 29101 - DNA, 25 bp, Mus musculus
gaatccctgtgtttgccaatgggaa

SEQ ID NO: 29102 - DNA, 25 bp, Mus musculus
gaatccgaagcgtggcacagagtca

SEQ ID NO: 29103 - DNA, 25 bp, Mus musculus
gaatccgaatcctgggaggtcctgc

SEQ ID NO: 29104 - DNA, 25 bp, Mus musculus
gaatccggtacaaaaagaatacagg

SEQ ID NO: 29105 - DNA, 25 bp, Mus musculus
gaatcctagatgtggacctgtgcgg

SEQ ID NO: 29106 - DNA, 25 bp, Mus musculus
gaatcctaggaatatgatgaaccac

SEQ ID NO: 29107 - DNA, 25 bp, Mus musculus
gaatcctatacccaattcagggtgg

SEQ ID NO: 29108 - DNA, 25 bp, Mus musculus
gaatcctgacgatttctctagggct

SEQ ID NO: 29109 - DNA, 25 bp, Mus musculus
gaatccttaccaaaggacgtatctg

SEQ ID NO: 29110 - DNA, 25 bp, Mus musculus
gaatccttcacaggaaaatctttac

SEQ ID NO: 29111 - DNA, 25 bp, Mus musculus
gaatccttccttgtttgcactggaa

SEQ ID NO: 29112 - DNA, 25 bp, Mus musculus
gaatcctttatctcacacatcgtgg

SEQ ID NO: 29113 - DNA, 25 bp, Mus musculus
gaatcgaaggaaagcaacacagtct

SEQ ID NO: 29114 - DNA, 25 bp, Mus musculus
gaatcgacggtctggcaggaaagct

SEQ ID NO: 29115 - DNA, 25 bp, Mus musculus
gaatcgagctttcccagtgaggaag

SEQ ID NO: 29116 - DNA, 25 bp, Mus musculus
gaatcgatatctgcctccggaagcg

SEQ ID NO: 29117 - DNA, 25 bp, Mus musculus
gaatcgatctcccatggatactgag

SEQ ID NO: 29118 - DNA, 25 bp, Mus musculus
gaatcgatctccgatggatactgag

SEQ ID NO: 29119 - DNA, 25 bp, Mus musculus
gaatcgatttcctccccagagcttg

SEQ ID NO: 29120 - DNA, 25 bp, Mus musculus
gaatcgcacgtccacaccggtgcgg

SEQ ID NO: 29121 - DNA, 25 bp, Mus musculus
gaatcgcagtctcagctggatgaag

SEQ ID NO: 29122 - DNA, 25 bp, Mus musculus
gaatcgcttctgtgatgccaaagtg

SEQ ID NO: 29123 - DNA, 25 bp, Mus musculus
gaatcggaaaagactcagtattggg

SEQ ID NO: 29124 - DNA, 25 bp, Mus musculus
gaatcggcctggcaatgccttagag

SEQ ID NO: 29125 - DNA, 25 bp, Mus musculus
gaatcggcgtaattccagtgaggag

SEQ ID NO: 29126 - DNA, 25 bp, Mus musculus
gaatcggcttgttcgttaaagcagg

SEQ ID NO: 29127 - DNA, 25 bp, Mus musculus
gaatcggtcaaacagaacatggccc

SEQ ID NO: 29128 - DNA, 25 bp, Mus musculus
gaatcggtcaaagagaacatggccc

SEQ ID NO: 29129 - DNA, 25 bp, Mus musculus
gaatcggttatgaatcttgacaagt

SEQ ID NO: 29130 - DNA, 25 bp, Mus musculus
gaatcgtccacctctaagtgacaag

SEQ ID NO: 29131 - DNA, 25 bp, Mus musculus
gaatcgtgaacctgtcagacaaatg

SEQ ID NO: 29132 - DNA, 25 bp, Mus musculus
gaatcgtgccctgcaaacagcttat

SEQ ID NO: 29133 - DNA, 25 bp, Mus musculus
gaatcgttagcatcataaaccaggt

SEQ ID NO: 29134 - DNA, 25 bp, Mus musculus
gaatcgttcaattggagcagcagct

SEQ ID NO: 29135 - DNA, 25 bp, Mus musculus
gaatcgttcttttatctcccacaac

SEQ ID NO: 29136 - DNA, 25 bp, Mus musculus
gaatctaaacaattatgaggtggag

SEQ ID NO: 29137 - DNA, 25 bp, Mus musculus
gaatctaagagggatggaggcttta

SEQ ID NO: 29138 - DNA, 25 bp, Mus musculus
gaatctaccctacggtgtgacccca

SEQ ID NO: 29139 - DNA, 25 bp, Mus musculus
gaatctaccggaagcactttctggg

SEQ ID NO: 29140 - DNA, 25 bp, Mus musculus
gaatctacttggtgagtacagctct

SEQ ID NO: 29141 - DNA, 25 bp, Mus musculus
gaatctagccgtgtctttagcagca

SEQ ID NO: 29142 - DNA, 25 bp, Mus musculus
gaatctcagcaggtgacaggctccg

SEQ ID NO: 29143 - DNA, 25 bp, Mus musculus
gaatctccacggtggcttctgtccc

SEQ ID NO: 29144 - DNA, 25 bp, Mus musculus
gaatctccccttttgggacatcatt

SEQ ID NO: 29145 - DNA, 25 bp, Mus musculus
gaatctcgtgaatttaagacatggt

SEQ ID NO: 29146 - DNA, 25 bp, Mus musculus
gaatctctattttctggtagtgtcc

SEQ ID NO: 29147 - DNA, 25 bp, Mus musculus
gaatctctcacagtgaattccttca

SEQ ID NO: 29148 - DNA, 25 bp, Mus musculus
gaatctctgctgaaacccctagtaa

SEQ ID NO: 29149 - DNA, 25 bp, Mus musculus
gaatctctgctgtaacccctagtaa

SEQ ID NO: 29150 - DNA, 25 bp, Mus musculus
gaatctcttcatgtcccggccagag

SEQ ID NO: 29151 - DNA, 25 bp, Mus musculus
gaatctctttgcctatgcctgtgat

SEQ ID NO: 29152 - DNA, 25 bp, Mus musculus
gaatctgaacccgatcttcaacgag

SEQ ID NO: 29153 - DNA, 25 bp, Mus musculus
gaatctgaagttgagaacagaggaa

SEQ ID NO: 29154 - DNA, 25 bp, Mus musculus
gaatctgagtccactcagaaggccg

SEQ ID NO: 29155 - DNA, 25 bp, Mus musculus
gaatctgatgctgtgcgcactgcag

SEQ ID NO: 29156 - DNA, 25 bp, Mus musculus
gaatctgattgggaccatccttaag

SEQ ID NO: 29157 - DNA, 25 bp, Mus musculus
gaatctgcattatgcctgcatacca

SEQ ID NO: 29158 - DNA, 25 bp, Mus musculus
gaatctgctggaggtttcagaagtt

SEQ ID NO: 29159 - DNA, 25 bp, Mus musculus
gaatctgcttcagcgctgtaaggag

SEQ ID NO: 29160 - DNA, 25 bp, Mus musculus
gaatctggacaatgacacggagacc

SEQ ID NO: 29161 - DNA, 25 bp, Mus musculus
gaatctggagcagacaaccagcaga

SEQ ID NO: 29162 - DNA, 25 bp, Mus musculus
gaatctggcagatagtgagatcacc

SEQ ID NO: 29163 - DNA, 25 bp, Mus musculus
gaatctgggagaaagtgaaattcga

SEQ ID NO: 29164 - DNA, 25 bp, Mus musculus
gaatctggttgacaacttcttagag

SEQ ID NO: 29165 - DNA, 25 bp, Mus musculus
gaatctggttgagaacttcttagag

SEQ ID NO: 29166 - DNA, 25 bp, Mus musculus
gaatctgtgaaaaaactccgctctt

SEQ ID NO: 29167 - DNA, 25 bp, Mus musculus
gaatctgtgtatgccttgcgtgcct

SEQ ID NO: 29168 - DNA, 25 bp, Mus musculus
gaatctgttctatgtctgcctgtgc

SEQ ID NO: 29169 - DNA, 25 bp, Mus musculus
gaatctgttggaaaccagatgggtg

SEQ ID NO: 29170 - DNA, 25 bp, Mus musculus
gaatcttagacatctacctgagcca

SEQ ID NO: 29171 - DNA, 25 bp, Mus musculus
gaatcttcaaaatggcaatggcgag

SEQ ID NO: 29172 - DNA, 25 bp, Mus musculus
gaatcttcaagagggagacatagag

SEQ ID NO: 29173 - DNA, 25 bp, Mus musculus
gaatcttcacaatgacagagggaaa

SEQ ID NO: 29174 - DNA, 25 bp, Mus musculus
gaatcttctatttggttagtgccac

SEQ ID NO: 29175 - DNA, 25 bp, Mus musculus
gaatcttgacttcctcaagcctttc

SEQ ID NO: 29176 - DNA, 25 bp, Mus musculus
gaatcttgcttctggacatccacgg

SEQ ID NO: 29177 - DNA, 25 bp, Mus musculus
gaatcttggaagatgcttgactgct

SEQ ID NO: 29178 - DNA, 25 bp, Mus musculus
gaatcttggatccagaaatgtgaca

SEQ ID NO: 29179 - DNA, 25 bp, Mus musculus
gaatcttgtgtcctttagatccaaa

SEQ ID NO: 29180 - DNA, 25 bp, Mus musculus
gaatctttcgaaacatgttgatcct

SEQ ID NO: 29181 - DNA, 25 bp, Mus musculus
gaatctttctctaacacggaacgct

SEQ ID NO: 29182 - DNA, 25 bp, Mus musculus
gaatcttttgcgagacagaactacg

SEQ ID NO: 29183 - DNA, 25 bp, Mus musculus
gaatgaaaatactagtgcactgact

SEQ ID NO: 29184 - DNA, 25 bp, Mus musculus
gaatgaaataaccaagataatgagc

SEQ ID NO: 29185 - DNA, 25 bp, Mus musculus
gaatgaaatggagacatttggtgca

SEQ ID NO: 29186 - DNA, 25 bp, Mus musculus
gaatgaacacagctttttcttgaag

SEQ ID NO: 29187 - DNA, 25 bp, Mus musculus
gaatgaacaggaatcaggcatttgg

SEQ ID NO: 29188 - DNA, 25 bp, Mus musculus
gaatgaaccgaaggtgctagaccct

SEQ ID NO: 29189 - DNA, 25 bp, Mus musculus
gaatgaactcttcctagatgttctg

SEQ ID NO: 29190 - DNA, 25 bp, Mus musculus
gaatgaagattgtcctgatcagcag

SEQ ID NO: 29191 - DNA, 25 bp, Mus musculus
gaatgaagcccggaaatacgttcgc

SEQ ID NO: 29192 - DNA, 25 bp, Mus musculus
gaatgaaggatgacagctacgcacc

SEQ ID NO: 29193 - DNA, 25 bp, Mus musculus
gaatgaagtcctcgatatgtcagac

SEQ ID NO: 29194 - DNA, 25 bp, Mus musculus
gaatgaagtgctccagtatgcagaa

SEQ ID NO: 29195 - DNA, 25 bp, Mus musculus
gaatgaagttgctgattatgaagct

SEQ ID NO: 29196 - DNA, 25 bp, Mus musculus
gaatgaatctgaaaccccaatggcc

SEQ ID NO: 29197 - DNA, 25 bp, Mus musculus
gaatgaattcgaagcctccaatagg

SEQ ID NO: 29198 - DNA, 25 bp, Mus musculus
gaatgacaagcttcagctggaagaa

SEQ ID NO: 29199 - DNA, 25 bp, Mus musculus
gaatgacacgggatgacctgttcaa

SEQ ID NO: 29200 - DNA, 25 bp, Mus musculus
gaatgacagaggtggtgccttccag

SEQ ID NO: 29201 - DNA, 25 bp, Mus musculus
gaatgacatagacatctttgagatc

SEQ ID NO: 29202 - DNA, 25 bp, Mus musculus
gaatgacattgggagtgttactcac

SEQ ID NO: 29203 - DNA, 25 bp, Mus musculus
gaatgaccacaacctcttcagtgga

SEQ ID NO: 29204 - DNA, 25 bp, Mus musculus
gaatgaccacaggatctgactctca

SEQ ID NO: 29205 - DNA, 25 bp, Mus musculus
gaatgaccacatcaacctgaaagtg

SEQ ID NO: 29206 - DNA, 25 bp, Mus musculus
gaatgacctgtccagtcagctgtct

SEQ ID NO: 29207 - DNA, 25 bp, Mus musculus
gaatgactacagcttgcccaaacct

SEQ ID NO: 29208 - DNA, 25 bp, Mus musculus
gaatgactatatcaactgggtccag

SEQ ID NO: 29209 - DNA, 25 bp, Mus musculus
gaatgagaaagtgacgcagtctgac

SEQ ID NO: 29210 - DNA, 25 bp, Mus musculus
gaatgagaactaagagccctgggtg

SEQ ID NO: 29211 - DNA, 25 bp, Mus musculus
gaatgagaatgttctcaagcctgca

SEQ ID NO: 29212 - DNA, 25 bp, Mus musculus
gaatgagaccatctggtacgtgcgt

SEQ ID NO: 29213 - DNA, 25 bp, Mus musculus
gaatgagataagtcctctattgggc

SEQ ID NO: 29214 - DNA, 25 bp, Mus musculus
gaatgagcaacataaacaactaaca

SEQ ID NO: 29215 - DNA, 25 bp, Mus musculus
gaatgagcacacaaatgagaaaacc

SEQ ID NO: 29216 - DNA, 25 bp, Mus musculus
gaatgagcacggcaatgtgccactt

SEQ ID NO: 29217 - DNA, 25 bp, Mus musculus
gaatgagcccctgacctttgcatgg

SEQ ID NO: 29218 - DNA, 25 bp, Mus musculus
gaatgagctgcaactcaatgatgct

SEQ ID NO: 29219 - DNA, 25 bp, Mus musculus
gaatgaggacacagtagagcggatt

SEQ ID NO: 29220 - DNA, 25 bp, Mus musculus
gaatgaggtcccattctgtgagtcc

SEQ ID NO: 29221 - DNA, 25 bp, Mus musculus
gaatgagtgccacttctcgtaaacg

SEQ ID NO: 29222 - DNA, 25 bp, Mus musculus
gaatgatattccagcaaaccaccgc

SEQ ID NO: 29223 - DNA, 25 bp, Mus musculus
gaatgatccagaggctgactgctga

SEQ ID NO: 29224 - DNA, 25 bp, Mus musculus
gaatgatccagccacagaaggcatc

SEQ ID NO: 29225 - DNA, 25 bp, Mus musculus
gaatgatctaacagttcaccgggca

SEQ ID NO: 29226 - DNA, 25 bp, Mus musculus
gaatgatctctttggaccccatgac

SEQ ID NO: 29227 - DNA, 25 bp, Mus musculus
gaatgatctgagaaggcctcctaag

SEQ ID NO: 29228 - DNA, 25 bp, Mus musculus
gaatgatgaagtccctgcactcttg

SEQ ID NO: 29229 - DNA, 25 bp, Mus musculus
gaatgatggacatgcaggagtgaca

SEQ ID NO: 29230 - DNA, 25 bp, Mus musculus
gaatgatgggcgatttagaccctgc

SEQ ID NO: 29231 - DNA, 25 bp, Mus musculus
gaatgattgatacagaactgaactc

SEQ ID NO: 29232 - DNA, 25 bp, Mus musculus
gaatgatttctatgacatcgtccga

SEQ ID NO: 29233 - DNA, 25 bp, Mus musculus
gaatgcaatcgcactgtgttccgtg

SEQ ID NO: 29234 - DNA, 25 bp, Mus musculus
gaatgcacatgggaaaatattgcca

SEQ ID NO: 29235 - DNA, 25 bp, Mus musculus
gaatgcacccgaggtggcttctgca

SEQ ID NO: 29236 - DNA, 25 bp, Mus musculus
gaatgcacgtgcagttgtccaccag

SEQ ID NO: 29237 - DNA, 25 bp, Mus musculus
gaatgcagacacagtccgcagagtg

SEQ ID NO: 29238 - DNA, 25 bp, Mus musculus
gaatgcagataacctattcgggtag

SEQ ID NO: 29239 - DNA, 25 bp, Mus musculus
gaatgcagcaataaggagtgcccct

SEQ ID NO: 29240 - DNA, 25 bp, Mus musculus
gaatgcaggtccagccacattggtc

SEQ ID NO: 29241 - DNA, 25 bp, Mus musculus
gaatgcatcgcctaagcaaaggaag

SEQ ID NO: 29242 - DNA, 25 bp, Mus musculus
gaatgccaacgttgctgagcttctg

SEQ ID NO: 29243 - DNA, 25 bp, Mus musculus
gaatgccactttactcttccccgag

SEQ ID NO: 29244 - DNA, 25 bp, Mus musculus
gaatgccagttttggaattgaacct

SEQ ID NO: 29245 - DNA, 25 bp, Mus musculus
gaatgcccagtcctcggcccagaga

SEQ ID NO: 29246 - DNA, 25 bp, Mus musculus
gaatgccctatacctaggtgatgtg

SEQ ID NO: 29247 - DNA, 25 bp, Mus musculus
gaatgccgccttccttgtcgggtgt

SEQ ID NO: 29248 - DNA, 25 bp, Mus musculus
gaatgccttgttcatcaaagtgaaa

SEQ ID NO: 29249 - DNA, 25 bp, Mus musculus
gaatgcctttaagaactatggcttc

SEQ ID NO: 29250 - DNA, 25 bp, Mus musculus
gaatgcgaaaaaggaagccggctga

SEQ ID NO: 29251 - DNA, 25 bp, Mus musculus
gaatgcgagcaccatcacctctgct

SEQ ID NO: 29252 - DNA, 25 bp, Mus musculus
gaatgcgctcatgttcaacaacgag

SEQ ID NO: 29253 - DNA, 25 bp, Mus musculus
gaatgcgtgtgaacccatagtgcct

SEQ ID NO: 29254 - DNA, 25 bp, Mus musculus
gaatgctagacaatagaaaactggg

SEQ ID NO: 29255 - DNA, 25 bp, Mus musculus
gaatgctctgcccatgatgcttgct

SEQ ID NO: 29256 - DNA, 25 bp, Mus musculus
gaatgctgcccttctgtgtccacat

SEQ ID NO: 29257 - DNA, 25 bp, Mus musculus
gaatgctggaaatgatggcaagcag

SEQ ID NO: 29258 - DNA, 25 bp, Mus musculus
gaatgcttggtagctccagccactg

SEQ ID NO: 29259 - DNA, 25 bp, Mus musculus
gaatgcttgtgaaaagacctcgttt

SEQ ID NO: 29260 - DNA, 25 bp, Mus musculus
gaatggaactgaggactcaaatgtt

SEQ ID NO: 29261 - DNA, 25 bp, Mus musculus
gaatggaatcatcaagacagataaa

SEQ ID NO: 29262 - DNA, 25 bp, Mus musculus
gaatggactttttcctcagtgctaa

SEQ ID NO: 29263 - DNA, 25 bp, Mus musculus
gaatggaggaccacagtaggccacg

SEQ ID NO: 29264 - DNA, 25 bp, Mus musculus
gaatggaggagtttgggatctcccc

SEQ ID NO: 29265 - DNA, 25 bp, Mus musculus
gaatggagtaccagctgtaggccta

SEQ ID NO: 29266 - DNA, 25 bp, Mus musculus
gaatggattctctaacaactactgg

SEQ ID NO: 29267 - DNA, 25 bp, Mus musculus
gaatggcaaatgattcaaaagctct

SEQ ID NO: 29268 - DNA, 25 bp, Mus musculus
gaatggcaagggtcccttccctcag

SEQ ID NO: 29269 - DNA, 25 bp, Mus musculus
gaatggcacgactctctgtttcaga

SEQ ID NO: 29270 - DNA, 25 bp, Mus musculus
gaatggcagtaaccttctcacaatg

SEQ ID NO: 29271 - DNA, 25 bp, Mus musculus
gaatggcagtaagcttctcacaatg

SEQ ID NO: 29272 - DNA, 25 bp, Mus musculus
gaatggcatcctgtgaaaatactct

SEQ ID NO: 29273 - DNA, 25 bp, Mus musculus
gaatggcattccttctaacaggatt

SEQ ID NO: 29274 - DNA, 25 bp, Mus musculus
gaatggcgcagaccgccatgtccga

SEQ ID NO: 29275 - DNA, 25 bp, Mus musculus
gaatggcgcagagcgccatgtccga

SEQ ID NO: 29276 - DNA, 25 bp, Mus musculus
gaatggcgttcacctgcattaccag

SEQ ID NO: 29277 - DNA, 25 bp, Mus musculus
gaatggcgtttacgttacaagagcg

SEQ ID NO: 29278 - DNA, 25 bp, Mus musculus
gaatggctcaccacattgggaaagc

SEQ ID NO: 29279 - DNA, 25 bp, Mus musculus
gaatggctgaccatcaagccccaag

SEQ ID NO: 29280 - DNA, 25 bp, Mus musculus
gaatggctgccactcgatatgaacc

SEQ ID NO: 29281 - DNA, 25 bp, Mus musculus
gaatggctgctgaatgaaatccgta

SEQ ID NO: 29282 - DNA, 25 bp, Mus musculus
gaatgggaagaatgctagagaattc

SEQ ID NO: 29283 - DNA, 25 bp, Mus musculus
gaatgggaagcagcgggcagctggc

SEQ ID NO: 29284 - DNA, 25 bp, Mus musculus
gaatgggacacaagggccgaaaaca

SEQ ID NO: 29285 - DNA, 25 bp, Mus musculus
gaatgggacacatgggccgaaaaca

SEQ ID NO: 29286 - DNA, 25 bp, Mus musculus
gaatgggacaccctcttcagtttgg

SEQ ID NO: 29287 - DNA, 25 bp, Mus musculus
gaatgggacagaagactccagctac

SEQ ID NO: 29288 - DNA, 25 bp, Mus musculus
gaatgggaccccataagacagcagt

SEQ ID NO: 29289 - DNA, 25 bp, Mus musculus
gaatgggactttcggctttggcaat

SEQ ID NO: 29290 - DNA, 25 bp, Mus musculus
gaatgggactttgggctttggcaat

SEQ ID NO: 29291 - DNA, 25 bp, Mus musculus
gaatgggtatctttcccggaataat

SEQ ID NO: 29292 - DNA, 25 bp, Mus musculus
gaatgggtctgtaccagagggatca

SEQ ID NO: 29293 - DNA, 25 bp, Mus musculus
gaatgggtctgttccagagggatca

SEQ ID NO: 29294 - DNA, 25 bp, Mus musculus
gaatggtaacctatccccaggccgc

SEQ ID NO: 29295 - DNA, 25 bp, Mus musculus
gaatggtatggtgtgccagatctag

SEQ ID NO: 29296 - DNA, 25 bp, Mus musculus
gaatggtctagcagcttatcgagcc

SEQ ID NO: 29297 - DNA, 25 bp, Mus musculus
gaatggtctggccactctccactac

SEQ ID NO: 29298 - DNA, 25 bp, Mus musculus
gaatggtgaatatcgagccaaaaaa

SEQ ID NO: 29299 - DNA, 25 bp, Mus musculus
gaatggtgcctctgtagaggagccc

SEQ ID NO: 29300 - DNA, 25 bp, Mus musculus
gaatggtgtatatgaactgagtctg

SEQ ID NO: 29301 - DNA, 25 bp, Mus musculus
gaatggtgtccccactccgccgata

SEQ ID NO: 29302 - DNA, 25 bp, Mus musculus
gaatggttccatccgctctttctgg

SEQ ID NO: 29303 - DNA, 25 bp, Mus musculus
gaatgtaacttttgaggatgctggg

SEQ ID NO: 29304 - DNA, 25 bp, Mus musculus
gaatgtaattatggcttctatcctg

SEQ ID NO: 29305 - DNA, 25 bp, Mus musculus
gaatgtaattcctctgcctcgtcct

SEQ ID NO: 29306 - DNA, 25 bp, Mus musculus
gaatgtagaaggctgaagccataca

SEQ ID NO: 29307 - DNA, 25 bp, Mus musculus
gaatgtagagagcagcaattcatct

SEQ ID NO: 29308 - DNA, 25 bp, Mus musculus
gaatgtagaggaaatctcttcatgg

SEQ ID NO: 29309 - DNA, 25 bp, Mus musculus
gaatgtagcacagatttactaagga

SEQ ID NO: 29310 - DNA, 25 bp, Mus musculus
gaatgtatgatttgccacatctgag

SEQ ID NO: 29311 - DNA, 25 bp, Mus musculus
gaatgtatttgaacaacaaggagac

SEQ ID NO: 29312 - DNA, 25 bp, Mus musculus
gaatgtcaacatactacaacgacca

SEQ ID NO: 29313 - DNA, 25 bp, Mus musculus
gaatgtcaacctgtgggacctgcgc

SEQ ID NO: 29314 - DNA, 25 bp, Mus musculus
gaatgtcaagattctgagctcccca

SEQ ID NO: 29315 - DNA, 25 bp, Mus musculus
gaatgtcaccaacaacctcaagtct

SEQ ID NO: 29316 - DNA, 25 bp, Mus musculus
gaatgtcaccatacataaaaagccg

SEQ ID NO: 29317 - DNA, 25 bp, Mus musculus
gaatgtcaccattcataaaaagccg

SEQ ID NO: 29318 - DNA, 25 bp, Mus musculus
gaatgtcaccgagtacgtcgtccga

SEQ ID NO: 29319 - DNA, 25 bp, Mus musculus
gaatgtcagcattcaaagccaccta

SEQ ID NO: 29320 - DNA, 25 bp, Mus musculus
gaatgtcagcctcgtgatctcacgg

SEQ ID NO: 29321 - DNA, 25 bp, Mus musculus
gaatgtcaggtcgaagattggctct

SEQ ID NO: 29322 - DNA, 25 bp, Mus musculus
gaatgtcagtgaagcccaagagatg

SEQ ID NO: 29323 - DNA, 25 bp, Mus musculus
gaatgtcatgggagagagcacctgc

SEQ ID NO: 29324 - DNA, 25 bp, Mus musculus
gaatgtccactgtgcttaagcaggt

SEQ ID NO: 29325 - DNA, 25 bp, Mus musculus
gaatgtcccagaaacgatgaatgaa

SEQ ID NO: 29326 - DNA, 25 bp, Mus musculus
gaatgtcccatgcacctggaggatt

SEQ ID NO: 29327 - DNA, 25 bp, Mus musculus
gaatgtccggctagacaaggcttgt

SEQ ID NO: 29328 - DNA, 25 bp, Mus musculus
gaatgtctacaaggaccttcgacag

SEQ ID NO: 29329 - DNA, 25 bp, Mus musculus
gaatgtctaccaagaactgacccag

SEQ ID NO: 29330 - DNA, 25 bp, Mus musculus
gaatgtctatatagatgcctagatc

SEQ ID NO: 29331 - DNA, 25 bp, Mus musculus
gaatgtctcgttggatttgaaaatg

SEQ ID NO: 29332 - DNA, 25 bp, Mus musculus
gaatgtctcttctccaaagactccg

SEQ ID NO: 29333 - DNA, 25 bp, Mus musculus
gaatgtcttcattatctgcttctac

SEQ ID NO: 29334 - DNA, 25 bp, Mus musculus
gaatgtgacgatggcagcatgccca

SEQ ID NO: 29335 - DNA, 25 bp, Mus musculus
gaatgtgagagactttcgaaagtgc

SEQ ID NO: 29336 - DNA, 25 bp, Mus musculus
gaatgtgagtagttctgagacggaa

SEQ ID NO: 29337 - DNA, 25 bp, Mus musculus
gaatgtgatcgccatggtcactgca

SEQ ID NO: 29338 - DNA, 25 bp, Mus musculus
gaatgtgcagctctcagaccacacc

SEQ ID NO: 29339 - DNA, 25 bp, Mus musculus
gaatgtgcagctgtcagaccacacc

SEQ ID NO: 29340 - DNA, 25 bp, Mus musculus
gaatgtgccaatcacactgtgtgtg

SEQ ID NO: 29341 - DNA, 25 bp, Mus musculus
gaatgtgccaatgacactgtgtgtg

SEQ ID NO: 29342 - DNA, 25 bp, Mus musculus
gaatgtgctcattacccgggatggg

SEQ ID NO: 29343 - DNA, 25 bp, Mus musculus
gaatgtgctgtttttgaccatgggc

SEQ ID NO: 29344 - DNA, 25 bp, Mus musculus
gaatgtgggaagaattacgaacctg

SEQ ID NO: 29345 - DNA, 25 bp, Mus musculus
gaatgtggtcacagccttacttaaa

SEQ ID NO: 29346 - DNA, 25 bp, Mus musculus
gaatgtggtcactgccttacttaaa

SEQ ID NO: 29347 - DNA, 25 bp, Mus musculus
gaatgtggtgtcgaggaattatcac

SEQ ID NO: 29348 - DNA, 25 bp, Mus musculus
gaatgtgtactgattgggcctgctc

SEQ ID NO: 29349 - DNA, 25 bp, Mus musculus
gaatgtgtactgtttgggcctgctc

SEQ ID NO: 29350 - DNA, 25 bp, Mus musculus
gaatgtgtatcagaagaaacatctg

SEQ ID NO: 29351 - DNA, 25 bp, Mus musculus
gaatgtgtggtcatttttcactccc

SEQ ID NO: 29352 - DNA, 25 bp, Mus musculus
gaatgtgttggcatcacagaaaagg

SEQ ID NO: 29353 - DNA, 25 bp, Mus musculus
gaatgtgtttgtggatacccatgat

SEQ ID NO: 29354 - DNA, 25 bp, Mus musculus
gaatgttaccaaaagagccttagtt

SEQ ID NO: 29355 - DNA, 25 bp, Mus musculus
gaatgttcaccagggcagtgatggc

SEQ ID NO: 29356 - DNA, 25 bp, Mus musculus
gaatgttcatactgcccagaaaatg

SEQ ID NO: 29357 - DNA, 25 bp, Mus musculus
gaatgttccggagaatcacagcagc

SEQ ID NO: 29358 - DNA, 25 bp, Mus musculus
gaatgttctcaagcctgcacaggag

SEQ ID NO: 29359 - DNA, 25 bp, Mus musculus
gaatgttgcctgaccttaggattct

SEQ ID NO: 29360 - DNA, 25 bp, Mus musculus
gaatgttgctgatcataagaaagga

SEQ ID NO: 29361 - DNA, 25 bp, Mus musculus
gaatgtttaaaatccaagtgctgtt

SEQ ID NO: 29362 - DNA, 25 bp, Mus musculus
gaatgtttgagtgaactaagcaagg

SEQ ID NO: 29363 - DNA, 25 bp, Mus musculus
gaatgtttttagtatgtcctgcaag

SEQ ID NO: 29364 - DNA, 25 bp, Mus musculus
gaattaaaattccaagcactttgag

SEQ ID NO: 29365 - DNA, 25 bp, Mus musculus
gaattaaaggacattgttctctacc

SEQ ID NO: 29366 - DNA, 25 bp, Mus musculus
gaattaaaggccagcttagactaca

SEQ ID NO: 29367 - DNA, 25 bp, Mus musculus
gaattaagacagttttgtgagctgc

SEQ ID NO: 29368 - DNA, 25 bp, Mus musculus
gaattacagctaaggagactgccac

SEQ ID NO: 29369 - DNA, 25 bp, Mus musculus
gaattacagtccagtgagaacaaaa

SEQ ID NO: 29370 - DNA, 25 bp, Mus musculus
gaattacatatgatactgcatgcag

SEQ ID NO: 29371 - DNA, 25 bp, Mus musculus
gaattacgaagaagacgcgcggtca

SEQ ID NO: 29372 - DNA, 25 bp, Mus musculus
gaattactacgtccgggctgccctc

SEQ ID NO: 29373 - DNA, 25 bp, Mus musculus
gaattactagccacaggagataaag

SEQ ID NO: 29374 - DNA, 25 bp, Mus musculus
gaattactatgcgtgcaaacaaatg

SEQ ID NO: 29375 - DNA, 25 bp, Mus musculus
gaattagacacttttaaccgtgtga

SEQ ID NO: 29376 - DNA, 25 bp, Mus musculus
gaattagatataggagatgccaccc

SEQ ID NO: 29377 - DNA, 25 bp, Mus musculus
gaattagcaataatccaagatcaac

SEQ ID NO: 29378 - DNA, 25 bp, Mus musculus
gaattagctgaacattgtgacatca

SEQ ID NO: 29379 - DNA, 25 bp, Mus musculus
gaattagtccttcagacattccctt

SEQ ID NO: 29380 - DNA, 25 bp, Mus musculus
gaattagttcgctatgacgcaagag

SEQ ID NO: 29381 - DNA, 25 bp, Mus musculus
gaattatatggagcaaaactgattg

SEQ ID NO: 29382 - DNA, 25 bp, Mus musculus
gaattatattatgtctcccagcgtg

SEQ ID NO: 29383 - DNA, 25 bp, Mus musculus
gaattatcggaagagaaccagcttg

SEQ ID NO: 29384 - DNA, 25 bp, Mus musculus
gaattatgagaccaactgatgtacc

SEQ ID NO: 29385 - DNA, 25 bp, Mus musculus
gaattatggtacttcaccagctgtt

SEQ ID NO: 29386 - DNA, 25 bp, Mus musculus
gaattattgctttgagctgagaatc

SEQ ID NO: 29387 - DNA, 25 bp, Mus musculus
gaattcaaagagaagggctctgagc

SEQ ID NO: 29388 - DNA, 25 bp, Mus musculus
gaattcaaagcattgtaaggaaaag

SEQ ID NO: 29389 - DNA, 25 bp, Mus musculus
gaattcaaaggcgatttaccagtga

SEQ ID NO: 29390 - DNA, 25 bp, Mus musculus
gaattcaagtcatccttcaagcttg

SEQ ID NO: 29391 - DNA, 25 bp, Mus musculus
gaattcaattgaaatgggccctgcc

SEQ ID NO: 29392 - DNA, 25 bp, Mus musculus
gaattcactggaaacagcggaagat

SEQ ID NO: 29393 - DNA, 25 bp, Mus musculus
gaattcagaatttgtggaaaggccc

SEQ ID NO: 29394 - DNA, 25 bp, Mus musculus
gaattcagcagaacagttcatgccg

SEQ ID NO: 29395 - DNA, 25 bp, Mus musculus
gaattcagccacatccacaaaccaa

SEQ ID NO: 29396 - DNA, 25 bp, Mus musculus
gaattcagctccagtttaaaagcct

SEQ ID NO: 29397 - DNA, 25 bp, Mus musculus
gaattcataagatcccagagacagc

SEQ ID NO: 29398 - DNA, 25 bp, Mus musculus
gaattcatgctgcaagttggagcac

SEQ ID NO: 29399 - DNA, 25 bp, Mus musculus
gaattcatgctggaagttggagcac

SEQ ID NO: 29400 - DNA, 25 bp, Mus musculus
gaattcatggtcgtggaaaccccgc

SEQ ID NO: 29401 - DNA, 25 bp, Mus musculus
gaattcattaagtgcatcttcggaa

SEQ ID NO: 29402 - DNA, 25 bp, Mus musculus
gaattccaccccatgttaaagcacc

SEQ ID NO: 29403 - DNA, 25 bp, Mus musculus
gaattccactgtcgttctctgtgac

SEQ ID NO: 29404 - DNA, 25 bp, Mus musculus
gaattccatgttttcactggaagag

SEQ ID NO: 29405 - DNA, 25 bp, Mus musculus
gaattccctgagactcataggtcag

SEQ ID NO: 29406 - DNA, 25 bp, Mus musculus
gaattccctgctgcatgtaccatct

SEQ ID NO: 29407 - DNA, 25 bp, Mus musculus
gaattccgagggtagccttcaggag

SEQ ID NO: 29408 - DNA, 25 bp, Mus musculus
gaattccgcggttgctgtgagcgcc

SEQ ID NO: 29409 - DNA, 25 bp, Mus musculus
gaattccggaagcaaaaggacattg

SEQ ID NO: 29410 - DNA, 25 bp, Mus musculus
gaattcctcacagcaatgaaaagcc

SEQ ID NO: 29411 - DNA, 25 bp, Mus musculus
gaattcctctataaatggttctaag

SEQ ID NO: 29412 - DNA, 25 bp, Mus musculus
gaattccttcatcgtcagcacgcag

SEQ ID NO: 29413 - DNA, 25 bp, Mus musculus
gaattcgactgaagacacatggtat

SEQ ID NO: 29414 - DNA, 25 bp, Mus musculus
gaattcgagagaatatttcgtgcac

SEQ ID NO: 29415 - DNA, 25 bp, Mus musculus
gaattcgcgcagatccttatcattg

SEQ ID NO: 29416 - DNA, 25 bp, Mus musculus
gaattcggtttcagcttcagcccca

SEQ ID NO: 29417 - DNA, 25 bp, Mus musculus
gaattctaccagcagtttaaaacct

SEQ ID NO: 29418 - DNA, 25 bp, Mus musculus
gaattctaccattaattagggtcta

SEQ ID NO: 29419 - DNA, 25 bp, Mus musculus
gaattctatgatgaagacgtcagct

SEQ ID NO: 29420 - DNA, 25 bp, Mus musculus
gaattctcaaagtagctcagctcta

SEQ ID NO: 29421 - DNA, 25 bp, Mus musculus
gaattctcactacagatttttctgg

SEQ ID NO: 29422 - DNA, 25 bp, Mus musculus
gaattctccccatctcataagtcaa

SEQ ID NO: 29423 - DNA, 25 bp, Mus musculus
gaattctcctaacaaaggtgtgctg

SEQ ID NO: 29424 - DNA, 25 bp, Mus musculus
gaattctctccattatctctgaaaa

SEQ ID NO: 29425 - DNA, 25 bp, Mus musculus
gaattctctttactggacacaaatg

SEQ ID NO: 29426 - DNA, 25 bp, Mus musculus
gaattctgactctatccggttgcag

SEQ ID NO: 29427 - DNA, 25 bp, Mus musculus
gaattctgcactgaggcaagctgcc

SEQ ID NO: 29428 - DNA, 25 bp, Mus musculus
gaattctgcctttggattccgaaga

SEQ ID NO: 29429 - DNA, 25 bp, Mus musculus
gaattctggaactctcttggaggga

SEQ ID NO: 29430 - DNA, 25 bp, Mus musculus
gaattctgtgatcactctcttcaga

SEQ ID NO: 29431 - DNA, 25 bp, Mus musculus
gaattctgttatggacgtcatatcc

SEQ ID NO: 29432 - DNA, 25 bp, Mus musculus
gaattcttacctgtgcttcagccca

SEQ ID NO: 29433 - DNA, 25 bp, Mus musculus
gaattcttcaccaaaaatcaacagc

SEQ ID NO: 29434 - DNA, 25 bp, Mus musculus
gaattcttcacggtttaatgccagc

SEQ ID NO: 29435 - DNA, 25 bp, Mus musculus
gaattcttcccaaaagaggctacac

SEQ ID NO: 29436 - DNA, 25 bp, Mus musculus
gaattcttccgcaacctctacctga

SEQ ID NO: 29437 - DNA, 25 bp, Mus musculus
gaattcttccgctacctctacctga

SEQ ID NO: 29438 - DNA, 25 bp, Mus musculus
gaattgaaaacggtgacgaacaact

SEQ ID NO: 29439 - DNA, 25 bp, Mus musculus
gaattgaacctctgcacaacagctc

SEQ ID NO: 29440 - DNA, 25 bp, Mus musculus
gaattgaactcaaaataccaccaag

SEQ ID NO: 29441 - DNA, 25 bp, Mus musculus
gaattgaactttactgacttgacat

SEQ ID NO: 29442 - DNA, 25 bp, Mus musculus
gaattgaaggcctttgtccaacaac

SEQ ID NO: 29443 - DNA, 25 bp, Mus musculus
gaattgacttaaaacagaattccag

SEQ ID NO: 29444 - DNA, 25 bp, Mus musculus
gaattgattcactgagtgagcaggt

SEQ ID NO: 29445 - DNA, 25 bp, Mus musculus
gaattgattctgttctgtcaaaagc

SEQ ID NO: 29446 - DNA, 25 bp, Mus musculus
gaattgcacatgtcaggaaagcgcc

SEQ ID NO: 29447 - DNA, 25 bp, Mus musculus
gaattgcagaattcttccccagggc

SEQ ID NO: 29448 - DNA, 25 bp, Mus musculus
gaattgcagcagaaggtcatttgcc

SEQ ID NO: 29449 - DNA, 25 bp, Mus musculus
gaattgcccacagtttcccaggaac

SEQ ID NO: 29450 - DNA, 25 bp, Mus musculus
gaattgcccctactgtcactacctg

SEQ ID NO: 29451 - DNA, 25 bp, Mus musculus
gaattgcctgagtacagatttctcc

SEQ ID NO: 29452 - DNA, 25 bp, Mus musculus
gaattgctgaaatgatcctggatga

SEQ ID NO: 29453 - DNA, 25 bp, Mus musculus
gaattgctggctcacaagattcatg

SEQ ID NO: 29454 - DNA, 25 bp, Mus musculus
gaattggaaaagcatatgcagaaga

SEQ ID NO: 29455 - DNA, 25 bp, Mus musculus
gaattggaaattcagtatcaagaac

SEQ ID NO: 29456 - DNA, 25 bp, Mus musculus
gaattggcactcttaaatcaaagca

SEQ ID NO: 29457 - DNA, 25 bp, Mus musculus
gaattgggagtcacacagcactaag

SEQ ID NO: 29458 - DNA, 25 bp, Mus musculus
gaattgggatcggaaattgcatagt

SEQ ID NO: 29459 - DNA, 25 bp, Mus musculus
gaattggtcttttgtctctgtcacg

SEQ ID NO: 29460 - DNA, 25 bp, Mus musculus
gaattggtgaggctttctaaatgaa

SEQ ID NO: 29461 - DNA, 25 bp, Mus musculus
gaattggtggcctagcaacctccaa

SEQ ID NO: 29462 - DNA, 25 bp, Mus musculus
gaattggttctactgtgtttcgagc

SEQ ID NO: 29463 - DNA, 25 bp, Mus musculus
gaattgtagtctgagcaccctggaa

SEQ ID NO: 29464 - DNA, 25 bp, Mus musculus
gaattgtcagccacttgaagaaaca

SEQ ID NO: 29465 - DNA, 25 bp, Mus musculus
gaattgtcccatttcagtaatcgtg

SEQ ID NO: 29466 - DNA, 25 bp, Mus musculus
gaattgtcttctttagctgccgctc

SEQ ID NO: 29467 - DNA, 25 bp, Mus musculus
gaatttaatcatcttcgccttcatg

SEQ ID NO: 29468 - DNA, 25 bp, Mus musculus
gaatttaatcccctttgtggagact

SEQ ID NO: 29469 - DNA, 25 bp, Mus musculus
gaatttagcgtccttcctgagaacg

SEQ ID NO: 29470 - DNA, 25 bp, Mus musculus
gaatttagtcgagaacttagacagc

SEQ ID NO: 29471 - DNA, 25 bp, Mus musculus
gaatttatggaggtcaaaagcgccc

SEQ ID NO: 29472 - DNA, 25 bp, Mus musculus
gaatttatttcagcactcacactga

SEQ ID NO: 29473 - DNA, 25 bp, Mus musculus
gaatttcacagtccatcagccaaag

SEQ ID NO: 29474 - DNA, 25 bp, Mus musculus
gaatttcagccttcctatttcccca

SEQ ID NO: 29475 - DNA, 25 bp, Mus musculus
gaatttcagtttctgcgctgcccga

SEQ ID NO: 29476 - DNA, 25 bp, Mus musculus
gaatttcatgaacacttgcacagca

SEQ ID NO: 29477 - DNA, 25 bp, Mus musculus
gaatttccacttcagatattgggca

SEQ ID NO: 29478 - DNA, 25 bp, Mus musculus
gaatttccctgagggagaccctatg

SEQ ID NO: 29479 - DNA, 25 bp, Mus musculus
gaatttcctggtcagaatagttaat

SEQ ID NO: 29480 - DNA, 25 bp, Mus musculus
gaatttcgacggcatgaggcatctg

SEQ ID NO: 29481 - DNA, 25 bp, Mus musculus
gaatttcgacgttttcagcgagaca

SEQ ID NO: 29482 - DNA, 25 bp, Mus musculus
gaatttcgactttctcggagtctgg

SEQ ID NO: 29483 - DNA, 25 bp, Mus musculus
gaatttctaaatcatgttgaagatg

SEQ ID NO: 29484 - DNA, 25 bp, Mus musculus
gaatttctcgctccatctctgaaag

SEQ ID NO: 29485 - DNA, 25 bp, Mus musculus
gaatttctcgctgcatctctgaaag

SEQ ID NO: 29486 - DNA, 25 bp, Mus musculus
gaatttctcttggaattgggctgct

SEQ ID NO: 29487 - DNA, 25 bp, Mus musculus
gaatttctgccagatgccccagcag

SEQ ID NO: 29488 - DNA, 25 bp, Mus musculus
gaatttctgtcagaagctccagaga

SEQ ID NO: 29489 - DNA, 25 bp, Mus musculus
gaatttctgttcaccacttgcctta

SEQ ID NO: 29490 - DNA, 25 bp, Mus musculus
gaatttgaagccctcatgaggatgc

SEQ ID NO: 29491 - DNA, 25 bp, Mus musculus
gaatttgacctcatagatcattctg

SEQ ID NO: 29492 - DNA, 25 bp, Mus musculus
gaatttgagcagtttaacaagcggt

SEQ ID NO: 29493 - DNA, 25 bp, Mus musculus
gaatttgaggatagagacaggtctc

SEQ ID NO: 29494 - DNA, 25 bp, Mus musculus
gaatttgaggctatgagcctgccct

SEQ ID NO: 29495 - DNA, 25 bp, Mus musculus
gaatttgatgaacaagtagctgctg

SEQ ID NO: 29496 - DNA, 25 bp, Mus musculus
gaatttgatgacctagatgggatac

SEQ ID NO: 29497 - DNA, 25 bp, Mus musculus
gaatttgcaccagaacttaatcagg

SEQ ID NO: 29498 - DNA, 25 bp, Mus musculus
gaatttgcacgtatatgccgagacc

SEQ ID NO: 29499 - DNA, 25 bp, Mus musculus
gaatttgctgctatgctgatgccac

SEQ ID NO: 29500 - DNA, 25 bp, Mus musculus
gaatttgctggctcgtaaaggcact

SEQ ID NO: 29501 - DNA, 25 bp, Mus musculus
gaatttggccagaatccctttaaag

SEQ ID NO: 29502 - DNA, 25 bp, Mus musculus
gaatttggccagtatccctttaaag

SEQ ID NO: 29503 - DNA, 25 bp, Mus musculus
gaatttggtctggaacttgatgaaa

SEQ ID NO: 29504 - DNA, 25 bp, Mus musculus
gaatttgtcaaatgcacaacaggga

SEQ ID NO: 29505 - DNA, 25 bp, Mus musculus
gaatttgtcttaaacaaggacagtg

SEQ ID NO: 29506 - DNA, 25 bp, Mus musculus
gaatttgtcttatacaaggacagtg

SEQ ID NO: 29507 - DNA, 25 bp, Mus musculus
gaatttgtgcagctacattttggaa

SEQ ID NO: 29508 - DNA, 25 bp, Mus musculus
gaatttgtggaaaggcccaatccct

SEQ ID NO: 29509 - DNA, 25 bp, Mus musculus
gaattttaaattggaacacggagca

SEQ ID NO: 29510 - DNA, 25 bp, Mus musculus
gaattttatacattgactcagttgg

SEQ ID NO: 29511 - DNA, 25 bp, Mus musculus
gaattttatctattccaatttggcc

SEQ ID NO: 29512 - DNA, 25 bp, Mus musculus
gaattttcgccaacagaggccatct

SEQ ID NO: 29513 - DNA, 25 bp, Mus musculus
gaatttttctgggagtgtgctacgt

SEQ ID NO: 29514 - DNA, 25 bp, Mus musculus
gacaaaaagaggctgaaatggattc

SEQ ID NO: 29515 - DNA, 25 bp, Mus musculus
gacaaaaatactacacaaattgccc

SEQ ID NO: 29516 - DNA, 25 bp, Mus musculus
gacaaaaatacttcacaaattgccc

SEQ ID NO: 29517 - DNA, 25 bp, Mus musculus
gacaaaacaattcaacatgtagaag

SEQ ID NO: 29518 - DNA, 25 bp, Mus musculus
gacaaaaccagatcaaatgcaaaaa

SEQ ID NO: 29519 - DNA, 25 bp, Mus musculus
gacaaaactgaaaacacagcctatc

SEQ ID NO: 29520 - DNA, 25 bp, Mus musculus
gacaaaagagggaggagatgcggct

SEQ ID NO: 29521 - DNA, 25 bp, Mus musculus
gacaaaataaacctcagcaccctta

SEQ ID NO: 29522 - DNA, 25 bp, Mus musculus
gacaaaatagaacagcttgagtgcc

SEQ ID NO: 29523 - DNA, 25 bp, Mus musculus
gacaaaatcatcagctggcagccac

SEQ ID NO: 29524 - DNA, 25 bp, Mus musculus
gacaaaatgcaacactacccggttt

SEQ ID NO: 29525 - DNA, 25 bp, Mus musculus
gacaaacaagatgccctggacttgg

SEQ ID NO: 29526 - DNA, 25 bp, Mus musculus
gacaaacactgacttctacaccggt

SEQ ID NO: 29527 - DNA, 25 bp, Mus musculus
gacaaacagcatgtttggtgcttca

SEQ ID NO: 29528 - DNA, 25 bp, Mus musculus
gacaaacagccggtaaaagtactgg

SEQ ID NO: 29529 - DNA, 25 bp, Mus musculus
gacaaaccaactttcaaggcccagg

SEQ ID NO: 29530 - DNA, 25 bp, Mus musculus
gacaaaccaattcttgctccagaac

SEQ ID NO: 29531 - DNA, 25 bp, Mus musculus
gacaaaccagaacactccagaatat

SEQ ID NO: 29532 - DNA, 25 bp, Mus musculus
gacaaacccaaggaggcggtcaccg

SEQ ID NO: 29533 - DNA, 25 bp, Mus musculus
gacaaaccctggttgataaacagta

SEQ ID NO: 29534 - DNA, 25 bp, Mus musculus
gacaaacggatagcttgcgatgaag

SEQ ID NO: 29535 - DNA, 25 bp, Mus musculus
gacaaacggcagaattcttcacggt

SEQ ID NO: 29536 - DNA, 25 bp, Mus musculus
gacaaacgggtccttcctaactgat

SEQ ID NO: 29537 - DNA, 25 bp, Mus musculus
gacaaactagcaaccactcaggaaa

SEQ ID NO: 29538 - DNA, 25 bp, Mus musculus
gacaaactctttgacttagatgaaa

SEQ ID NO: 29539 - DNA, 25 bp, Mus musculus
gacaaagaacattagaagagtagaa

SEQ ID NO: 29540 - DNA, 25 bp, Mus musculus
gacaaagaagatgaacagcctcaag

SEQ ID NO: 29541 - DNA, 25 bp, Mus musculus
gacaaagactatctgaggtcactaa

SEQ ID NO: 29542 - DNA, 25 bp, Mus musculus
gacaaagacttccaaggtctcccgg

SEQ ID NO: 29543 - DNA, 25 bp, Mus musculus
gacaaagatggaaagacgcctctca

SEQ ID NO: 29544 - DNA, 25 bp, Mus musculus
gacaaagcagtggagcagaagcaaa

SEQ ID NO: 29545 - DNA, 25 bp, Mus musculus
gacaaagctgctgatacgatgagat

SEQ ID NO: 29546 - DNA, 25 bp, Mus musculus
gacaaagcttcgaggcctctacaca

SEQ ID NO: 29547 - DNA, 25 bp, Mus musculus
gacaaaggcacagcagaaggagctg

SEQ ID NO: 29548 - DNA, 25 bp, Mus musculus
gacaaaggcagcaaaatggctgcag

SEQ ID NO: 29549 - DNA, 25 bp, Mus musculus
gacaaaggctttgctgcagttcatc

SEQ ID NO: 29550 - DNA, 25 bp, Mus musculus
gacaaagggataactcacaccacgg

SEQ ID NO: 29551 - DNA, 25 bp, Mus musculus
gacaaagggccacccacattctaga

SEQ ID NO: 29552 - DNA, 25 bp, Mus musculus
gacaaagggccagccacattctaga

SEQ ID NO: 29553 - DNA, 25 bp, Mus musculus
gacaaagggccctgacattagagtc

SEQ ID NO: 29554 - DNA, 25 bp, Mus musculus
gacaaagtagctccagaaactgcag

SEQ ID NO: 29555 - DNA, 25 bp, Mus musculus
gacaaagtccgaacagatccagcag

SEQ ID NO: 29556 - DNA, 25 bp, Mus musculus
gacaaagtttcttcagtccgctgga

SEQ ID NO: 29557 - DNA, 25 bp, Mus musculus
gacaaatactcattagctcacggaa

SEQ ID NO: 29558 - DNA, 25 bp, Mus musculus
gacaaatactccgaggctctcaaag

SEQ ID NO: 29559 - DNA, 25 bp, Mus musculus
gacaaatactggagaaatatcagga

SEQ ID NO: 29560 - DNA, 25 bp, Mus musculus
gacaaatccaaggacaatagtggtg

SEQ ID NO: 29561 - DNA, 25 bp, Mus musculus
gacaaatcctcattcactttacccg

SEQ ID NO: 29562 - DNA, 25 bp, Mus musculus
gacaaatccttctcccttcgacaga

SEQ ID NO: 29563 - DNA, 25 bp, Mus musculus
gacaaatcggcctatgcactctgca

SEQ ID NO: 29564 - DNA, 25 bp, Mus musculus
gacaaatcgtgtcttgttcttggaa

SEQ ID NO: 29565 - DNA, 25 bp, Mus musculus
gacaaatctatcacacagaactgga

SEQ ID NO: 29566 - DNA, 25 bp, Mus musculus
gacaaatgctggctatgattaccta

SEQ ID NO: 29567 - DNA, 25 bp, Mus musculus
gacaaatgcttggtcttcaaggact

SEQ ID NO: 29568 - DNA, 25 bp, Mus musculus
gacaaatggcctgattttaatactg

SEQ ID NO: 29569 - DNA, 25 bp, Mus musculus
gacaaattagactatgaatgtctcg

SEQ ID NO: 29570 - DNA, 25 bp, Mus musculus
gacaaattctgcagcctctgccatt

SEQ ID NO: 29571 - DNA, 25 bp, Mus musculus
gacaaattgcacatcacgaagacct

SEQ ID NO: 29572 - DNA, 25 bp, Mus musculus
gacaacaaacgtgtggctgaagcag

SEQ ID NO: 29573 - DNA, 25 bp, Mus musculus
gacaacaaccgttcacattgggccc

SEQ ID NO: 29574 - DNA, 25 bp, Mus musculus
gacaacaagcccaagttcactcaag

SEQ ID NO: 29575 - DNA, 25 bp, Mus musculus
gacaacagcacaccagcgaaggatg

SEQ ID NO: 29576 - DNA, 25 bp, Mus musculus
gacaacaggcatatatttaaccaga

SEQ ID NO: 29577 - DNA, 25 bp, Mus musculus
gacaacagtacgtcatccaataaga

SEQ ID NO: 29578 - DNA, 25 bp, Mus musculus
gacaacagtgaagctggaacacagc

SEQ ID NO: 29579 - DNA, 25 bp, Mus musculus
gacaacagtgctacagtttgaaggc

SEQ ID NO: 29580 - DNA, 25 bp, Mus musculus
gacaaccaaccaggatctcaaaaac

SEQ ID NO: 29581 - DNA, 25 bp, Mus musculus
gacaaccagagctggtggcctcgcg

SEQ ID NO: 29582 - DNA, 25 bp, Mus musculus
gacaaccagtgtacagcagcctaaa

SEQ ID NO: 29583 - DNA, 25 bp, Mus musculus
gacaaccagtgttcagcagcctaaa

SEQ ID NO: 29584 - DNA, 25 bp, Mus musculus
gacaaccatcctccctttgttggtg

SEQ ID NO: 29585 - DNA, 25 bp, Mus musculus
gacaacccttgacatcgtcagagcg

SEQ ID NO: 29586 - DNA, 25 bp, Mus musculus
gacaacctcctcaatctgtctgaaa

SEQ ID NO: 29587 - DNA, 25 bp, Mus musculus
gacaacctgatgcaacagaagctgg

SEQ ID NO: 29588 - DNA, 25 bp, Mus musculus
gacaaccttctagtttcagatgcca

SEQ ID NO: 29589 - DNA, 25 bp, Mus musculus
gacaacgacagtgagttcagacttg

SEQ ID NO: 29590 - DNA, 25 bp, Mus musculus
gacaacgatggccaagcggaattcc

SEQ ID NO: 29591 - DNA, 25 bp, Mus musculus
gacaacggtcagagaaggcacaaga

SEQ ID NO: 29592 - DNA, 25 bp, Mus musculus
gacaacgtggccaagtgtggcacca

SEQ ID NO: 29593 - DNA, 25 bp, Mus musculus
gacaactacagtgcaccagacacag

SEQ ID NO: 29594 - DNA, 25 bp, Mus musculus
gacaactatcaagttcgcaccagca

SEQ ID NO: 29595 - DNA, 25 bp, Mus musculus
gacaactgtgaagtaacccatagac

SEQ ID NO: 29596 - DNA, 25 bp, Mus musculus
gacaacttacctgctttccattgga

SEQ ID NO: 29597 - DNA, 25 bp, Mus musculus
gacaacttatccaaacctgtggctg

SEQ ID NO: 29598 - DNA, 25 bp, Mus musculus
gacaacttatcctaacctgtggctg

SEQ ID NO: 29599 - DNA, 25 bp, Mus musculus
gacaacttatgcactgaagagatct

SEQ ID NO: 29600 - DNA, 25 bp, Mus musculus
gacaacttcttgacagcccatcacg

SEQ ID NO: 29601 - DNA, 25 bp, Mus musculus
gacaactttgccatgctgggacttg

SEQ ID NO: 29602 - DNA, 25 bp, Mus musculus
gacaactttttcaggatgggcagca

SEQ ID NO: 29603 - DNA, 25 bp, Mus musculus
gacaagaaacgagctacagactggg

SEQ ID NO: 29604 - DNA, 25 bp, Mus musculus
gacaagaaagcgcactgcattcggg

SEQ ID NO: 29605 - DNA, 25 bp, Mus musculus
gacaagaaatcctatgaaccccagg

SEQ ID NO: 29606 - DNA, 25 bp, Mus musculus
gacaagaacaaactacaggcgattg

SEQ ID NO: 29607 - DNA, 25 bp, Mus musculus
gacaagaacccggataataaagaat

SEQ ID NO: 29608 - DNA, 25 bp, Mus musculus
gacaagaaccgaagcaccaagagga

SEQ ID NO: 29609 - DNA, 25 bp, Mus musculus
gacaagaacggtgtggacctcctaa

SEQ ID NO: 29610 - DNA, 25 bp, Mus musculus
gacaagaactgttacctggcttatg

SEQ ID NO: 29611 - DNA, 25 bp, Mus musculus
gacaagaagattcatcaagttcaag

SEQ ID NO: 29612 - DNA, 25 bp, Mus musculus
gacaagacataaagtcagccgggcc

SEQ ID NO: 29613 - DNA, 25 bp, Mus musculus
gacaagacctataagtatatccgag

SEQ ID NO: 29614 - DNA, 25 bp, Mus musculus
gacaagactggagataaacctcgaa

SEQ ID NO: 29615 - DNA, 25 bp, Mus musculus
gacaagagcactgaatctcctggca

SEQ ID NO: 29616 - DNA, 25 bp, Mus musculus
gacaagagtgaaagtaacccggttg

SEQ ID NO: 29617 - DNA, 25 bp, Mus musculus
gacaagagtgacgagaaggaatgcc

SEQ ID NO: 29618 - DNA, 25 bp, Mus musculus
gacaagagttcatccgtgtgggcta

SEQ ID NO: 29619 - DNA, 25 bp, Mus musculus
gacaagatgcaaggttgagggcacc

SEQ ID NO: 29620 - DNA, 25 bp, Mus musculus
gacaagatgtctaagggacacatgt

SEQ ID NO: 29621 - DNA, 25 bp, Mus musculus
gacaagatgttcttcctcgacccga

SEQ ID NO: 29622 - DNA, 25 bp, Mus musculus
gacaagcaaaccagacgatgcacag

SEQ ID NO: 29623 - DNA, 25 bp, Mus musculus
gacaagcagaagaagagtcaaggct

SEQ ID NO: 29624 - DNA, 25 bp, Mus musculus
gacaagcagaagtggtgcggtatct

SEQ ID NO: 29625 - DNA, 25 bp, Mus musculus
gacaagccttagatggtgtttccat

SEQ ID NO: 29626 - DNA, 25 bp, Mus musculus
gacaagcgggctctagttggctttt

SEQ ID NO: 29627 - DNA, 25 bp, Mus musculus
gacaagctggatcaggcaagctcca

SEQ ID NO: 29628 - DNA, 25 bp, Mus musculus
gacaagcttataccaggatctgaga

SEQ ID NO: 29629 - DNA, 25 bp, Mus musculus
gacaagcttatagcaggatctgaga

SEQ ID NO: 29630 - DNA, 25 bp, Mus musculus
gacaaggacttggactgtgaaaacg

SEQ ID NO: 29631 - DNA, 25 bp, Mus musculus
gacaaggagtcagagaagcagcttc

SEQ ID NO: 29632 - DNA, 25 bp, Mus musculus
gacaaggcaatagacttcatattga

SEQ ID NO: 29633 - DNA, 25 bp, Mus musculus
gacaaggcatctgatgacaccttcc

SEQ ID NO: 29634 - DNA, 25 bp, Mus musculus
gacaaggcccctgtggtgaaggcta

SEQ ID NO: 29635 - DNA, 25 bp, Mus musculus
gacaaggctgctctgtagatctgaa

SEQ ID NO: 29636 - DNA, 25 bp, Mus musculus
gacaaggctgtcaccatgcagcagg

SEQ ID NO: 29637 - DNA, 25 bp, Mus musculus
gacaaggctgtctccatgcagcagg

SEQ ID NO: 29638 - DNA, 25 bp, Mus musculus
gacaagggcccttggtgctacacca

SEQ ID NO: 29639 - DNA, 25 bp, Mus musculus
gacaaggtagcttcactctctcatg

SEQ ID NO: 29640 - DNA, 25 bp, Mus musculus
gacaagtactgcctccagaaaagcc

SEQ ID NO: 29641 - DNA, 25 bp, Mus musculus
gacaagtagaatccgtacgatttcg

SEQ ID NO: 29642 - DNA, 25 bp, Mus musculus
gacaagtcaaatgaactcacaggta

SEQ ID NO: 29643 - DNA, 25 bp, Mus musculus
gacaagtcatctgggatccactacg

SEQ ID NO: 29644 - DNA, 25 bp, Mus musculus
gacaagtcctttaaaggcgtggtag

SEQ ID NO: 29645 - DNA, 25 bp, Mus musculus
gacaagtctcctggaaggaacagcc

SEQ ID NO: 29646 - DNA, 25 bp, Mus musculus
gacaagtcttagaagccagtgcttt

SEQ ID NO: 29647 - DNA, 25 bp, Mus musculus
gacaagtggtgtttgccactcagga

SEQ ID NO: 29648 - DNA, 25 bp, Mus musculus
gacaagtgtaaccaaaagtgtccac

SEQ ID NO: 29649 - DNA, 25 bp, Mus musculus
gacaagttctcaaatatttctgaag

SEQ ID NO: 29650 - DNA, 25 bp, Mus musculus
gacaagttctcatatatttctgaag

SEQ ID NO: 29651 - DNA, 25 bp, Mus musculus
gacaagttttgctaagagttttcct

SEQ ID NO: 29652 - DNA, 25 bp, Mus musculus
gacaataaagcgcacagtgggcgaa

SEQ ID NO: 29653 - DNA, 25 bp, Mus musculus
gacaataaaggcaaagttctcctga

SEQ ID NO: 29654 - DNA, 25 bp, Mus musculus
gacaataaatttggatcagtatatc

SEQ ID NO: 29655 - DNA, 25 bp, Mus musculus
gacaataccccaactggaagcagca

SEQ ID NO: 29656 - DNA, 25 bp, Mus musculus
gacaatagtccatgaaagtgagaga

SEQ ID NO: 29657 - DNA, 25 bp, Mus musculus
gacaatattctgctgatttttcagg

SEQ ID NO: 29658 - DNA, 25 bp, Mus musculus
gacaatcaaggaattctaccagcag

SEQ ID NO: 29659 - DNA, 25 bp, Mus musculus
gacaatcactgccagcgtccaggct

SEQ ID NO: 29660 - DNA, 25 bp, Mus musculus
gacaatcggtcagaagcctggtgac

SEQ ID NO: 29661 - DNA, 25 bp, Mus musculus
gacaatcgtcaccaagaatgggcag

SEQ ID NO: 29662 - DNA, 25 bp, Mus musculus
gacaatcgtctttgtgcatctatcc

SEQ ID NO: 29663 - DNA, 25 bp, Mus musculus
gacaatgaagctgatttcttagctg

SEQ ID NO: 29664 - DNA, 25 bp, Mus musculus
gacaatgaatgtctatatagatgcc

SEQ ID NO: 29665 - DNA, 25 bp, Mus musculus
gacaatgacaactggcccaccttca

SEQ ID NO: 29666 - DNA, 25 bp, Mus musculus
gacaatgaccatgcgatacctgcct

SEQ ID NO: 29667 - DNA, 25 bp, Mus musculus
gacaatgcaattgagaagaggaagc

SEQ ID NO: 29668 - DNA, 25 bp, Mus musculus
gacaatgcccaggtaatcctcgtgg

SEQ ID NO: 29669 - DNA, 25 bp, Mus musculus
gacaatgcgccaaaattctcctttg

SEQ ID NO: 29670 - DNA, 25 bp, Mus musculus
gacaatgcgtatgagaatatgcagg

SEQ ID NO: 29671 - DNA, 25 bp, Mus musculus
gacaatggagcaagatgaggacccc

SEQ ID NO: 29672 - DNA, 25 bp, Mus musculus
gacaatggctcagatgaatcagcta

SEQ ID NO: 29673 - DNA, 25 bp, Mus musculus
gacaatgggatatgctgcatcgatg

SEQ ID NO: 29674 - DNA, 25 bp, Mus musculus
gacaatgtggaggacgagttgaccc

SEQ ID NO: 29675 - DNA, 25 bp, Mus musculus
gacaatgttcacaaacagagagtgg

SEQ ID NO: 29676 - DNA, 25 bp, Mus musculus
gacaattatgcagaatgggacttaa

SEQ ID NO: 29677 - DNA, 25 bp, Mus musculus
gacaattcaagtaacactttcaggg

SEQ ID NO: 29678 - DNA, 25 bp, Mus musculus
gacaattccatcaagacatcaaagt

SEQ ID NO: 29679 - DNA, 25 bp, Mus musculus
gacaattggcctccaagaccgagag

SEQ ID NO: 29680 - DNA, 25 bp, Mus musculus
gacaatttgcttaatatggcctatg

SEQ ID NO: 29681 - DNA, 25 bp, Mus musculus
gacaatttggttcaagtataccagc

SEQ ID NO: 29682 - DNA, 25 bp, Mus musculus
gacacaaaaactgctcttctggaaa

SEQ ID NO: 29683 - DNA, 25 bp, Mus musculus
gacacaaccattgtttattgggtca

SEQ ID NO: 29684 - DNA, 25 bp, Mus musculus
gacacaactcattttcagggaactc

SEQ ID NO: 29685 - DNA, 25 bp, Mus musculus
gacacaagaactgaggagcagcctg

SEQ ID NO: 29686 - DNA, 25 bp, Mus musculus
gacacaagccaaagagaatgcctat

SEQ ID NO: 29687 - DNA, 25 bp, Mus musculus
gacacaaggctgataatgctgtgaa

SEQ ID NO: 29688 - DNA, 25 bp, Mus musculus
gacacaatagagcttcgggagtctc

SEQ ID NO: 29689 - DNA, 25 bp, Mus musculus
gacacaatctgcatcctactctcaa

SEQ ID NO: 29690 - DNA, 25 bp, Mus musculus
gacacaatgcagcaagagctacaga

SEQ ID NO: 29691 - DNA, 25 bp, Mus musculus
gacacaatgtcatggtcagcactga

SEQ ID NO: 29692 - DNA, 25 bp, Mus musculus
gacacacactccagaacagatggta

SEQ ID NO: 29693 - DNA, 25 bp, Mus musculus
gacacacaggcatctcctggatggg

SEQ ID NO: 29694 - DNA, 25 bp, Mus musculus
gacacacaggccagctttcagccat

SEQ ID NO: 29695 - DNA, 25 bp, Mus musculus
gacacaccacctaagaagccctgta

SEQ ID NO: 29696 - DNA, 25 bp, Mus musculus
gacacaccgactcaacagaggcagc

SEQ ID NO: 29697 - DNA, 25 bp, Mus musculus
gacacacgtgtatttcctgcagcag

SEQ ID NO: 29698 - DNA, 25 bp, Mus musculus
gacacactaagatccaccctaaagg

SEQ ID NO: 29699 - DNA, 25 bp, Mus musculus
gacacactccggctggaggtagaca

SEQ ID NO: 29700 - DNA, 25 bp, Mus musculus
gacacactgaagcagcggcggcaca

SEQ ID NO: 29701 - DNA, 25 bp, Mus musculus
gacacactgccctggaaccttggga

SEQ ID NO: 29702 - DNA, 25 bp, Mus musculus
gacacagaggatgtccgaagaatga

SEQ ID NO: 29703 - DNA, 25 bp, Mus musculus
gacacagatagctccgaagacgttg

SEQ ID NO: 29704 - DNA, 25 bp, Mus musculus
gacacagatgggagactcagaagag

SEQ ID NO: 29705 - DNA, 25 bp, Mus musculus
gacacagcaaggactcactgtatgg

SEQ ID NO: 29706 - DNA, 25 bp, Mus musculus
gacacagcatcagagagcagctacc

SEQ ID NO: 29707 - DNA, 25 bp, Mus musculus
gacacagccgtctgtctttcagagt

SEQ ID NO: 29708 - DNA, 25 bp, Mus musculus
gacacagctccggttcctgagaaaa

SEQ ID NO: 29709 - DNA, 25 bp, Mus musculus
gacacagctgctacgagccatagaa

SEQ ID NO: 29710 - DNA, 25 bp, Mus musculus
gacacagctgcttcgagccatagaa

SEQ ID NO: 29711 - DNA, 25 bp, Mus musculus
gacacaggaagcaggagactaagct

SEQ ID NO: 29712 - DNA, 25 bp, Mus musculus
gacacaggaatgctgccaaggtcct

SEQ ID NO: 29713 - DNA, 25 bp, Mus musculus
gacacaggtcctaaatttctaccaa

SEQ ID NO: 29714 - DNA, 25 bp, Mus musculus
gacacatacaagctgccaaagttaa

SEQ ID NO: 29715 - DNA, 25 bp, Mus musculus
gacacatacaaggtgccaaagttaa

SEQ ID NO: 29716 - DNA, 25 bp, Mus musculus
gacacatacaatattcctttagacc

SEQ ID NO: 29717 - DNA, 25 bp, Mus musculus
gacacatagaagtctgacctgtttg

SEQ ID NO: 29718 - DNA, 25 bp, Mus musculus
gacacatccaaagtccaagtccaag

SEQ ID NO: 29719 - DNA, 25 bp, Mus musculus
gacacatccctaagcagaaactact

SEQ ID NO: 29720 - DNA, 25 bp, Mus musculus
gacacatgcattttgatggaacaga

SEQ ID NO: 29721 - DNA, 25 bp, Mus musculus
gacacatggaactgggactctgagg

SEQ ID NO: 29722 - DNA, 25 bp, Mus musculus
gacacatgtggtaaagatagaccct

SEQ ID NO: 29723 - DNA, 25 bp, Mus musculus
gacacattcatgttcgaaggccacg

SEQ ID NO: 29724 - DNA, 25 bp, Mus musculus
gacacattggttctgcactgccgcg

SEQ ID NO: 29725 - DNA, 25 bp, Mus musculus
gacacatttgagtctgagttctact

SEQ ID NO: 29726 - DNA, 25 bp, Mus musculus
gacaccaagcctgtccaaagcgtgg

SEQ ID NO: 29727 - DNA, 25 bp, Mus musculus
gacaccaaggccctgaactgcagtg

SEQ ID NO: 29728 - DNA, 25 bp, Mus musculus
gacaccacagacagttattactgca

SEQ ID NO: 29729 - DNA, 25 bp, Mus musculus
gacaccacagtaccagagagaaaga

SEQ ID NO: 29730 - DNA, 25 bp, Mus musculus
gacaccacagtagcagagagaaaga

SEQ ID NO: 29731 - DNA, 25 bp, Mus musculus
gacaccaggcttttccacgtgcaag

SEQ ID NO: 29732 - DNA, 25 bp, Mus musculus
gacaccatcgaggtgcagcagatga

SEQ ID NO: 29733 - DNA, 25 bp, Mus musculus
gacaccatctggaacgagctgcatt

SEQ ID NO: 29734 - DNA, 25 bp, Mus musculus
gacaccatgaagtacagttggccat

SEQ ID NO: 29735 - DNA, 25 bp, Mus musculus
gacaccatgatgagccttctgaaga

SEQ ID NO: 29736 - DNA, 25 bp, Mus musculus
gacaccatgatgtgccttctgaaga

SEQ ID NO: 29737 - DNA, 25 bp, Mus musculus
gacaccatgcagatcattctacagc

SEQ ID NO: 29738 - DNA, 25 bp, Mus musculus
gacacccactcaagaatagagcaat

SEQ ID NO: 29739 - DNA, 25 bp, Mus musculus
gacaccccgaaccaggaggaccaag

SEQ ID NO: 29740 - DNA, 25 bp, Mus musculus
gacacccctttttaccagtgtgcag

SEQ ID NO: 29741 - DNA, 25 bp, Mus musculus
gacaccctaaaaaggtgcagcgctg

SEQ ID NO: 29742 - DNA, 25 bp, Mus musculus
gacaccctagaagtcaggaggcatg

SEQ ID NO: 29743 - DNA, 25 bp, Mus musculus
gacaccctcatgaagtgcacctttg

SEQ ID NO: 29744 - DNA, 25 bp, Mus musculus
gacaccctctctacaggaaatacat

SEQ ID NO: 29745 - DNA, 25 bp, Mus musculus
gacaccctctcttcaggaaatacat

SEQ ID NO: 29746 - DNA, 25 bp, Mus musculus
gacaccctggaaccagggtgcaact

SEQ ID NO: 29747 - DNA, 25 bp, Mus musculus
gacaccgaaactaatctggcaggaa

SEQ ID NO: 29748 - DNA, 25 bp, Mus musculus
gacaccgagttacctctttccttag

SEQ ID NO: 29749 - DNA, 25 bp, Mus musculus
gacaccgagttccagcatccttgtt

SEQ ID NO: 29750 - DNA, 25 bp, Mus musculus
gacaccgccctgttatatttaaggg

SEQ ID NO: 29751 - DNA, 25 bp, Mus musculus
gacaccgccttcatcagtcctgatt

SEQ ID NO: 29752 - DNA, 25 bp, Mus musculus
gacaccgcgtcacggatagacgtca

SEQ ID NO: 29753 - DNA, 25 bp, Mus musculus
gacaccgtccgctgcatcaagtctt

SEQ ID NO: 29754 - DNA, 25 bp, Mus musculus
gacaccgtggaggaagctttctaca

SEQ ID NO: 29755 - DNA, 25 bp, Mus musculus
gacacctatatcaacattagagagg

SEQ ID NO: 29756 - DNA, 25 bp, Mus musculus
gacacctatcccaatgaggagaagc

SEQ ID NO: 29757 - DNA, 25 bp, Mus musculus
gacacctatgtacaggcattgctgg

SEQ ID NO: 29758 - DNA, 25 bp, Mus musculus
gacacctgtccacccgacagtggag

SEQ ID NO: 29759 - DNA, 25 bp, Mus musculus
gacaccttcaaagccgagaatccgg

SEQ ID NO: 29760 - DNA, 25 bp, Mus musculus
gacaccttctgaccatgaagaaaga

SEQ ID NO: 29761 - DNA, 25 bp, Mus musculus
gacaccttcttgctggcctcctcgg

SEQ ID NO: 29762 - DNA, 25 bp, Mus musculus
gacaccttcttggtggcctcctcgg

SEQ ID NO: 29763 - DNA, 25 bp, Mus musculus
gacacgaatttatttcagcactcac

SEQ ID NO: 29764 - DNA, 25 bp, Mus musculus
gacacgacagaatcctcagcatcct

SEQ ID NO: 29765 - DNA, 25 bp, Mus musculus
gacacgaccattaggaacttgttgc

SEQ ID NO: 29766 - DNA, 25 bp, Mus musculus
gacacgactctatggtgaggactga

SEQ ID NO: 29767 - DNA, 25 bp, Mus musculus
gacacgagtatacattcagcatcat

SEQ ID NO: 29768 - DNA, 25 bp, Mus musculus
gacacgatcacccacggactcatgg

SEQ ID NO: 29769 - DNA, 25 bp, Mus musculus
gacacgcactactggacttggatca

SEQ ID NO: 29770 - DNA, 25 bp, Mus musculus
gacacgcctgcgaaatgttcctgtt

SEQ ID NO: 29771 - DNA, 25 bp, Mus musculus
gacacgcgctatagcaacagcttct

SEQ ID NO: 29772 - DNA, 25 bp, Mus musculus
gacacgctatggtaaacaaactgca

SEQ ID NO: 29773 - DNA, 25 bp, Mus musculus
gacacgctggtcaaagttcgaaaca

SEQ ID NO: 29774 - DNA, 25 bp, Mus musculus
gacacgctggtctaagttcgaaaca

SEQ ID NO: 29775 - DNA, 25 bp, Mus musculus
gacacggaaatgacacagcaggaca

SEQ ID NO: 29776 - DNA, 25 bp, Mus musculus
gacacggaggactgtccgggactca

SEQ ID NO: 29777 - DNA, 25 bp, Mus musculus
gacacggatgctctctatattgtgt

SEQ ID NO: 29778 - DNA, 25 bp, Mus musculus
gacacgggagggtccatagatttta

SEQ ID NO: 29779 - DNA, 25 bp, Mus musculus
gacacgggatgacctgttcaacacc

SEQ ID NO: 29780 - DNA, 25 bp, Mus musculus
gacacgggtttctcacaggattcct

SEQ ID NO: 29781 - DNA, 25 bp, Mus musculus
gacacgggtttttcctgcagctgga

SEQ ID NO: 29782 - DNA, 25 bp, Mus musculus
gacacggtgagctggatctccagcg

SEQ ID NO: 29783 - DNA, 25 bp, Mus musculus
gacacgtacaaactggatccggaca

SEQ ID NO: 29784 - DNA, 25 bp, Mus musculus
gacacgtagttgctacccttttggg

SEQ ID NO: 29785 - DNA, 25 bp, Mus musculus
gacacgtcctgtcactatgggtacc

SEQ ID NO: 29786 - DNA, 25 bp, Mus musculus
gacacgtcctgtgactatgggtacc

SEQ ID NO: 29787 - DNA, 25 bp, Mus musculus
gacacgtgctgatcctgctttacca

SEQ ID NO: 29788 - DNA, 25 bp, Mus musculus
gacactaaccagaagctacggctct

SEQ ID NO: 29789 - DNA, 25 bp, Mus musculus
gacactaagcagatgatgagtagct

SEQ ID NO: 29790 - DNA, 25 bp, Mus musculus
gacactaagcctcagcctgttgact

SEQ ID NO: 29791 - DNA, 25 bp, Mus musculus
gacactaagtaagaacaccttcaac

SEQ ID NO: 29792 - DNA, 25 bp, Mus musculus
gacactaatcaagaaaggagtccag

SEQ ID NO: 29793 - DNA, 25 bp, Mus musculus
gacactaatccctacgggttcacag

SEQ ID NO: 29794 - DNA, 25 bp, Mus musculus
gacactacgggtagagcgctactct

SEQ ID NO: 29795 - DNA, 25 bp, Mus musculus
gacactagacacattaagaaggccc

SEQ ID NO: 29796 - DNA, 25 bp, Mus musculus
gacactagacagagcaactccagcg

SEQ ID NO: 29797 - DNA, 25 bp, Mus musculus
gacactagacagtgcaactccagcg

SEQ ID NO: 29798 - DNA, 25 bp, Mus musculus
gacactagaggagctcctgaagccc

SEQ ID NO: 29799 - DNA, 25 bp, Mus musculus
gacactatgacggaagtaaaggctt

SEQ ID NO: 29800 - DNA, 25 bp, Mus musculus
gacactcactcttaccacctgtggt

SEQ ID NO: 29801 - DNA, 25 bp, Mus musculus
gacactcagacattcagcagccaag

SEQ ID NO: 29802 - DNA, 25 bp, Mus musculus
gacactcctcctctgatactggcag

SEQ ID NO: 29803 - DNA, 25 bp, Mus musculus
gacactgaaggagcacactgaccag

SEQ ID NO: 29804 - DNA, 25 bp, Mus musculus
gacactgagagctctatcatcatta

SEQ ID NO: 29805 - DNA, 25 bp, Mus musculus
gacactgagggaacgacacattctg

SEQ ID NO: 29806 - DNA, 25 bp, Mus musculus
gacactgatgagatcccagccaaaa

SEQ ID NO: 29807 - DNA, 25 bp, Mus musculus
gacactgcaggcagtgttcacgctg

SEQ ID NO: 29808 - DNA, 25 bp, Mus musculus
gacactgcaggctgtgttcacgctg

SEQ ID NO: 29809 - DNA, 25 bp, Mus musculus
gacactggagcttggtcgtcctacc

SEQ ID NO: 29810 - DNA, 25 bp, Mus musculus
gacactggcttcatgggtccttggg

SEQ ID NO: 29811 - DNA, 25 bp, Mus musculus
gacactgggatccagactccactgg

SEQ ID NO: 29812 - DNA, 25 bp, Mus musculus
gacactgggcctagattctgtctcc

SEQ ID NO: 29813 - DNA, 25 bp, Mus musculus
gacactgtccatcttcgacaacgag

SEQ ID NO: 29814 - DNA, 25 bp, Mus musculus
gacactgtcctctgagtactgcggc

SEQ ID NO: 29815 - DNA, 25 bp, Mus musculus
gacactgtgcagaccttcgtcattc

SEQ ID NO: 29816 - DNA, 25 bp, Mus musculus
gacactgttgcctcttcagattctg

SEQ ID NO: 29817 - DNA, 25 bp, Mus musculus
gacacttactctgggtttctggact

SEQ ID NO: 29818 - DNA, 25 bp, Mus musculus
gacacttcgggtctcttggagctaa

SEQ ID NO: 29819 - DNA, 25 bp, Mus musculus
gacacttctgatacaacttccaccg

SEQ ID NO: 29820 - DNA, 25 bp, Mus musculus
gacacttctttctgcaaggagagaa

SEQ ID NO: 29821 - DNA, 25 bp, Mus musculus
gacacttgcccatgcagaatggagg

SEQ ID NO: 29822 - DNA, 25 bp, Mus musculus
gacacttggacagctgcaaaagagg

SEQ ID NO: 29823 - DNA, 25 bp, Mus musculus
gacacttggatttcttggacatcct

SEQ ID NO: 29824 - DNA, 25 bp, Mus musculus
gacacttggctggtttagtttttag

SEQ ID NO: 29825 - DNA, 25 bp, Mus musculus
gacacttgtctgataatgactctgc

SEQ ID NO: 29826 - DNA, 25 bp, Mus musculus
gacacttgtcttcacttgtccgggt

SEQ ID NO: 29827 - DNA, 25 bp, Mus musculus
gacacttgtgtctacccagaaggga

SEQ ID NO: 29828 - DNA, 25 bp, Mus musculus
gacactttgtactggtgtgacacca

SEQ ID NO: 29829 - DNA, 25 bp, Mus musculus
gacagaaaaactagcccagaagaac

SEQ ID NO: 29830 - DNA, 25 bp, Mus musculus
gacagaaaatctggttctcttgcac

SEQ ID NO: 29831 - DNA, 25 bp, Mus musculus
gacagaaacagcatccaccattaca

SEQ ID NO: 29832 - DNA, 25 bp, Mus musculus
gacagaaacatctggtgatgggtga

SEQ ID NO: 29833 - DNA, 25 bp, Mus musculus
gacagaaacattgacctggcaacgc

SEQ ID NO: 29834 - DNA, 25 bp, Mus musculus
gacagaaagagcaggtgcatgccga

SEQ ID NO: 29835 - DNA, 25 bp, Mus musculus
gacagaaagccgagaatcagcagcc

SEQ ID NO: 29836 - DNA, 25 bp, Mus musculus
gacagaaagtaacctcagcattgac

SEQ ID NO: 29837 - DNA, 25 bp, Mus musculus
gacagaaattgggagaacagaacac

SEQ ID NO: 29838 - DNA, 25 bp, Mus musculus
gacagaacaactccgaataggcccg

SEQ ID NO: 29839 - DNA, 25 bp, Mus musculus
gacagaacagctgctcagtgtgatc

SEQ ID NO: 29840 - DNA, 25 bp, Mus musculus
gacagaacgtgtcctttcctggaca

SEQ ID NO: 29841 - DNA, 25 bp, Mus musculus
gacagaagaacagttagcaaccgct

SEQ ID NO: 29842 - DNA, 25 bp, Mus musculus
gacagaagcaatatcctcatttata

SEQ ID NO: 29843 - DNA, 25 bp, Mus musculus
gacagaagcctgtgcctcatcccag

SEQ ID NO: 29844 - DNA, 25 bp, Mus musculus
gacagaagctatgcactggcaggct

SEQ ID NO: 29845 - DNA, 25 bp, Mus musculus
gacagaaggaccagtatccactccc

SEQ ID NO: 29846 - DNA, 25 bp, Mus musculus
gacagaaggacctgtatccactccc

SEQ ID NO: 29847 - DNA, 25 bp, Mus musculus
gacagaatcatcacagggtcctttg

SEQ ID NO: 29848 - DNA, 25 bp, Mus musculus
gacagaatcatcagagggaaccagc

SEQ ID NO: 29849 - DNA, 25 bp, Mus musculus
gacagaatgtagtgacgatattgaa

SEQ ID NO: 29850 - DNA, 25 bp, Mus musculus
gacagaattatggtacttcaccagc

SEQ ID NO: 29851 - DNA, 25 bp, Mus musculus
gacagacaacagtagaaattggcgc

SEQ ID NO: 29852 - DNA, 25 bp, Mus musculus
gacagacacaaattggccgctcagg

SEQ ID NO: 29853 - DNA, 25 bp, Mus musculus
gacagacagaatgttttttcctaca

SEQ ID NO: 29854 - DNA, 25 bp, Mus musculus
gacagacagctgtttgacaccatct

SEQ ID NO: 29855 - DNA, 25 bp, Mus musculus
gacagacagtttctcatccgtgaac

SEQ ID NO: 29856 - DNA, 25 bp, Mus musculus
gacagacatgcctttccgctttcat

SEQ ID NO: 29857 - DNA, 25 bp, Mus musculus
gacagacatggattgacaaaagact

SEQ ID NO: 29858 - DNA, 25 bp, Mus musculus
gacagaccatggctcagtcaccatt

SEQ ID NO: 29859 - DNA, 25 bp, Mus musculus
gacagacccctgtgcaggtgcaaat

SEQ ID NO: 29860 - DNA, 25 bp, Mus musculus
gacagaccccttggttcaagagaac

SEQ ID NO: 29861 - DNA, 25 bp, Mus musculus
gacagacgaatacagttcaaactct

SEQ ID NO: 29862 - DNA, 25 bp, Mus musculus
gacagacgctatcatctacttaaag

SEQ ID NO: 29863 - DNA, 25 bp, Mus musculus
gacagacgctatgatctacttaaag

SEQ ID NO: 29864 - DNA, 25 bp, Mus musculus
gacagactacttcttgagcagcggt

SEQ ID NO: 29865 - DNA, 25 bp, Mus musculus
gacagactatggagcttttatcaaa

SEQ ID NO: 29866 - DNA, 25 bp, Mus musculus
gacagactatgtcctcatctggagg

SEQ ID NO: 29867 - DNA, 25 bp, Mus musculus
gacagacttgagcagtgctgccaaa

SEQ ID NO: 29868 - DNA, 25 bp, Mus musculus
gacagagaaaagagggtctttgcca

SEQ ID NO: 29869 - DNA, 25 bp, Mus musculus
gacagagaacacaatcaccgtcagc

SEQ ID NO: 29870 - DNA, 25 bp, Mus musculus
gacagagaatgaccacatcaacctg

SEQ ID NO: 29871 - DNA, 25 bp, Mus musculus
gacagagacctttaccctggacacc

SEQ ID NO: 29872 - DNA, 25 bp, Mus musculus
gacagagactgggtccagagtacat

SEQ ID NO: 29873 - DNA, 25 bp, Mus musculus
gacagagaggaagacacatgtacta

SEQ ID NO: 29874 - DNA, 25 bp, Mus musculus
gacagagatgtttggagaaactgcc

SEQ ID NO: 29875 - DNA, 25 bp, Mus musculus
gacagagcaaagtacgattccatca

SEQ ID NO: 29876 - DNA, 25 bp, Mus musculus
gacagagcatcagtcacaagtacct

SEQ ID NO: 29877 - DNA, 25 bp, Mus musculus
gacagagcatcggaggcctcttgta

SEQ ID NO: 29878 - DNA, 25 bp, Mus musculus
gacagagccgctcacaaatagaggt

SEQ ID NO: 29879 - DNA, 25 bp, Mus musculus
gacagagctgttattgagcataatt

SEQ ID NO: 29880 - DNA, 25 bp, Mus musculus
gacagaggacctgtccctgtttcta

SEQ ID NO: 29881 - DNA, 25 bp, Mus musculus
gacagaggacgctgctaaggatcct

SEQ ID NO: 29882 - DNA, 25 bp, Mus musculus
gacagaggagatcgactgcactgaa

SEQ ID NO: 29883 - DNA, 25 bp, Mus musculus
gacagaggatagacaaaagtttccc

SEQ ID NO: 29884 - DNA, 25 bp, Mus musculus
gacagaggcaccaagattttctaca

SEQ ID NO: 29885 - DNA, 25 bp, Mus musculus
gacagaggccgggattttgaaaagc

SEQ ID NO: 29886 - DNA, 25 bp, Mus musculus
gacagagggctggtcttcattctta

SEQ ID NO: 29887 - DNA, 25 bp, Mus musculus
gacagaggtcccatcacttagcagt

SEQ ID NO: 29888 - DNA, 25 bp, Mus musculus
gacagaggtcctacaggaacaccag

SEQ ID NO: 29889 - DNA, 25 bp, Mus musculus
gacagagtacatgtgtggagatcag

SEQ ID NO: 29890 - DNA, 25 bp, Mus musculus
gacagagtagaagacaattcagtaa

SEQ ID NO: 29891 - DNA, 25 bp, Mus musculus
gacagagtcggtgcagtatgaccac

SEQ ID NO: 29892 - DNA, 25 bp, Mus musculus
gacagagtcttgaggatacacagga

SEQ ID NO: 29893 - DNA, 25 bp, Mus musculus
gacagatattcactcaagctacaca

SEQ ID NO: 29894 - DNA, 25 bp, Mus musculus
gacagatcatgggagagataaattg

SEQ ID NO: 29895 - DNA, 25 bp, Mus musculus
gacagatcctgacggaaatcccaag

SEQ ID NO: 29896 - DNA, 25 bp, Mus musculus
gacagatgacagctcaatcagaagt

SEQ ID NO: 29897 - DNA, 25 bp, Mus musculus
gacagatgacaggtcaatcagaagt

SEQ ID NO: 29898 - DNA, 25 bp, Mus musculus
gacagatgaccttgaccactacaac

SEQ ID NO: 29899 - DNA, 25 bp, Mus musculus
gacagatgcacagtcaagattggcc

SEQ ID NO: 29900 - DNA, 25 bp, Mus musculus
gacagatgctgtcatctatctgaag

SEQ ID NO: 29901 - DNA, 25 bp, Mus musculus
gacagatgggactgtttatcggagc

SEQ ID NO: 29902 - DNA, 25 bp, Mus musculus
gacagatgggcctcagtttgaagat

SEQ ID NO: 29903 - DNA, 25 bp, Mus musculus
gacagatgtacttatgttgtagata

SEQ ID NO: 29904 - DNA, 25 bp, Mus musculus
gacagatgtgagcttacccttgagg

SEQ ID NO: 29905 - DNA, 25 bp, Mus musculus
gacagatgttccttaagaccggcaa

SEQ ID NO: 29906 - DNA, 25 bp, Mus musculus
gacagattcttcgaacgccagctca

SEQ ID NO: 29907 - DNA, 25 bp, Mus musculus
gacagattctttcactgaactcaga

SEQ ID NO: 29908 - DNA, 25 bp, Mus musculus
gacagattgcgcatcctggaggacc

SEQ ID NO: 29909 - DNA, 25 bp, Mus musculus
gacagatttctaccagagggctacc

SEQ ID NO: 29910 - DNA, 25 bp, Mus musculus
gacagcaaagtgagcttccccaaga

SEQ ID NO: 29911 - DNA, 25 bp, Mus musculus
gacagcaaccgctttgaggaatatg

SEQ ID NO: 29912 - DNA, 25 bp, Mus musculus
gacagcaaggtactcaacagcctgg

SEQ ID NO: 29913 - DNA, 25 bp, Mus musculus
gacagcaagtgtaggatcattttcc

SEQ ID NO: 29914 - DNA, 25 bp, Mus musculus
gacagcaatgagcagactgggctct

SEQ ID NO: 29915 - DNA, 25 bp, Mus musculus
gacagcaatgttctagtctatgagg

SEQ ID NO: 29916 - DNA, 25 bp, Mus musculus
gacagcacagccaaggaggtctacc

SEQ ID NO: 29917 - DNA, 25 bp, Mus musculus
gacagcacgctgtgcatgcagaaag

SEQ ID NO: 29918 - DNA, 25 bp, Mus musculus
gacagcacggtttactctgaatcct

SEQ ID NO: 29919 - DNA, 25 bp, Mus musculus
gacagcactagagtgtaatgaccct

SEQ ID NO: 29920 - DNA, 25 bp, Mus musculus
gacagcactctggaatttctgttca

SEQ ID NO: 29921 - DNA, 25 bp, Mus musculus
gacagcacttacacgtatgtcagca

SEQ ID NO: 29922 - DNA, 25 bp, Mus musculus
gacagcagattctagtgcccagcaa

SEQ ID NO: 29923 - DNA, 25 bp, Mus musculus
gacagcagcagtgggaaacattatg

SEQ ID NO: 29924 - DNA, 25 bp, Mus musculus
gacagcagcgttgtgattcagcaag

SEQ ID NO: 29925 - DNA, 25 bp, Mus musculus
gacagcagtaccacgggaccctggt

SEQ ID NO: 29926 - DNA, 25 bp, Mus musculus
gacagcagtagcattctagctgaca

SEQ ID NO: 29927 - DNA, 25 bp, Mus musculus
gacagcagtcacagtgctgggctca

SEQ ID NO: 29928 - DNA, 25 bp, Mus musculus
gacagcagtgacattctgcagaatg

SEQ ID NO: 29929 - DNA, 25 bp, Mus musculus
gacagcataatcttgaactggccag

SEQ ID NO: 29930 - DNA, 25 bp, Mus musculus
gacagcatcaagttcactaccgtgg

SEQ ID NO: 29931 - DNA, 25 bp, Mus musculus
gacagcatcccacggacacaagtag

SEQ ID NO: 29932 - DNA, 25 bp, Mus musculus
gacagcatccgcaagcattgcgtgg

SEQ ID NO: 29933 - DNA, 25 bp, Mus musculus
gacagcatctctgggacatcaaggt

SEQ ID NO: 29934 - DNA, 25 bp, Mus musculus
gacagcatctggcatctatttatga

SEQ ID NO: 29935 - DNA, 25 bp, Mus musculus
gacagcatgaacttcactccgacac

SEQ ID NO: 29936 - DNA, 25 bp, Mus musculus
gacagcatgagtatcccgcgaggct

SEQ ID NO: 29937 - DNA, 25 bp, Mus musculus
gacagcatgagtttcccgcgaggct

SEQ ID NO: 29938 - DNA, 25 bp, Mus musculus
gacagcatgatgagacttattctga

SEQ ID NO: 29939 - DNA, 25 bp, Mus musculus
gacagcatgatgatagaggaacttc

SEQ ID NO: 29940 - DNA, 25 bp, Mus musculus
gacagcatgccttcgctgcgatgcc

SEQ ID NO: 29941 - DNA, 25 bp, Mus musculus
gacagcatgcttctgcgtgggctca

SEQ ID NO: 29942 - DNA, 25 bp, Mus musculus
gacagcatggagtccctctttcctg

SEQ ID NO: 29943 - DNA, 25 bp, Mus musculus
gacagccaagtccttcagcataaag

SEQ ID NO: 29944 - DNA, 25 bp, Mus musculus
gacagccaatggtgtcctcttctaa

SEQ ID NO: 29945 - DNA, 25 bp, Mus musculus
gacagccacttccaagcagtgcagt

SEQ ID NO: 29946 - DNA, 25 bp, Mus musculus
gacagccagcatgtcatccacaaat

SEQ ID NO: 29947 - DNA, 25 bp, Mus musculus
gacagccatgctggtttgctgcaga

SEQ ID NO: 29948 - DNA, 25 bp, Mus musculus
gacagcccagtaagtctacgtggga

SEQ ID NO: 29949 - DNA, 25 bp, Mus musculus
gacagccccggttccggagcatgtg

SEQ ID NO: 29950 - DNA, 25 bp, Mus musculus
gacagccctcattacagtgatcact

SEQ ID NO: 29951 - DNA, 25 bp, Mus musculus
gacagcctgagacagtccttacaga

SEQ ID NO: 29952 - DNA, 25 bp, Mus musculus
gacagccttgggatacactcttaga

SEQ ID NO: 29953 - DNA, 25 bp, Mus musculus
gacagccttttctcaacagcccaat

SEQ ID NO: 29954 - DNA, 25 bp, Mus musculus
gacagcgactaccatgatgagaaca

SEQ ID NO: 29955 - DNA, 25 bp, Mus musculus
gacagcgagcgctactctcgtagat

SEQ ID NO: 29956 - DNA, 25 bp, Mus musculus
gacagcggccacgttcatagacgca

SEQ ID NO: 29957 - DNA, 25 bp, Mus musculus
gacagcggccagtactggcccagca

SEQ ID NO: 29958 - DNA, 25 bp, Mus musculus
gacagcggcctcaaaacggagggca

SEQ ID NO: 29959 - DNA, 25 bp, Mus musculus
gacagcgtgtgaatgctgccaccat

SEQ ID NO: 29960 - DNA, 25 bp, Mus musculus
gacagcgttgcaaattccattcact

SEQ ID NO: 29961 - DNA, 25 bp, Mus musculus
gacagctacagccatgatgattaaa

SEQ ID NO: 29962 - DNA, 25 bp, Mus musculus
gacagctcaatattgatatttccaa

SEQ ID NO: 29963 - DNA, 25 bp, Mus musculus
gacagctcagaagcttcaagtcaag

SEQ ID NO: 29964 - DNA, 25 bp, Mus musculus
gacagctcaggacggtcataagcat

SEQ ID NO: 29965 - DNA, 25 bp, Mus musculus
gacagctccttactctgtactttgt

SEQ ID NO: 29966 - DNA, 25 bp, Mus musculus
gacagctcggattcacactcaagaa

SEQ ID NO: 29967 - DNA, 25 bp, Mus musculus
gacagctcgttgatcttttaacccc

SEQ ID NO: 29968 - DNA, 25 bp, Mus musculus
gacagctctggatcatactgcttgg

SEQ ID NO: 29969 - DNA, 25 bp, Mus musculus
gacagctgagtcttagtgcaatgcc

SEQ ID NO: 29970 - DNA, 25 bp, Mus musculus
gacagctgcagacctggttccaatc

SEQ ID NO: 29971 - DNA, 25 bp, Mus musculus
gacagctgcctacatctgaaacatg

SEQ ID NO: 29972 - DNA, 25 bp, Mus musculus
gacagctgccttgcgtgtcaccgat

SEQ ID NO: 29973 - DNA, 25 bp, Mus musculus
gacagctgctcagtctcgtgggtgc

SEQ ID NO: 29974 - DNA, 25 bp, Mus musculus
gacagctgggaaactctgccaggaa

SEQ ID NO: 29975 - DNA, 25 bp, Mus musculus
gacagctgtcttgatagactggata

SEQ ID NO: 29976 - DNA, 25 bp, Mus musculus
gacagctgttaacaactgagaatgt

SEQ ID NO: 29977 - DNA, 25 bp, Mus musculus
gacagctgtttgacaccatctccct

SEQ ID NO: 29978 - DNA, 25 bp, Mus musculus
gacagcttcgaatacattaaccaag

SEQ ID NO: 29979 - DNA, 25 bp, Mus musculus
gacagctttctagtaacggtggtgg

SEQ ID NO: 29980 - DNA, 25 bp, Mus musculus
gacagcttttcgcaagacatacgat

SEQ ID NO: 29981 - DNA, 25 bp, Mus musculus
gacaggaaagccactgcagcgtcca

SEQ ID NO: 29982 - DNA, 25 bp, Mus musculus
gacaggaacagctccctcgggtgtt

SEQ ID NO: 29983 - DNA, 25 bp, Mus musculus
gacaggacccttgaaaaccagcttt

SEQ ID NO: 29984 - DNA, 25 bp, Mus musculus
gacaggacgctgattttgcacatct

SEQ ID NO: 29985 - DNA, 25 bp, Mus musculus
gacaggagccggaagcctagctctg

SEQ ID NO: 29986 - DNA, 25 bp, Mus musculus
gacaggaggcagtagctaaggatcc

SEQ ID NO: 29987 - DNA, 25 bp, Mus musculus
gacaggaggtccacagaatcctcca

SEQ ID NO: 29988 - DNA, 25 bp, Mus musculus
gacaggaggtgtcgaggctgcggat

SEQ ID NO: 29989 - DNA, 25 bp, Mus musculus
gacaggataagactgttgtcagagc

SEQ ID NO: 29990 - DNA, 25 bp, Mus musculus
gacaggatctccagaaagactttgc

SEQ ID NO: 29991 - DNA, 25 bp, Mus musculus
gacaggattccatggctttgcacct

SEQ ID NO: 29992 - DNA, 25 bp, Mus musculus
gacaggcacagcatcgacattacct

SEQ ID NO: 29993 - DNA, 25 bp, Mus musculus
gacaggcactgtcagaatgctacct

SEQ ID NO: 29994 - DNA, 25 bp, Mus musculus
gacaggcagacggaccggatatgca

SEQ ID NO: 29995 - DNA, 25 bp, Mus musculus
gacaggcagcgattgacaaaatgac

SEQ ID NO: 29996 - DNA, 25 bp, Mus musculus
gacaggcattcacacttctcttgaa

SEQ ID NO: 29997 - DNA, 25 bp, Mus musculus
gacaggcgaaacaggctgaaagtgt

SEQ ID NO: 29998 - DNA, 25 bp, Mus musculus
gacaggcgactgcagtacactgagc

SEQ ID NO: 29999 - DNA, 25 bp, Mus musculus
gacaggctgagctgggactattgcg

SEQ ID NO: 30000 - DNA, 25 bp, Mus musculus
gacaggctgctgtctggtggccttc

SEQ ID NO: 30001 - DNA, 25 bp, Mus musculus
gacagggaacgacagaaactagaaa

SEQ ID NO: 30002 - DNA, 25 bp, Mus musculus
gacagggactctaccttcaatgtgt

SEQ ID NO: 30003 - DNA, 25 bp, Mus musculus
gacagggcagactctcctgacctca

SEQ ID NO: 30004 - DNA, 25 bp, Mus musculus
gacagggccctcataggatttcagc

SEQ ID NO: 30005 - DNA, 25 bp, Mus musculus
gacagggtacgagatgctcacgctc

SEQ ID NO: 30006 - DNA, 25 bp, Mus musculus
gacagggtggcttcctacctggtgt

SEQ ID NO: 30007 - DNA, 25 bp, Mus musculus
gacaggtacagcacaggcagcgaca

SEQ ID NO: 30008 - DNA, 25 bp, Mus musculus
gacaggtcagctacattcgctggga

SEQ ID NO: 30009 - DNA, 25 bp, Mus musculus
gacaggtgctccgtgtgttcctgcc

SEQ ID NO: 30010 - DNA, 25 bp, Mus musculus
gacaggtggtcgtctcagccctgaa

SEQ ID NO: 30011 - DNA, 25 bp, Mus musculus
gacaggttcagccatctgcagcaga

SEQ ID NO: 30012 - DNA, 25 bp, Mus musculus
gacagtaaaagagtcaatcactgag

SEQ ID NO: 30013 - DNA, 25 bp, Mus musculus
gacagtaataggaaccaggcagcag

SEQ ID NO: 30014 - DNA, 25 bp, Mus musculus
gacagtaataggtaccaggcagcag

SEQ ID NO: 30015 - DNA, 25 bp, Mus musculus
gacagtacactttcacagcatcaag

SEQ ID NO: 30016 - DNA, 25 bp, Mus musculus
gacagtaggctcattcctgcaggac

SEQ ID NO: 30017 - DNA, 25 bp, Mus musculus
gacagtagtcaacatgggctactca

SEQ ID NO: 30018 - DNA, 25 bp, Mus musculus
gacagtatcaccagcggctcttcaa

SEQ ID NO: 30019 - DNA, 25 bp, Mus musculus
gacagtatcacctgcggctcttcaa

SEQ ID NO: 30020 - DNA, 25 bp, Mus musculus
gacagtattttatgtctacccgctg

SEQ ID NO: 30021 - DNA, 25 bp, Mus musculus
gacagtcatcttttgccgaatgaag

SEQ ID NO: 30022 - DNA, 25 bp, Mus musculus
gacagtcatggcaacagcgtgcacc

SEQ ID NO: 30023 - DNA, 25 bp, Mus musculus
gacagtcccaggtgctctgtgggta

SEQ ID NO: 30024 - DNA, 25 bp, Mus musculus
gacagtcccctgctaatggtcatag

SEQ ID NO: 30025 - DNA, 25 bp, Mus musculus
gacagtcccgtcgttatgactggtg

SEQ ID NO: 30026 - DNA, 25 bp, Mus musculus
gacagtccttacagaaacaccccaa

SEQ ID NO: 30027 - DNA, 25 bp, Mus musculus
gacagtcggcccaatatgtcaagac

SEQ ID NO: 30028 - DNA, 25 bp, Mus musculus
gacagtctataacctgaaccgcacc

SEQ ID NO: 30029 - DNA, 25 bp, Mus musculus
gacagtctccaccattttcctggtg

SEQ ID NO: 30030 - DNA, 25 bp, Mus musculus
gacagtctccacgattttcctggtg

SEQ ID NO: 30031 - DNA, 25 bp, Mus musculus
gacagtctccgtaagaaggatgaca

SEQ ID NO: 30032 - DNA, 25 bp, Mus musculus
gacagtctggctcagcagactcctg

SEQ ID NO: 30033 - DNA, 25 bp, Mus musculus
gacagtcttatgaaatccgaatgct

SEQ ID NO: 30034 - DNA, 25 bp, Mus musculus
gacagtgaagtagaacagaacaaaa

SEQ ID NO: 30035 - DNA, 25 bp, Mus musculus
gacagtgacagcgaccaggaagaga

SEQ ID NO: 30036 - DNA, 25 bp, Mus musculus
gacagtgaccatagtgcagcaggcg

SEQ ID NO: 30037 - DNA, 25 bp, Mus musculus
gacagtgaccctccgatcagtgaga

SEQ ID NO: 30038 - DNA, 25 bp, Mus musculus
gacagtgagctaggccgtctgacac

SEQ ID NO: 30039 - DNA, 25 bp, Mus musculus
gacagtgagttcagacttgaaaaaa

SEQ ID NO: 30040 - DNA, 25 bp, Mus musculus
gacagtgatgcagccgcatgtccct

SEQ ID NO: 30041 - DNA, 25 bp, Mus musculus
gacagtgatgctgtcgttcacccga

SEQ ID NO: 30042 - DNA, 25 bp, Mus musculus
gacagtgccagcagaagagtcagga

SEQ ID NO: 30043 - DNA, 25 bp, Mus musculus
gacagtgcccggcaccactatgagt

SEQ ID NO: 30044 - DNA, 25 bp, Mus musculus
gacagtgccgggtgcaacacctgca

SEQ ID NO: 30045 - DNA, 25 bp, Mus musculus
gacagtgcggctacatccacctatg

SEQ ID NO: 30046 - DNA, 25 bp, Mus musculus
gacagtgctcctactgcagtgacca

SEQ ID NO: 30047 - DNA, 25 bp, Mus musculus
gacagtgctgcccaggatggacaac

SEQ ID NO: 30048 - DNA, 25 bp, Mus musculus
gacagtgctgccgaggatggacaac

SEQ ID NO: 30049 - DNA, 25 bp, Mus musculus
gacagtgctgctctcagagatggct

SEQ ID NO: 30050 - DNA, 25 bp, Mus musculus
gacagtgctggtgggaatctggccg

SEQ ID NO: 30051 - DNA, 25 bp, Mus musculus
gacagtgcttgagttagtcctgcag

SEQ ID NO: 30052 - DNA, 25 bp, Mus musculus
gacagtggcagttaaggtccagcac

SEQ ID NO: 30053 - DNA, 25 bp, Mus musculus
gacagtggcgaaggaagccacgctt

SEQ ID NO: 30054 - DNA, 25 bp, Mus musculus
gacagtggtctagagcagatgtcca

SEQ ID NO: 30055 - DNA, 25 bp, Mus musculus
gacagtggttcttgttctgagtgcc

SEQ ID NO: 30056 - DNA, 25 bp, Mus musculus
gacagtggttggctaatgtaagaat

SEQ ID NO: 30057 - DNA, 25 bp, Mus musculus
gacagtgtagtcctgcaaaacattt

SEQ ID NO: 30058 - DNA, 25 bp, Mus musculus
gacagtgtctactacattgataacc

SEQ ID NO: 30059 - DNA, 25 bp, Mus musculus
gacagtgtggcctctggtgcagaga

SEQ ID NO: 30060 - DNA, 25 bp, Mus musculus
gacagtgtggtaccacagcgacgaa

SEQ ID NO: 30061 - DNA, 25 bp, Mus musculus
gacagtgttcctggcttgcgtgctg

SEQ ID NO: 30062 - DNA, 25 bp, Mus musculus
gacagtgtttcctcacggcctgcct

SEQ ID NO: 30063 - DNA, 25 bp, Mus musculus
gacagttatctgctcagccaatcac

SEQ ID NO: 30064 - DNA, 25 bp, Mus musculus
gacagttcagacaaggcccctgtgg

SEQ ID NO: 30065 - DNA, 25 bp, Mus musculus
gacagttccaatttgagataatgcc

SEQ ID NO: 30066 - DNA, 25 bp, Mus musculus
gacagttcgtcgctatccggccact

SEQ ID NO: 30067 - DNA, 25 bp, Mus musculus
gacagttcgtcggtatccggccact

SEQ ID NO: 30068 - DNA, 25 bp, Mus musculus
gacagttctggtgcagagttccagt

SEQ ID NO: 30069 - DNA, 25 bp, Mus musculus
gacagttgcatcctgtgtctttcta

SEQ ID NO: 30070 - DNA, 25 bp, Mus musculus
gacagttgctgtgcgacttggacag

SEQ ID NO: 30071 - DNA, 25 bp, Mus musculus
gacagttggtcagaaacgattccat

SEQ ID NO: 30072 - DNA, 25 bp, Mus musculus
gacagttgtcaaaatctccccaaga

SEQ ID NO: 30073 - DNA, 25 bp, Mus musculus
gacagttgtgatactgatgcttcgc

SEQ ID NO: 30074 - DNA, 25 bp, Mus musculus
gacagtttaagtacaaccaacttct

SEQ ID NO: 30075 - DNA, 25 bp, Mus musculus
gacagtttctcatccgtgaactaaa

SEQ ID NO: 30076 - DNA, 25 bp, Mus musculus
gacagtttgactaagcagcctgaag

SEQ ID NO: 30077 - DNA, 25 bp, Mus musculus
gacagtttgtgggacaagctcgtgt

SEQ ID NO: 30078 - DNA, 25 bp, Mus musculus
gacagttttggatctttgatgtgca

SEQ ID NO: 30079 - DNA, 25 bp, Mus musculus
gacataaaaatacgccaggacagtg

SEQ ID NO: 30080 - DNA, 25 bp, Mus musculus
gacataaacaatacgggaaccgagt

SEQ ID NO: 30081 - DNA, 25 bp, Mus musculus
gacataaagctggttgccgccatag

SEQ ID NO: 30082 - DNA, 25 bp, Mus musculus
gacataaagtcagccgggcctcagt

SEQ ID NO: 30083 - DNA, 25 bp, Mus musculus
gacataaagttcaaggcactttccc

SEQ ID NO: 30084 - DNA, 25 bp, Mus musculus
gacataaagttctaggcactttccc

SEQ ID NO: 30085 - DNA, 25 bp, Mus musculus
gacataaccagaagaacaccaaaga

SEQ ID NO: 30086 - DNA, 25 bp, Mus musculus
gacataagccagagcatcgttcttc

SEQ ID NO: 30087 - DNA, 25 bp, Mus musculus
gacataagccagtgcatcgttcttc

SEQ ID NO: 30088 - DNA, 25 bp, Mus musculus
gacataatctgtccttcagcattgc

SEQ ID NO: 30089 - DNA, 25 bp, Mus musculus
gacatacaaggatcatgagaatatc

SEQ ID NO: 30090 - DNA, 25 bp, Mus musculus
gacatacaagttggagacctcatca

SEQ ID NO: 30091 - DNA, 25 bp, Mus musculus
gacatacaatggctctgagtgtaga

SEQ ID NO: 30092 - DNA, 25 bp, Mus musculus
gacataccgcgtagtccaggtgact

SEQ ID NO: 30093 - DNA, 25 bp, Mus musculus
gacatacctgtagacagcccagagc

SEQ ID NO: 30094 - DNA, 25 bp, Mus musculus
gacataccttttggaatcacgtcca

SEQ ID NO: 30095 - DNA, 25 bp, Mus musculus
gacatactctacaggctgcaggcat

SEQ ID NO: 30096 - DNA, 25 bp, Mus musculus
gacatagaaacagaagaaatagact

SEQ ID NO: 30097 - DNA, 25 bp, Mus musculus
gacatagatgctgcagaggaggctt

SEQ ID NO: 30098 - DNA, 25 bp, Mus musculus
gacatagcgtttgcgtacccattca

SEQ ID NO: 30099 - DNA, 25 bp, Mus musculus
gacataggcacatttggattctagg

SEQ ID NO: 30100 - DNA, 25 bp, Mus musculus
gacataggccctcccattccagaag

SEQ ID NO: 30101 - DNA, 25 bp, Mus musculus
gacatagtcacattaccatgcctag

SEQ ID NO: 30102 - DNA, 25 bp, Mus musculus
gacatagtgcaacaactgttacagc

SEQ ID NO: 30103 - DNA, 25 bp, Mus musculus
gacatatacaactatagtcctgtga

SEQ ID NO: 30104 - DNA, 25 bp, Mus musculus
gacatatcaggccatggtccatgaa

SEQ ID NO: 30105 - DNA, 25 bp, Mus musculus
gacatatgtgtccagcttctaccat

SEQ ID NO: 30106 - DNA, 25 bp, Mus musculus
gacatattactacgacatccttcag

SEQ ID NO: 30107 - DNA, 25 bp, Mus musculus
gacatattgcattttctggaaacaa

SEQ ID NO: 30108 - DNA, 25 bp, Mus musculus
gacatatttgaagtggctgcctgag

SEQ ID NO: 30109 - DNA, 25 bp, Mus musculus
gacatcaaaaagatggcaaagcaag

SEQ ID NO: 30110 - DNA, 25 bp, Mus musculus
gacatcaaagcagcgtttgcaccat

SEQ ID NO: 30111 - DNA, 25 bp, Mus musculus
gacatcaagaggtctgtgcctacct

SEQ ID NO: 30112 - DNA, 25 bp, Mus musculus
gacatcaatgcaagcctgaagaaaa

SEQ ID NO: 30113 - DNA, 25 bp, Mus musculus
gacatcacagcttatctttttggat

SEQ ID NO: 30114 - DNA, 25 bp, Mus musculus
gacatcacatggtccgagagcccat

SEQ ID NO: 30115 - DNA, 25 bp, Mus musculus
gacatcaccctgattctggagagaa

SEQ ID NO: 30116 - DNA, 25 bp, Mus musculus
gacatcacctccttgtcattaccag

SEQ ID NO: 30117 - DNA, 25 bp, Mus musculus
gacatcacctttccaacagacattg

SEQ ID NO: 30118 - DNA, 25 bp, Mus musculus
gacatcacctttgcaacagacattg

SEQ ID NO: 30119 - DNA, 25 bp, Mus musculus
gacatcactaagatccgttccaaca

SEQ ID NO: 30120 - DNA, 25 bp, Mus musculus
gacatcactaagttccgttccaaca

SEQ ID NO: 30121 - DNA, 25 bp, Mus musculus
gacatcactaccttcgtcaagggca

SEQ ID NO: 30122 - DNA, 25 bp, Mus musculus
gacatcactggccataaacgaagtg

SEQ ID NO: 30123 - DNA, 25 bp, Mus musculus
gacatcagaattctctgcccctgtg

SEQ ID NO: 30124 - DNA, 25 bp, Mus musculus
gacatcagcgcaagatgctggccgc

SEQ ID NO: 30125 - DNA, 25 bp, Mus musculus
gacatcaggctgtaaacttcctggc

SEQ ID NO: 30126 - DNA, 25 bp, Mus musculus
gacatcagggaaattctccagtgaa

SEQ ID NO: 30127 - DNA, 25 bp, Mus musculus
gacatcagtcagcagaacagtaaaa

SEQ ID NO: 30128 - DNA, 25 bp, Mus musculus
gacatcatcaccaataaggtctctg

SEQ ID NO: 30129 - DNA, 25 bp, Mus musculus
gacatcatcccaaccatgatcaatg

SEQ ID NO: 30130 - DNA, 25 bp, Mus musculus
gacatcatgctgctagacaatggcc

SEQ ID NO: 30131 - DNA, 25 bp, Mus musculus
gacatcatggacctgaagcaggagc

SEQ ID NO: 30132 - DNA, 25 bp, Mus musculus
gacatcatgtgaccacctgaaacct

SEQ ID NO: 30133 - DNA, 25 bp, Mus musculus
gacatcatgttcatgggagacttca

SEQ ID NO: 30134 - DNA, 25 bp, Mus musculus
gacatcattcttctgatgctgccag

SEQ ID NO: 30135 - DNA, 25 bp, Mus musculus
gacatccacgaagagatcctcaaag

SEQ ID NO: 30136 - DNA, 25 bp, Mus musculus
gacatccagcagtgcttgctaaatg

SEQ ID NO: 30137 - DNA, 25 bp, Mus musculus
gacatccagtccaggagagtgttgc

SEQ ID NO: 30138 - DNA, 25 bp, Mus musculus
gacatccatcggctggagaagatcc

SEQ ID NO: 30139 - DNA, 25 bp, Mus musculus
gacatcccgatacagacagcagcgt

SEQ ID NO: 30140 - DNA, 25 bp, Mus musculus
gacatccgaaatgtatctcatccag

SEQ ID NO: 30141 - DNA, 25 bp, Mus musculus
gacatccgcctgactatgaggaaag

SEQ ID NO: 30142 - DNA, 25 bp, Mus musculus
gacatccgcctgtctatgaggaaag

SEQ ID NO: 30143 - DNA, 25 bp, Mus musculus
gacatcctgagtcctcctagacact

SEQ ID NO: 30144 - DNA, 25 bp, Mus musculus
gacatcctgcctcaccgcttagtga

SEQ ID NO: 30145 - DNA, 25 bp, Mus musculus
gacatcctgcctgaccgcttagtga

SEQ ID NO: 30146 - DNA, 25 bp, Mus musculus
gacatcctgtaagcaatctactaga

SEQ ID NO: 30147 - DNA, 25 bp, Mus musculus
gacatcgatgctatagagttctacc

SEQ ID NO: 30148 - DNA, 25 bp, Mus musculus
gacatcgatgctttagagttctacc

SEQ ID NO: 30149 - DNA, 25 bp, Mus musculus
gacatcgcagcgaaagagaagctgc

SEQ ID NO: 30150 - DNA, 25 bp, Mus musculus
gacatcgccaaccaggagtccttca

SEQ ID NO: 30151 - DNA, 25 bp, Mus musculus
gacatcgccatcatcaagttggctg

SEQ ID NO: 30152 - DNA, 25 bp, Mus musculus
gacatcgtcagagcgaacacgtttg

SEQ ID NO: 30153 - DNA, 25 bp, Mus musculus
gacatcgtgcgtgatgggcgcttat

SEQ ID NO: 30154 - DNA, 25 bp, Mus musculus
gacatctaaaaatgttggaaccgga

SEQ ID NO: 30155 - DNA, 25 bp, Mus musculus
gacatctaagaattatccagggact

SEQ ID NO: 30156 - DNA, 25 bp, Mus musculus
gacatctatccctccaagtggatcg

SEQ ID NO: 30157 - DNA, 25 bp, Mus musculus
gacatctatgacctgaaggaccaga

SEQ ID NO: 30158 - DNA, 25 bp, Mus musculus
gacatctcaaattccactgaagctg

SEQ ID NO: 30159 - DNA, 25 bp, Mus musculus
gacatctcctctacaagtacctaac

SEQ ID NO: 30160 - DNA, 25 bp, Mus musculus
gacatctcggagaagctctataccc

SEQ ID NO: 30161 - DNA, 25 bp, Mus musculus
gacatctctcggtagcagatccttg

SEQ ID NO: 30162 - DNA, 25 bp, Mus musculus
gacatctcttccttcagctataaga

SEQ ID NO: 30163 - DNA, 25 bp, Mus musculus
gacatctgatttgaaggcagactca

SEQ ID NO: 30164 - DNA, 25 bp, Mus musculus
gacatctgctggaaaaaagtcacca

SEQ ID NO: 30165 - DNA, 25 bp, Mus musculus
gacatctgctggtaaaaagtcacca

SEQ ID NO: 30166 - DNA, 25 bp, Mus musculus
gacatctggagagctgcggttcaga

SEQ ID NO: 30167 - DNA, 25 bp, Mus musculus
gacatctggccccacttcggaagtg

SEQ ID NO: 30168 - DNA, 25 bp, Mus musculus
gacatctgtcttgctcgggccaagg

SEQ ID NO: 30169 - DNA, 25 bp, Mus musculus
gacatctgtgactacaatgtcacca

SEQ ID NO: 30170 - DNA, 25 bp, Mus musculus
gacatctgtgctggtctgccctgat

SEQ ID NO: 30171 - DNA, 25 bp, Mus musculus
gacatcttcaaggacaatgccatcc

SEQ ID NO: 30172 - DNA, 25 bp, Mus musculus
gacatcttcaggctcgcttcaatct

SEQ ID NO: 30173 - DNA, 25 bp, Mus musculus
gacatcttctgtgacgtgggccaca

SEQ ID NO: 30174 - DNA, 25 bp, Mus musculus
gacatcttgaaagctcccaagcctg

SEQ ID NO: 30175 - DNA, 25 bp, Mus musculus
gacatctttaataagaacatgagag

SEQ ID NO: 30176 - DNA, 25 bp, Mus musculus
gacatctttcctttggcctgccaaa

SEQ ID NO: 30177 - DNA, 25 bp, Mus musculus
gacatctttgacatgctgctcacat

SEQ ID NO: 30178 - DNA, 25 bp, Mus musculus
gacatgaaccgactcatcatgaact

SEQ ID NO: 30179 - DNA, 25 bp, Mus musculus
gacatgaagaacaccacatgccagg

SEQ ID NO: 30180 - DNA, 25 bp, Mus musculus
gacatgaagctattggagaactcca

SEQ ID NO: 30181 - DNA, 25 bp, Mus musculus
gacatgaaggctgcgaatgtgctca

SEQ ID NO: 30182 - DNA, 25 bp, Mus musculus
gacatgaatgactttggcactgtca

SEQ ID NO: 30183 - DNA, 25 bp, Mus musculus
gacatgacaagaggatcaagctgca

SEQ ID NO: 30184 - DNA, 25 bp, Mus musculus
gacatgacagaagaacagttagcaa

SEQ ID NO: 30185 - DNA, 25 bp, Mus musculus
gacatgacagatgaccttgaccact

SEQ ID NO: 30186 - DNA, 25 bp, Mus musculus
gacatgacatttttacgcttcctga

SEQ ID NO: 30187 - DNA, 25 bp, Mus musculus
gacatgaccaagtgggaacagaagt

SEQ ID NO: 30188 - DNA, 25 bp, Mus musculus
gacatgactcaacggtgcacagtcc

SEQ ID NO: 30189 - DNA, 25 bp, Mus musculus
gacatgagtggtattgttaagcccc

SEQ ID NO: 30190 - DNA, 25 bp, Mus musculus
gacatgattttcctggttagaagac

SEQ ID NO: 30191 - DNA, 25 bp, Mus musculus
gacatgcaagaggttgttctgagcc

SEQ ID NO: 30192 - DNA, 25 bp, Mus musculus
gacatgcacagatgctctcagcttt

SEQ ID NO: 30193 - DNA, 25 bp, Mus musculus
gacatgcagagaccagatcaaagga

SEQ ID NO: 30194 - DNA, 25 bp, Mus musculus
gacatgcaggagatcacacaacatt

SEQ ID NO: 30195 - DNA, 25 bp, Mus musculus
gacatgccaggaaagacagcatgat

SEQ ID NO: 30196 - DNA, 25 bp, Mus musculus
gacatgccattcttgaagtggttga

SEQ ID NO: 30197 - DNA, 25 bp, Mus musculus
gacatgcccatggatattgacagta

SEQ ID NO: 30198 - DNA, 25 bp, Mus musculus
gacatgcgctggtcgtgtgagcacc

SEQ ID NO: 30199 - DNA, 25 bp, Mus musculus
gacatgcggaaagcccttttcagct

SEQ ID NO: 30200 - DNA, 25 bp, Mus musculus
gacatgctgctcacattcacggatt

SEQ ID NO: 30201 - DNA, 25 bp, Mus musculus
gacatgctggaaaaagctgccgagc

SEQ ID NO: 30202 - DNA, 25 bp, Mus musculus
gacatggaagacctatcttctggcc

SEQ ID NO: 30203 - DNA, 25 bp, Mus musculus
gacatggaaggtgcaccaggaacct

SEQ ID NO: 30204 - DNA, 25 bp, Mus musculus
gacatggactcttgtttgtacaaag

SEQ ID NO: 30205 - DNA, 25 bp, Mus musculus
gacatggagaggtgaccctgacagt

SEQ ID NO: 30206 - DNA, 25 bp, Mus musculus
gacatggccgaggaacaagacctat

SEQ ID NO: 30207 - DNA, 25 bp, Mus musculus
gacatggcggccatcgtaaaagcca

SEQ ID NO: 30208 - DNA, 25 bp, Mus musculus
gacatggtattatgacttccgacat

SEQ ID NO: 30209 - DNA, 25 bp, Mus musculus
gacatggtcatcctagagaaaagtg

SEQ ID NO: 30210 - DNA, 25 bp, Mus musculus
gacatggtccgttttactatatgaa

SEQ ID NO: 30211 - DNA, 25 bp, Mus musculus
gacatgtatgatgctcatctcacca

SEQ ID NO: 30212 - DNA, 25 bp, Mus musculus
gacatgtcaatctaacaatgttagg

SEQ ID NO: 30213 - DNA, 25 bp, Mus musculus
gacatgtcacaagaatggccagtgc

SEQ ID NO: 30214 - DNA, 25 bp, Mus musculus
gacatgtctacagtctgagaagaca

SEQ ID NO: 30215 - DNA, 25 bp, Mus musculus
gacatgtctctgctgcatccaagcg

SEQ ID NO: 30216 - DNA, 25 bp, Mus musculus
gacatgtgacgttttatgttgaata

SEQ ID NO: 30217 - DNA, 25 bp, Mus musculus
gacatgtgccgcttccattctgagg

SEQ ID NO: 30218 - DNA, 25 bp, Mus musculus
gacatgtggacaattggcctccaag

SEQ ID NO: 30219 - DNA, 25 bp, Mus musculus
gacatgttcagcatcagatatacac

SEQ ID NO: 30220 - DNA, 25 bp, Mus musculus
gacatgttgaagagtagtctcttcc

SEQ ID NO: 30221 - DNA, 25 bp, Mus musculus
gacatgttgaccaagatgatggccc

SEQ ID NO: 30222 - DNA, 25 bp, Mus musculus
gacatgtttcacagctgtttcagaa

SEQ ID NO: 30223 - DNA, 25 bp, Mus musculus
gacatgtttgggatgatgaacgaca

SEQ ID NO: 30224 - DNA, 25 bp, Mus musculus
gacattactacaataccaaacctga

SEQ ID NO: 30225 - DNA, 25 bp, Mus musculus
gacattactacattaccaaacctga

SEQ ID NO: 30226 - DNA, 25 bp, Mus musculus
gacattactattaagatgacacaaa

SEQ ID NO: 30227 - DNA, 25 bp, Mus musculus
gacattactatttagatgacacaaa

SEQ ID NO: 30228 - DNA, 25 bp, Mus musculus
gacattagagtcaattgagatagac

SEQ ID NO: 30229 - DNA, 25 bp, Mus musculus
gacattagggtctctgaaacttgga

SEQ ID NO: 30230 - DNA, 25 bp, Mus musculus
gacattagtctttgtccttctgatg

SEQ ID NO: 30231 - DNA, 25 bp, Mus musculus
gacattagtgatctcacattgagaa

SEQ ID NO: 30232 - DNA, 25 bp, Mus musculus
gacattatctcatccacagacaaac

SEQ ID NO: 30233 - DNA, 25 bp, Mus musculus
gacattatctgacgaatctgatgag

SEQ ID NO: 30234 - DNA, 25 bp, Mus musculus
gacattcaagcttctatttctggag

SEQ ID NO: 30235 - DNA, 25 bp, Mus musculus
gacattcaatcaagctgccaagggt

SEQ ID NO: 30236 - DNA, 25 bp, Mus musculus
gacattcagcatcttcgcaaagaat

SEQ ID NO: 30237 - DNA, 25 bp, Mus musculus
gacattcagctctgcaaggacatca

SEQ ID NO: 30238 - DNA, 25 bp, Mus musculus
gacattcatgctgctgactttctag

SEQ ID NO: 30239 - DNA, 25 bp, Mus musculus
gacattcatgttctattgtgcacac

SEQ ID NO: 30240 - DNA, 25 bp, Mus musculus
gacattccacatctctcagccaaga

SEQ ID NO: 30241 - DNA, 25 bp, Mus musculus
gacattccgggctgtcttctctaca

SEQ ID NO: 30242 - DNA, 25 bp, Mus musculus
gacattctacgaactagtggactgg

SEQ ID NO: 30243 - DNA, 25 bp, Mus musculus
gacattctcaggctgacgctccaga

SEQ ID NO: 30244 - DNA, 25 bp, Mus musculus
gacattctgacacagtatgatgcca

SEQ ID NO: 30245 - DNA, 25 bp, Mus musculus
gacattcttcgggacacccagtcat

SEQ ID NO: 30246 - DNA, 25 bp, Mus musculus
gacattgaaactgattggtattggc

SEQ ID NO: 30247 - DNA, 25 bp, Mus musculus
gacattgaatatctggacttctaca

SEQ ID NO: 30248 - DNA, 25 bp, Mus musculus
gacattgaatatgtggacttctaca

SEQ ID NO: 30249 - DNA, 25 bp, Mus musculus
gacattgaccttaaagatgacctag

SEQ ID NO: 30250 - DNA, 25 bp, Mus musculus
gacattgactccctgcgaaaactgt

SEQ ID NO: 30251 - DNA, 25 bp, Mus musculus
gacattgatccaagggtagtcactg

SEQ ID NO: 30252 - DNA, 25 bp, Mus musculus
gacattgatgatcttcttgatgcca

SEQ ID NO: 30253 - DNA, 25 bp, Mus musculus
gacattgattttgttgaagacgact

SEQ ID NO: 30254 - DNA, 25 bp, Mus musculus
gacattgcatcagggatggccatag

SEQ ID NO: 30255 - DNA, 25 bp, Mus musculus
gacattgcccggtcacgtgtggaga

SEQ ID NO: 30256 - DNA, 25 bp, Mus musculus
gacattgcctcgatcgacagtgatg

SEQ ID NO: 30257 - DNA, 25 bp, Mus musculus
gacattgggttggaatactgtaaag

SEQ ID NO: 30258 - DNA, 25 bp, Mus musculus
gacattggtcgcagtctcctgactt

SEQ ID NO: 30259 - DNA, 25 bp, Mus musculus
gacattgtcaactggctgaagaaac

SEQ ID NO: 30260 - DNA, 25 bp, Mus musculus
gacattgtcacggagtgacgtcaca

SEQ ID NO: 30261 - DNA, 25 bp, Mus musculus
gacattgtcagcactctgcaagccc

SEQ ID NO: 30262 - DNA, 25 bp, Mus musculus
gacattgtcatcaatgttattgaca

SEQ ID NO: 30263 - DNA, 25 bp, Mus musculus
gacattgtcatctatgttattgaca

SEQ ID NO: 30264 - DNA, 25 bp, Mus musculus
gacattgtttttgaggatgtggaaa

SEQ ID NO: 30265 - DNA, 25 bp, Mus musculus
gacatttaagctcgactacagccgg

SEQ ID NO: 30266 - DNA, 25 bp, Mus musculus
gacatttaatttcttcagcaggaag

SEQ ID NO: 30267 - DNA, 25 bp, Mus musculus
gacatttagtgaacgctcttcaagc

SEQ ID NO: 30268 - DNA, 25 bp, Mus musculus
gacatttattcagagcagctgggga

SEQ ID NO: 30269 - DNA, 25 bp, Mus musculus
gacatttcacctagtgctttaaaaa

SEQ ID NO: 30270 - DNA, 25 bp, Mus musculus
gacatttgggctgtcagcttcgggc

SEQ ID NO: 30271 - DNA, 25 bp, Mus musculus
gacatttggtcagttgggtgcatca

SEQ ID NO: 30272 - DNA, 25 bp, Mus musculus
gacatttgtgacttacactgtttac

SEQ ID NO: 30273 - DNA, 25 bp, Mus musculus
gacatttgtggctgcctcgtgtagg

SEQ ID NO: 30274 - DNA, 25 bp, Mus musculus
gacatttgttctttgttggacttca

SEQ ID NO: 30275 - DNA, 25 bp, Mus musculus
gacattttaaatatactgatgcaac

SEQ ID NO: 30276 - DNA, 25 bp, Mus musculus
gacattttaagtctaaaggatatga

SEQ ID NO: 30277 - DNA, 25 bp, Mus musculus
gacattttatcaactttttggaaag

SEQ ID NO: 30278 - DNA, 25 bp, Mus musculus
gacatttttacactgtttgcctaga

SEQ ID NO: 30279 - DNA, 25 bp, Mus musculus
gaccaaaaacgaagaccctggctca

SEQ ID NO: 30280 - DNA, 25 bp, Mus musculus
gaccaaaaacgatgaccctggctca

SEQ ID NO: 30281 - DNA, 25 bp, Mus musculus
gaccaaaaggtgaagcagacgtttg

SEQ ID NO: 30282 - DNA, 25 bp, Mus musculus
gaccaaaatttttgataactgccgt

SEQ ID NO: 30283 - DNA, 25 bp, Mus musculus
gaccaaacatgaatatgcaaccaaa

SEQ ID NO: 30284 - DNA, 25 bp, Mus musculus
gaccaaacggttcatctgggagtac

SEQ ID NO: 30285 - DNA, 25 bp, Mus musculus
gaccaaactggacttctggagatga

SEQ ID NO: 30286 - DNA, 25 bp, Mus musculus
gaccaaacttatctactgctcacgg

SEQ ID NO: 30287 - DNA, 25 bp, Mus musculus
gaccaaagaagagctggccaggaag

SEQ ID NO: 30288 - DNA, 25 bp, Mus musculus
gaccaaagaaggcaaagttgaccac

SEQ ID NO: 30289 - DNA, 25 bp, Mus musculus
gaccaaagatggcagaacaccaagc

SEQ ID NO: 30290 - DNA, 25 bp, Mus musculus
gaccaaatcctctggaaacattctg

SEQ ID NO: 30291 - DNA, 25 bp, Mus musculus
gaccaaatgacagaggacctgtccc

SEQ ID NO: 30292 - DNA, 25 bp, Mus musculus
gaccaaatttccctgttacctctgt

SEQ ID NO: 30293 - DNA, 25 bp, Mus musculus
gaccaactactacaacctggatgga

SEQ ID NO: 30294 - DNA, 25 bp, Mus musculus
gaccaactagcaaaacatttgaaaa

SEQ ID NO: 30295 - DNA, 25 bp, Mus musculus
gaccaactgcagaaatacattaggg

SEQ ID NO: 30296 - DNA, 25 bp, Mus musculus
gaccaacttgcagttctgcctgtat

SEQ ID NO: 30297 - DNA, 25 bp, Mus musculus
gaccaagaaaatgcagaagactctt

SEQ ID NO: 30298 - DNA, 25 bp, Mus musculus
gaccaagaaactggtgcatgacatg

SEQ ID NO: 30299 - DNA, 25 bp, Mus musculus
gaccaagaaagagtcaaattctacc

SEQ ID NO: 30300 - DNA, 25 bp, Mus musculus
gaccaagaacactggcacaaagaca

SEQ ID NO: 30301 - DNA, 25 bp, Mus musculus
gaccaagacggagacatagatcccg

SEQ ID NO: 30302 - DNA, 25 bp, Mus musculus
gaccaagagtagaaaccacagagga

SEQ ID NO: 30303 - DNA, 25 bp, Mus musculus
gaccaagatacgttgtaggttgtcg

SEQ ID NO: 30304 - DNA, 25 bp, Mus musculus
gaccaagatgatggccctagagctt

SEQ ID NO: 30305 - DNA, 25 bp, Mus musculus
gaccaagccctcaagtcgctgatcg

SEQ ID NO: 30306 - DNA, 25 bp, Mus musculus
gaccaagcctactaccatcatcgag

SEQ ID NO: 30307 - DNA, 25 bp, Mus musculus
gaccaaggacatgactggaaaggaa

SEQ ID NO: 30308 - DNA, 25 bp, Mus musculus
gaccaaggagactgcaacaggacac

SEQ ID NO: 30309 - DNA, 25 bp, Mus musculus
gaccaaggcagtgaacagcctcttt

SEQ ID NO: 30310 - DNA, 25 bp, Mus musculus
gaccaagtaccactaaatagtacag

SEQ ID NO: 30311 - DNA, 25 bp, Mus musculus
gaccaagtgccagacacagactctg

SEQ ID NO: 30312 - DNA, 25 bp, Mus musculus
gaccaagtgttctcatccttgcatg

SEQ ID NO: 30313 - DNA, 25 bp, Mus musculus
gaccaagttagaggcttcctagaga

SEQ ID NO: 30314 - DNA, 25 bp, Mus musculus
gaccaagttcttcttcactatcatt

SEQ ID NO: 30315 - DNA, 25 bp, Mus musculus
gaccaatctgagtacaataacctga

SEQ ID NO: 30316 - DNA, 25 bp, Mus musculus
gaccaatgagcagatagatgcccca

SEQ ID NO: 30317 - DNA, 25 bp, Mus musculus
gaccacaaaatctttgcaagcatct

SEQ ID NO: 30318 - DNA, 25 bp, Mus musculus
gaccacaagccagctattcattatt

SEQ ID NO: 30319 - DNA, 25 bp, Mus musculus
gaccacactgtgtcttttgtacagc

SEQ ID NO: 30320 - DNA, 25 bp, Mus musculus
gaccacagcacagtacagagtatct

SEQ ID NO: 30321 - DNA, 25 bp, Mus musculus
gaccacagccacttttactgtttgc

SEQ ID NO: 30322 - DNA, 25 bp, Mus musculus
gaccacagcccaggttttgatggag

SEQ ID NO: 30323 - DNA, 25 bp, Mus musculus
gaccacaggaaggacagcaagtgta

SEQ ID NO: 30324 - DNA, 25 bp, Mus musculus
gaccacagtggagcgacagcctgca

SEQ ID NO: 30325 - DNA, 25 bp, Mus musculus
gaccacctagagagaactgccagtg

SEQ ID NO: 30326 - DNA, 25 bp, Mus musculus
gaccacctattacatgatcttcaac

SEQ ID NO: 30327 - DNA, 25 bp, Mus musculus
gaccacctgtaacccaatttcaagg

SEQ ID NO: 30328 - DNA, 25 bp, Mus musculus
gaccacgaggtcagaaaagagcgcc

SEQ ID NO: 30329 - DNA, 25 bp, Mus musculus
gaccacgcctaggaatgaagttttt

SEQ ID NO: 30330 - DNA, 25 bp, Mus musculus
gaccacgctctcaacgatatgactt

SEQ ID NO: 30331 - DNA, 25 bp, Mus musculus
gaccacggtggccaaaattcttagc

SEQ ID NO: 30332 - DNA, 25 bp, Mus musculus
gaccacgtggagtaccgctatggca

SEQ ID NO: 30333 - DNA, 25 bp, Mus musculus
gaccactacaacaacacttatctag

SEQ ID NO: 30334 - DNA, 25 bp, Mus musculus
gaccactcaatctggccatggttta

SEQ ID NO: 30335 - DNA, 25 bp, Mus musculus
gaccactcatgatgctggcccagaa

SEQ ID NO: 30336 - DNA, 25 bp, Mus musculus
gaccactccgcctctgctggaatgt

SEQ ID NO: 30337 - DNA, 25 bp, Mus musculus
gaccactgcgagattttcaaagaaa

SEQ ID NO: 30338 - DNA, 25 bp, Mus musculus
gaccactgcgtacattcaccaggtg

SEQ ID NO: 30339 - DNA, 25 bp, Mus musculus
gaccactttccactgggtgtcccag

SEQ ID NO: 30340 - DNA, 25 bp, Mus musculus
gaccagaaaaggacaggttccagga

SEQ ID NO: 30341 - DNA, 25 bp, Mus musculus
gaccagaaacagcagtcgtcagccg

SEQ ID NO: 30342 - DNA, 25 bp, Mus musculus
gaccagaagcaggaattcaacaaac

SEQ ID NO: 30343 - DNA, 25 bp, Mus musculus
gaccagaatgaagcccggaaatacg

SEQ ID NO: 30344 - DNA, 25 bp, Mus musculus
gaccagacacgggagctttgtcaat

SEQ ID NO: 30345 - DNA, 25 bp, Mus musculus
gaccagacagacatcatctttgagg

SEQ ID NO: 30346 - DNA, 25 bp, Mus musculus
gaccagactgtactgttgacccgaa

SEQ ID NO: 30347 - DNA, 25 bp, Mus musculus
gaccagagcactcctgacttcactg

SEQ ID NO: 30348 - DNA, 25 bp, Mus musculus
gaccagagcagcaggacggaaatca

SEQ ID NO: 30349 - DNA, 25 bp, Mus musculus
gaccagagtaatgcggagcagcacg

SEQ ID NO: 30350 - DNA, 25 bp, Mus musculus
gaccagagttctggttgccagaccg

SEQ ID NO: 30351 - DNA, 25 bp, Mus musculus
gaccagatcgccttgctgaagacct

SEQ ID NO: 30352 - DNA, 25 bp, Mus musculus
gaccagattatccaggctaaccccg

SEQ ID NO: 30353 - DNA, 25 bp, Mus musculus
gaccagattcaggatgtagaaggca

SEQ ID NO: 30354 - DNA, 25 bp, Mus musculus
gaccagattcatgatgtagaagggc

SEQ ID NO: 30355 - DNA, 25 bp, Mus musculus
gaccagattcctaagtactgtttcc

SEQ ID NO: 30356 - DNA, 25 bp, Mus musculus
gaccagcaacgcaatacaagtttgg

SEQ ID NO: 30357 - DNA, 25 bp, Mus musculus
gaccagcaagatgaaagttctcaag

SEQ ID NO: 30358 - DNA, 25 bp, Mus musculus
gaccagcagaaagtccttcaggaaa

SEQ ID NO: 30359 - DNA, 25 bp, Mus musculus
gaccagcagctctacaacgtagagg

SEQ ID NO: 30360 - DNA, 25 bp, Mus musculus
gaccagcagctgaaacccctggctt

SEQ ID NO: 30361 - DNA, 25 bp, Mus musculus
gaccagcagctgatgctaccagaaa

SEQ ID NO: 30362 - DNA, 25 bp, Mus musculus
gaccagcatgttgactatacttggt

SEQ ID NO: 30363 - DNA, 25 bp, Mus musculus
gaccagccactttctgatagaagaa

SEQ ID NO: 30364 - DNA, 25 bp, Mus musculus
gaccagcccagtagaagactatatg

SEQ ID NO: 30365 - DNA, 25 bp, Mus musculus
gaccagcctccgtgtgttcatccga

SEQ ID NO: 30366 - DNA, 25 bp, Mus musculus
gaccagcgccacatcttcacgttga

SEQ ID NO: 30367 - DNA, 25 bp, Mus musculus
gaccagcgccacttcttcacgttga

SEQ ID NO: 30368 - DNA, 25 bp, Mus musculus
gaccagctaaagtatgatgtccagc

SEQ ID NO: 30369 - DNA, 25 bp, Mus musculus
gaccagctagaggatgccgctatgg

SEQ ID NO: 30370 - DNA, 25 bp, Mus musculus
gaccagctccacaggttttcaccat

SEQ ID NO: 30371 - DNA, 25 bp, Mus musculus
gaccaggaaattccattcccttagg

SEQ ID NO: 30372 - DNA, 25 bp, Mus musculus
gaccaggacaagcaatactacgagc

SEQ ID NO: 30373 - DNA, 25 bp, Mus musculus
gaccaggacaaggaatactacgagc

SEQ ID NO: 30374 - DNA, 25 bp, Mus musculus
gaccaggagaccgatgtttcagtga

SEQ ID NO: 30375 - DNA, 25 bp, Mus musculus
gaccaggaggcttataaacaacagg

SEQ ID NO: 30376 - DNA, 25 bp, Mus musculus
gaccaggagtctatcaggcctctga

SEQ ID NO: 30377 - DNA, 25 bp, Mus musculus
gaccaggcagacattgagaacattg

SEQ ID NO: 30378 - DNA, 25 bp, Mus musculus
gaccaggcagctaagaacaaggccc

SEQ ID NO: 30379 - DNA, 25 bp, Mus musculus
gaccaggccaataacctgctgatag

SEQ ID NO: 30380 - DNA, 25 bp, Mus musculus
gaccaggcttaaatgatcttcctga

SEQ ID NO: 30381 - DNA, 25 bp, Mus musculus
gaccagggagtagctacagaggaca

SEQ ID NO: 30382 - DNA, 25 bp, Mus musculus
gaccagggccctacatctgtagtga

SEQ ID NO: 30383 - DNA, 25 bp, Mus musculus
gaccaggtatgatcgcctctctctc

SEQ ID NO: 30384 - DNA, 25 bp, Mus musculus
gaccagtaaaatcaagaatgcttac

SEQ ID NO: 30385 - DNA, 25 bp, Mus musculus
gaccagtaaaatgaagaatgcttac

SEQ ID NO: 30386 - DNA, 25 bp, Mus musculus
gaccagtaccggaagggcatcatct

SEQ ID NO: 30387 - DNA, 25 bp, Mus musculus
gaccagtagagctggattaaaacac

SEQ ID NO: 30388 - DNA, 25 bp, Mus musculus
gaccagtattatctaacatcgccag

SEQ ID NO: 30389 - DNA, 25 bp, Mus musculus
gaccagtattatgtaacatcgccag

SEQ ID NO: 30390 - DNA, 25 bp, Mus musculus
gaccagtcctttcatgctgatctgt

SEQ ID NO: 30391 - DNA, 25 bp, Mus musculus
gaccagtctcactgcatggagccag

SEQ ID NO: 30392 - DNA, 25 bp, Mus musculus
gaccagtgtattctaaaaagggact

SEQ ID NO: 30393 - DNA, 25 bp, Mus musculus
gaccagttatgatggctttggaccc

SEQ ID NO: 30394 - DNA, 25 bp, Mus musculus
gaccagttgttagcattcaagtcag

SEQ ID NO: 30395 - DNA, 25 bp, Mus musculus
gaccagttttgttgctcctgttgga

SEQ ID NO: 30396 - DNA, 25 bp, Mus musculus
gaccatacacagtggccattgctgg

SEQ ID NO: 30397 - DNA, 25 bp, Mus musculus
gaccatacaggtaggcctttccctg

SEQ ID NO: 30398 - DNA, 25 bp, Mus musculus
gaccatagagttctaagaataaagg

SEQ ID NO: 30399 - DNA, 25 bp, Mus musculus
gaccatatatggtgcagaagctcgg

SEQ ID NO: 30400 - DNA, 25 bp, Mus musculus
gaccatatctaaacacactgcaatt

SEQ ID NO: 30401 - DNA, 25 bp, Mus musculus
gaccatcaccgtctttacaaatccg

SEQ ID NO: 30402 - DNA, 25 bp, Mus musculus
gaccatcatgactagatgcatccag

SEQ ID NO: 30403 - DNA, 25 bp, Mus musculus
gaccatcatgcatatgcaaatcaag

SEQ ID NO: 30404 - DNA, 25 bp, Mus musculus
gaccatcatttttattccagaaaca

SEQ ID NO: 30405 - DNA, 25 bp, Mus musculus
gaccatccccagtaaatacataaat

SEQ ID NO: 30406 - DNA, 25 bp, Mus musculus
gaccatcgaccagctacatttggag

SEQ ID NO: 30407 - DNA, 25 bp, Mus musculus
gaccatcgtcagtggccttctcatg

SEQ ID NO: 30408 - DNA, 25 bp, Mus musculus
gaccatctggtacgtgcgtttcctg

SEQ ID NO: 30409 - DNA, 25 bp, Mus musculus
gaccatcttagcagcaaagccatcc

SEQ ID NO: 30410 - DNA, 25 bp, Mus musculus
gaccatcttagctgcaaagccatcc

SEQ ID NO: 30411 - DNA, 25 bp, Mus musculus
gaccatctttccaccatagaaaagg

SEQ ID NO: 30412 - DNA, 25 bp, Mus musculus
gaccatgaagaaagacgagcttaca

SEQ ID NO: 30413 - DNA, 25 bp, Mus musculus
gaccatgatctctgcccggccgtgg

SEQ ID NO: 30414 - DNA, 25 bp, Mus musculus
gaccatgcaagtggacgagcacgct

SEQ ID NO: 30415 - DNA, 25 bp, Mus musculus
gaccatgcacagttgaacgcctgct

SEQ ID NO: 30416 - DNA, 25 bp, Mus musculus
gaccatgcagttatctgaggtgatg

SEQ ID NO: 30417 - DNA, 25 bp, Mus musculus
gaccatgccatttggtgggagcaga

SEQ ID NO: 30418 - DNA, 25 bp, Mus musculus
gaccatgccgcttcggtctctgtga

SEQ ID NO: 30419 - DNA, 25 bp, Mus musculus
gaccatgccttcctttgttcatgaa

SEQ ID NO: 30420 - DNA, 25 bp, Mus musculus
gaccatgcgtctgagaattcctttg

SEQ ID NO: 30421 - DNA, 25 bp, Mus musculus
gaccatggacacctacctaggccag

SEQ ID NO: 30422 - DNA, 25 bp, Mus musculus
gaccatggccctttctgtggagacg

SEQ ID NO: 30423 - DNA, 25 bp, Mus musculus
gaccatgggcatgcagactggcttc

SEQ ID NO: 30424 - DNA, 25 bp, Mus musculus
gaccatgtctgcatggcttttgcag

SEQ ID NO: 30425 - DNA, 25 bp, Mus musculus
gaccatgtttacagggcctcctcaa

SEQ ID NO: 30426 - DNA, 25 bp, Mus musculus
gaccattaatcgatctgctcgactg

SEQ ID NO: 30427 - DNA, 25 bp, Mus musculus
gaccattaatcgttctgctcgactg

SEQ ID NO: 30428 - DNA, 25 bp, Mus musculus
gaccattataaaaatccctggagaa

SEQ ID NO: 30429 - DNA, 25 bp, Mus musculus
gaccattccatgtccgtgactcagg

SEQ ID NO: 30430 - DNA, 25 bp, Mus musculus
gaccattcctgcagacacagccttt

SEQ ID NO: 30431 - DNA, 25 bp, Mus musculus
gaccattcgaagcttcctgtccaaa

SEQ ID NO: 30432 - DNA, 25 bp, Mus musculus
gaccattctgggaagagtgccaacg

SEQ ID NO: 30433 - DNA, 25 bp, Mus musculus
gaccattctgggtagagtgccaacg

SEQ ID NO: 30434 - DNA, 25 bp, Mus musculus
gaccattgctgtcgacttttcattg

SEQ ID NO: 30435 - DNA, 25 bp, Mus musculus
gaccatttaaactgcgtccaactcc

SEQ ID NO: 30436 - DNA, 25 bp, Mus musculus
gaccatttaaggtcgctgtgcggta

SEQ ID NO: 30437 - DNA, 25 bp, Mus musculus
gaccatttaccaattccagtttcaa

SEQ ID NO: 30438 - DNA, 25 bp, Mus musculus
gaccatttctatactggatgtgcct

SEQ ID NO: 30439 - DNA, 25 bp, Mus musculus
gaccatttgaagatctgtccccagg

SEQ ID NO: 30440 - DNA, 25 bp, Mus musculus
gaccatttgaagttctgtccccagg

SEQ ID NO: 30441 - DNA, 25 bp, Mus musculus
gaccatttgcaagaggcttctggac

SEQ ID NO: 30442 - DNA, 25 bp, Mus musculus
gaccatttggagctagttctcaccg

SEQ ID NO: 30443 - DNA, 25 bp, Mus musculus
gacccaaaactctttgcaggctgag

SEQ ID NO: 30444 - DNA, 25 bp, Mus musculus
gacccaaaatttccggaatcatgcc

SEQ ID NO: 30445 - DNA, 25 bp, Mus musculus
gacccaaacaggagacattcacctt

SEQ ID NO: 30446 - DNA, 25 bp, Mus musculus
gacccaaactgcaggtcctaggcgc

SEQ ID NO: 30447 - DNA, 25 bp, Mus musculus
gacccaaagtcattcagcctgaagt

SEQ ID NO: 30448 - DNA, 25 bp, Mus musculus
gacccaaatgggaccagtagtttgc

SEQ ID NO: 30449 - DNA, 25 bp, Mus musculus
gacccaaattttctggatgcttata

SEQ ID NO: 30450 - DNA, 25 bp, Mus musculus
gacccaacagtactctgatcatcag

SEQ ID NO: 30451 - DNA, 25 bp, Mus musculus
gacccaactttatgttgtggttaag

SEQ ID NO: 30452 - DNA, 25 bp, Mus musculus
gacccaagaggaatatcattcagaa

SEQ ID NO: 30453 - DNA, 25 bp, Mus musculus
gacccaagagtctgcagttcgttgg

SEQ ID NO: 30454 - DNA, 25 bp, Mus musculus
gacccaagatgactacaaaccatct

SEQ ID NO: 30455 - DNA, 25 bp, Mus musculus
gacccaagcctgagcttgcagtgag

SEQ ID NO: 30456 - DNA, 25 bp, Mus musculus
gacccaatatagtttgcaaagcctg

SEQ ID NO: 30457 - DNA, 25 bp, Mus musculus
gacccaatgactaggttcccgctga

SEQ ID NO: 30458 - DNA, 25 bp, Mus musculus
gacccaatgacttggttcccgctga

SEQ ID NO: 30459 - DNA, 25 bp, Mus musculus
gacccaccgtgatgaactgtactct

SEQ ID NO: 30460 - DNA, 25 bp, Mus musculus
gacccaccgttcttcagagctagga

SEQ ID NO: 30461 - DNA, 25 bp, Mus musculus
gacccacgcaaagagcctaaagctg

SEQ ID NO: 30462 - DNA, 25 bp, Mus musculus
gacccactccctcagggcgtgaaag

SEQ ID NO: 30463 - DNA, 25 bp, Mus musculus
gacccactgtttaaagtttctgcta

SEQ ID NO: 30464 - DNA, 25 bp, Mus musculus
gacccagagctggatcctgagcaga

SEQ ID NO: 30465 - DNA, 25 bp, Mus musculus
gacccagaggatcacaggacggaaa

SEQ ID NO: 30466 - DNA, 25 bp, Mus musculus
gacccagaggtgatcgtggtgacaa

SEQ ID NO: 30467 - DNA, 25 bp, Mus musculus
gacccagcatgaactgtggacaaac

SEQ ID NO: 30468 - DNA, 25 bp, Mus musculus
gacccagccctatgacgtttacgac

SEQ ID NO: 30469 - DNA, 25 bp, Mus musculus
gacccaggatataaatgagctttct

SEQ ID NO: 30470 - DNA, 25 bp, Mus musculus
gacccaggcccgtaagaatattgag

SEQ ID NO: 30471 - DNA, 25 bp, Mus musculus
gacccaggctcagataagctctcag

SEQ ID NO: 30472 - DNA, 25 bp, Mus musculus
gacccagggaaattcaaggaggcag

SEQ ID NO: 30473 - DNA, 25 bp, Mus musculus
gacccagtatccagatgtcaatcat

SEQ ID NO: 30474 - DNA, 25 bp, Mus musculus
gacccataaccagacagcaagaaag

SEQ ID NO: 30475 - DNA, 25 bp, Mus musculus
gacccatacgtgaagctgtccttgt

SEQ ID NO: 30476 - DNA, 25 bp, Mus musculus
gacccatagactcacccttacggaa

SEQ ID NO: 30477 - DNA, 25 bp, Mus musculus
gacccatatgtggtttgtaatgcac

SEQ ID NO: 30478 - DNA, 25 bp, Mus musculus
gacccatgctgatttctgcccttcg

SEQ ID NO: 30479 - DNA, 25 bp, Mus musculus
gacccattatcagctcatgatgttg

SEQ ID NO: 30480 - DNA, 25 bp, Mus musculus
gacccattatttgccctgggcgctg

SEQ ID NO: 30481 - DNA, 25 bp, Mus musculus
gacccattgatcgatgattactctg

SEQ ID NO: 30482 - DNA, 25 bp, Mus musculus
gaccccaacagcaatgatgggctag

SEQ ID NO: 30483 - DNA, 25 bp, Mus musculus
gaccccaacagctatgatgggctag

SEQ ID NO: 30484 - DNA, 25 bp, Mus musculus
gaccccaacctctatttggactata

SEQ ID NO: 30485 - DNA, 25 bp, Mus musculus
gaccccaacctggtgttggacgatg

SEQ ID NO: 30486 - DNA, 25 bp, Mus musculus
gaccccaagaagatcaaggtgtttg

SEQ ID NO: 30487 - DNA, 25 bp, Mus musculus
gaccccaatccaatgcacatcgatg

SEQ ID NO: 30488 - DNA, 25 bp, Mus musculus
gaccccaggattcagaaggaggact

SEQ ID NO: 30489 - DNA, 25 bp, Mus musculus
gaccccaggctggaaaagctgtggc

SEQ ID NO: 30490 - DNA, 25 bp, Mus musculus
gaccccataagacagcagtgtaaag

SEQ ID NO: 30491 - DNA, 25 bp, Mus musculus
gaccccatccgtacagctggtgcaa

SEQ ID NO: 30492 - DNA, 25 bp, Mus musculus
gaccccatcttggacaactatgtgc

SEQ ID NO: 30493 - DNA, 25 bp, Mus musculus
gaccccatgtgcttagagcctgcaa

SEQ ID NO: 30494 - DNA, 25 bp, Mus musculus
gaccccattgttctgacttccctag

SEQ ID NO: 30495 - DNA, 25 bp, Mus musculus
gaccccgaagttgaggtgaccattg

SEQ ID NO: 30496 - DNA, 25 bp, Mus musculus
gaccccgagaggagattgtctactt

SEQ ID NO: 30497 - DNA, 25 bp, Mus musculus
gaccccgaggaccacactgtgtctt

SEQ ID NO: 30498 - DNA, 25 bp, Mus musculus
gaccccgcggacagagctactgatg

SEQ ID NO: 30499 - DNA, 25 bp, Mus musculus
gacccctagttcttcctatggtttg

SEQ ID NO: 30500 - DNA, 25 bp, Mus musculus
gacccctatattaacatcgatgctg

SEQ ID NO: 30501 - DNA, 25 bp, Mus musculus
gacccctcggagaagtgtgctaatg

SEQ ID NO: 30502 - DNA, 25 bp, Mus musculus
gacccctggaccttgcagatgatgg

SEQ ID NO: 30503 - DNA, 25 bp, Mus musculus
gacccctgggatatgtacccatgga

SEQ ID NO: 30504 - DNA, 25 bp, Mus musculus
gacccctgggatttgtacccatgga

SEQ ID NO: 30505 - DNA, 25 bp, Mus musculus
gacccctgtgcagcatcttggtcaa

SEQ ID NO: 30506 - DNA, 25 bp, Mus musculus
gacccgaatcctttgcggcacatca

SEQ ID NO: 30507 - DNA, 25 bp, Mus musculus
gacccgactccctttggtttgcgag

SEQ ID NO: 30508 - DNA, 25 bp, Mus musculus
gacccgagagtacccgtcagaacag

SEQ ID NO: 30509 - DNA, 25 bp, Mus musculus
gacccgagcgtcaggtgggaatact

SEQ ID NO: 30510 - DNA, 25 bp, Mus musculus
gacccgcaggctgcaaggagcaaca

SEQ ID NO: 30511 - DNA, 25 bp, Mus musculus
gacccgccgggcctgcatcaattga

SEQ ID NO: 30512 - DNA, 25 bp, Mus musculus
gacccgcctggaacaaagcctttct

SEQ ID NO: 30513 - DNA, 25 bp, Mus musculus
gacccgcgcgcaagaagccacatgt

SEQ ID NO: 30514 - DNA, 25 bp, Mus musculus
gacccgctgtttggaatgcagccga

SEQ ID NO: 30515 - DNA, 25 bp, Mus musculus
gacccggccatgctctcatcgaaat

SEQ ID NO: 30516 - DNA, 25 bp, Mus musculus
gacccgtcgttggagagtcaaacag

SEQ ID NO: 30517 - DNA, 25 bp, Mus musculus
gacccgtgaacccactgagactgga

SEQ ID NO: 30518 - DNA, 25 bp, Mus musculus
gacccgtttctatctaggctctgct

SEQ ID NO: 30519 - DNA, 25 bp, Mus musculus
gaccctacaggaaggtttgccatcc

SEQ ID NO: 30520 - DNA, 25 bp, Mus musculus
gaccctacaggatggtttgccatcc

SEQ ID NO: 30521 - DNA, 25 bp, Mus musculus
gaccctacgggatctacgacccagg

SEQ ID NO: 30522 - DNA, 25 bp, Mus musculus
gaccctacgtctttcagattgtcag

SEQ ID NO: 30523 - DNA, 25 bp, Mus musculus
gaccctacttaccacattacagatg

SEQ ID NO: 30524 - DNA, 25 bp, Mus musculus
gaccctagggtaaggagcaattcca

SEQ ID NO: 30525 - DNA, 25 bp, Mus musculus
gaccctagggtatggagcaattcca

SEQ ID NO: 30526 - DNA, 25 bp, Mus musculus
gaccctagtgagatccgtgcacctc

SEQ ID NO: 30527 - DNA, 25 bp, Mus musculus
gaccctatggtgcaggtgtgccact

SEQ ID NO: 30528 - DNA, 25 bp, Mus musculus
gaccctcaacatctggacgcacttg

SEQ ID NO: 30529 - DNA, 25 bp, Mus musculus
gaccctcaagaaagggaggattcaa

SEQ ID NO: 30530 - DNA, 25 bp, Mus musculus
gaccctcaatgtcaagagtgaaaag

SEQ ID NO: 30531 - DNA, 25 bp, Mus musculus
gaccctcccagatgatgcagctagt

SEQ ID NO: 30532 - DNA, 25 bp, Mus musculus
gaccctcctgcgagctgtgtgttca

SEQ ID NO: 30533 - DNA, 25 bp, Mus musculus
gaccctcggagtaagcccagaacta

SEQ ID NO: 30534 - DNA, 25 bp, Mus musculus
gaccctctctggaagggactctcag

SEQ ID NO: 30535 - DNA, 25 bp, Mus musculus
gaccctgaacttagatgattatatt

SEQ ID NO: 30536 - DNA, 25 bp, Mus musculus
gaccctgaagctggctcggtgacgt

SEQ ID NO: 30537 - DNA, 25 bp, Mus musculus
gaccctgaagttaggatcctccagc

SEQ ID NO: 30538 - DNA, 25 bp, Mus musculus
gaccctgacagtgaagccgatagca

SEQ ID NO: 30539 - DNA, 25 bp, Mus musculus
gaccctgagccgtaatgatcctgca

SEQ ID NO: 30540 - DNA, 25 bp, Mus musculus
gaccctgagctggtgagacattccc

SEQ ID NO: 30541 - DNA, 25 bp, Mus musculus
gaccctgaggaggtctgctcttgtt

SEQ ID NO: 30542 - DNA, 25 bp, Mus musculus
gaccctgagggaatcaaggatctaa

SEQ ID NO: 30543 - DNA, 25 bp, Mus musculus
gaccctgcagttttggctggctagg

SEQ ID NO: 30544 - DNA, 25 bp, Mus musculus
gaccctgcatctctgttccatgttt

SEQ ID NO: 30545 - DNA, 25 bp, Mus musculus
gaccctgcccaatgtgctgcaatag

SEQ ID NO: 30546 - DNA, 25 bp, Mus musculus
gaccctgccttgaagaccaccttaa

SEQ ID NO: 30547 - DNA, 25 bp, Mus musculus
gaccctgcctttgccaatggattgc

SEQ ID NO: 30548 - DNA, 25 bp, Mus musculus
gaccctgctgtctgactatgaagta

SEQ ID NO: 30549 - DNA, 25 bp, Mus musculus
gaccctggcacaaatgaaagagttt

SEQ ID NO: 30550 - DNA, 25 bp, Mus musculus
gaccctgggaatgatctggaccatc

SEQ ID NO: 30551 - DNA, 25 bp, Mus musculus
gaccctgggaccctttacacatcgg

SEQ ID NO: 30552 - DNA, 25 bp, Mus musculus
gaccctgggaccttaagatccacaa

SEQ ID NO: 30553 - DNA, 25 bp, Mus musculus
gaccctggtgaatgcaccatataag

SEQ ID NO: 30554 - DNA, 25 bp, Mus musculus
gaccctgtaatatgcctaagcctgg

SEQ ID NO: 30555 - DNA, 25 bp, Mus musculus
gaccctgtcacctgagccttggaac

SEQ ID NO: 30556 - DNA, 25 bp, Mus musculus
gaccctgtgaagcagtactatgtga

SEQ ID NO: 30557 - DNA, 25 bp, Mus musculus
gaccctgtgcggctgacccagctgt

SEQ ID NO: 30558 - DNA, 25 bp, Mus musculus
gaccctgttcagagggagctctaca

SEQ ID NO: 30559 - DNA, 25 bp, Mus musculus
gaccctgttctcctgttggactgtt

SEQ ID NO: 30560 - DNA, 25 bp, Mus musculus
gacccttacccagcagaatgatgag

SEQ ID NO: 30561 - DNA, 25 bp, Mus musculus
gacccttcaaagaggacatctgtgt

SEQ ID NO: 30562 - DNA, 25 bp, Mus musculus
gacccttcaagctctctatgagaat

SEQ ID NO: 30563 - DNA, 25 bp, Mus musculus
gacccttctgttgataaagatggag

SEQ ID NO: 30564 - DNA, 25 bp, Mus musculus
gaccctttcctcaagagcttgtcag

SEQ ID NO: 30565 - DNA, 25 bp, Mus musculus
gaccctttcctctagagcttgtcag

SEQ ID NO: 30566 - DNA, 25 bp, Mus musculus
gacccttttgatgacgacctgatga

SEQ ID NO: 30567 - DNA, 25 bp, Mus musculus
gaccgaaaatcctctgcaagaagct

SEQ ID NO: 30568 - DNA, 25 bp, Mus musculus
gaccgaaagagctgtgcagcttcag

SEQ ID NO: 30569 - DNA, 25 bp, Mus musculus
gaccgaaatgtcaaatttaggaagt

SEQ ID NO: 30570 - DNA, 25 bp, Mus musculus
gaccgaaatgtctaatttaggaagt

SEQ ID NO: 30571 - DNA, 25 bp, Mus musculus
gaccgaagcatgattgctgctgcag

SEQ ID NO: 30572 - DNA, 25 bp, Mus musculus
gaccgaaggctccacaggtgtacac

SEQ ID NO: 30573 - DNA, 25 bp, Mus musculus
gaccgaatcgtcctaaaccaagagg

SEQ ID NO: 30574 - DNA, 25 bp, Mus musculus
gaccgaattcaggaggaaatccttt

SEQ ID NO: 30575 - DNA, 25 bp, Mus musculus
gaccgagaactcttgcagtcgttta

SEQ ID NO: 30576 - DNA, 25 bp, Mus musculus
gaccgagatctgatcagccaacccg

SEQ ID NO: 30577 - DNA, 25 bp, Mus musculus
gaccgagatctgttcagccaacccg

SEQ ID NO: 30578 - DNA, 25 bp, Mus musculus
gaccgaggactgaccactcgaccag

SEQ ID NO: 30579 - DNA, 25 bp, Mus musculus
gaccgagtagatgaacccgtctcct

SEQ ID NO: 30580 - DNA, 25 bp, Mus musculus
gaccgatccccttggttcattttag

SEQ ID NO: 30581 - DNA, 25 bp, Mus musculus
gaccgatctgatttacgcagagaag

SEQ ID NO: 30582 - DNA, 25 bp, Mus musculus
gaccgatggtttcctgatctcttag

SEQ ID NO: 30583 - DNA, 25 bp, Mus musculus
gaccgatggtttgctgatctcttag

SEQ ID NO: 30584 - DNA, 25 bp, Mus musculus
gaccgcaatcggctatgctgtgtgc

SEQ ID NO: 30585 - DNA, 25 bp, Mus musculus
gaccgcatgtggctcaagattacca

SEQ ID NO: 30586 - DNA, 25 bp, Mus musculus
gaccgccaaagattttaacccagag

SEQ ID NO: 30587 - DNA, 25 bp, Mus musculus
gaccgccagtagtctgagtttctga

SEQ ID NO: 30588 - DNA, 25 bp, Mus musculus
gaccgcctctttagttacacgtact

SEQ ID NO: 30589 - DNA, 25 bp, Mus musculus
gaccgcctcttttgttacacgtact

SEQ ID NO: 30590 - DNA, 25 bp, Mus musculus
gaccgcgactgcagttccaacggaa

SEQ ID NO: 30591 - DNA, 25 bp, Mus musculus
gaccgcgagcaggatcctggcttcg

SEQ ID NO: 30592 - DNA, 25 bp, Mus musculus
gaccgcggctcactgcctgcagaat

SEQ ID NO: 30593 - DNA, 25 bp, Mus musculus
gaccgctgatgttggcagcgctgaa

SEQ ID NO: 30594 - DNA, 25 bp, Mus musculus
gaccgctgcatccagctaaccatgg

SEQ ID NO: 30595 - DNA, 25 bp, Mus musculus
gaccggagcagttgccagattgcct

SEQ ID NO: 30596 - DNA, 25 bp, Mus musculus
gaccggatgcgctcctttggcatga

SEQ ID NO: 30597 - DNA, 25 bp, Mus musculus
gaccgggaagaaattccaatgagca

SEQ ID NO: 30598 - DNA, 25 bp, Mus musculus
gaccgggacaaacataacgagccca

SEQ ID NO: 30599 - DNA, 25 bp, Mus musculus
gaccgggacaaagataacgagccca

SEQ ID NO: 30600 - DNA, 25 bp, Mus musculus
gaccgggctcatcttgtactcacaa

SEQ ID NO: 30601 - DNA, 25 bp, Mus musculus
gaccgggtgttaagccctagtgcag

SEQ ID NO: 30602 - DNA, 25 bp, Mus musculus
gaccgggttgtctccaaacccacag

SEQ ID NO: 30603 - DNA, 25 bp, Mus musculus
gaccggtataaaatggtggtgcaag

SEQ ID NO: 30604 - DNA, 25 bp, Mus musculus
gaccggtcagcaaggccttatgttt

SEQ ID NO: 30605 - DNA, 25 bp, Mus musculus
gaccgtccagaggtatttgagcagc

SEQ ID NO: 30606 - DNA, 25 bp, Mus musculus
gaccgtccggtctaacagatttcac

SEQ ID NO: 30607 - DNA, 25 bp, Mus musculus
gaccgtctgggcagaatgtcacgat

SEQ ID NO: 30608 - DNA, 25 bp, Mus musculus
gaccgtcttgtggacgagaccccga

SEQ ID NO: 30609 - DNA, 25 bp, Mus musculus
gaccgtgaggcctttgcttcagccc

SEQ ID NO: 30610 - DNA, 25 bp, Mus musculus
gaccgtgcaggcagcatcgtcttga

SEQ ID NO: 30611 - DNA, 25 bp, Mus musculus
gaccgtgctgagaagatcctcacca

SEQ ID NO: 30612 - DNA, 25 bp, Mus musculus
gaccgtgcttggaagaaatgattta

SEQ ID NO: 30613 - DNA, 25 bp, Mus musculus
gaccgtggatggcaaacaccaagac

SEQ ID NO: 30614 - DNA, 25 bp, Mus musculus
gaccgtgggaatctggctgataaac

SEQ ID NO: 30615 - DNA, 25 bp, Mus musculus
gaccgtggtgcctgctgttcaggcc

SEQ ID NO: 30616 - DNA, 25 bp, Mus musculus
gaccgtgtcttccatattggttgct

SEQ ID NO: 30617 - DNA, 25 bp, Mus musculus
gaccgtgtgcagaagaaaactttca

SEQ ID NO: 30618 - DNA, 25 bp, Mus musculus
gaccgtgtggcagtagtgcttcccc

SEQ ID NO: 30619 - DNA, 25 bp, Mus musculus
gaccgtgtggtgtgctttggtaaca

SEQ ID NO: 30620 - DNA, 25 bp, Mus musculus
gaccgtgtttacgaggaaccctatg

SEQ ID NO: 30621 - DNA, 25 bp, Mus musculus
gaccgttcccactatgcaaaatcta

SEQ ID NO: 30622 - DNA, 25 bp, Mus musculus
gacctaaaaccacagcaagtactgg

SEQ ID NO: 30623 - DNA, 25 bp, Mus musculus
gacctaaaagaacttcgagattttg

SEQ ID NO: 30624 - DNA, 25 bp, Mus musculus
gacctaaagcatctaaagacattcg

SEQ ID NO: 30625 - DNA, 25 bp, Mus musculus
gacctacaactcagcgcatgactac

SEQ ID NO: 30626 - DNA, 25 bp, Mus musculus
gacctacaactctgcgcatgactac

SEQ ID NO: 30627 - DNA, 25 bp, Mus musculus
gacctacacttatgagaagcttctg

SEQ ID NO: 30628 - DNA, 25 bp, Mus musculus
gacctaccccaagctttgtgatgga

SEQ ID NO: 30629 - DNA, 25 bp, Mus musculus
gacctaccgagtgctgctgggcgca

SEQ ID NO: 30630 - DNA, 25 bp, Mus musculus
gacctacctaggcaacgccctggtt

SEQ ID NO: 30631 - DNA, 25 bp, Mus musculus
gacctactaaattcactggtgacag

SEQ ID NO: 30632 - DNA, 25 bp, Mus musculus
gacctactctggatggactaccacc

SEQ ID NO: 30633 - DNA, 25 bp, Mus musculus
gacctactgcagtaactagttgcta

SEQ ID NO: 30634 - DNA, 25 bp, Mus musculus
gacctagagcgagccaagcggaagc

SEQ ID NO: 30635 - DNA, 25 bp, Mus musculus
gacctagcagatgtggaatggcaac

SEQ ID NO: 30636 - DNA, 25 bp, Mus musculus
gacctatctgcatttgagtcctcaa

SEQ ID NO: 30637 - DNA, 25 bp, Mus musculus
gacctatcttctggcctgggagtga

SEQ ID NO: 30638 - DNA, 25 bp, Mus musculus
gacctatgaaggtggtgtagacttg

SEQ ID NO: 30639 - DNA, 25 bp, Mus musculus
gacctatgcgtttcttgtgaacaca

SEQ ID NO: 30640 - DNA, 25 bp, Mus musculus
gacctattgagaggcaaatggaggc

SEQ ID NO: 30641 - DNA, 25 bp, Mus musculus
gacctcaacagtcaccgatcaggtt

SEQ ID NO: 30642 - DNA, 25 bp, Mus musculus
gacctcaaggcattcacctgtctac

SEQ ID NO: 30643 - DNA, 25 bp, Mus musculus
gacctcaaggtctacagtctgctaa

SEQ ID NO: 30644 - DNA, 25 bp, Mus musculus
gacctcaagtgggtctttgcctaga

SEQ ID NO: 30645 - DNA, 25 bp, Mus musculus
gacctcaatgaatggattgctgtta

SEQ ID NO: 30646 - DNA, 25 bp, Mus musculus
gacctcacagttgcagcagagcgct

SEQ ID NO: 30647 - DNA, 25 bp, Mus musculus
gacctcagagtcctttccccttggg

SEQ ID NO: 30648 - DNA, 25 bp, Mus musculus
gacctcaggagtaaaggtgttgctg

SEQ ID NO: 30649 - DNA, 25 bp, Mus musculus
gacctcagggcattccaggtgcagc

SEQ ID NO: 30650 - DNA, 25 bp, Mus musculus
gacctcagtacatgccgatctctgc

SEQ ID NO: 30651 - DNA, 25 bp, Mus musculus
gacctcatcgatgttgatcttgtga

SEQ ID NO: 30652 - DNA, 25 bp, Mus musculus
gacctcatgctggagatatcgaccc

SEQ ID NO: 30653 - DNA, 25 bp, Mus musculus
gacctcatgtccttcctggtggctt

SEQ ID NO: 30654 - DNA, 25 bp, Mus musculus
gacctcattcatgccaaggagagct

SEQ ID NO: 30655 - DNA, 25 bp, Mus musculus
gacctcattggaggcgggcacagta

SEQ ID NO: 30656 - DNA, 25 bp, Mus musculus
gacctccaagagaccctgctctgga

SEQ ID NO: 30657 - DNA, 25 bp, Mus musculus
gacctccaagatcctggagaatgga

SEQ ID NO: 30658 - DNA, 25 bp, Mus musculus
gacctccacggatgcctcggaagat

SEQ ID NO: 30659 - DNA, 25 bp, Mus musculus
gacctccatgggtaactgcacaaac

SEQ ID NO: 30660 - DNA, 25 bp, Mus musculus
gacctcccaaaagcagtttgccttg

SEQ ID NO: 30661 - DNA, 25 bp, Mus musculus
gacctcccgggagctgtctcaagta

SEQ ID NO: 30662 - DNA, 25 bp, Mus musculus
gacctccctccaaagtgtcatgact

SEQ ID NO: 30663 - DNA, 25 bp, Mus musculus
gacctccgatatacagtaccagttg

SEQ ID NO: 30664 - DNA, 25 bp, Mus musculus
gacctccgatgctaagagcactcca

SEQ ID NO: 30665 - DNA, 25 bp, Mus musculus
gacctcctcaatatagatgatacgg

SEQ ID NO: 30666 - DNA, 25 bp, Mus musculus
gacctcctgcaacaaacaagttacg

SEQ ID NO: 30667 - DNA, 25 bp, Mus musculus
gacctcctgcagattcggtcctatg

SEQ ID NO: 30668 - DNA, 25 bp, Mus musculus
gacctcgatcccaacaacgttgtca

SEQ ID NO: 30669 - DNA, 25 bp, Mus musculus
gacctcggatgttaggatgaaatca

SEQ ID NO: 30670 - DNA, 25 bp, Mus musculus
gacctctcagaaaactatgaagttg

SEQ ID NO: 30671 - DNA, 25 bp, Mus musculus
gacctctcggaagactctgagtatg

SEQ ID NO: 30672 - DNA, 25 bp, Mus musculus
gacctctctacgtcatagttgaata

SEQ ID NO: 30673 - DNA, 25 bp, Mus musculus
gacctctgagtacatctacttctgc

SEQ ID NO: 30674 - DNA, 25 bp, Mus musculus
gacctcttccacaacagcattgctg

SEQ ID NO: 30675 - DNA, 25 bp, Mus musculus
gacctcttccgtaatgcgggatgtg

SEQ ID NO: 30676 - DNA, 25 bp, Mus musculus
gacctcttgattccattttgaaaga

SEQ ID NO: 30677 - DNA, 25 bp, Mus musculus
gacctgaaaatgaggtgcctgagcc

SEQ ID NO: 30678 - DNA, 25 bp, Mus musculus
gacctgaaccgagtgctcaacgaga

SEQ ID NO: 30679 - DNA, 25 bp, Mus musculus
gacctgaagatctgcatgtatgacc

SEQ ID NO: 30680 - DNA, 25 bp, Mus musculus
gacctgactaacttcactagtgcca

SEQ ID NO: 30681 - DNA, 25 bp, Mus musculus
gacctgactgaattcctctgtgcca

SEQ ID NO: 30682 - DNA, 25 bp, Mus musculus
gacctgagagcttttatgccacaaa

SEQ ID NO: 30683 - DNA, 25 bp, Mus musculus
gacctgagttcacaagagaatttga

SEQ ID NO: 30684 - DNA, 25 bp, Mus musculus
gacctgatagtcttgaagatgcatg

SEQ ID NO: 30685 - DNA, 25 bp, Mus musculus
gacctgatgcataatcacgtcttgg

SEQ ID NO: 30686 - DNA, 25 bp, Mus musculus
gacctgatgttactacgcctcagca

SEQ ID NO: 30687 - DNA, 25 bp, Mus musculus
gacctgatttctgtactgtgggaga

SEQ ID NO: 30688 - DNA, 25 bp, Mus musculus
gacctgcagagaaactcagcacagc

SEQ ID NO: 30689 - DNA, 25 bp, Mus musculus
gacctgcagggtcctatttgactac

SEQ ID NO: 30690 - DNA, 25 bp, Mus musculus
gacctgcagtttcttcatgaatgta

SEQ ID NO: 30691 - DNA, 25 bp, Mus musculus
gacctgccatattcagtaagaactg

SEQ ID NO: 30692 - DNA, 25 bp, Mus musculus
gacctgccgcgttgtgcgtctgctg

SEQ ID NO: 30693 - DNA, 25 bp, Mus musculus
gacctgcgcagcctgtgtcgtacag

SEQ ID NO: 30694 - DNA, 25 bp, Mus musculus
gacctgcgccaaattaaagggaaag

SEQ ID NO: 30695 - DNA, 25 bp, Mus musculus
gacctgcgtgcagaaactggtggct

SEQ ID NO: 30696 - DNA, 25 bp, Mus musculus
gacctgcgtgtccatctcaagatgg

SEQ ID NO: 30697 - DNA, 25 bp, Mus musculus
gacctgctgcagttctctgccaaca

SEQ ID NO: 30698 - DNA, 25 bp, Mus musculus
gacctgctgcccatcaacaatgacg

SEQ ID NO: 30699 - DNA, 25 bp, Mus musculus
gacctgctggaatgcgcagatgaca

SEQ ID NO: 30700 - DNA, 25 bp, Mus musculus
gacctggagattcagtacgaaaccc

SEQ ID NO: 30701 - DNA, 25 bp, Mus musculus
gacctggagattgactctctgtcct

SEQ ID NO: 30702 - DNA, 25 bp, Mus musculus
gacctggagctctgtgaactcgtct

SEQ ID NO: 30703 - DNA, 25 bp, Mus musculus
gacctggataaggcccaggaggcca

SEQ ID NO: 30704 - DNA, 25 bp, Mus musculus
gacctggatggtacctgcagtgcga

SEQ ID NO: 30705 - DNA, 25 bp, Mus musculus
gacctggatggttcctgcagtgcga

SEQ ID NO: 30706 - DNA, 25 bp, Mus musculus
gacctggattctctcatttctgcct

SEQ ID NO: 30707 - DNA, 25 bp, Mus musculus
gacctggccaccttaaaacatggga

SEQ ID NO: 30708 - DNA, 25 bp, Mus musculus
gacctggctgccgtgattgcgcacg

SEQ ID NO: 30709 - DNA, 25 bp, Mus musculus
gacctggcttatccagtagtgttta

SEQ ID NO: 30710 - DNA, 25 bp, Mus musculus
gacctggcttcgcaattctctgcgg

SEQ ID NO: 30711 - DNA, 25 bp, Mus musculus
gacctggcttcggaattctctgcgg

SEQ ID NO: 30712 - DNA, 25 bp, Mus musculus
gacctgggaccatgttgtaaagcat

SEQ ID NO: 30713 - DNA, 25 bp, Mus musculus
gacctgggacttactaatcatacat

SEQ ID NO: 30714 - DNA, 25 bp, Mus musculus
gacctgggcaaaaaagttagcatcc

SEQ ID NO: 30715 - DNA, 25 bp, Mus musculus
gacctgggcaatgtgactgctggaa

SEQ ID NO: 30716 - DNA, 25 bp, Mus musculus
gacctgggcccatcaagtgtgtggc

SEQ ID NO: 30717 - DNA, 25 bp, Mus musculus
gacctgggctgttccaagagagcac

SEQ ID NO: 30718 - DNA, 25 bp, Mus musculus
gacctgggcttctgtggcctccaga

SEQ ID NO: 30719 - DNA, 25 bp, Mus musculus
gacctgggtcgcttagagatccccg

SEQ ID NO: 30720 - DNA, 25 bp, Mus musculus
gacctggtagaaaaggttgatctta

SEQ ID NO: 30721 - DNA, 25 bp, Mus musculus
gacctggtgcgtacccggagatatg

SEQ ID NO: 30722 - DNA, 25 bp, Mus musculus
gacctgtaaactctggagtgctgag

SEQ ID NO: 30723 - DNA, 25 bp, Mus musculus
gacctgtacgaagacctccgtgatg

SEQ ID NO: 30724 - DNA, 25 bp, Mus musculus
gacctgtcattccagcgctcaggaa

SEQ ID NO: 30725 - DNA, 25 bp, Mus musculus
gacctgtcgccaaagcaaggtatcc

SEQ ID NO: 30726 - DNA, 25 bp, Mus musculus
gacctgtctgatctggtatcagaga

SEQ ID NO: 30727 - DNA, 25 bp, Mus musculus
gacctgtctgcatttggcttgactg

SEQ ID NO: 30728 - DNA, 25 bp, Mus musculus
gacctgtgaccgctgcatccagcta

SEQ ID NO: 30729 - DNA, 25 bp, Mus musculus
gacctgtgcagtcactgccagatgt

SEQ ID NO: 30730 - DNA, 25 bp, Mus musculus
gacctgttcattggaccgaaagcag

SEQ ID NO: 30731 - DNA, 25 bp, Mus musculus
gacctgttgctctgcatcaatatga

SEQ ID NO: 30732 - DNA, 25 bp, Mus musculus
gacctgttggagaattcaaggccct

SEQ ID NO: 30733 - DNA, 25 bp, Mus musculus
gaccttagacaagaaagatgggaga

SEQ ID NO: 30734 - DNA, 25 bp, Mus musculus
gaccttagaggagagacgcaaagaa

SEQ ID NO: 30735 - DNA, 25 bp, Mus musculus
gaccttattcgcaagggaatcctgc

SEQ ID NO: 30736 - DNA, 25 bp, Mus musculus
gaccttcaagcttatggagcagctg

SEQ ID NO: 30737 - DNA, 25 bp, Mus musculus
gaccttcagccatgtgcgtccagag

SEQ ID NO: 30738 - DNA, 25 bp, Mus musculus
gaccttcatggcatccgaattcctg

SEQ ID NO: 30739 - DNA, 25 bp, Mus musculus
gaccttccaagccttcattgacttc

SEQ ID NO: 30740 - DNA, 25 bp, Mus musculus
gaccttcctggcgttggagaagatg

SEQ ID NO: 30741 - DNA, 25 bp, Mus musculus
gaccttcgagagtatacccaagcca

SEQ ID NO: 30742 - DNA, 25 bp, Mus musculus
gaccttcgggaaaaacagcagatta

SEQ ID NO: 30743 - DNA, 25 bp, Mus musculus
gaccttctgtgtcctctattcagag

SEQ ID NO: 30744 - DNA, 25 bp, Mus musculus
gaccttcttactgagataggagcca

SEQ ID NO: 30745 - DNA, 25 bp, Mus musculus
gaccttgaaagcattaatggctgca

SEQ ID NO: 30746 - DNA, 25 bp, Mus musculus
gaccttgactcaaactgaaaagagc

SEQ ID NO: 30747 - DNA, 25 bp, Mus musculus
gaccttgagaaagtagtctaagact

SEQ ID NO: 30748 - DNA, 25 bp, Mus musculus
gaccttgaggaatcggaaaagactc

SEQ ID NO: 30749 - DNA, 25 bp, Mus musculus
gaccttgagtcgtgaaactgtctct

SEQ ID NO: 30750 - DNA, 25 bp, Mus musculus
gaccttgatggtttgccagagatta

SEQ ID NO: 30751 - DNA, 25 bp, Mus musculus
gaccttgcagaaattcttgcaaaaa

SEQ ID NO: 30752 - DNA, 25 bp, Mus musculus
gaccttgccccaagtcacatggctg

SEQ ID NO: 30753 - DNA, 25 bp, Mus musculus
gaccttggacaagctccctctgtgg

SEQ ID NO: 30754 - DNA, 25 bp, Mus musculus
gaccttggatagctcaataccatcc

SEQ ID NO: 30755 - DNA, 25 bp, Mus musculus
gaccttgggcttcaaagacccagag

SEQ ID NO: 30756 - DNA, 25 bp, Mus musculus
gaccttggggtgcacatcctgtccg

SEQ ID NO: 30757 - DNA, 25 bp, Mus musculus
gaccttgtccttcaggatgcttcgg

SEQ ID NO: 30758 - DNA, 25 bp, Mus musculus
gaccttgtgtgggacccctgagtac

SEQ ID NO: 30759 - DNA, 25 bp, Mus musculus
gaccttgtgtttggtgctgctcgtt

SEQ ID NO: 30760 - DNA, 25 bp, Mus musculus
gacctttactctttgatgatcttcc

SEQ ID NO: 30761 - DNA, 25 bp, Mus musculus
gacctttatgaaacaatgaggagat

SEQ ID NO: 30762 - DNA, 25 bp, Mus musculus
gacctttcgctcatggacttcctgt

SEQ ID NO: 30763 - DNA, 25 bp, Mus musculus
gacctttcggagatcactgacgagt

SEQ ID NO: 30764 - DNA, 25 bp, Mus musculus
gacctttgcccagggccagagatga

SEQ ID NO: 30765 - DNA, 25 bp, Mus musculus
gacgaaagcgtaatcacagaagaaa

SEQ ID NO: 30766 - DNA, 25 bp, Mus musculus
gacgaaaggctatgctgaccatatg

SEQ ID NO: 30767 - DNA, 25 bp, Mus musculus
gacgaaatttgcaaaagcctacaat

SEQ ID NO: 30768 - DNA, 25 bp, Mus musculus
gacgaacaacttgaagtcactggag

SEQ ID NO: 30769 - DNA, 25 bp, Mus musculus
gacgaacaatttgcagctacatcca

SEQ ID NO: 30770 - DNA, 25 bp, Mus musculus
gacgaacacagaaatcccaggactg

SEQ ID NO: 30771 - DNA, 25 bp, Mus musculus
gacgaacacagatatcccaggactg

SEQ ID NO: 30772 - DNA, 25 bp, Mus musculus
gacgaacatacttctgcggtacctg

SEQ ID NO: 30773 - DNA, 25 bp, Mus musculus
gacgaactgtgttttgaatttggtc

SEQ ID NO: 30774 - DNA, 25 bp, Mus musculus
gacgaagaacctgttgatgaagaac

SEQ ID NO: 30775 - DNA, 25 bp, Mus musculus
gacgaagaatgaccaccaacactta

SEQ ID NO: 30776 - DNA, 25 bp, Mus musculus
gacgaagattcgaatcatctccacc

SEQ ID NO: 30777 - DNA, 25 bp, Mus musculus
gacgaagattcgtatcatctccacc

SEQ ID NO: 30778 - DNA, 25 bp, Mus musculus
gacgaagcatccgaaaagagcagag

SEQ ID NO: 30779 - DNA, 25 bp, Mus musculus
gacgaagctgatgcggatctcatca

SEQ ID NO: 30780 - DNA, 25 bp, Mus musculus
gacgaaggtggaattgtctctacta

SEQ ID NO: 30781 - DNA, 25 bp, Mus musculus
gacgaagtcgttgctgctgtcagcg

SEQ ID NO: 30782 - DNA, 25 bp, Mus musculus
gacgaatcaaattacgacccatctg

SEQ ID NO: 30783 - DNA, 25 bp, Mus musculus
gacgaattcataccagtgtgcactg

SEQ ID NO: 30784 - DNA, 25 bp, Mus musculus
gacgaattcttacacatcaatgact

SEQ ID NO: 30785 - DNA, 25 bp, Mus musculus
gacgacacagatagctccgaagacg

SEQ ID NO: 30786 - DNA, 25 bp, Mus musculus
gacgacatgaccaagaacgatccct

SEQ ID NO: 30787 - DNA, 25 bp, Mus musculus
gacgacatgggatcaaaaggcctga

SEQ ID NO: 30788 - DNA, 25 bp, Mus musculus
gacgaccacgccattgtcctttatg

SEQ ID NO: 30789 - DNA, 25 bp, Mus musculus
gacgacccgggcattttctacagcg

SEQ ID NO: 30790 - DNA, 25 bp, Mus musculus
gacgacctgatgaaaagaggagaaa

SEQ ID NO: 30791 - DNA, 25 bp, Mus musculus
gacgacctggacagcaagctcaatt

SEQ ID NO: 30792 - DNA, 25 bp, Mus musculus
gacgacgatgactcctcctcggagg

SEQ ID NO: 30793 - DNA, 25 bp, Mus musculus
gacgacgccgataactaagaggacg

SEQ ID NO: 30794 - DNA, 25 bp, Mus musculus
gacgacgccgattactaagaggacg

SEQ ID NO: 30795 - DNA, 25 bp, Mus musculus
gacgacgctgcatctgtttcacaaa

SEQ ID NO: 30796 - DNA, 25 bp, Mus musculus
gacgactacacgttctgtgtgaaac

SEQ ID NO: 30797 - DNA, 25 bp, Mus musculus
gacgactccaccctggtcaggattg

SEQ ID NO: 30798 - DNA, 25 bp, Mus musculus
gacgactgtcataccgtgcactcca

SEQ ID NO: 30799 - DNA, 25 bp, Mus musculus
gacgacttagaactcctggctaagc

SEQ ID NO: 30800 - DNA, 25 bp, Mus musculus
gacgacttcgagacccatttagaat

SEQ ID NO: 30801 - DNA, 25 bp, Mus musculus
gacgacttctatcaagtgcactgca

SEQ ID NO: 30802 - DNA, 25 bp, Mus musculus
gacgacttttctccttcaattacca

SEQ ID NO: 30803 - DNA, 25 bp, Mus musculus
gacgagaagctactacagaggtgca

SEQ ID NO: 30804 - DNA, 25 bp, Mus musculus
gacgagaagctagtacagaggtgca

SEQ ID NO: 30805 - DNA, 25 bp, Mus musculus
gacgagaaggaagtgattgatgccc

SEQ ID NO: 30806 - DNA, 25 bp, Mus musculus
gacgagaaggatgaaaatattccca

SEQ ID NO: 30807 - DNA, 25 bp, Mus musculus
gacgagagtctaaccaagtacaaga

SEQ ID NO: 30808 - DNA, 25 bp, Mus musculus
gacgagcaaacctaaaactatagag

SEQ ID NO: 30809 - DNA, 25 bp, Mus musculus
gacgagcaggccctggctcttcagc

SEQ ID NO: 30810 - DNA, 25 bp, Mus musculus
gacgagccatcagtgaagaccatga

SEQ ID NO: 30811 - DNA, 25 bp, Mus musculus
gacgagccatgaagtgccaaggata

SEQ ID NO: 30812 - DNA, 25 bp, Mus musculus
gacgagccgggaccaccatgcgttt

SEQ ID NO: 30813 - DNA, 25 bp, Mus musculus
gacgagccgggagcaccatgcgttt

SEQ ID NO: 30814 - DNA, 25 bp, Mus musculus
gacgagctagtgtctacactgaagc

SEQ ID NO: 30815 - DNA, 25 bp, Mus musculus
gacgagctggaccacgccctcaatg

SEQ ID NO: 30816 - DNA, 25 bp, Mus musculus
gacgagcttctgtctcgcaccttca

SEQ ID NO: 30817 - DNA, 25 bp, Mus musculus
gacgaggactcggccctggataatg

SEQ ID NO: 30818 - DNA, 25 bp, Mus musculus
gacgaggctaggaataagcacgcta

SEQ ID NO: 30819 - DNA, 25 bp, Mus musculus
gacgagggccgcagtttttctcatg

SEQ ID NO: 30820 - DNA, 25 bp, Mus musculus
gacgaggtctccagggttgtcttca

SEQ ID NO: 30821 - DNA, 25 bp, Mus musculus
gacgagtactccagattgctgtctg

SEQ ID NO: 30822 - DNA, 25 bp, Mus musculus
gacgagtctggagctgccagagccc

SEQ ID NO: 30823 - DNA, 25 bp, Mus musculus
gacgagtttgtccatgttgtggcca

SEQ ID NO: 30824 - DNA, 25 bp, Mus musculus
gacgatatggctatgctgccttgaa

SEQ ID NO: 30825 - DNA, 25 bp, Mus musculus
gacgatatggctttgctgccttgaa

SEQ ID NO: 30826 - DNA, 25 bp, Mus musculus
gacgatatgtttgcggttggatagc

SEQ ID NO: 30827 - DNA, 25 bp, Mus musculus
gacgatcgccttaagcagctccagg

SEQ ID NO: 30828 - DNA, 25 bp, Mus musculus
gacgatctctggacccgttttgttt

SEQ ID NO: 30829 - DNA, 25 bp, Mus musculus
gacgatgactccttagaagaacaaa

SEQ ID NO: 30830 - DNA, 25 bp, Mus musculus
gacgatgcccgagaaggcaaggact

SEQ ID NO: 30831 - DNA, 25 bp, Mus musculus
gacgatggagtctggtattcacact

SEQ ID NO: 30832 - DNA, 25 bp, Mus musculus
gacgatgggcaaactgcataaagag

SEQ ID NO: 30833 - DNA, 25 bp, Mus musculus
gacgatgtcccatttaagataggag

SEQ ID NO: 30834 - DNA, 25 bp, Mus musculus
gacgattatgttcgagtaacccagc

SEQ ID NO: 30835 - DNA, 25 bp, Mus musculus
gacgattgtgactgtcatcctgaat

SEQ ID NO: 30836 - DNA, 25 bp, Mus musculus
gacgcaaagaatacataagggacta

SEQ ID NO: 30837 - DNA, 25 bp, Mus musculus
gacgcaacttacatacatctcaaaa

SEQ ID NO: 30838 - DNA, 25 bp, Mus musculus
gacgcaagtttgagttcatccagga

SEQ ID NO: 30839 - DNA, 25 bp, Mus musculus
gacgcacattctaatgataacggag

SEQ ID NO: 30840 - DNA, 25 bp, Mus musculus
gacgcacctgcaaagaagaagtctg

SEQ ID NO: 30841 - DNA, 25 bp, Mus musculus
gacgcaccttgtttaacaggtggat

SEQ ID NO: 30842 - DNA, 25 bp, Mus musculus
gacgcactgccgcagcttctctgag

SEQ ID NO: 30843 - DNA, 25 bp, Mus musculus
gacgcagaacaaaaagcagccaggg

SEQ ID NO: 30844 - DNA, 25 bp, Mus musculus
gacgcagaccagcaaattattcacg

SEQ ID NO: 30845 - DNA, 25 bp, Mus musculus
gacgcagaggatctatgacaagttt

SEQ ID NO: 30846 - DNA, 25 bp, Mus musculus
gacgcagcctcctcactgacatgta

SEQ ID NO: 30847 - DNA, 25 bp, Mus musculus
gacgcagtccgagtccttcgggaga

SEQ ID NO: 30848 - DNA, 25 bp, Mus musculus
gacgcatcaagcagcaaaattctgg

SEQ ID NO: 30849 - DNA, 25 bp, Mus musculus
gacgcatggaatatctcgtgaaatg

SEQ ID NO: 30850 - DNA, 25 bp, Mus musculus
gacgccaacgtttgcacctctagtt

SEQ ID NO: 30851 - DNA, 25 bp, Mus musculus
gacgccaagatacactgatgggaca

SEQ ID NO: 30852 - DNA, 25 bp, Mus musculus
gacgccagtcacactgaagcagaga

SEQ ID NO: 30853 - DNA, 25 bp, Mus musculus
gacgccatctttgtggatgaggccc

SEQ ID NO: 30854 - DNA, 25 bp, Mus musculus
gacgcccagagtttgagtcccagga

SEQ ID NO: 30855 - DNA, 25 bp, Mus musculus
gacgccgggctgtcattctgaaatt

SEQ ID NO: 30856 - DNA, 25 bp, Mus musculus
gacgccgttgtgtctgttgctccag

SEQ ID NO: 30857 - DNA, 25 bp, Mus musculus
gacgcctcctgaagtggaccgaaag

SEQ ID NO: 30858 - DNA, 25 bp, Mus musculus
gacgcctgcagaagaacagcctaaa

SEQ ID NO: 30859 - DNA, 25 bp, Mus musculus
gacgcctgtcttacaagtgtttccc

SEQ ID NO: 30860 - DNA, 25 bp, Mus musculus
gacgcctttgtttttagccatttgg

SEQ ID NO: 30861 - DNA, 25 bp, Mus musculus
gacgcgggtcttgatgccctttcct

SEQ ID NO: 30862 - DNA, 25 bp, Mus musculus
gacgctacactgcacacttccgtgg

SEQ ID NO: 30863 - DNA, 25 bp, Mus musculus
gacgctatctatattgtggttatca

SEQ ID NO: 30864 - DNA, 25 bp, Mus musculus
gacgctatctattttgtggttatca

SEQ ID NO: 30865 - DNA, 25 bp, Mus musculus
gacgctcacctggtgaccttaaagc

SEQ ID NO: 30866 - DNA, 25 bp, Mus musculus
gacgctcagcgtctctatcaggccg

SEQ ID NO: 30867 - DNA, 25 bp, Mus musculus
gacgctccagagtgaactgacagga

SEQ ID NO: 30868 - DNA, 25 bp, Mus musculus
gacgctccatgtcctggaagccaga

SEQ ID NO: 30869 - DNA, 25 bp, Mus musculus
gacgctcgctctcctttttctgcag

SEQ ID NO: 30870 - DNA, 25 bp, Mus musculus
gacgctcgctctgctttttctgcag

SEQ ID NO: 30871 - DNA, 25 bp, Mus musculus
gacgctcggacccatggcaactctg

SEQ ID NO: 30872 - DNA, 25 bp, Mus musculus
gacgctgagcctgggagtttcctga

SEQ ID NO: 30873 - DNA, 25 bp, Mus musculus
gacgctgaggatccacgaaaggctt

SEQ ID NO: 30874 - DNA, 25 bp, Mus musculus
gacgctgatcactctggctctgact

SEQ ID NO: 30875 - DNA, 25 bp, Mus musculus
gacgctgatgaagatgtgtacgccg

SEQ ID NO: 30876 - DNA, 25 bp, Mus musculus
gacgctgattttgcacatcttagga

SEQ ID NO: 30877 - DNA, 25 bp, Mus musculus
gacgctgcaaaagtctgacggtctg

SEQ ID NO: 30878 - DNA, 25 bp, Mus musculus
gacgctgcagactcagatagcaaaa

SEQ ID NO: 30879 - DNA, 25 bp, Mus musculus
gacgctgcatctgtttcacaaattc

SEQ ID NO: 30880 - DNA, 25 bp, Mus musculus
gacgctgccccgcttcagtacttgg

SEQ ID NO: 30881 - DNA, 25 bp, Mus musculus
gacgctgtagttggttgtcagccac

SEQ ID NO: 30882 - DNA, 25 bp, Mus musculus
gacgctgtgacacgccctctgagct

SEQ ID NO: 30883 - DNA, 25 bp, Mus musculus
gacgctgtggctctgccgattgtta

SEQ ID NO: 30884 - DNA, 25 bp, Mus musculus
gacgctgtgtgcaaccaccagcagc

SEQ ID NO: 30885 - DNA, 25 bp, Mus musculus
gacgctgtgtgctaccaccagcagc

SEQ ID NO: 30886 - DNA, 25 bp, Mus musculus
gacgctttcgacattggctcctttg

SEQ ID NO: 30887 - DNA, 25 bp, Mus musculus
gacggaagagctgatacggctcacc

SEQ ID NO: 30888 - DNA, 25 bp, Mus musculus
gacggaagcttcgtgttgaccgaaa

SEQ ID NO: 30889 - DNA, 25 bp, Mus musculus
gacggacaaagttatcagcactatt

SEQ ID NO: 30890 - DNA, 25 bp, Mus musculus
gacggacaagtgtttccggaagtgc

SEQ ID NO: 30891 - DNA, 25 bp, Mus musculus
gacggacggcactctaaagccgaca

SEQ ID NO: 30892 - DNA, 25 bp, Mus musculus
gacggacttttgttggaggcatttg

SEQ ID NO: 30893 - DNA, 25 bp, Mus musculus
gacggagacatagatcccgatcaag

SEQ ID NO: 30894 - DNA, 25 bp, Mus musculus
gacggagagaggatgagaaatccac

SEQ ID NO: 30895 - DNA, 25 bp, Mus musculus
gacggagaggtgaacccaccttccg

SEQ ID NO: 30896 - DNA, 25 bp, Mus musculus
gacggagaggtgtacccaccttccg

SEQ ID NO: 30897 - DNA, 25 bp, Mus musculus
gacggagataagctaaggatcctcc

SEQ ID NO: 30898 - DNA, 25 bp, Mus musculus
gacggaggaaattatgaccaccact

SEQ ID NO: 30899 - DNA, 25 bp, Mus musculus
gacggataatatcaagtacgaagac

SEQ ID NO: 30900 - DNA, 25 bp, Mus musculus
gacggatatctacagcaagcggacc

SEQ ID NO: 30901 - DNA, 25 bp, Mus musculus
gacggatcttgtaaatacagagccg

SEQ ID NO: 30902 - DNA, 25 bp, Mus musculus
gacggcaaggctccatagaggacct

SEQ ID NO: 30903 - DNA, 25 bp, Mus musculus
gacggcacagccatggtcactaggg

SEQ ID NO: 30904 - DNA, 25 bp, Mus musculus
gacggcaccacgactaagtactttg

SEQ ID NO: 30905 - DNA, 25 bp, Mus musculus
gacggcatgctgtggaaaaagctca

SEQ ID NO: 30906 - DNA, 25 bp, Mus musculus
gacggccaaagcacatgcgggttat

SEQ ID NO: 30907 - DNA, 25 bp, Mus musculus
gacggccactgatgtctctgctctg

SEQ ID NO: 30908 - DNA, 25 bp, Mus musculus
gacggccagttcagggtgatgcaca

SEQ ID NO: 30909 - DNA, 25 bp, Mus musculus
gacggccttgccttgtgttgttgat

SEQ ID NO: 30910 - DNA, 25 bp, Mus musculus
gacggcgcgcccaaggtttaccagg

SEQ ID NO: 30911 - DNA, 25 bp, Mus musculus
gacggctgccctgtctggtacgaca

SEQ ID NO: 30912 - DNA, 25 bp, Mus musculus
gacggcttccgcttcttcactaact

SEQ ID NO: 30913 - DNA, 25 bp, Mus musculus
gacggcttggcaatctggtacacaa

SEQ ID NO: 30914 - DNA, 25 bp, Mus musculus
gacgggaaacccaagccacattgga

SEQ ID NO: 30915 - DNA, 25 bp, Mus musculus
gacgggaaaccctagccacattgga

SEQ ID NO: 30916 - DNA, 25 bp, Mus musculus
gacgggaagatcaacgcatgggacc

SEQ ID NO: 30917 - DNA, 25 bp, Mus musculus
gacgggacccatttccagaagaact

SEQ ID NO: 30918 - DNA, 25 bp, Mus musculus
gacgggactctgcaatccggaagca

SEQ ID NO: 30919 - DNA, 25 bp, Mus musculus
gacgggagccagtacaaccctgtta

SEQ ID NO: 30920 - DNA, 25 bp, Mus musculus
gacgggaggcaaagtgttcggagag

SEQ ID NO: 30921 - DNA, 25 bp, Mus musculus
gacgggataaagtccgagaaatgtt

SEQ ID NO: 30922 - DNA, 25 bp, Mus musculus
gacgggatcttcgacatgtttacta

SEQ ID NO: 30923 - DNA, 25 bp, Mus musculus
gacgggattgttcaagtcctgaact

SEQ ID NO: 30924 - DNA, 25 bp, Mus musculus
gacgggcatgatggacacagacgat

SEQ ID NO: 30925 - DNA, 25 bp, Mus musculus
gacgggctctggacgaccatcacca

SEQ ID NO: 30926 - DNA, 25 bp, Mus musculus
gacgggggtcgcagtcatgcaccta

SEQ ID NO: 30927 - DNA, 25 bp, Mus musculus
gacgggtcacactgctggaagccat

SEQ ID NO: 30928 - DNA, 25 bp, Mus musculus
gacggtatttatatacacgaccatg

SEQ ID NO: 30929 - DNA, 25 bp, Mus musculus
gacggtcaagactcggatgaaatca

SEQ ID NO: 30930 - DNA, 25 bp, Mus musculus
gacggtcactgattgacgtttctcc

SEQ ID NO: 30931 - DNA, 25 bp, Mus musculus
gacggtctaccgacatgacaagagg

SEQ ID NO: 30932 - DNA, 25 bp, Mus musculus
gacggtctgactccgttgcactgtg

SEQ ID NO: 30933 - DNA, 25 bp, Mus musculus
gacggtctgtccactcacagaagct

SEQ ID NO: 30934 - DNA, 25 bp, Mus musculus
gacggtgttatatgccctggatcct

SEQ ID NO: 30935 - DNA, 25 bp, Mus musculus
gacggtgtttccctcaaagactgta

SEQ ID NO: 30936 - DNA, 25 bp, Mus musculus
gacggttcacctttctgtccctggg

SEQ ID NO: 30937 - DNA, 25 bp, Mus musculus
gacgtaagccctggtgatggcttca

SEQ ID NO: 30938 - DNA, 25 bp, Mus musculus
gacgtaataacgcagctggagccca

SEQ ID NO: 30939 - DNA, 25 bp, Mus musculus
gacgtaataacggagctggagccca

SEQ ID NO: 30940 - DNA, 25 bp, Mus musculus
gacgtacagggcatgtctgaaggca

SEQ ID NO: 30941 - DNA, 25 bp, Mus musculus
gacgtatgccaatatcacttgggag

SEQ ID NO: 30942 - DNA, 25 bp, Mus musculus
gacgtatggtcttgacccttaccca

SEQ ID NO: 30943 - DNA, 25 bp, Mus musculus
gacgtatgtgatcacggtcactgcc

SEQ ID NO: 30944 - DNA, 25 bp, Mus musculus
gacgtatgtgatgacggtcactgcc

SEQ ID NO: 30945 - DNA, 25 bp, Mus musculus
gacgtcacccagcagtgcatcattg

SEQ ID NO: 30946 - DNA, 25 bp, Mus musculus
gacgtcagtgaagaaacggaatctg

SEQ ID NO: 30947 - DNA, 25 bp, Mus musculus
gacgtcagtgcgcttcacgcagctg

SEQ ID NO: 30948 - DNA, 25 bp, Mus musculus
gacgtcatcatgtggcactaacacc

SEQ ID NO: 30949 - DNA, 25 bp, Mus musculus
gacgtccacttttcctacttgcctt

SEQ ID NO: 30950 - DNA, 25 bp, Mus musculus
gacgtccctgttgacccaggtgtgg

SEQ ID NO: 30951 - DNA, 25 bp, Mus musculus
gacgtccgactctctggctatgtgg

SEQ ID NO: 30952 - DNA, 25 bp, Mus musculus
gacgtcctcaagaaggtcctgtgta

SEQ ID NO: 30953 - DNA, 25 bp, Mus musculus
gacgtcctcactgacgaggcctttg

SEQ ID NO: 30954 - DNA, 25 bp, Mus musculus
gacgtcctccccagggagccggtgt

SEQ ID NO: 30955 - DNA, 25 bp, Mus musculus
gacgtcgctctttgtctcgttccat

SEQ ID NO: 30956 - DNA, 25 bp, Mus musculus
gacgtcgtctgtacccacaactgtg

SEQ ID NO: 30957 - DNA, 25 bp, Mus musculus
gacgtctactccttttcggtgctgg

SEQ ID NO: 30958 - DNA, 25 bp, Mus musculus
gacgtctctcaactggaaggacatt

SEQ ID NO: 30959 - DNA, 25 bp, Mus musculus
gacgtctgtattatgaagagagcct

SEQ ID NO: 30960 - DNA, 25 bp, Mus musculus
gacgtctgtcctctccaagtgcgca

SEQ ID NO: 30961 - DNA, 25 bp, Mus musculus
gacgtcttcaaggaacaacttatgc

SEQ ID NO: 30962 - DNA, 25 bp, Mus musculus
gacgtgaagctcttagccaggcgaa

SEQ ID NO: 30963 - DNA, 25 bp, Mus musculus
gacgtgaatccttctcaaacacagt

SEQ ID NO: 30964 - DNA, 25 bp, Mus musculus
gacgtgaatgaggacacagtagagc

SEQ ID NO: 30965 - DNA, 25 bp, Mus musculus
gacgtgatgacaacaggcccgggct

SEQ ID NO: 30966 - DNA, 25 bp, Mus musculus
gacgtgatgacatcaggcccgggct

SEQ ID NO: 30967 - DNA, 25 bp, Mus musculus
gacgtgatggtagctacctgctgcg

SEQ ID NO: 30968 - DNA, 25 bp, Mus musculus
gacgtgcccaacaaatttggcttta

SEQ ID NO: 30969 - DNA, 25 bp, Mus musculus
gacgtgcctacgctgactggagcct

SEQ ID NO: 30970 - DNA, 25 bp, Mus musculus
gacgtgctttcccactgtctttgat

SEQ ID NO: 30971 - DNA, 25 bp, Mus musculus
gacgtgctttccgactgtctttgat

SEQ ID NO: 30972 - DNA, 25 bp, Mus musculus
gacgtggaatcataagcgaaacagc

SEQ ID NO: 30973 - DNA, 25 bp, Mus musculus
gacgtggaccttccagcctgggcct

SEQ ID NO: 30974 - DNA, 25 bp, Mus musculus
gacgtggagctgacagttgaagaac

SEQ ID NO: 30975 - DNA, 25 bp, Mus musculus
gacgtggccgactatgtggtcccag

SEQ ID NO: 30976 - DNA, 25 bp, Mus musculus
gacgtggcctgatctacgctgactg

SEQ ID NO: 30977 - DNA, 25 bp, Mus musculus
gacgtggcctgcatggccatctgct

SEQ ID NO: 30978 - DNA, 25 bp, Mus musculus
gacgtgggccacatggcactggaca

SEQ ID NO: 30979 - DNA, 25 bp, Mus musculus
gacgtgggcttcaaccttgtcaaca

SEQ ID NO: 30980 - DNA, 25 bp, Mus musculus
gacgtgggcttctaccttgtcaaca

SEQ ID NO: 30981 - DNA, 25 bp, Mus musculus
gacgtggtgcaaatggatgaagaca

SEQ ID NO: 30982 - DNA, 25 bp, Mus musculus
gacgtgtgtaaggtccggtgcatta

SEQ ID NO: 30983 - DNA, 25 bp, Mus musculus
gacgtgtgtctgctctgttaaaatg

SEQ ID NO: 30984 - DNA, 25 bp, Mus musculus
gacgtgttgtattttgcaaaaagtg

SEQ ID NO: 30985 - DNA, 25 bp, Mus musculus
gacgttagcacaaatgatagaagaa

SEQ ID NO: 30986 - DNA, 25 bp, Mus musculus
gacgttcgagctgcagctcagagcc

SEQ ID NO: 30987 - DNA, 25 bp, Mus musculus
gacgttctcctaccttcgggaatct

SEQ ID NO: 30988 - DNA, 25 bp, Mus musculus
gacgttgctgcccagactacattgg

SEQ ID NO: 30989 - DNA, 25 bp, Mus musculus
gacgttggtaactgacaaagtgaaa

SEQ ID NO: 30990 - DNA, 25 bp, Mus musculus
gacgttgtcccaataaccagctacg

SEQ ID NO: 30991 - DNA, 25 bp, Mus musculus
gacgtttctatcattccacccctgt

SEQ ID NO: 30992 - DNA, 25 bp, Mus musculus
gactaaacttatcactcagttgcgt

SEQ ID NO: 30993 - DNA, 25 bp, Mus musculus
gactaaagaagatgcagagcagtct

SEQ ID NO: 30994 - DNA, 25 bp, Mus musculus
gactaaaggagtcaccgtcataccc

SEQ ID NO: 30995 - DNA, 25 bp, Mus musculus
gactaaatccaagtcctgcaagtga

SEQ ID NO: 30996 - DNA, 25 bp, Mus musculus
gactaacttcactagtgccactggg

SEQ ID NO: 30997 - DNA, 25 bp, Mus musculus
gactaagagaagaaaccactggtca

SEQ ID NO: 30998 - DNA, 25 bp, Mus musculus
gactaagtatagcagcccagtggac

SEQ ID NO: 30999 - DNA, 25 bp, Mus musculus
gactaatcaacaaggtcaagtcaca

SEQ ID NO: 31000 - DNA, 25 bp, Mus musculus
gactaatctagagcagaacccaaga

SEQ ID NO: 31001 - DNA, 25 bp, Mus musculus
gactacaaaagccatgtgaagtgca

SEQ ID NO: 31002 - DNA, 25 bp, Mus musculus
gactacaaaagtctgctgtttacgt

SEQ ID NO: 31003 - DNA, 25 bp, Mus musculus
gactacaagcacctcataccaggga

SEQ ID NO: 31004 - DNA, 25 bp, Mus musculus
gactacaaggcctttgggcgtctca

SEQ ID NO: 31005 - DNA, 25 bp, Mus musculus
gactacaatgatcagacattccaag

SEQ ID NO: 31006 - DNA, 25 bp, Mus musculus
gactacacagttatcaagttctctg

SEQ ID NO: 31007 - DNA, 25 bp, Mus musculus
gactacactctcctggatgtgctgg

SEQ ID NO: 31008 - DNA, 25 bp, Mus musculus
gactacagatacacaaatggcctag

SEQ ID NO: 31009 - DNA, 25 bp, Mus musculus
gactacagccagtcagacttcaggg

SEQ ID NO: 31010 - DNA, 25 bp, Mus musculus
gactacagctacgacagcaaattca

SEQ ID NO: 31011 - DNA, 25 bp, Mus musculus
gactacagtgactcggtggcacgga

SEQ ID NO: 31012 - DNA, 25 bp, Mus musculus
gactacatcaaaaatggagtggacg

SEQ ID NO: 31013 - DNA, 25 bp, Mus musculus
gactacatccagcacctgggctcag

SEQ ID NO: 31014 - DNA, 25 bp, Mus musculus
gactacattgcatatgcccatagta

SEQ ID NO: 31015 - DNA, 25 bp, Mus musculus
gactacattgggttgcactgagaaa

SEQ ID NO: 31016 - DNA, 25 bp, Mus musculus
gactaccagacttcaccattgctag

SEQ ID NO: 31017 - DNA, 25 bp, Mus musculus
gactacccagtgaggaaaatcttgc

SEQ ID NO: 31018 - DNA, 25 bp, Mus musculus
gactaccgctgctgtatgtcccctg

SEQ ID NO: 31019 - DNA, 25 bp, Mus musculus
gactacctaggtcgctctggccaac

SEQ ID NO: 31020 - DNA, 25 bp, Mus musculus
gactacctaggtggctctggccaac

SEQ ID NO: 31021 - DNA, 25 bp, Mus musculus
gactacctcacctccctgaggagtg

SEQ ID NO: 31022 - DNA, 25 bp, Mus musculus
gactacctctggaccatcacctgtg

SEQ ID NO: 31023 - DNA, 25 bp, Mus musculus
gactacggtgattctctggcaaagc

SEQ ID NO: 31024 - DNA, 25 bp, Mus musculus
gactacgtccctcgttagtgtggct

SEQ ID NO: 31025 - DNA, 25 bp, Mus musculus
gactactacctggagcagtagacct

SEQ ID NO: 31026 - DNA, 25 bp, Mus musculus
gactactccatttgcacttcaggga

SEQ ID NO: 31027 - DNA, 25 bp, Mus musculus
gactactcgccctatggctattacg

SEQ ID NO: 31028 - DNA, 25 bp, Mus musculus
gactactcttctcgacaagttctca

SEQ ID NO: 31029 - DNA, 25 bp, Mus musculus
gactactcttctggacaagttctca

SEQ ID NO: 31030 - DNA, 25 bp, Mus musculus
gactactgatgtgcaagaattcaag

SEQ ID NO: 31031 - DNA, 25 bp, Mus musculus
gactactgcctagagattttaccct

SEQ ID NO: 31032 - DNA, 25 bp, Mus musculus
gactacttcttgagcagcggtgaca

SEQ ID NO: 31033 - DNA, 25 bp, Mus musculus
gactacttggacaacagcacaccag

SEQ ID NO: 31034 - DNA, 25 bp, Mus musculus
gactagaaaggactgcgattcaccc

SEQ ID NO: 31035 - DNA, 25 bp, Mus musculus
gactagactgcgtcttatgggcaga

SEQ ID NO: 31036 - DNA, 25 bp, Mus musculus
gactagagaccatggagcgtagaga

SEQ ID NO: 31037 - DNA, 25 bp, Mus musculus
gactagaggccttaaagcatgcact

SEQ ID NO: 31038 - DNA, 25 bp, Mus musculus
gactagagtcattcctggcctggtg

SEQ ID NO: 31039 - DNA, 25 bp, Mus musculus
gactagataagacctcagagctgga

SEQ ID NO: 31040 - DNA, 25 bp, Mus musculus
gactagatgcatccagtgtacccgg

SEQ ID NO: 31041 - DNA, 25 bp, Mus musculus
gactagcaaggataaggtgccagct

SEQ ID NO: 31042 - DNA, 25 bp, Mus musculus
gactagccagtcaattccaagatcc

SEQ ID NO: 31043 - DNA, 25 bp, Mus musculus
gactagctcatctcatggccctggg

SEQ ID NO: 31044 - DNA, 25 bp, Mus musculus
gactaggctggtttataacccaaga

SEQ ID NO: 31045 - DNA, 25 bp, Mus musculus
gactagggctggttctggcttaccg

SEQ ID NO: 31046 - DNA, 25 bp, Mus musculus
gactagtaaccagcttctaaagaaa

SEQ ID NO: 31047 - DNA, 25 bp, Mus musculus
gactatagcagcaaatgtactagag

SEQ ID NO: 31048 - DNA, 25 bp, Mus musculus
gactataggcgtgtgcacaagccgc

SEQ ID NO: 31049 - DNA, 25 bp, Mus musculus
gactatatcaactgggtccagcagc

SEQ ID NO: 31050 - DNA, 25 bp, Mus musculus
gactatatcacaggccctgaagtga

SEQ ID NO: 31051 - DNA, 25 bp, Mus musculus
gactatcaacccctgaaaggtcaat

SEQ ID NO: 31052 - DNA, 25 bp, Mus musculus
gactatctcctcttcagcagtgcaa

SEQ ID NO: 31053 - DNA, 25 bp, Mus musculus
gactatctgcacagaaacggtcaga

SEQ ID NO: 31054 - DNA, 25 bp, Mus musculus
gactatctggatgactggacagtgc

SEQ ID NO: 31055 - DNA, 25 bp, Mus musculus
gactatctggtagcaattgaggaga

SEQ ID NO: 31056 - DNA, 25 bp, Mus musculus
gactatgaaagactgctcagcacca

SEQ ID NO: 31057 - DNA, 25 bp, Mus musculus
gactatgacggcaagctgagcagct

SEQ ID NO: 31058 - DNA, 25 bp, Mus musculus
gactatgactccctgccggagtcta

SEQ ID NO: 31059 - DNA, 25 bp, Mus musculus
gactatgattactaccaagactact

SEQ ID NO: 31060 - DNA, 25 bp, Mus musculus
gactatggcaaaggctggagcctca

SEQ ID NO: 31061 - DNA, 25 bp, Mus musculus
gactatggcaggctctgtccactac

SEQ ID NO: 31062 - DNA, 25 bp, Mus musculus
gactatggcagggtctgtccactac

SEQ ID NO: 31063 - DNA, 25 bp, Mus musculus
gactatgtgagtcagccatctccag

SEQ ID NO: 31064 - DNA, 25 bp, Mus musculus
gactatgttcctatcccaatgactg

SEQ ID NO: 31065 - DNA, 25 bp, Mus musculus
gactattatcttaagggctatgttg

SEQ ID NO: 31066 - DNA, 25 bp, Mus musculus
gactattcacggatcattgagcgtc

SEQ ID NO: 31067 - DNA, 25 bp, Mus musculus
gactattgtagatgagctgggcaag

SEQ ID NO: 31068 - DNA, 25 bp, Mus musculus
gactatttaagaactcaacttgtgg

SEQ ID NO: 31069 - DNA, 25 bp, Mus musculus
gactatttaagatctcaacttgtgg

SEQ ID NO: 31070 - DNA, 25 bp, Mus musculus
gactatttgaaatggctcttcccca

SEQ ID NO: 31071 - DNA, 25 bp, Mus musculus
gactcaaaagagtactgtgctgcct

SEQ ID NO: 31072 - DNA, 25 bp, Mus musculus
gactcaaactgaaaagagcagaggc

SEQ ID NO: 31073 - DNA, 25 bp, Mus musculus
gactcaaagcattggccgatgccac

SEQ ID NO: 31074 - DNA, 25 bp, Mus musculus
gactcaaatcataccataggagtgg

SEQ ID NO: 31075 - DNA, 25 bp, Mus musculus
gactcaaatcattccataggagtgg

SEQ ID NO: 31076 - DNA, 25 bp, Mus musculus
gactcaacctgagaaacgtcttgtg

SEQ ID NO: 31077 - DNA, 25 bp, Mus musculus
gactcaagaaactctttcacaggct

SEQ ID NO: 31078 - DNA, 25 bp, Mus musculus
gactcaagagccctgagggagctca

SEQ ID NO: 31079 - DNA, 25 bp, Mus musculus
gactcaagcgaagtgacggtcatcg

SEQ ID NO: 31080 - DNA, 25 bp, Mus musculus
gactcaatcaaaatttgccactgct

SEQ ID NO: 31081 - DNA, 25 bp, Mus musculus
gactcacaagacgatttacctacaa

SEQ ID NO: 31082 - DNA, 25 bp, Mus musculus
gactcacattcatccagcttggtgt

SEQ ID NO: 31083 - DNA, 25 bp, Mus musculus
gactcaccactagaagacgatggag

SEQ ID NO: 31084 - DNA, 25 bp, Mus musculus
gactcacctgaaggatcctgacatg

SEQ ID NO: 31085 - DNA, 25 bp, Mus musculus
gactcagaacacttaacatggctca

SEQ ID NO: 31086 - DNA, 25 bp, Mus musculus
gactcagaatggtgaagtaactcat

SEQ ID NO: 31087 - DNA, 25 bp, Mus musculus
gactcagacatctcctctacaagta

SEQ ID NO: 31088 - DNA, 25 bp, Mus musculus
gactcagacccagcaagttttcctt

SEQ ID NO: 31089 - DNA, 25 bp, Mus musculus
gactcagagctagaagacttatgct

SEQ ID NO: 31090 - DNA, 25 bp, Mus musculus
gactcagaggtggagtcgaccgcca

SEQ ID NO: 31091 - DNA, 25 bp, Mus musculus
gactcagatagcaaaataataagcc

SEQ ID NO: 31092 - DNA, 25 bp, Mus musculus
gactcagcccttcagtcagagatgg

SEQ ID NO: 31093 - DNA, 25 bp, Mus musculus
gactcagcgggcatctggtggcctc

SEQ ID NO: 31094 - DNA, 25 bp, Mus musculus
gactcagcgggcttctggtggcctc

SEQ ID NO: 31095 - DNA, 25 bp, Mus musculus
gactcagctccgaattacgtataga

SEQ ID NO: 31096 - DNA, 25 bp, Mus musculus
gactcagctggatatgttttaccgg

SEQ ID NO: 31097 - DNA, 25 bp, Mus musculus
gactcaggatctgcctcgtctctga

SEQ ID NO: 31098 - DNA, 25 bp, Mus musculus
gactcaggctcaagaggactccttg

SEQ ID NO: 31099 - DNA, 25 bp, Mus musculus
gactcagtaccagacactgcagcaa

SEQ ID NO: 31100 - DNA, 25 bp, Mus musculus
gactcataggtcagctaccctggcg

SEQ ID NO: 31101 - DNA, 25 bp, Mus musculus
gactcatccacgagccccattaaaa

SEQ ID NO: 31102 - DNA, 25 bp, Mus musculus
gactcatgctttgacccttacacgg

SEQ ID NO: 31103 - DNA, 25 bp, Mus musculus
gactcatggtccgtggatccgtcat

SEQ ID NO: 31104 - DNA, 25 bp, Mus musculus
gactcattagactttgcaagatatt

SEQ ID NO: 31105 - DNA, 25 bp, Mus musculus
gactcattgctgtctcgggacatgg

SEQ ID NO: 31106 - DNA, 25 bp, Mus musculus
gactcatttagaataaagacactta

SEQ ID NO: 31107 - DNA, 25 bp, Mus musculus
gactcatttagattaaagacactta

SEQ ID NO: 31108 - DNA, 25 bp, Mus musculus
gactccaaactatcatgtcacacag

SEQ ID NO: 31109 - DNA, 25 bp, Mus musculus
gactccaaactcatcagctttagag

SEQ ID NO: 31110 - DNA, 25 bp, Mus musculus
gactccaaactcttcagctttagag

SEQ ID NO: 31111 - DNA, 25 bp, Mus musculus
gactccaaagcaacgcgttgctggt

SEQ ID NO: 31112 - DNA, 25 bp, Mus musculus
gactccaatcaacaatatcaataag

SEQ ID NO: 31113 - DNA, 25 bp, Mus musculus
gactccaatggacactgcacggacg

SEQ ID NO: 31114 - DNA, 25 bp, Mus musculus
gactccaatggagactgcacggacg

SEQ ID NO: 31115 - DNA, 25 bp, Mus musculus
gactccaccgggtcgactcatttcg

SEQ ID NO: 31116 - DNA, 25 bp, Mus musculus
gactccactatgtctctcaacatca

SEQ ID NO: 31117 - DNA, 25 bp, Mus musculus
gactccactccaaggttgacttgaa

SEQ ID NO: 31118 - DNA, 25 bp, Mus musculus
gactccagagctcagaagtccaaga

SEQ ID NO: 31119 - DNA, 25 bp, Mus musculus
gactccagagctgagaagtccaaga

SEQ ID NO: 31120 - DNA, 25 bp, Mus musculus
gactccagattccaaggaggccacg

SEQ ID NO: 31121 - DNA, 25 bp, Mus musculus
gactccagcaaagtggtacccggca

SEQ ID NO: 31122 - DNA, 25 bp, Mus musculus
gactccaggaccacaatattttctc

SEQ ID NO: 31123 - DNA, 25 bp, Mus musculus
gactccagtggcttgcaattttgta

SEQ ID NO: 31124 - DNA, 25 bp, Mus musculus
gactccagttctgactccgactatg

SEQ ID NO: 31125 - DNA, 25 bp, Mus musculus
gactccatcaaccttacatgaccag

SEQ ID NO: 31126 - DNA, 25 bp, Mus musculus
gactccatcaagtacccttacaagg

SEQ ID NO: 31127 - DNA, 25 bp, Mus musculus
gactccatctgtaacagacactgca

SEQ ID NO: 31128 - DNA, 25 bp, Mus musculus
gactccatctgttacagacactgca

SEQ ID NO: 31129 - DNA, 25 bp, Mus musculus
gactccattagaggacacactggtt

SEQ ID NO: 31130 - DNA, 25 bp, Mus musculus
gactcccagcatgaaggagcctgtg

SEQ ID NO: 31131 - DNA, 25 bp, Mus musculus
gactccccaagtcccgaagaagata

SEQ ID NO: 31132 - DNA, 25 bp, Mus musculus
gactccccgctctgggagttcctga

SEQ ID NO: 31133 - DNA, 25 bp, Mus musculus
gactcccgagacatttgataaggct

SEQ ID NO: 31134 - DNA, 25 bp, Mus musculus
gactccgactatgagcactatgact

SEQ ID NO: 31135 - DNA, 25 bp, Mus musculus
gactccgaggttaacccatgcttgt

SEQ ID NO: 31136 - DNA, 25 bp, Mus musculus
gactccgcaaagagagacaaaacca

SEQ ID NO: 31137 - DNA, 25 bp, Mus musculus
gactccgcgatcaccgcgtcagggt

SEQ ID NO: 31138 - DNA, 25 bp, Mus musculus
gactccgttcaacgataccaacgtg

SEQ ID NO: 31139 - DNA, 25 bp, Mus musculus
gactcctaaggtcacgtgtgttgtg

SEQ ID NO: 31140 - DNA, 25 bp, Mus musculus
gactcctacagattgatccagtttc

SEQ ID NO: 31141 - DNA, 25 bp, Mus musculus
gactcctatttctggcgataccttg

SEQ ID NO: 31142 - DNA, 25 bp, Mus musculus
gactcctcagtaggatactacacag

SEQ ID NO: 31143 - DNA, 25 bp, Mus musculus
gactcctccaagcaaagtgaataat

SEQ ID NO: 31144 - DNA, 25 bp, Mus musculus
gactcctcgaactgacagcactcag

SEQ ID NO: 31145 - DNA, 25 bp, Mus musculus
gactcctctatcatttcagaaggga

SEQ ID NO: 31146 - DNA, 25 bp, Mus musculus
gactcctctgataaaatgcctaatg

SEQ ID NO: 31147 - DNA, 25 bp, Mus musculus
gactcctcttcgtcggcagtgacag

SEQ ID NO: 31148 - DNA, 25 bp, Mus musculus
gactcctctttgtccgaggtgcaca

SEQ ID NO: 31149 - DNA, 25 bp, Mus musculus
gactcctgctgtcactagagtatga

SEQ ID NO: 31150 - DNA, 25 bp, Mus musculus
gactcctggctgtgtgaaaattaaa

SEQ ID NO: 31151 - DNA, 25 bp, Mus musculus
gactcctgggcaacgtgtttctgca

SEQ ID NO: 31152 - DNA, 25 bp, Mus musculus
gactcctgggtctagcttgcatgcc

SEQ ID NO: 31153 - DNA, 25 bp, Mus musculus
gactcctgtatgtttcctgtaaccc

SEQ ID NO: 31154 - DNA, 25 bp, Mus musculus
gactcctgtcgaaagggcttctgaa

SEQ ID NO: 31155 - DNA, 25 bp, Mus musculus
gactccttaacagggtctatgataa

SEQ ID NO: 31156 - DNA, 25 bp, Mus musculus
gactccttggaatctatccctgcag

SEQ ID NO: 31157 - DNA, 25 bp, Mus musculus
gactccttggtgtctgcccaacgag

SEQ ID NO: 31158 - DNA, 25 bp, Mus musculus
gactccttggttcagctaatgcacc

SEQ ID NO: 31159 - DNA, 25 bp, Mus musculus
gactcctttatcacacttagcctaa

SEQ ID NO: 31160 - DNA, 25 bp, Mus musculus
gactcgaccaagatctcggtcacga

SEQ ID NO: 31161 - DNA, 25 bp, Mus musculus
gactcgagctgacagacagcagccc

SEQ ID NO: 31162 - DNA, 25 bp, Mus musculus
gactcgagctgagagacagcagccc

SEQ ID NO: 31163 - DNA, 25 bp, Mus musculus
gactcgatgtttggaatctctgtga

SEQ ID NO: 31164 - DNA, 25 bp, Mus musculus
gactcgcttatgctggctgagcatg

SEQ ID NO: 31165 - DNA, 25 bp, Mus musculus
gactcggaaagcaatctggatcaga

SEQ ID NO: 31166 - DNA, 25 bp, Mus musculus
gactcggaccaaactgacagtagaa

SEQ ID NO: 31167 - DNA, 25 bp, Mus musculus
gactcggactccagttctgactccg

SEQ ID NO: 31168 - DNA, 25 bp, Mus musculus
gactcggagccgacatggaggatct

SEQ ID NO: 31169 - DNA, 25 bp, Mus musculus
gactcggagtccaagaacagctcat

SEQ ID NO: 31170 - DNA, 25 bp, Mus musculus
gactcggatgaaatcacacaacttg

SEQ ID NO: 31171 - DNA, 25 bp, Mus musculus
gactcggctccagtcccttgagaga

SEQ ID NO: 31172 - DNA, 25 bp, Mus musculus
gactcggctctgtttgtggagacgc

SEQ ID NO: 31173 - DNA, 25 bp, Mus musculus
gactcgggcagtaccgcaacgaggt

SEQ ID NO: 31174 - DNA, 25 bp, Mus musculus
gactcgggcattcctaccctggaga

SEQ ID NO: 31175 - DNA, 25 bp, Mus musculus
gactcgggcctacaatggacagcca

SEQ ID NO: 31176 - DNA, 25 bp, Mus musculus
gactcgggcctagaatggacagcca

SEQ ID NO: 31177 - DNA, 25 bp, Mus musculus
gactcgtagccctatcatgcagggt

SEQ ID NO: 31178 - DNA, 25 bp, Mus musculus
gactcgtcccaccatggtgacgctg

SEQ ID NO: 31179 - DNA, 25 bp, Mus musculus
gactcgtccgttttgccagttgcaa

SEQ ID NO: 31180 - DNA, 25 bp, Mus musculus
gactcgtctttgcagaaacccacct

SEQ ID NO: 31181 - DNA, 25 bp, Mus musculus
gactctaacaagctcgggaagaagg

SEQ ID NO: 31182 - DNA, 25 bp, Mus musculus
gactctaagcctgggaccatacgag

SEQ ID NO: 31183 - DNA, 25 bp, Mus musculus
gactctacacatcacatgtggtgta

SEQ ID NO: 31184 - DNA, 25 bp, Mus musculus
gactctaccaggactccatcactgt

SEQ ID NO: 31185 - DNA, 25 bp, Mus musculus
gactctacccgaaaacaagatgctt

SEQ ID NO: 31186 - DNA, 25 bp, Mus musculus
gactctagttgtcttttagaaacac

SEQ ID NO: 31187 - DNA, 25 bp, Mus musculus
gactctcaagactccaattagcaag

SEQ ID NO: 31188 - DNA, 25 bp, Mus musculus
gactctcagcaagaccatagccagg

SEQ ID NO: 31189 - DNA, 25 bp, Mus musculus
gactctcagtagcatcacaagccaa

SEQ ID NO: 31190 - DNA, 25 bp, Mus musculus
gactctcagtaggatcacaagccaa

SEQ ID NO: 31191 - DNA, 25 bp, Mus musculus
gactctcatgaagcccttggagtgt

SEQ ID NO: 31192 - DNA, 25 bp, Mus musculus
gactctcatgcacccaatcttggaa

SEQ ID NO: 31193 - DNA, 25 bp, Mus musculus
gactctcatggtttatgatccatct

SEQ ID NO: 31194 - DNA, 25 bp, Mus musculus
gactctcgcagcctgctggaggcct

SEQ ID NO: 31195 - DNA, 25 bp, Mus musculus
gactctcgctgttgtcactgtcaca

SEQ ID NO: 31196 - DNA, 25 bp, Mus musculus
gactctctaggagttggaaatccgg

SEQ ID NO: 31197 - DNA, 25 bp, Mus musculus
gactctctccagttgcctctaactt

SEQ ID NO: 31198 - DNA, 25 bp, Mus musculus
gactctctctaccaggcagccagag

SEQ ID NO: 31199 - DNA, 25 bp, Mus musculus
gactctctggagttatgatcagacc

SEQ ID NO: 31200 - DNA, 25 bp, Mus musculus
gactctgacaatagtgctggtgagg

SEQ ID NO: 31201 - DNA, 25 bp, Mus musculus
gactctgacactgttgcctcttcag

SEQ ID NO: 31202 - DNA, 25 bp, Mus musculus
gactctgaccaagtagcgcagagtg

SEQ ID NO: 31203 - DNA, 25 bp, Mus musculus
gactctgagaccagaattatcctgc

SEQ ID NO: 31204 - DNA, 25 bp, Mus musculus
gactctgagctctgagggaccttgc

SEQ ID NO: 31205 - DNA, 25 bp, Mus musculus
gactctgaggaagagtttgtcccta

SEQ ID NO: 31206 - DNA, 25 bp, Mus musculus
gactctgagtggtaaagtggaccag

SEQ ID NO: 31207 - DNA, 25 bp, Mus musculus
gactctgatgacctgattagcatgg

SEQ ID NO: 31208 - DNA, 25 bp, Mus musculus
gactctgatgagcacagatctctta

SEQ ID NO: 31209 - DNA, 25 bp, Mus musculus
gactctgatgtccttagttcttgac

SEQ ID NO: 31210 - DNA, 25 bp, Mus musculus
gactctgcaacaattggccaagaaa

SEQ ID NO: 31211 - DNA, 25 bp, Mus musculus
gactctgcagttcaggcgcatttgg

SEQ ID NO: 31212 - DNA, 25 bp, Mus musculus
gactctgcccttctaagtaaacggc

SEQ ID NO: 31213 - DNA, 25 bp, Mus musculus
gactctgcgcgacctgttggctgta

SEQ ID NO: 31214 - DNA, 25 bp, Mus musculus
gactctgctagaggagactcacttc

SEQ ID NO: 31215 - DNA, 25 bp, Mus musculus
gactctgctcatactgaattggtga

SEQ ID NO: 31216 - DNA, 25 bp, Mus musculus
gactctgctgagctagcaatgccat

SEQ ID NO: 31217 - DNA, 25 bp, Mus musculus
gactctgctgcagccgtagtagttt

SEQ ID NO: 31218 - DNA, 25 bp, Mus musculus
gactctgcttggtgattggctccag

SEQ ID NO: 31219 - DNA, 25 bp, Mus musculus
gactctgcttttgactctgatgtcc

SEQ ID NO: 31220 - DNA, 25 bp, Mus musculus
gactctggaagctattgcagactta

SEQ ID NO: 31221 - DNA, 25 bp, Mus musculus
gactctggatgccaagagttctggt

SEQ ID NO: 31222 - DNA, 25 bp, Mus musculus
gactctggatgctgagttccgtgat

SEQ ID NO: 31223 - DNA, 25 bp, Mus musculus
gactctggctgcttccagatgcacc

SEQ ID NO: 31224 - DNA, 25 bp, Mus musculus
gactctgggtttaacaaacagagac

SEQ ID NO: 31225 - DNA, 25 bp, Mus musculus
gactctggtacctacatttgcacat

SEQ ID NO: 31226 - DNA, 25 bp, Mus musculus
gactctgtctccatctaatctcaaa

SEQ ID NO: 31227 - DNA, 25 bp, Mus musculus
gactctgtggtcagctcggtgacaa

SEQ ID NO: 31228 - DNA, 25 bp, Mus musculus
gactctgtggttgatgtgggaaaca

SEQ ID NO: 31229 - DNA, 25 bp, Mus musculus
gactcttcaatcagctcatcaagtg

SEQ ID NO: 31230 - DNA, 25 bp, Mus musculus
gactcttcgcttttggattacctgg

SEQ ID NO: 31231 - DNA, 25 bp, Mus musculus
gactcttctgctgtcctggacatga

SEQ ID NO: 31232 - DNA, 25 bp, Mus musculus
gactcttgagctgggcgccctggaa

SEQ ID NO: 31233 - DNA, 25 bp, Mus musculus
gactcttgatccattcctggacgag

SEQ ID NO: 31234 - DNA, 25 bp, Mus musculus
gactcttgatcctttcctggacgag

SEQ ID NO: 31235 - DNA, 25 bp, Mus musculus
gactgaaactgagtggtggcatctt

SEQ ID NO: 31236 - DNA, 25 bp, Mus musculus
gactgaaactgctcaaaagaggaat

SEQ ID NO: 31237 - DNA, 25 bp, Mus musculus
gactgaaaggaagcatccagagaat

SEQ ID NO: 31238 - DNA, 25 bp, Mus musculus
gactgaaatgccaacggtaagcgcc

SEQ ID NO: 31239 - DNA, 25 bp, Mus musculus
gactgaaattgagacacatacatcc

SEQ ID NO: 31240 - DNA, 25 bp, Mus musculus
gactgaaccacaagacagatgtact

SEQ ID NO: 31241 - DNA, 25 bp, Mus musculus
gactgaaccacagctggcccattgt

SEQ ID NO: 31242 - DNA, 25 bp, Mus musculus
gactgaacggattgaggatcgcccc

SEQ ID NO: 31243 - DNA, 25 bp, Mus musculus
gactgaactgaagacgctgcagact

SEQ ID NO: 31244 - DNA, 25 bp, Mus musculus
gactgaagcgtcgactgattcctgt

SEQ ID NO: 31245 - DNA, 25 bp, Mus musculus
gactgaatcggcctgtgctggtccc

SEQ ID NO: 31246 - DNA, 25 bp, Mus musculus
gactgacagaaactaaagatggctc

SEQ ID NO: 31247 - DNA, 25 bp, Mus musculus
gactgacagcagagagggaactcat

SEQ ID NO: 31248 - DNA, 25 bp, Mus musculus
gactgacagcagtgagggaactcat

SEQ ID NO: 31249 - DNA, 25 bp, Mus musculus
gactgacagggcagctggacaacat

SEQ ID NO: 31250 - DNA, 25 bp, Mus musculus
gactgaccaagaaactggtgcatga

SEQ ID NO: 31251 - DNA, 25 bp, Mus musculus
gactgactcttaagatgcagaattg

SEQ ID NO: 31252 - DNA, 25 bp, Mus musculus
gactgactcttatgatgcagaattg

SEQ ID NO: 31253 - DNA, 25 bp, Mus musculus
gactgactggcattcctataattaa

SEQ ID NO: 31254 - DNA, 25 bp, Mus musculus
gactgactgttgctctgtccatctt

SEQ ID NO: 31255 - DNA, 25 bp, Mus musculus
gactgacttacatctagaccctact

SEQ ID NO: 31256 - DNA, 25 bp, Mus musculus
gactgagaaatgcattctctctctg

SEQ ID NO: 31257 - DNA, 25 bp, Mus musculus
gactgagaagcaagcgctaagctgg

SEQ ID NO: 31258 - DNA, 25 bp, Mus musculus
gactgagaccatagagttctaagaa

SEQ ID NO: 31259 - DNA, 25 bp, Mus musculus
gactgagacgagttacaggccagag

SEQ ID NO: 31260 - DNA, 25 bp, Mus musculus
gactgagccaagtgatgaaatgata

SEQ ID NO: 31261 - DNA, 25 bp, Mus musculus
gactgagcctgcgacgatggcctct

SEQ ID NO: 31262 - DNA, 25 bp, Mus musculus
gactgagcgagactattttggttta

SEQ ID NO: 31263 - DNA, 25 bp, Mus musculus
gactgaggaaagcagaactctggcc

SEQ ID NO: 31264 - DNA, 25 bp, Mus musculus
gactgaggaaccaaaaaggctgacc

SEQ ID NO: 31265 - DNA, 25 bp, Mus musculus
gactgaggatcccagactttttgca

SEQ ID NO: 31266 - DNA, 25 bp, Mus musculus
gactgaggcaaggtcatgctgaatg

SEQ ID NO: 31267 - DNA, 25 bp, Mus musculus
gactgagtgcaccaccatagaacgg

SEQ ID NO: 31268 - DNA, 25 bp, Mus musculus
gactgagtggctctaagaacctaga

SEQ ID NO: 31269 - DNA, 25 bp, Mus musculus
gactgatatccacaataaggaaaaa

SEQ ID NO: 31270 - DNA, 25 bp, Mus musculus
gactgatatccagaataaggaaaaa

SEQ ID NO: 31271 - DNA, 25 bp, Mus musculus
gactgatcttgcttccttggccttt

SEQ ID NO: 31272 - DNA, 25 bp, Mus musculus
gactgatgacagaggtcccatcact

SEQ ID NO: 31273 - DNA, 25 bp, Mus musculus
gactgatgcagttaagttggctatc

SEQ ID NO: 31274 - DNA, 25 bp, Mus musculus
gactgatgtcctgaactgaaggcat

SEQ ID NO: 31275 - DNA, 25 bp, Mus musculus
gactgattcctgtcacctgaggcta

SEQ ID NO: 31276 - DNA, 25 bp, Mus musculus
gactgattttattgattgccttgaa

SEQ ID NO: 31277 - DNA, 25 bp, Mus musculus
gactgattttctgatcctgagccat

SEQ ID NO: 31278 - DNA, 25 bp, Mus musculus
gactgattttggcttgtctgtgcag

SEQ ID NO: 31279 - DNA, 25 bp, Mus musculus
gactgcaagaggcttactctgtcac

SEQ ID NO: 31280 - DNA, 25 bp, Mus musculus
gactgcaatgctaacgtgtacatga

SEQ ID NO: 31281 - DNA, 25 bp, Mus musculus
gactgcaccatacacacctaatttg

SEQ ID NO: 31282 - DNA, 25 bp, Mus musculus
gactgcacgcacacgtgaggaagct

SEQ ID NO: 31283 - DNA, 25 bp, Mus musculus
gactgcacgccacttccgtgatgag

SEQ ID NO: 31284 - DNA, 25 bp, Mus musculus
gactgcacggtggacattccgggct

SEQ ID NO: 31285 - DNA, 25 bp, Mus musculus
gactgcactggagctggcatggata

SEQ ID NO: 31286 - DNA, 25 bp, Mus musculus
gactgcagacgccatgtccaaaagc

SEQ ID NO: 31287 - DNA, 25 bp, Mus musculus
gactgcagactaggcatctgtgcct

SEQ ID NO: 31288 - DNA, 25 bp, Mus musculus
gactgcagcaaaactcagccctgcg

SEQ ID NO: 31289 - DNA, 25 bp, Mus musculus
gactgcagcaaatctcagccctgcg

SEQ ID NO: 31290 - DNA, 25 bp, Mus musculus
gactgcagcagctcaattcggcagc

SEQ ID NO: 31291 - DNA, 25 bp, Mus musculus
gactgcagtaatggatgctccgcgc

SEQ ID NO: 31292 - DNA, 25 bp, Mus musculus
gactgcagtgctacgagtgctatgg

SEQ ID NO: 31293 - DNA, 25 bp, Mus musculus
gactgcatgaacaagctaaaaaaca

SEQ ID NO: 31294 - DNA, 25 bp, Mus musculus
gactgcatgacacggagggcatctt

SEQ ID NO: 31295 - DNA, 25 bp, Mus musculus
gactgcatgacagggagggcatctt

SEQ ID NO: 31296 - DNA, 25 bp, Mus musculus
gactgcatgtaagctcgctcgtcgt

SEQ ID NO: 31297 - DNA, 25 bp, Mus musculus
gactgccaacgatgtggccatccca

SEQ ID NO: 31298 - DNA, 25 bp, Mus musculus
gactgccaatgaagcctggcatggc

SEQ ID NO: 31299 - DNA, 25 bp, Mus musculus
gactgccagaatgcccagggtagga

SEQ ID NO: 31300 - DNA, 25 bp, Mus musculus
gactgccagtggattgatattacag

SEQ ID NO: 31301 - DNA, 25 bp, Mus musculus
gactgccagtggtttgatattacag

SEQ ID NO: 31302 - DNA, 25 bp, Mus musculus
gactgccccggaggacaatggagtc

SEQ ID NO: 31303 - DNA, 25 bp, Mus musculus
gactgccctgatggaggcaaattcc

SEQ ID NO: 31304 - DNA, 25 bp, Mus musculus
gactgcccttggtatgaccgcggct

SEQ ID NO: 31305 - DNA, 25 bp, Mus musculus
gactgccggaggttttaccgagagc

SEQ ID NO: 31306 - DNA, 25 bp, Mus musculus
gactgccgggctgttgtagtctccg

SEQ ID NO: 31307 - DNA, 25 bp, Mus musculus
gactgccgttttggatttcgttgac

SEQ ID NO: 31308 - DNA, 25 bp, Mus musculus
gactgcctccccatggaccagtttg

SEQ ID NO: 31309 - DNA, 25 bp, Mus musculus
gactgcctgaccttcaaagttcacc

SEQ ID NO: 31310 - DNA, 25 bp, Mus musculus
gactgcctgggaaggtcttccaagg

SEQ ID NO: 31311 - DNA, 25 bp, Mus musculus
gactgcctgttgtggttaaactcct

SEQ ID NO: 31312 - DNA, 25 bp, Mus musculus
gactgccttcagatcttagcttatg

SEQ ID NO: 31313 - DNA, 25 bp, Mus musculus
gactgccttggcgaagttactttca

SEQ ID NO: 31314 - DNA, 25 bp, Mus musculus
gactgcctttgattttcccatgaag

SEQ ID NO: 31315 - DNA, 25 bp, Mus musculus
gactgcgagcttgagacacatccag

SEQ ID NO: 31316 - DNA, 25 bp, Mus musculus
gactgcgattggtgaacaaacagaa

SEQ ID NO: 31317 - DNA, 25 bp, Mus musculus
gactgcgcccagaggcctgactgtg

SEQ ID NO: 31318 - DNA, 25 bp, Mus musculus
gactgcgtcttatgggcagatctca

SEQ ID NO: 31319 - DNA, 25 bp, Mus musculus
gactgctaacacatagcgaggagga

SEQ ID NO: 31320 - DNA, 25 bp, Mus musculus
gactgctatatacagctctacgtgg

SEQ ID NO: 31321 - DNA, 25 bp, Mus musculus
gactgctcatctggagaatcccaag

SEQ ID NO: 31322 - DNA, 25 bp, Mus musculus
gactgctcctggcatcgtttaagaa

SEQ ID NO: 31323 - DNA, 25 bp, Mus musculus
gactgctcctggtatgatacatcca

SEQ ID NO: 31324 - DNA, 25 bp, Mus musculus
gactgctcgcttccgtggtgttaaa

SEQ ID NO: 31325 - DNA, 25 bp, Mus musculus
gactgctctcctcattcctcaaaag

SEQ ID NO: 31326 - DNA, 25 bp, Mus musculus
gactgctgaagagtccaaagctctg

SEQ ID NO: 31327 - DNA, 25 bp, Mus musculus
gactgctgaaggaaacatctattcc

SEQ ID NO: 31328 - DNA, 25 bp, Mus musculus
gactgctgacctaaggctcaatgag

SEQ ID NO: 31329 - DNA, 25 bp, Mus musculus
gactgctgagatcgagaatgccaag

SEQ ID NO: 31330 - DNA, 25 bp, Mus musculus
gactgctgagcgactatattgagaa

SEQ ID NO: 31331 - DNA, 25 bp, Mus musculus
gactgctgatgaagggatattcgac

SEQ ID NO: 31332 - DNA, 25 bp, Mus musculus
gactgctgtatggactggcatcagg

SEQ ID NO: 31333 - DNA, 25 bp, Mus musculus
gactgcttcgacaagagtgacgaga

SEQ ID NO: 31334 - DNA, 25 bp, Mus musculus
gactgcttctctgctaaatgtttcc

SEQ ID NO: 31335 - DNA, 25 bp, Mus musculus
gactgcttggtgtcgctgcgcttgt

SEQ ID NO: 31336 - DNA, 25 bp, Mus musculus
gactgcttttccaacgacatccaca

SEQ ID NO: 31337 - DNA, 25 bp, Mus musculus
gactggaaacataccagaagatttt

SEQ ID NO: 31338 - DNA, 25 bp, Mus musculus
gactggaaaggaagatgtataccga

SEQ ID NO: 31339 - DNA, 25 bp, Mus musculus
gactggaaagtttgcaaaccctggt

SEQ ID NO: 31340 - DNA, 25 bp, Mus musculus
gactggaaatccgagaaatctatgg

SEQ ID NO: 31341 - DNA, 25 bp, Mus musculus
gactggaacaacagggcctaaatgt

SEQ ID NO: 31342 - DNA, 25 bp, Mus musculus
gactggaagatctcattgatgataa

SEQ ID NO: 31343 - DNA, 25 bp, Mus musculus
gactggaagcattgaatcctctgga

SEQ ID NO: 31344 - DNA, 25 bp, Mus musculus
gactggaaggcctacatggcccagg

SEQ ID NO: 31345 - DNA, 25 bp, Mus musculus
gactggaagtaggactgcaccatac

SEQ ID NO: 31346 - DNA, 25 bp, Mus musculus
gactggaatgccttagggctctggc

SEQ ID NO: 31347 - DNA, 25 bp, Mus musculus
gactggaattgtcaggcagaatctg

SEQ ID NO: 31348 - DNA, 25 bp, Mus musculus
gactggaatttgatggcttcctcag

SEQ ID NO: 31349 - DNA, 25 bp, Mus musculus
gactggacacaccagggcattacta

SEQ ID NO: 31350 - DNA, 25 bp, Mus musculus
gactggacactgcttctagctagca

SEQ ID NO: 31351 - DNA, 25 bp, Mus musculus
gactggaccagtttgcaatgccacc

SEQ ID NO: 31352 - DNA, 25 bp, Mus musculus
gactggagcctcagtgatacagtgc

SEQ ID NO: 31353 - DNA, 25 bp, Mus musculus
gactggagcctttggcatcttggca

SEQ ID NO: 31354 - DNA, 25 bp, Mus musculus
gactggaggaaaagatgacccactg

SEQ ID NO: 31355 - DNA, 25 bp, Mus musculus
gactggagtccacatcatagctgga

SEQ ID NO: 31356 - DNA, 25 bp, Mus musculus
gactggatagatgatgaagttctct

SEQ ID NO: 31357 - DNA, 25 bp, Mus musculus
gactggatgctacaaactgtttgag

SEQ ID NO: 31358 - DNA, 25 bp, Mus musculus
gactggatgctatgagttgctaaaa

SEQ ID NO: 31359 - DNA, 25 bp, Mus musculus
gactggcaccagcagagatgcagac

SEQ ID NO: 31360 - DNA, 25 bp, Mus musculus
gactggcagatggacgtggatctcc

SEQ ID NO: 31361 - DNA, 25 bp, Mus musculus
gactggcagcaaccggtttgccaag

SEQ ID NO: 31362 - DNA, 25 bp, Mus musculus
gactggcagcgccatgagattatcc

SEQ ID NO: 31363 - DNA, 25 bp, Mus musculus
gactggcagcgtctgtaaattctaa

SEQ ID NO: 31364 - DNA, 25 bp, Mus musculus
gactggccaaaacagggtacgtctt

SEQ ID NO: 31365 - DNA, 25 bp, Mus musculus
gactggcccggtctggaataaacac

SEQ ID NO: 31366 - DNA, 25 bp, Mus musculus
gactggcccggtgtggaataaacac

SEQ ID NO: 31367 - DNA, 25 bp, Mus musculus
gactggcccttggataccatcaagc

SEQ ID NO: 31368 - DNA, 25 bp, Mus musculus
gactggcctatggtgtccgaaactg

SEQ ID NO: 31369 - DNA, 25 bp, Mus musculus
gactggcgagaagcagcagactttg

SEQ ID NO: 31370 - DNA, 25 bp, Mus musculus
gactggcgcactcacagctttccag

SEQ ID NO: 31371 - DNA, 25 bp, Mus musculus
gactggcgttcttaacctctgacca

SEQ ID NO: 31372 - DNA, 25 bp, Mus musculus
gactggctacggctgatctctaaga

SEQ ID NO: 31373 - DNA, 25 bp, Mus musculus
gactggctacgggtgatctctaaga

SEQ ID NO: 31374 - DNA, 25 bp, Mus musculus
gactggcttatacaaggagctccca

SEQ ID NO: 31375 - DNA, 25 bp, Mus musculus
gactgggaaccgtgtggccacgttt

SEQ ID NO: 31376 - DNA, 25 bp, Mus musculus
gactgggaacggatgaatcctgttt

SEQ ID NO: 31377 - DNA, 25 bp, Mus musculus
gactgggacaaacagccggtaaaag

SEQ ID NO: 31378 - DNA, 25 bp, Mus musculus
gactgggctctttaatgacagcgac

SEQ ID NO: 31379 - DNA, 25 bp, Mus musculus
gactgggtccagagtacattagcag

SEQ ID NO: 31380 - DNA, 25 bp, Mus musculus
gactggtatcttcgaaatctctgga

SEQ ID NO: 31381 - DNA, 25 bp, Mus musculus
gactggtatcttggaaatctctgga

SEQ ID NO: 31382 - DNA, 25 bp, Mus musculus
gactggtcaaatttctgttcctact

SEQ ID NO: 31383 - DNA, 25 bp, Mus musculus
gactggtcactctaatgccacggag

SEQ ID NO: 31384 - DNA, 25 bp, Mus musculus
gactggtcattgcagccagagctca

SEQ ID NO: 31385 - DNA, 25 bp, Mus musculus
gactggtgatcggagtctactctgg

SEQ ID NO: 31386 - DNA, 25 bp, Mus musculus
gactggtgcagagcaaggtcttccc

SEQ ID NO: 31387 - DNA, 25 bp, Mus musculus
gactggtgctccaagctgaagttca

SEQ ID NO: 31388 - DNA, 25 bp, Mus musculus
gactggtggtgtagagcagcggagt

SEQ ID NO: 31389 - DNA, 25 bp, Mus musculus
gactggtgtctacttcttcagagaa

SEQ ID NO: 31390 - DNA, 25 bp, Mus musculus
gactggttatccttgctcatttctg

SEQ ID NO: 31391 - DNA, 25 bp, Mus musculus
gactggttggacagcatacggccac

SEQ ID NO: 31392 - DNA, 25 bp, Mus musculus
gactgtaaagtgcttcatttcaaca

SEQ ID NO: 31393 - DNA, 25 bp, Mus musculus
gactgtaaggcggataagacccagc

SEQ ID NO: 31394 - DNA, 25 bp, Mus musculus
gactgtaattgaagaagccagtggt

SEQ ID NO: 31395 - DNA, 25 bp, Mus musculus
gactgtacagcaggcgctcttaacc

SEQ ID NO: 31396 - DNA, 25 bp, Mus musculus
gactgtagactcagctgtgggatct

SEQ ID NO: 31397 - DNA, 25 bp, Mus musculus
gactgtagagtagaaacgaggagct

SEQ ID NO: 31398 - DNA, 25 bp, Mus musculus
gactgtagccaaggagggtgcggag

SEQ ID NO: 31399 - DNA, 25 bp, Mus musculus
gactgtatatggatgacttctgtaa

SEQ ID NO: 31400 - DNA, 25 bp, Mus musculus
gactgtatctgtactcctgacttta

SEQ ID NO: 31401 - DNA, 25 bp, Mus musculus
gactgtattcaaagctgtataaaga

SEQ ID NO: 31402 - DNA, 25 bp, Mus musculus
gactgtcaaccatcaacacatcatc

SEQ ID NO: 31403 - DNA, 25 bp, Mus musculus
gactgtcaagacatccagcagctgg

SEQ ID NO: 31404 - DNA, 25 bp, Mus musculus
gactgtcacaacgtgtctgtgttcc

SEQ ID NO: 31405 - DNA, 25 bp, Mus musculus
gactgtcacgatttcacctttggat

SEQ ID NO: 31406 - DNA, 25 bp, Mus musculus
gactgtcagggtacaggctgtagca

SEQ ID NO: 31407 - DNA, 25 bp, Mus musculus
gactgtcagggttcaggctgtagca

SEQ ID NO: 31408 - DNA, 25 bp, Mus musculus
gactgtcataccgtgcactccaggg

SEQ ID NO: 31409 - DNA, 25 bp, Mus musculus
gactgtcatcctgaatttctgccac

SEQ ID NO: 31410 - DNA, 25 bp, Mus musculus
gactgtccagcaggttaaccaggaa

SEQ ID NO: 31411 - DNA, 25 bp, Mus musculus
gactgtcctagaggccgattcctga

SEQ ID NO: 31412 - DNA, 25 bp, Mus musculus
gactgtcctgcctgaaggtcttgat

SEQ ID NO: 31413 - DNA, 25 bp, Mus musculus
gactgtcgaatgtttcatgtccgga

SEQ ID NO: 31414 - DNA, 25 bp, Mus musculus
gactgtctatgatgcgtctcacatg

SEQ ID NO: 31415 - DNA, 25 bp, Mus musculus
gactgtctcgtaatctacttaagga

SEQ ID NO: 31416 - DNA, 25 bp, Mus musculus
gactgtctctttctgcgtcctgggt

SEQ ID NO: 31417 - DNA, 25 bp, Mus musculus
gactgtctgcagctgattgcagaca

SEQ ID NO: 31418 - DNA, 25 bp, Mus musculus
gactgtcttccacatcaatcaggga

SEQ ID NO: 31419 - DNA, 25 bp, Mus musculus
gactgtcttcccatcaacttgtagc

SEQ ID NO: 31420 - DNA, 25 bp, Mus musculus
gactgtgaatgagtggcctgatcaa

SEQ ID NO: 31421 - DNA, 25 bp, Mus musculus
gactgtgaccgagatcactcgctat

SEQ ID NO: 31422 - DNA, 25 bp, Mus musculus
gactgtgactgaccttccaggaacc

SEQ ID NO: 31423 - DNA, 25 bp, Mus musculus
gactgtgcagcatggatgactttgc

SEQ ID NO: 31424 - DNA, 25 bp, Mus musculus
gactgtgccaaagcccacatagaga

SEQ ID NO: 31425 - DNA, 25 bp, Mus musculus
gactgtgcgctggtgaaccgctttc

SEQ ID NO: 31426 - DNA, 25 bp, Mus musculus
gactgtgcttatcaccagaaaactg

SEQ ID NO: 31427 - DNA, 25 bp, Mus musculus
gactgtggaacttgccccggcagga

SEQ ID NO: 31428 - DNA, 25 bp, Mus musculus
gactgtggagaccacgttgtcataa

SEQ ID NO: 31429 - DNA, 25 bp, Mus musculus
gactgtggcaagattgcattctaca

SEQ ID NO: 31430 - DNA, 25 bp, Mus musculus
gactgtggccgctgcgacttctgct

SEQ ID NO: 31431 - DNA, 25 bp, Mus musculus
gactgtggtatatgaaactttgttg

SEQ ID NO: 31432 - DNA, 25 bp, Mus musculus
gactgtgtggaggacccgaagaact

SEQ ID NO: 31433 - DNA, 25 bp, Mus musculus
gactgtgtggtattctaactccttg

SEQ ID NO: 31434 - DNA, 25 bp, Mus musculus
gactgttacctattaaaccctgcca

SEQ ID NO: 31435 - DNA, 25 bp, Mus musculus
gactgttcagtggtatcctcatgac

SEQ ID NO: 31436 - DNA, 25 bp, Mus musculus
gactgttccagagcgaagcacttta

SEQ ID NO: 31437 - DNA, 25 bp, Mus musculus
gactgttcccgacgccgggctgtca

SEQ ID NO: 31438 - DNA, 25 bp, Mus musculus
gactgttcgcagaagtccccgaaga

SEQ ID NO: 31439 - DNA, 25 bp, Mus musculus
gactgttcgcagtagtccccgaaga

SEQ ID NO: 31440 - DNA, 25 bp, Mus musculus
gactgttctcttttatatgcccaga

SEQ ID NO: 31441 - DNA, 25 bp, Mus musculus
gactgttctgccaccagtgaccgga

SEQ ID NO: 31442 - DNA, 25 bp, Mus musculus
gactgttggccaagtgaagaacttc

SEQ ID NO: 31443 - DNA, 25 bp, Mus musculus
gactgttgtcagagctggaagttac

SEQ ID NO: 31444 - DNA, 25 bp, Mus musculus
gactgtttatcggagccagcctgct

SEQ ID NO: 31445 - DNA, 25 bp, Mus musculus
gactgtttcactcattgccttattg

SEQ ID NO: 31446 - DNA, 25 bp, Mus musculus
gactgtttctgttctcctacgccgc

SEQ ID NO: 31447 - DNA, 25 bp, Mus musculus
gactgttttaaagaacggacctcag

SEQ ID NO: 31448 - DNA, 25 bp, Mus musculus
gactgttttaactgcttgccgatag

SEQ ID NO: 31449 - DNA, 25 bp, Mus musculus
gactgttttacctcctctttccctg

SEQ ID NO: 31450 - DNA, 25 bp, Mus musculus
gacttaaaccagtgtttctcactaa

SEQ ID NO: 31451 - DNA, 25 bp, Mus musculus
gacttaaagtctggatcctgttctc

SEQ ID NO: 31452 - DNA, 25 bp, Mus musculus
gacttaactctgtttcccatggaca

SEQ ID NO: 31453 - DNA, 25 bp, Mus musculus
gacttaattttacagcaggagggat

SEQ ID NO: 31454 - DNA, 25 bp, Mus musculus
gacttacagaagaaataacttatgg

SEQ ID NO: 31455 - DNA, 25 bp, Mus musculus
gacttacagggtacccagtcagaaa

SEQ ID NO: 31456 - DNA, 25 bp, Mus musculus
gacttacagtgagacaaaagatatc

SEQ ID NO: 31457 - DNA, 25 bp, Mus musculus
gacttaccaatttattatggaccag

SEQ ID NO: 31458 - DNA, 25 bp, Mus musculus
gacttaccagaatactatgaattaa

SEQ ID NO: 31459 - DNA, 25 bp, Mus musculus
gacttacgatatgtggtccttcaga

SEQ ID NO: 31460 - DNA, 25 bp, Mus musculus
gacttacggttaattgaagtcactg

SEQ ID NO: 31461 - DNA, 25 bp, Mus musculus
gacttacgtgtcctgcttctaccac

SEQ ID NO: 31462 - DNA, 25 bp, Mus musculus
gacttactttcacttagttctgagg

SEQ ID NO: 31463 - DNA, 25 bp, Mus musculus
gacttactttgctgcatttgaggta

SEQ ID NO: 31464 - DNA, 25 bp, Mus musculus
gacttagaacagaggaatttgtaca

SEQ ID NO: 31465 - DNA, 25 bp, Mus musculus
gacttagaagaacaggaccttggat

SEQ ID NO: 31466 - DNA, 25 bp, Mus musculus
gacttagaggtggtactggagaaaa

SEQ ID NO: 31467 - DNA, 25 bp, Mus musculus
gacttagagtatctgtgactgttga

SEQ ID NO: 31468 - DNA, 25 bp, Mus musculus
gacttagagtatgtgtgactgttga

SEQ ID NO: 31469 - DNA, 25 bp, Mus musculus
gacttagatgaaaaactcatgttgg

SEQ ID NO: 31470 - DNA, 25 bp, Mus musculus
gacttagctggacaacaaagccccg

SEQ ID NO: 31471 - DNA, 25 bp, Mus musculus
gacttagtggagtgggtaaatgtct

SEQ ID NO: 31472 - DNA, 25 bp, Mus musculus
gacttatcaatctcaccttcctgga

SEQ ID NO: 31473 - DNA, 25 bp, Mus musculus
gacttatcttcctttagtagaagag

SEQ ID NO: 31474 - DNA, 25 bp, Mus musculus
gacttatgctcttatgttaatgaga

SEQ ID NO: 31475 - DNA, 25 bp, Mus musculus
gacttcaaaagaacagccttcatga

SEQ ID NO: 31476 - DNA, 25 bp, Mus musculus
gacttcaagcgcaagtttgcagact

SEQ ID NO: 31477 - DNA, 25 bp, Mus musculus
gacttcaaggtcaagacggtctacc

SEQ ID NO: 31478 - DNA, 25 bp, Mus musculus
gacttcaagtctgtggaccacctga

SEQ ID NO: 31479 - DNA, 25 bp, Mus musculus
gacttcaatgcagaagctgtcaaga

SEQ ID NO: 31480 - DNA, 25 bp, Mus musculus
gacttcaatgccgttgagtatatca

SEQ ID NO: 31481 - DNA, 25 bp, Mus musculus
gacttcaccatgtgagctcccagga

SEQ ID NO: 31482 - DNA, 25 bp, Mus musculus
gacttcagaagaaaaaacttttcag

SEQ ID NO: 31483 - DNA, 25 bp, Mus musculus
gacttcagacgcagagcgagccctt

SEQ ID NO: 31484 - DNA, 25 bp, Mus musculus
gacttcagattttccttccccgcag

SEQ ID NO: 31485 - DNA, 25 bp, Mus musculus
gacttcaggaacagggacatacatt

SEQ ID NO: 31486 - DNA, 25 bp, Mus musculus
gacttcaggagtgtcaggagaagct

SEQ ID NO: 31487 - DNA, 25 bp, Mus musculus
gacttcagggataaagatggaacac

SEQ ID NO: 31488 - DNA, 25 bp, Mus musculus
gacttcagtgtgatgtagcggaccc

SEQ ID NO: 31489 - DNA, 25 bp, Mus musculus
gacttcagttacaaccgggaagact

SEQ ID NO: 31490 - DNA, 25 bp, Mus musculus
gacttcatattgacactgtacaagg

SEQ ID NO: 31491 - DNA, 25 bp, Mus musculus
gacttcatcaagcacaatcagctgc

SEQ ID NO: 31492 - DNA, 25 bp, Mus musculus
gacttcatcgccagcaagggagtca

SEQ ID NO: 31493 - DNA, 25 bp, Mus musculus
gacttcatggacgaggttttacagg

SEQ ID NO: 31494 - DNA, 25 bp, Mus musculus
gacttcatttactggctcacaccac

SEQ ID NO: 31495 - DNA, 25 bp, Mus musculus
gacttccaaggtctcccggctgttt

SEQ ID NO: 31496 - DNA, 25 bp, Mus musculus
gacttccacacccatgttggaacat

SEQ ID NO: 31497 - DNA, 25 bp, Mus musculus
gacttcccctgatgattcagatcga

SEQ ID NO: 31498 - DNA, 25 bp, Mus musculus
gacttccctagcatggaggactata

SEQ ID NO: 31499 - DNA, 25 bp, Mus musculus
gacttccgctaaaaccctggaaatg

SEQ ID NO: 31500 - DNA, 25 bp, Mus musculus
gacttcctcttccataagtcaggtg

SEQ ID NO: 31501 - DNA, 25 bp, Mus musculus
gacttcctgagcgaagatgagagtg

SEQ ID NO: 31502 - DNA, 25 bp, Mus musculus
gacttcctgaggcatgaactccgct

SEQ ID NO: 31503 - DNA, 25 bp, Mus musculus
gacttcctggccttgattctgcacc

SEQ ID NO: 31504 - DNA, 25 bp, Mus musculus
gacttccttctccagcatgtgaaag

SEQ ID NO: 31505 - DNA, 25 bp, Mus musculus
gacttccttgagcttccgaagcgga

SEQ ID NO: 31506 - DNA, 25 bp, Mus musculus
gacttcgaacaaaaggcccagactt

SEQ ID NO: 31507 - DNA, 25 bp, Mus musculus
gacttcgagtgtgaagaggacccat

SEQ ID NO: 31508 - DNA, 25 bp, Mus musculus
gacttcgattccatcagtggatgcc

SEQ ID NO: 31509 - DNA, 25 bp, Mus musculus
gacttcgattccttcagtggatgcc

SEQ ID NO: 31510 - DNA, 25 bp, Mus musculus
gacttcgcagtagtagaccagccat

SEQ ID NO: 31511 - DNA, 25 bp, Mus musculus
gacttcggcaatttccaaggcaaaa

SEQ ID NO: 31512 - DNA, 25 bp, Mus musculus
gacttcggtgtaaaatggtgcttca

SEQ ID NO: 31513 - DNA, 25 bp, Mus musculus
gacttcggttttgccaagcgtgtga

SEQ ID NO: 31514 - DNA, 25 bp, Mus musculus
gacttcgtaagcaaggagatgttcg

SEQ ID NO: 31515 - DNA, 25 bp, Mus musculus
gacttcgtaccaaccaacactttga

SEQ ID NO: 31516 - DNA, 25 bp, Mus musculus
gacttcgtcagccacaacgtccgaa

SEQ ID NO: 31517 - DNA, 25 bp, Mus musculus
gacttcgtggagatctgcaaacggg

SEQ ID NO: 31518 - DNA, 25 bp, Mus musculus
gacttcgtgggacaatgccaccagc

SEQ ID NO: 31519 - DNA, 25 bp, Mus musculus
gacttcgtgtatgatcaggcaatga

SEQ ID NO: 31520 - DNA, 25 bp, Mus musculus
gacttcgttttactggccctggcaa

SEQ ID NO: 31521 - DNA, 25 bp, Mus musculus
gacttctacgggaatcagatcaagc

SEQ ID NO: 31522 - DNA, 25 bp, Mus musculus
gacttctactcttctcggcagcatg

SEQ ID NO: 31523 - DNA, 25 bp, Mus musculus
gacttctagagtctgtgaagcctca

SEQ ID NO: 31524 - DNA, 25 bp, Mus musculus
gacttctagtagcattgacacaatg

SEQ ID NO: 31525 - DNA, 25 bp, Mus musculus
gacttctcattgagtccagctctac

SEQ ID NO: 31526 - DNA, 25 bp, Mus musculus
gacttctccgggaacctggacctag

SEQ ID NO: 31527 - DNA, 25 bp, Mus musculus
gacttctctccggatgagtgggaat

SEQ ID NO: 31528 - DNA, 25 bp, Mus musculus
gacttctctgaaaatgccgccaggc

SEQ ID NO: 31529 - DNA, 25 bp, Mus musculus
gacttctctgagctctgtttcctag

SEQ ID NO: 31530 - DNA, 25 bp, Mus musculus
gacttctgaagatcaagctgccata

SEQ ID NO: 31531 - DNA, 25 bp, Mus musculus
gacttctgcagaggaattgtgcagt

SEQ ID NO: 31532 - DNA, 25 bp, Mus musculus
gacttctgcggttcaaattgcaact

SEQ ID NO: 31533 - DNA, 25 bp, Mus musculus
gacttctgcgtgcatactgttagca

SEQ ID NO: 31534 - DNA, 25 bp, Mus musculus
gacttctggagatgaagtgctgtcc

SEQ ID NO: 31535 - DNA, 25 bp, Mus musculus
gacttctggagtcttcgtcccgagt

SEQ ID NO: 31536 - DNA, 25 bp, Mus musculus
gacttctggtgctctgcaccctggc

SEQ ID NO: 31537 - DNA, 25 bp, Mus musculus
gacttcttaccgcagccaagacatg

SEQ ID NO: 31538 - DNA, 25 bp, Mus musculus
gacttcttcgtgatgagtgattaca

SEQ ID NO: 31539 - DNA, 25 bp, Mus musculus
gacttcttgtctcctgataaccctc

SEQ ID NO: 31540 - DNA, 25 bp, Mus musculus
gacttcttgtctgctgataaccctc

SEQ ID NO: 31541 - DNA, 25 bp, Mus musculus
gacttgaatcggaaggacagaacag

SEQ ID NO: 31542 - DNA, 25 bp, Mus musculus
gacttgaatctctttgcctatgcct

SEQ ID NO: 31543 - DNA, 25 bp, Mus musculus
gacttgaccctgaacttagatgatt

SEQ ID NO: 31544 - DNA, 25 bp, Mus musculus
gacttgactgatatccagaataagg

SEQ ID NO: 31545 - DNA, 25 bp, Mus musculus
gacttgactgatttccagaataagg

SEQ ID NO: 31546 - DNA, 25 bp, Mus musculus
gacttgaggcttctactaataaaag

SEQ ID NO: 31547 - DNA, 25 bp, Mus musculus
gacttgatcaacttctgccttagct

SEQ ID NO: 31548 - DNA, 25 bp, Mus musculus
gacttgatgccgttctccactcgtg

SEQ ID NO: 31549 - DNA, 25 bp, Mus musculus
gacttgattgtgaccccgtttgctc

SEQ ID NO: 31550 - DNA, 25 bp, Mus musculus
gacttgcacgttctgccatggagga

SEQ ID NO: 31551 - DNA, 25 bp, Mus musculus
gacttgcctcctgatgcacttatca

SEQ ID NO: 31552 - DNA, 25 bp, Mus musculus
gacttgcctggaagctgtgacagca

SEQ ID NO: 31553 - DNA, 25 bp, Mus musculus
gacttgctgcaatctgtaaagaaca

SEQ ID NO: 31554 - DNA, 25 bp, Mus musculus
gacttgctgcgataaaccactgttg

SEQ ID NO: 31555 - DNA, 25 bp, Mus musculus
gacttggaagctacttaatacggaa

SEQ ID NO: 31556 - DNA, 25 bp, Mus musculus
gacttggactgtgaaaacgaccacg

SEQ ID NO: 31557 - DNA, 25 bp, Mus musculus
gacttggagacatagtccctccaac

SEQ ID NO: 31558 - DNA, 25 bp, Mus musculus
gacttggaggccagcagctcctaca

SEQ ID NO: 31559 - DNA, 25 bp, Mus musculus
gacttggatcaaccactttgtcatc

SEQ ID NO: 31560 - DNA, 25 bp, Mus musculus
gacttggatcacattgtcccatccg

SEQ ID NO: 31561 - DNA, 25 bp, Mus musculus
gacttggatcccgtatgctttccac

SEQ ID NO: 31562 - DNA, 25 bp, Mus musculus
gacttggatctggagctggttctgc

SEQ ID NO: 31563 - DNA, 25 bp, Mus musculus
gacttggatgaaaatatggactaca

SEQ ID NO: 31564 - DNA, 25 bp, Mus musculus
gacttggatgacttcaagggttcct

SEQ ID NO: 31565 - DNA, 25 bp, Mus musculus
gacttgggcctttatataggattta

SEQ ID NO: 31566 - DNA, 25 bp, Mus musculus
gacttggtctatacactggctttct

SEQ ID NO: 31567 - DNA, 25 bp, Mus musculus
gacttggttcctattggctcctgac

SEQ ID NO: 31568 - DNA, 25 bp, Mus musculus
gacttgtaaacatcgtggcccggtg

SEQ ID NO: 31569 - DNA, 25 bp, Mus musculus
gacttgtaagttctactgaaacatg

SEQ ID NO: 31570 - DNA, 25 bp, Mus musculus
gacttgtcacctgtattatttccaa

SEQ ID NO: 31571 - DNA, 25 bp, Mus musculus
gacttgtcgattctctgatgcccac

SEQ ID NO: 31572 - DNA, 25 bp, Mus musculus
gacttgtcttcatgtgcaacgtggc

SEQ ID NO: 31573 - DNA, 25 bp, Mus musculus
gacttgtgctatcagttccggcgag

SEQ ID NO: 31574 - DNA, 25 bp, Mus musculus
gacttgtgctatgagttccggcgag

SEQ ID NO: 31575 - DNA, 25 bp, Mus musculus
gacttgttcagtaacgtgcccttcc

SEQ ID NO: 31576 - DNA, 25 bp, Mus musculus
gactttaaaagcaaaactctgctgg

SEQ ID NO: 31577 - DNA, 25 bp, Mus musculus
gactttaaccaagggcggtgagcag

SEQ ID NO: 31578 - DNA, 25 bp, Mus musculus
gactttaagctcgacttcggcaatt

SEQ ID NO: 31579 - DNA, 25 bp, Mus musculus
gactttacacccttctcgctattca

SEQ ID NO: 31580 - DNA, 25 bp, Mus musculus
gactttacagagcagcctcccataa

SEQ ID NO: 31581 - DNA, 25 bp, Mus musculus
gactttagccactgagcatcatgaa

SEQ ID NO: 31582 - DNA, 25 bp, Mus musculus
gactttaggagcagggatacaccac

SEQ ID NO: 31583 - DNA, 25 bp, Mus musculus
gactttaggaggattatgcacagaa

SEQ ID NO: 31584 - DNA, 25 bp, Mus musculus
gactttattagtgccattcatcgta

SEQ ID NO: 31585 - DNA, 25 bp, Mus musculus
gactttcaaaagagagctgctgccc

SEQ ID NO: 31586 - DNA, 25 bp, Mus musculus
gactttcaacagcaaatgatgagat

SEQ ID NO: 31587 - DNA, 25 bp, Mus musculus
gactttcaagcaccccattaagagg

SEQ ID NO: 31588 - DNA, 25 bp, Mus musculus
gactttcacctcagaatagtgctgc

SEQ ID NO: 31589 - DNA, 25 bp, Mus musculus
gactttcagagtagagggagaagca

SEQ ID NO: 31590 - DNA, 25 bp, Mus musculus
gactttcagctgagaaatttaagaa

SEQ ID NO: 31591 - DNA, 25 bp, Mus musculus
gactttcattgatccgagcacctta

SEQ ID NO: 31592 - DNA, 25 bp, Mus musculus
gactttccggagcacatagacagcg

SEQ ID NO: 31593 - DNA, 25 bp, Mus musculus
gactttccggaggacatagacagcg

SEQ ID NO: 31594 - DNA, 25 bp, Mus musculus
gactttcgaaagtgcgggatcaact

SEQ ID NO: 31595 - DNA, 25 bp, Mus musculus
gactttctagcacaaccaagctgag

SEQ ID NO: 31596 - DNA, 25 bp, Mus musculus
gactttctccggaatgttcatactg

SEQ ID NO: 31597 - DNA, 25 bp, Mus musculus
gactttctctctactgtaggaggag

SEQ ID NO: 31598 - DNA, 25 bp, Mus musculus
gactttctgctctacctggatcctc

SEQ ID NO: 31599 - DNA, 25 bp, Mus musculus
gactttctggatggcttcttcagag

SEQ ID NO: 31600 - DNA, 25 bp, Mus musculus
gactttgaaaaaagacctgctggac

SEQ ID NO: 31601 - DNA, 25 bp, Mus musculus
gactttgaacagcaaagctccacag

SEQ ID NO: 31602 - DNA, 25 bp, Mus musculus
gactttgaagattctacgtgcctca

SEQ ID NO: 31603 - DNA, 25 bp, Mus musculus
gactttgaagttactacattagtgg

SEQ ID NO: 31604 - DNA, 25 bp, Mus musculus
gactttgaagtttctacattagtgg

SEQ ID NO: 31605 - DNA, 25 bp, Mus musculus
gactttgcaagatattcagatgatg

SEQ ID NO: 31606 - DNA, 25 bp, Mus musculus
gactttgcacgatttagtggaacaa

SEQ ID NO: 31607 - DNA, 25 bp, Mus musculus
gactttgccaaacagctccctggct

SEQ ID NO: 31608 - DNA, 25 bp, Mus musculus
gactttgccagaagccaattagtag

SEQ ID NO: 31609 - DNA, 25 bp, Mus musculus
gactttgccaggactcatggctggg

SEQ ID NO: 31610 - DNA, 25 bp, Mus musculus
gactttggccgacctgttctttgca

SEQ ID NO: 31611 - DNA, 25 bp, Mus musculus
gactttggccgtgatgaggcccctg

SEQ ID NO: 31612 - DNA, 25 bp, Mus musculus
gactttggctgggatccctgctttc

SEQ ID NO: 31613 - DNA, 25 bp, Mus musculus
gactttggtggacaaatggcctgat

SEQ ID NO: 31614 - DNA, 25 bp, Mus musculus
gactttgtaaacagttttatagact

SEQ ID NO: 31615 - DNA, 25 bp, Mus musculus
gactttgtagccatcaaccagagtg

SEQ ID NO: 31616 - DNA, 25 bp, Mus musculus
gactttgtcactcggtatttgaata

SEQ ID NO: 31617 - DNA, 25 bp, Mus musculus
gactttgtctcaaggagtcaaaaag

SEQ ID NO: 31618 - DNA, 25 bp, Mus musculus
gactttgtgcgtctccgaaattact

SEQ ID NO: 31619 - DNA, 25 bp, Mus musculus
gacttttagccaggacaatacccca

SEQ ID NO: 31620 - DNA, 25 bp, Mus musculus
gacttttaggagtaacgcagcagct

SEQ ID NO: 31621 - DNA, 25 bp, Mus musculus
gacttttgagatcacaggcccagga

SEQ ID NO: 31622 - DNA, 25 bp, Mus musculus
gacttttggagcagatgactccgga

SEQ ID NO: 31623 - DNA, 25 bp, Mus musculus
gacttttggctcagtgacttcaaca

SEQ ID NO: 31624 - DNA, 25 bp, Mus musculus
gacttttgtcaagattggataaacc

SEQ ID NO: 31625 - DNA, 25 bp, Mus musculus
gacttttgttggaggcatttggacc

SEQ ID NO: 31626 - DNA, 25 bp, Mus musculus
gagaaaaaacgcaagggcaaaacag

SEQ ID NO: 31627 - DNA, 25 bp, Mus musculus
gagaaaaagacgaagaaatgtggat

SEQ ID NO: 31628 - DNA, 25 bp, Mus musculus
gagaaaaagcaaaaaggagaaggtt

SEQ ID NO: 31629 - DNA, 25 bp, Mus musculus
gagaaaaagcaataaggagaaggtt

SEQ ID NO: 31630 - DNA, 25 bp, Mus musculus
gagaaaacacaagctatgatgtagc

SEQ ID NO: 31631 - DNA, 25 bp, Mus musculus
gagaaaacacctgctccaatgctca

SEQ ID NO: 31632 - DNA, 25 bp, Mus musculus
gagaaaacagacaccgtccgctgca

SEQ ID NO: 31633 - DNA, 25 bp, Mus musculus
gagaaaacctcaggcacaatggagt

SEQ ID NO: 31634 - DNA, 25 bp, Mus musculus
gagaaaacgtcttttgtggaagaag

SEQ ID NO: 31635 - DNA, 25 bp, Mus musculus
gagaaaactgcagagcaactccgtg

SEQ ID NO: 31636 - DNA, 25 bp, Mus musculus
gagaaaactgcagcctcaggacgat

SEQ ID NO: 31637 - DNA, 25 bp, Mus musculus
gagaaaagagagtcaccttctccag

SEQ ID NO: 31638 - DNA, 25 bp, Mus musculus
gagaaaatagatatagtactgcact

SEQ ID NO: 31639 - DNA, 25 bp, Mus musculus
gagaaaatatcaagctaataggagg

SEQ ID NO: 31640 - DNA, 25 bp, Mus musculus
gagaaaatcccaggctcatatagct

SEQ ID NO: 31641 - DNA, 25 bp, Mus musculus
gagaaaatctggcttcggctccgcg

SEQ ID NO: 31642 - DNA, 25 bp, Mus musculus
gagaaacaacaaatactggtaacag

SEQ ID NO: 31643 - DNA, 25 bp, Mus musculus
gagaaacagacacagcatcagagag

SEQ ID NO: 31644 - DNA, 25 bp, Mus musculus
gagaaacagcatttcgagcaacaga

SEQ ID NO: 31645 - DNA, 25 bp, Mus musculus
gagaaacagtgtggatataagttat

SEQ ID NO: 31646 - DNA, 25 bp, Mus musculus
gagaaacatgatggcctctatccag

SEQ ID NO: 31647 - DNA, 25 bp, Mus musculus
gagaaacctagtgttcagagttcca

SEQ ID NO: 31648 - DNA, 25 bp, Mus musculus
gagaaacctgcaatgcgcttactaa

SEQ ID NO: 31649 - DNA, 25 bp, Mus musculus
gagaaacctgcattgcgcttactaa

SEQ ID NO: 31650 - DNA, 25 bp, Mus musculus
gagaaacgtgtgaaattgcttaagg

SEQ ID NO: 31651 - DNA, 25 bp, Mus musculus
gagaaactggcttatatgccccata

SEQ ID NO: 31652 - DNA, 25 bp, Mus musculus
gagaaactttagacagacgctcgct

SEQ ID NO: 31653 - DNA, 25 bp, Mus musculus
gagaaactttagtcagacgctcgct

SEQ ID NO: 31654 - DNA, 25 bp, Mus musculus
gagaaagaacacatcgagaacttga

SEQ ID NO: 31655 - DNA, 25 bp, Mus musculus
gagaaagacattttcagacttaaga

SEQ ID NO: 31656 - DNA, 25 bp, Mus musculus
gagaaagactgttcatcaatgaggg

SEQ ID NO: 31657 - DNA, 25 bp, Mus musculus
gagaaagagacggacaacaccaaac

SEQ ID NO: 31658 - DNA, 25 bp, Mus musculus
gagaaagagactcccatacacctgt

SEQ ID NO: 31659 - DNA, 25 bp, Mus musculus
gagaaagagatggacaccccagact

SEQ ID NO: 31660 - DNA, 25 bp, Mus musculus
gagaaagcatcgtacctttggagaa

SEQ ID NO: 31661 - DNA, 25 bp, Mus musculus
gagaaagccagtgtgtctgtaaacg

SEQ ID NO: 31662 - DNA, 25 bp, Mus musculus
gagaaagcttgttccctgaagacca

SEQ ID NO: 31663 - DNA, 25 bp, Mus musculus
gagaaaggccatatatctgctggat

SEQ ID NO: 31664 - DNA, 25 bp, Mus musculus
gagaaaggcgagttccagattcttc

SEQ ID NO: 31665 - DNA, 25 bp, Mus musculus
gagaaatagcaggacctccagacac

SEQ ID NO: 31666 - DNA, 25 bp, Mus musculus
gagaaatcacccgatgatccacggt

SEQ ID NO: 31667 - DNA, 25 bp, Mus musculus
gagaaatcagagctctttggcctta

SEQ ID NO: 31668 - DNA, 25 bp, Mus musculus
gagaaatcagcattgactattcaga

SEQ ID NO: 31669 - DNA, 25 bp, Mus musculus
gagaaatccacccacagtactgaac

SEQ ID NO: 31670 - DNA, 25 bp, Mus musculus
gagaaatcctgctggtctgatgcaa

SEQ ID NO: 31671 - DNA, 25 bp, Mus musculus
gagaaatcggcgagccaggaagaca

SEQ ID NO: 31672 - DNA, 25 bp, Mus musculus
gagaaatgaagtggcccagctgaaa

SEQ ID NO: 31673 - DNA, 25 bp, Mus musculus
gagaaatggtttgccacaaaatcct

SEQ ID NO: 31674 - DNA, 25 bp, Mus musculus
gagaaattctgagtcacccctgggt

SEQ ID NO: 31675 - DNA, 25 bp, Mus musculus
gagaacacacttgcgatataaacct

SEQ ID NO: 31676 - DNA, 25 bp, Mus musculus
gagaacagagacgtggagtatcatg

SEQ ID NO: 31677 - DNA, 25 bp, Mus musculus
gagaacagatgaagtggtaaaacaa

SEQ ID NO: 31678 - DNA, 25 bp, Mus musculus
gagaacagcccttgaagatcattag

SEQ ID NO: 31679 - DNA, 25 bp, Mus musculus
gagaacagctcaggctgaaaatcaa

SEQ ID NO: 31680 - DNA, 25 bp, Mus musculus
gagaacagggaggatattagccagt

SEQ ID NO: 31681 - DNA, 25 bp, Mus musculus
gagaacagtgagatttacgactacc

SEQ ID NO: 31682 - DNA, 25 bp, Mus musculus
gagaacagtttgcttccagcctccc

SEQ ID NO: 31683 - DNA, 25 bp, Mus musculus
gagaacatccttgggaaggacaccg

SEQ ID NO: 31684 - DNA, 25 bp, Mus musculus
gagaacattatgaagccggagccca

SEQ ID NO: 31685 - DNA, 25 bp, Mus musculus
gagaaccacctggaagtcgtcaggt

SEQ ID NO: 31686 - DNA, 25 bp, Mus musculus
gagaaccactatgtgtcacggctca

SEQ ID NO: 31687 - DNA, 25 bp, Mus musculus
gagaaccagatgaaaggcctggaga

SEQ ID NO: 31688 - DNA, 25 bp, Mus musculus
gagaacccagctcatgctgatgggc

SEQ ID NO: 31689 - DNA, 25 bp, Mus musculus
gagaacccagctgatgctgatgggc

SEQ ID NO: 31690 - DNA, 25 bp, Mus musculus
gagaacccggatgatggagatattt

SEQ ID NO: 31691 - DNA, 25 bp, Mus musculus
gagaaccggccttctataccgtatg

SEQ ID NO: 31692 - DNA, 25 bp, Mus musculus
gagaaccggcgaatgcaggagctac

SEQ ID NO: 31693 - DNA, 25 bp, Mus musculus
gagaacctcatcctcttggagcaag

SEQ ID NO: 31694 - DNA, 25 bp, Mus musculus
gagaacctcattagtgccccactgg

SEQ ID NO: 31695 - DNA, 25 bp, Mus musculus
gagaaccttctggaccatcagatga

SEQ ID NO: 31696 - DNA, 25 bp, Mus musculus
gagaacgaagttcttcgtcaccagc

SEQ ID NO: 31697 - DNA, 25 bp, Mus musculus
gagaacgagccaccaagcggaagct

SEQ ID NO: 31698 - DNA, 25 bp, Mus musculus
gagaacgagcctgatttggcccagt

SEQ ID NO: 31699 - DNA, 25 bp, Mus musculus
gagaacgccgagaggaacgagaaaa

SEQ ID NO: 31700 - DNA, 25 bp, Mus musculus
gagaacgtggatgaagactcctctg

SEQ ID NO: 31701 - DNA, 25 bp, Mus musculus
gagaactatcctgaggacgtactgg

SEQ ID NO: 31702 - DNA, 25 bp, Mus musculus
gagaactgccagtgtcctccgccgg

SEQ ID NO: 31703 - DNA, 25 bp, Mus musculus
gagaacttaactaggcagcctctga

SEQ ID NO: 31704 - DNA, 25 bp, Mus musculus
gagaacttagacagctcgttgatct

SEQ ID NO: 31705 - DNA, 25 bp, Mus musculus
gagaacttagctggccacattcaac

SEQ ID NO: 31706 - DNA, 25 bp, Mus musculus
gagaacttaggccacctacttattc

SEQ ID NO: 31707 - DNA, 25 bp, Mus musculus
gagaacttatatgcaaagacaggag

SEQ ID NO: 31708 - DNA, 25 bp, Mus musculus
gagaacttccacagtgtttttgcag

SEQ ID NO: 31709 - DNA, 25 bp, Mus musculus
gagaacttcgagctgattaaccatg

SEQ ID NO: 31710 - DNA, 25 bp, Mus musculus
gagaacttgctctggttcaaaccaa

SEQ ID NO: 31711 - DNA, 25 bp, Mus musculus
gagaacttttcatccggatccgcag

SEQ ID NO: 31712 - DNA, 25 bp, Mus musculus
gagaagaaagatgtgtgcttgccag

SEQ ID NO: 31713 - DNA, 25 bp, Mus musculus
gagaagaaatagagaccggtatgtg

SEQ ID NO: 31714 - DNA, 25 bp, Mus musculus
gagaagaactagttacggtggcttc

SEQ ID NO: 31715 - DNA, 25 bp, Mus musculus
gagaagaagcggagaaagaaatgaa

SEQ ID NO: 31716 - DNA, 25 bp, Mus musculus
gagaagacagcatgaacttcactcc

SEQ ID NO: 31717 - DNA, 25 bp, Mus musculus
gagaagacagctgttaacaactgag

SEQ ID NO: 31718 - DNA, 25 bp, Mus musculus
gagaagaccagctacatggcggtgc

SEQ ID NO: 31719 - DNA, 25 bp, Mus musculus
gagaagacgatgacctcagactcag

SEQ ID NO: 31720 - DNA, 25 bp, Mus musculus
gagaagactaaacttatcactcagt

SEQ ID NO: 31721 - DNA, 25 bp, Mus musculus
gagaagactcatcctccgtcagtgc

SEQ ID NO: 31722 - DNA, 25 bp, Mus musculus
gagaagactgtaataatggcgaacc

SEQ ID NO: 31723 - DNA, 25 bp, Mus musculus
gagaagagaacaatgaccaagttac

SEQ ID NO: 31724 - DNA, 25 bp, Mus musculus
gagaagagagtgactaacacacaag

SEQ ID NO: 31725 - DNA, 25 bp, Mus musculus
gagaagagcatccaccaggaatcag

SEQ ID NO: 31726 - DNA, 25 bp, Mus musculus
gagaagagccttgtcctgcaggccc

SEQ ID NO: 31727 - DNA, 25 bp, Mus musculus
gagaagagcctttgaaacaaagcgc

SEQ ID NO: 31728 - DNA, 25 bp, Mus musculus
gagaagagcgaccagctcactagga

SEQ ID NO: 31729 - DNA, 25 bp, Mus musculus
gagaagagggtgaagcttgaagaga

SEQ ID NO: 31730 - DNA, 25 bp, Mus musculus
gagaagagtctcgtcaacttggaca

SEQ ID NO: 31731 - DNA, 25 bp, Mus musculus
gagaagagtctttctgataggcttg

SEQ ID NO: 31732 - DNA, 25 bp, Mus musculus
gagaagataaacaaaactgacctga

SEQ ID NO: 31733 - DNA, 25 bp, Mus musculus
gagaagataacgaaggtgaaagagc

SEQ ID NO: 31734 - DNA, 25 bp, Mus musculus
gagaagatcaaagagaatgctgtga

SEQ ID NO: 31735 - DNA, 25 bp, Mus musculus
gagaagatcaacctgaatgtccggc

SEQ ID NO: 31736 - DNA, 25 bp, Mus musculus
gagaagatcaatacggattccacag

SEQ ID NO: 31737 - DNA, 25 bp, Mus musculus
gagaagatcccttacttccgaggac

SEQ ID NO: 31738 - DNA, 25 bp, Mus musculus
gagaagatcctataacatttgcacc

SEQ ID NO: 31739 - DNA, 25 bp, Mus musculus
gagaagatcctgatccggccaacag

SEQ ID NO: 31740 - DNA, 25 bp, Mus musculus
gagaagatcttgaagcttactgctg

SEQ ID NO: 31741 - DNA, 25 bp, Mus musculus
gagaagatgaccaggacaggttcag

SEQ ID NO: 31742 - DNA, 25 bp, Mus musculus
gagaagatgtacctagacagaatca

SEQ ID NO: 31743 - DNA, 25 bp, Mus musculus
gagaagcacaaaatgaatgtcccag

SEQ ID NO: 31744 - DNA, 25 bp, Mus musculus
gagaagcagaagagctcagggctca

SEQ ID NO: 31745 - DNA, 25 bp, Mus musculus
gagaagcagctcaagatcaaccggc

SEQ ID NO: 31746 - DNA, 25 bp, Mus musculus
gagaagcagctggttgctctcatcc

SEQ ID NO: 31747 - DNA, 25 bp, Mus musculus
gagaagcatatctccctcctccatg

SEQ ID NO: 31748 - DNA, 25 bp, Mus musculus
gagaagcatttccagaaagaagagc

SEQ ID NO: 31749 - DNA, 25 bp, Mus musculus
gagaagccatgcctctatcctgaag

SEQ ID NO: 31750 - DNA, 25 bp, Mus musculus
gagaagcccgaggtcaagcagaagt

SEQ ID NO: 31751 - DNA, 25 bp, Mus musculus
gagaagcccgggaagcagcgctctt

SEQ ID NO: 31752 - DNA, 25 bp, Mus musculus
gagaagcctagtagaactcccagcc

SEQ ID NO: 31753 - DNA, 25 bp, Mus musculus
gagaagcctccaagttcaggcaagc

SEQ ID NO: 31754 - DNA, 25 bp, Mus musculus
gagaagcctgtctggtctgttggta

SEQ ID NO: 31755 - DNA, 25 bp, Mus musculus
gagaagcgcctgcaatctctgcgcc

SEQ ID NO: 31756 - DNA, 25 bp, Mus musculus
gagaagcgcctggaatctctgcgcc

SEQ ID NO: 31757 - DNA, 25 bp, Mus musculus
gagaagcgctaccaagcagccgctg

SEQ ID NO: 31758 - DNA, 25 bp, Mus musculus
gagaagcggctccacgctgtccctg

SEQ ID NO: 31759 - DNA, 25 bp, Mus musculus
gagaagcgtctaggtctcctgcagg

SEQ ID NO: 31760 - DNA, 25 bp, Mus musculus
gagaagctgcaggagacggctagct

SEQ ID NO: 31761 - DNA, 25 bp, Mus musculus
gagaagcttcaaccaaccgagggtg

SEQ ID NO: 31762 - DNA, 25 bp, Mus musculus
gagaagcttcccactcactgcagag

SEQ ID NO: 31763 - DNA, 25 bp, Mus musculus
gagaagcttccctctcactgcagag

SEQ ID NO: 31764 - DNA, 25 bp, Mus musculus
gagaagcttctagacttcatcaagc

SEQ ID NO: 31765 - DNA, 25 bp, Mus musculus
gagaaggaatacactcagaagcttg

SEQ ID NO: 31766 - DNA, 25 bp, Mus musculus
gagaaggaatcagagctctggaagc

SEQ ID NO: 31767 - DNA, 25 bp, Mus musculus
gagaaggacccaaacaggagacatt

SEQ ID NO: 31768 - DNA, 25 bp, Mus musculus
gagaaggaggaagaaaacatctcag

SEQ ID NO: 31769 - DNA, 25 bp, Mus musculus
gagaaggaggttctcatgactccac

SEQ ID NO: 31770 - DNA, 25 bp, Mus musculus
gagaaggatgaaaatattcccaaga

SEQ ID NO: 31771 - DNA, 25 bp, Mus musculus
gagaaggatggtcacaaagatccac

SEQ ID NO: 31772 - DNA, 25 bp, Mus musculus
gagaaggctggtgtctacaagctga

SEQ ID NO: 31773 - DNA, 25 bp, Mus musculus
gagaagggaccacagtttgacctaa

SEQ ID NO: 31774 - DNA, 25 bp, Mus musculus
gagaagggctttggctacaaaggct

SEQ ID NO: 31775 - DNA, 25 bp, Mus musculus
gagaagggtacactcggtttatcct

SEQ ID NO: 31776 - DNA, 25 bp, Mus musculus
gagaaggtctgctgtgccagcagca

SEQ ID NO: 31777 - DNA, 25 bp, Mus musculus
gagaaggtgccctactcatcactgc

SEQ ID NO: 31778 - DNA, 25 bp, Mus musculus
gagaagtactgactctttataaaaa

SEQ ID NO: 31779 - DNA, 25 bp, Mus musculus
gagaagtcccgggtgatcttccagc

SEQ ID NO: 31780 - DNA, 25 bp, Mus musculus
gagaagtcgcctttctatgtgtcct

SEQ ID NO: 31781 - DNA, 25 bp, Mus musculus
gagaagtctcccagcccgactgcag

SEQ ID NO: 31782 - DNA, 25 bp, Mus musculus
gagaagtctggtttcagcagcccct

SEQ ID NO: 31783 - DNA, 25 bp, Mus musculus
gagaagtgagcacaacttggtgaac

SEQ ID NO: 31784 - DNA, 25 bp, Mus musculus
gagaagtggcccagccatgctgaaa

SEQ ID NO: 31785 - DNA, 25 bp, Mus musculus
gagaagttatcagctggtgttttca

SEQ ID NO: 31786 - DNA, 25 bp, Mus musculus
gagaagttatcagtgccccggaagt

SEQ ID NO: 31787 - DNA, 25 bp, Mus musculus
gagaagttatctaccagcgaaaaag

SEQ ID NO: 31788 - DNA, 25 bp, Mus musculus
gagaagttgatttggaccttggaaa

SEQ ID NO: 31789 - DNA, 25 bp, Mus musculus
gagaagttggcgatcaaggacctcc

SEQ ID NO: 31790 - DNA, 25 bp, Mus musculus
gagaagttgttggtccctggtccta

SEQ ID NO: 31791 - DNA, 25 bp, Mus musculus
gagaagtttgagatgcagcactcag

SEQ ID NO: 31792 - DNA, 25 bp, Mus musculus
gagaagtttgcagtggtcgtttgaa

SEQ ID NO: 31793 - DNA, 25 bp, Mus musculus
gagaataatgaacagtgtggtcacg

SEQ ID NO: 31794 - DNA, 25 bp, Mus musculus
gagaatacatgttcaccacagccgt

SEQ ID NO: 31795 - DNA, 25 bp, Mus musculus
gagaatactcggctgaagggaaaaa

SEQ ID NO: 31796 - DNA, 25 bp, Mus musculus
gagaatagaattcccgggcccttgc

SEQ ID NO: 31797 - DNA, 25 bp, Mus musculus
gagaatataaatattcaggaagaga

SEQ ID NO: 31798 - DNA, 25 bp, Mus musculus
gagaatatcaagcttcaaacctcgc

SEQ ID NO: 31799 - DNA, 25 bp, Mus musculus
gagaatatcatcattgctaagatgg

SEQ ID NO: 31800 - DNA, 25 bp, Mus musculus
gagaatatcctcaaccctctgcgaa

SEQ ID NO: 31801 - DNA, 25 bp, Mus musculus
gagaatcaacaaaactgtggccatc

SEQ ID NO: 31802 - DNA, 25 bp, Mus musculus
gagaatcatcagaagatcccgatgg

SEQ ID NO: 31803 - DNA, 25 bp, Mus musculus
gagaatcatgagctccgtcgaggac

SEQ ID NO: 31804 - DNA, 25 bp, Mus musculus
gagaatcccctggacttgctggatt

SEQ ID NO: 31805 - DNA, 25 bp, Mus musculus
gagaatccctgcagttgatcaagag

SEQ ID NO: 31806 - DNA, 25 bp, Mus musculus
gagaatccggcagggctgtcatagt

SEQ ID NO: 31807 - DNA, 25 bp, Mus musculus
gagaatcctcattgacactggtgag

SEQ ID NO: 31808 - DNA, 25 bp, Mus musculus
gagaatcgaaaccaagagctgagtc

SEQ ID NO: 31809 - DNA, 25 bp, Mus musculus
gagaatcgagtggagctcatcccga

SEQ ID NO: 31810 - DNA, 25 bp, Mus musculus
gagaatcttaccttcagtggctgag

SEQ ID NO: 31811 - DNA, 25 bp, Mus musculus
gagaatcttgactgggattggaatc

SEQ ID NO: 31812 - DNA, 25 bp, Mus musculus
gagaatgaagtgctccagtatgcag

SEQ ID NO: 31813 - DNA, 25 bp, Mus musculus
gagaatgacaagcttcagctggaag

SEQ ID NO: 31814 - DNA, 25 bp, Mus musculus
gagaatgaccacatcaacctgaaag

SEQ ID NO: 31815 - DNA, 25 bp, Mus musculus
gagaatgaccatcagctcagtggcg

SEQ ID NO: 31816 - DNA, 25 bp, Mus musculus
gagaatgagagcagaaaagtcttga

SEQ ID NO: 31817 - DNA, 25 bp, Mus musculus
gagaatgagatcaacctgacacaca

SEQ ID NO: 31818 - DNA, 25 bp, Mus musculus
gagaatgatccagctacacaacggg

SEQ ID NO: 31819 - DNA, 25 bp, Mus musculus
gagaatgatctctttggaccccatg

SEQ ID NO: 31820 - DNA, 25 bp, Mus musculus
gagaatgatgaaagtgattaccaca

SEQ ID NO: 31821 - DNA, 25 bp, Mus musculus
gagaatgcaaaatcggcatcatgcc

SEQ ID NO: 31822 - DNA, 25 bp, Mus musculus
gagaatgcccttcttctgcctcaaa

SEQ ID NO: 31823 - DNA, 25 bp, Mus musculus
gagaatgcctatgatctggaggcca

SEQ ID NO: 31824 - DNA, 25 bp, Mus musculus
gagaatgctcttcaggacagtgtcc

SEQ ID NO: 31825 - DNA, 25 bp, Mus musculus
gagaatggcacttgctttggattca

SEQ ID NO: 31826 - DNA, 25 bp, Mus musculus
gagaatggcttcacaggttggacag

SEQ ID NO: 31827 - DNA, 25 bp, Mus musculus
gagaatgggctactgcggactccac

SEQ ID NO: 31828 - DNA, 25 bp, Mus musculus
gagaatgtattcagagcaaccagat

SEQ ID NO: 31829 - DNA, 25 bp, Mus musculus
gagaatgtcaagattctgagctccc

SEQ ID NO: 31830 - DNA, 25 bp, Mus musculus
gagaatgttctcaagcctgcacagg

SEQ ID NO: 31831 - DNA, 25 bp, Mus musculus
gagaatgtttatcttcacaaggcgc

SEQ ID NO: 31832 - DNA, 25 bp, Mus musculus
gagaattactgagatttcaaaggcc

SEQ ID NO: 31833 - DNA, 25 bp, Mus musculus
gagaattccccgtattcccttccag

SEQ ID NO: 31834 - DNA, 25 bp, Mus musculus
gagaattctcaagcacagcccagag

SEQ ID NO: 31835 - DNA, 25 bp, Mus musculus
gagaattctgtgatcactctcttca

SEQ ID NO: 31836 - DNA, 25 bp, Mus musculus
gagaattgccagtgccctacttaac

SEQ ID NO: 31837 - DNA, 25 bp, Mus musculus
gagaattggcattcaatcctgcgca

SEQ ID NO: 31838 - DNA, 25 bp, Mus musculus
gagaattgtctgtccttgtcaatgg

SEQ ID NO: 31839 - DNA, 25 bp, Mus musculus
gagaatttgagaggtgggcccaaca

SEQ ID NO: 31840 - DNA, 25 bp, Mus musculus
gagaattttcgggatacgttgaaag

SEQ ID NO: 31841 - DNA, 25 bp, Mus musculus
gagacaaaagtttcactcagtcaaa

SEQ ID NO: 31842 - DNA, 25 bp, Mus musculus
gagacaaaattctaccctcccacag

SEQ ID NO: 31843 - DNA, 25 bp, Mus musculus
gagacaaacattttcaccatttgga

SEQ ID NO: 31844 - DNA, 25 bp, Mus musculus
gagacaaattcgtgctaacagctgc

SEQ ID NO: 31845 - DNA, 25 bp, Mus musculus
gagacaacagcttccggcttctgtt

SEQ ID NO: 31846 - DNA, 25 bp, Mus musculus
gagacaaccacagcaagttttgctg

SEQ ID NO: 31847 - DNA, 25 bp, Mus musculus
gagacaaccaccaaacatgaccaaa

SEQ ID NO: 31848 - DNA, 25 bp, Mus musculus
gagacaacgaagctcttgcgccacc

SEQ ID NO: 31849 - DNA, 25 bp, Mus musculus
gagacaactattccggaaggcctct

SEQ ID NO: 31850 - DNA, 25 bp, Mus musculus
gagacaactgtcatgactgatgccg

SEQ ID NO: 31851 - DNA, 25 bp, Mus musculus
gagacaaggctgataattcaaagtc

SEQ ID NO: 31852 - DNA, 25 bp, Mus musculus
gagacaagttcgaaacatttccaaa

SEQ ID NO: 31853 - DNA, 25 bp, Mus musculus
gagacaagtttcctaaaggctcgag

SEQ ID NO: 31854 - DNA, 25 bp, Mus musculus
gagacaatcgtcaccaagaatgggc

SEQ ID NO: 31855 - DNA, 25 bp, Mus musculus
gagacaatgtgtttgctgccatcaa

SEQ ID NO: 31856 - DNA, 25 bp, Mus musculus
gagacacagcagatcatccctgtgg

SEQ ID NO: 31857 - DNA, 25 bp, Mus musculus
gagacacagtctgtcctgcacgaag

SEQ ID NO: 31858 - DNA, 25 bp, Mus musculus
gagacacagtgaaaggctacttcct

SEQ ID NO: 31859 - DNA, 25 bp, Mus musculus
gagacacatacaatagagaccatat

SEQ ID NO: 31860 - DNA, 25 bp, Mus musculus
gagacacatacatcctattgtatag

SEQ ID NO: 31861 - DNA, 25 bp, Mus musculus
gagacacatgtggtaaagatagacc

SEQ ID NO: 31862 - DNA, 25 bp, Mus musculus
gagacaccgatgacccggaagaaga

SEQ ID NO: 31863 - DNA, 25 bp, Mus musculus
gagacacctggacttcctcgacatt

SEQ ID NO: 31864 - DNA, 25 bp, Mus musculus
gagacaccttcttgggacgtaactg

SEQ ID NO: 31865 - DNA, 25 bp, Mus musculus
gagacacgccgttgaagatgcaccc

SEQ ID NO: 31866 - DNA, 25 bp, Mus musculus
gagacactaaccagaagctacggct

SEQ ID NO: 31867 - DNA, 25 bp, Mus musculus
gagacactaaggatgtctgtagaca

SEQ ID NO: 31868 - DNA, 25 bp, Mus musculus
gagacactaaggttgtctgtagaca

SEQ ID NO: 31869 - DNA, 25 bp, Mus musculus
gagacactcatcaagaacttccata

SEQ ID NO: 31870 - DNA, 25 bp, Mus musculus
gagacactgcacagggcctctgagt

SEQ ID NO: 31871 - DNA, 25 bp, Mus musculus
gagacacttggatttcttggacatc

SEQ ID NO: 31872 - DNA, 25 bp, Mus musculus
gagacagaactacggagtcacattc

SEQ ID NO: 31873 - DNA, 25 bp, Mus musculus
gagacagaagtctggaccaggctga

SEQ ID NO: 31874 - DNA, 25 bp, Mus musculus
gagacagaccattaccctaagaagg

SEQ ID NO: 31875 - DNA, 25 bp, Mus musculus
gagacagacctttccacaccaaggc

SEQ ID NO: 31876 - DNA, 25 bp, Mus musculus
gagacagacgtctctcaactggaag

SEQ ID NO: 31877 - DNA, 25 bp, Mus musculus
gagacagactgaaacgaggcttgaa

SEQ ID NO: 31878 - DNA, 25 bp, Mus musculus
gagacagagaaatcaattccacgaa

SEQ ID NO: 31879 - DNA, 25 bp, Mus musculus
gagacagaggctttgctagttggca

SEQ ID NO: 31880 - DNA, 25 bp, Mus musculus
gagacagatttcctgttctcacacc

SEQ ID NO: 31881 - DNA, 25 bp, Mus musculus
gagacagcagtatgttgggaagatc

SEQ ID NO: 31882 - DNA, 25 bp, Mus musculus
gagacagcccagtaagtctacgtgg

SEQ ID NO: 31883 - DNA, 25 bp, Mus musculus
gagacagcctggactttcagccggg

SEQ ID NO: 31884 - DNA, 25 bp, Mus musculus
gagacagcggccagtactggcccag

SEQ ID NO: 31885 - DNA, 25 bp, Mus musculus
gagacaggacgatgtgctcatctcc

SEQ ID NO: 31886 - DNA, 25 bp, Mus musculus
gagacaggagtctggagtcagttca

SEQ ID NO: 31887 - DNA, 25 bp, Mus musculus
gagacaggtctcaccgggaggaaat

SEQ ID NO: 31888 - DNA, 25 bp, Mus musculus
gagacagtatctgatgtcagaacac

SEQ ID NO: 31889 - DNA, 25 bp, Mus musculus
gagacagtatgtctaacaagcactg

SEQ ID NO: 31890 - DNA, 25 bp, Mus musculus
gagacagtccagaactggattgagt

SEQ ID NO: 31891 - DNA, 25 bp, Mus musculus
gagacagtttaagtacaaccaactt

SEQ ID NO: 31892 - DNA, 25 bp, Mus musculus
gagacatactatgagaaaataaaat

SEQ ID NO: 31893 - DNA, 25 bp, Mus musculus
gagacatagtccctccaacttgctc

SEQ ID NO: 31894 - DNA, 25 bp, Mus musculus
gagacatatgaaaacccactgatga

SEQ ID NO: 31895 - DNA, 25 bp, Mus musculus
gagacatgaagtccgcgcatctgct

SEQ ID NO: 31896 - DNA, 25 bp, Mus musculus
gagacattcaagcttctatttctgg

SEQ ID NO: 31897 - DNA, 25 bp, Mus musculus
gagacattgagataccatggctgcc

SEQ ID NO: 31898 - DNA, 25 bp, Mus musculus
gagacattgtacatagctcccgtgt

SEQ ID NO: 31899 - DNA, 25 bp, Mus musculus
gagaccaaaagagcagcaaaagctg

SEQ ID NO: 31900 - DNA, 25 bp, Mus musculus
gagaccaaaggctgaagcccagacg

SEQ ID NO: 31901 - DNA, 25 bp, Mus musculus
gagaccaactaacaagttagacttg

SEQ ID NO: 31902 - DNA, 25 bp, Mus musculus
gagaccaactaagaagttagacttg

SEQ ID NO: 31903 - DNA, 25 bp, Mus musculus
gagaccaactatggcataccacagc

SEQ ID NO: 31904 - DNA, 25 bp, Mus musculus
gagaccaagtccctgtggttcctgg

SEQ ID NO: 31905 - DNA, 25 bp, Mus musculus
gagaccaagtggcagttctaccaga

SEQ ID NO: 31906 - DNA, 25 bp, Mus musculus
gagaccaatagacgccccagaggga

SEQ ID NO: 31907 - DNA, 25 bp, Mus musculus
gagaccacacagacactgctcattg

SEQ ID NO: 31908 - DNA, 25 bp, Mus musculus
gagaccaccagcacaactctgagat

SEQ ID NO: 31909 - DNA, 25 bp, Mus musculus
gagaccaccttataccagcgttata

SEQ ID NO: 31910 - DNA, 25 bp, Mus musculus
gagaccacgttgtcataataaacac

SEQ ID NO: 31911 - DNA, 25 bp, Mus musculus
gagaccactgcaatcattcaggcct

SEQ ID NO: 31912 - DNA, 25 bp, Mus musculus
gagaccagcagaaagtccttcagga

SEQ ID NO: 31913 - DNA, 25 bp, Mus musculus
gagaccatactgattcacttcatgt

SEQ ID NO: 31914 - DNA, 25 bp, Mus musculus
gagaccatagagttctaagaataaa

SEQ ID NO: 31915 - DNA, 25 bp, Mus musculus
gagaccatcactagccccaagaaga

SEQ ID NO: 31916 - DNA, 25 bp, Mus musculus
gagaccatctccagctaacaggtga

SEQ ID NO: 31917 - DNA, 25 bp, Mus musculus
gagaccatctggtacgtgcgtttcc

SEQ ID NO: 31918 - DNA, 25 bp, Mus musculus
gagaccatgaatggcagtctattag

SEQ ID NO: 31919 - DNA, 25 bp, Mus musculus
gagacccaaaactctttgcaggctg

SEQ ID NO: 31920 - DNA, 25 bp, Mus musculus
gagacccagaggtaacccatcagga

SEQ ID NO: 31921 - DNA, 25 bp, Mus musculus
gagacccagcggcagattctgtcac

SEQ ID NO: 31922 - DNA, 25 bp, Mus musculus
gagacccatttagaattacggcact

SEQ ID NO: 31923 - DNA, 25 bp, Mus musculus
gagacccggatcagtgaagtgcgtc

SEQ ID NO: 31924 - DNA, 25 bp, Mus musculus
gagacccggatctgtgaagtgcgtc

SEQ ID NO: 31925 - DNA, 25 bp, Mus musculus
gagaccctactatcgacgaaaacag

SEQ ID NO: 31926 - DNA, 25 bp, Mus musculus
gagaccctatgggtttctagtgggt

SEQ ID NO: 31927 - DNA, 25 bp, Mus musculus
gagaccctcatcaatgtgttccatg

SEQ ID NO: 31928 - DNA, 25 bp, Mus musculus
gagaccctgacgtacctcaatcaag

SEQ ID NO: 31929 - DNA, 25 bp, Mus musculus
gagaccctggttgcggtgtatagaa

SEQ ID NO: 31930 - DNA, 25 bp, Mus musculus
gagaccgagaactcttgcagtcgtt

SEQ ID NO: 31931 - DNA, 25 bp, Mus musculus
gagaccgctgtgaccttacgtaaaa

SEQ ID NO: 31932 - DNA, 25 bp, Mus musculus
gagaccgctgtgtccttacgtaaaa

SEQ ID NO: 31933 - DNA, 25 bp, Mus musculus
gagaccgtttttaagatcagtccag

SEQ ID NO: 31934 - DNA, 25 bp, Mus musculus
gagacctcaccaacaggctgggagt

SEQ ID NO: 31935 - DNA, 25 bp, Mus musculus
gagacctcaccatcaggctgggagt

SEQ ID NO: 31936 - DNA, 25 bp, Mus musculus
gagacctcatgtccttcctggtggc

SEQ ID NO: 31937 - DNA, 25 bp, Mus musculus
gagacctcggttatgcacaagccgg

SEQ ID NO: 31938 - DNA, 25 bp, Mus musculus
gagacctcggttttgcacaagccgg

SEQ ID NO: 31939 - DNA, 25 bp, Mus musculus
gagacctgaagccagaaaacatcgt

SEQ ID NO: 31940 - DNA, 25 bp, Mus musculus
gagacctgcagggtcctatttgact

SEQ ID NO: 31941 - DNA, 25 bp, Mus musculus
gagacctgggagaccatcactgtca

SEQ ID NO: 31942 - DNA, 25 bp, Mus musculus
gagacctggtctggttatgccctca

SEQ ID NO: 31943 - DNA, 25 bp, Mus musculus
gagacctgtcacttctgaggaactc

SEQ ID NO: 31944 - DNA, 25 bp, Mus musculus
gagacctgtgaaactccagaaccca

SEQ ID NO: 31945 - DNA, 25 bp, Mus musculus
gagacctgtgaatctccagaaccca

SEQ ID NO: 31946 - DNA, 25 bp, Mus musculus
gagaccttcaacttcacccttcaca

SEQ ID NO: 31947 - DNA, 25 bp, Mus musculus
gagaccttcaccttccactctgata

SEQ ID NO: 31948 - DNA, 25 bp, Mus musculus
gagaccttcgagcatctttctgaaa

SEQ ID NO: 31949 - DNA, 25 bp, Mus musculus
gagaccttcgaggtgaaagggacat

SEQ ID NO: 31950 - DNA, 25 bp, Mus musculus
gagacctttaaacccaattgcaggg

SEQ ID NO: 31951 - DNA, 25 bp, Mus musculus
gagacctttaaagccaattgcaggg

SEQ ID NO: 31952 - DNA, 25 bp, Mus musculus
gagacctttctgctgcagcgtccca

SEQ ID NO: 31953 - DNA, 25 bp, Mus musculus
gagacgagtactccagattgctgtc

SEQ ID NO: 31954 - DNA, 25 bp, Mus musculus
gagacgatggaatatttgatgacaa

SEQ ID NO: 31955 - DNA, 25 bp, Mus musculus
gagacgcaggttccctcgtcaacct

SEQ ID NO: 31956 - DNA, 25 bp, Mus musculus
gagacgcatcatcacccgtaagcat

SEQ ID NO: 31957 - DNA, 25 bp, Mus musculus
gagacgcctgcagaagaacagccta

SEQ ID NO: 31958 - DNA, 25 bp, Mus musculus
gagacgctgcattttccattcttgg

SEQ ID NO: 31959 - DNA, 25 bp, Mus musculus
gagacgctgtcgtttatccgagaca

SEQ ID NO: 31960 - DNA, 25 bp, Mus musculus
gagacggagtcgcatatctaccgag

SEQ ID NO: 31961 - DNA, 25 bp, Mus musculus
gagacggccatgacagagcatcaga

SEQ ID NO: 31962 - DNA, 25 bp, Mus musculus
gagacggccatgatcttcgctggtg

SEQ ID NO: 31963 - DNA, 25 bp, Mus musculus
gagacggttatggaaagaaagtctt

SEQ ID NO: 31964 - DNA, 25 bp, Mus musculus
gagacgtaagtcctccaaagacacg

SEQ ID NO: 31965 - DNA, 25 bp, Mus musculus
gagacgtcatcatgtggcactaaca

SEQ ID NO: 31966 - DNA, 25 bp, Mus musculus
gagacgtcggagatgcgctctgccc

SEQ ID NO: 31967 - DNA, 25 bp, Mus musculus
gagacgttaatgaaagatgatgaga

SEQ ID NO: 31968 - DNA, 25 bp, Mus musculus
gagacgtttgccctgaacatgcaac

SEQ ID NO: 31969 - DNA, 25 bp, Mus musculus
gagactaactaccatttacaaagag

SEQ ID NO: 31970 - DNA, 25 bp, Mus musculus
gagactagatggtgaaaacatttat

SEQ ID NO: 31971 - DNA, 25 bp, Mus musculus
gagactagcaaggataaggtgccag

SEQ ID NO: 31972 - DNA, 25 bp, Mus musculus
gagactatacatatgtggagagagt

SEQ ID NO: 31973 - DNA, 25 bp, Mus musculus
gagactatactacattgaactaaag

SEQ ID NO: 31974 - DNA, 25 bp, Mus musculus
gagactatgaaagactgctcagcac

SEQ ID NO: 31975 - DNA, 25 bp, Mus musculus
gagactcaatgcttaagtacccaga

SEQ ID NO: 31976 - DNA, 25 bp, Mus musculus
gagactcacagctacccagcatgta

SEQ ID NO: 31977 - DNA, 25 bp, Mus musculus
gagactcattttaatcctgaacagg

SEQ ID NO: 31978 - DNA, 25 bp, Mus musculus
gagactccactgaaaccaaggtatg

SEQ ID NO: 31979 - DNA, 25 bp, Mus musculus
gagactccagttggttttctgaaca

SEQ ID NO: 31980 - DNA, 25 bp, Mus musculus
gagactccctctgtgaatgtaattc

SEQ ID NO: 31981 - DNA, 25 bp, Mus musculus
gagactcctcacctttatgggaatg

SEQ ID NO: 31982 - DNA, 25 bp, Mus musculus
gagactcctgcagaatccgaaagtc

SEQ ID NO: 31983 - DNA, 25 bp, Mus musculus
gagactcgtgtgcactgacttcaag

SEQ ID NO: 31984 - DNA, 25 bp, Mus musculus
gagactctcactgcctataatctgc

SEQ ID NO: 31985 - DNA, 25 bp, Mus musculus
gagactctcttcgtgcaccgattct

SEQ ID NO: 31986 - DNA, 25 bp, Mus musculus
gagactctgagcatcatccctgggt

SEQ ID NO: 31987 - DNA, 25 bp, Mus musculus
gagactgagcctgcgacgatggcct

SEQ ID NO: 31988 - DNA, 25 bp, Mus musculus
gagactgaggctaaggagccttgca

SEQ ID NO: 31989 - DNA, 25 bp, Mus musculus
gagactgcatgtaagctcgctcgtc

SEQ ID NO: 31990 - DNA, 25 bp, Mus musculus
gagactgcattgctgtcttggaaag

SEQ ID NO: 31991 - DNA, 25 bp, Mus musculus
gagactgcctcaccaagtggaacaa

SEQ ID NO: 31992 - DNA, 25 bp, Mus musculus
gagactgccttgtgtggaagactat

SEQ ID NO: 31993 - DNA, 25 bp, Mus musculus
gagactgctcctggtatgatacatc

SEQ ID NO: 31994 - DNA, 25 bp, Mus musculus
gagactgctggcacagaataaacag

SEQ ID NO: 31995 - DNA, 25 bp, Mus musculus
gagactgctggctcagaataaacag

SEQ ID NO: 31996 - DNA, 25 bp, Mus musculus
gagactggagaatcccctggacttg

SEQ ID NO: 31997 - DNA, 25 bp, Mus musculus
gagactgtcgttcgccgatgcccat

SEQ ID NO: 31998 - DNA, 25 bp, Mus musculus
gagacttacctgaagattgcaaggc

SEQ ID NO: 31999 - DNA, 25 bp, Mus musculus
gagacttattctgaaatccggtcct

SEQ ID NO: 32000 - DNA, 25 bp, Mus musculus
gagacttctgcatccaagttggcag

SEQ ID NO: 32001 - DNA, 25 bp, Mus musculus
gagacttcttgccatggctgccgta

SEQ ID NO: 32002 - DNA, 25 bp, Mus musculus
gagacttgactttaagagactcctg

SEQ ID NO: 32003 - DNA, 25 bp, Mus musculus
gagacttgctcagtatctctgatgg

SEQ ID NO: 32004 - DNA, 25 bp, Mus musculus
gagacttggaagctacttaatacgg

SEQ ID NO: 32005 - DNA, 25 bp, Mus musculus
gagacttggtctccaagaaaggaaa

SEQ ID NO: 32006 - DNA, 25 bp, Mus musculus
gagactttaaaagcaaaactctgct

SEQ ID NO: 32007 - DNA, 25 bp, Mus musculus
gagactttagaagagactaactacc

SEQ ID NO: 32008 - DNA, 25 bp, Mus musculus
gagactttagacattctttgttaca

SEQ ID NO: 32009 - DNA, 25 bp, Mus musculus
gagactttagactaagccaccaagg

SEQ ID NO: 32010 - DNA, 25 bp, Mus musculus
gagactttatcttgtaaagccagga

SEQ ID NO: 32011 - DNA, 25 bp, Mus musculus
gagacttttcccatctctagtgtcc

SEQ ID NO: 32012 - DNA, 25 bp, Mus musculus
gagacttttcccttctctagtgtcc

SEQ ID NO: 32013 - DNA, 25 bp, Mus musculus
gagagaaaacacaagctatgatgta

SEQ ID NO: 32014 - DNA, 25 bp, Mus musculus
gagagaaacaacaaaggctgggctt

SEQ ID NO: 32015 - DNA, 25 bp, Mus musculus
gagagaaagacaagcttataccagg

SEQ ID NO: 32016 - DNA, 25 bp, Mus musculus
gagagaaagacatgcttataccagg

SEQ ID NO: 32017 - DNA, 25 bp, Mus musculus
gagagaaaggacagactatgtcctc

SEQ ID NO: 32018 - DNA, 25 bp, Mus musculus
gagagaaatttggtgtatcctgctg

SEQ ID NO: 32019 - DNA, 25 bp, Mus musculus
gagagaaccccagaggaaagcatcg

SEQ ID NO: 32020 - DNA, 25 bp, Mus musculus
gagagaactccagaaagtgaagaag

SEQ ID NO: 32021 - DNA, 25 bp, Mus musculus
gagagaagagaattccctgagactc

SEQ ID NO: 32022 - DNA, 25 bp, Mus musculus
gagagaagcatttccagaaagaaga

SEQ ID NO: 32023 - DNA, 25 bp, Mus musculus
gagagaaggagatcacggcttcccc

SEQ ID NO: 32024 - DNA, 25 bp, Mus musculus
gagagaagtggatgtcactgtagaa

SEQ ID NO: 32025 - DNA, 25 bp, Mus musculus
gagagaagttaccatagctgctcaa

SEQ ID NO: 32026 - DNA, 25 bp, Mus musculus
gagagacaaaaccagatcaaatgca

SEQ ID NO: 32027 - DNA, 25 bp, Mus musculus
gagagacaacttgacaccaaataac

SEQ ID NO: 32028 - DNA, 25 bp, Mus musculus
gagagacactctggcaactttcctg

SEQ ID NO: 32029 - DNA, 25 bp, Mus musculus
gagagacagactggaagcttcggct

SEQ ID NO: 32030 - DNA, 25 bp, Mus musculus
gagagaccagcagaaagtccttcag

SEQ ID NO: 32031 - DNA, 25 bp, Mus musculus
gagagaccccgaaacatacggaact

SEQ ID NO: 32032 - DNA, 25 bp, Mus musculus
gagagaccttgcagaaattcttgca

SEQ ID NO: 32033 - DNA, 25 bp, Mus musculus
gagagacgcaaagaatacataaggg

SEQ ID NO: 32034 - DNA, 25 bp, Mus musculus
gagagactagatggtgaaaacattt

SEQ ID NO: 32035 - DNA, 25 bp, Mus musculus
gagagactccaatcaacaatatcaa

SEQ ID NO: 32036 - DNA, 25 bp, Mus musculus
gagagactgaccaagaaactggtgc

SEQ ID NO: 32037 - DNA, 25 bp, Mus musculus
gagagactgcatgtaagctcgctcg

SEQ ID NO: 32038 - DNA, 25 bp, Mus musculus
gagagactgtgagctgcttctgcag

SEQ ID NO: 32039 - DNA, 25 bp, Mus musculus
gagagacttctgaaacagctttgcg

SEQ ID NO: 32040 - DNA, 25 bp, Mus musculus
gagagacttctgtaacagctttgcg

SEQ ID NO: 32041 - DNA, 25 bp, Mus musculus
gagagagaagactgtaataatggcg

SEQ ID NO: 32042 - DNA, 25 bp, Mus musculus
gagagagaatcaatgcttacaagct

SEQ ID NO: 32043 - DNA, 25 bp, Mus musculus
gagagagactgctcctggcatcgtt

SEQ ID NO: 32044 - DNA, 25 bp, Mus musculus
gagagagagaaggttcagaactcac

SEQ ID NO: 32045 - DNA, 25 bp, Mus musculus
gagagagagggctgcttggcattct

SEQ ID NO: 32046 - DNA, 25 bp, Mus musculus
gagagagatgacaccgagttccagc

SEQ ID NO: 32047 - DNA, 25 bp, Mus musculus
gagagagatgctatatcatggtatc

SEQ ID NO: 32048 - DNA, 25 bp, Mus musculus
gagagagcaaagtcctactccagca

SEQ ID NO: 32049 - DNA, 25 bp, Mus musculus
gagagagcaccacctgacctgagat

SEQ ID NO: 32050 - DNA, 25 bp, Mus musculus
gagagagcacggtacctgcagacaa

SEQ ID NO: 32051 - DNA, 25 bp, Mus musculus
gagagagctatccagattggtgtta

SEQ ID NO: 32052 - DNA, 25 bp, Mus musculus
gagagagctcccgacaagcaggccg

SEQ ID NO: 32053 - DNA, 25 bp, Mus musculus
gagagaggctcattttccctgtaca

SEQ ID NO: 32054 - DNA, 25 bp, Mus musculus
gagagaggtcctatcaaaaccaaac

SEQ ID NO: 32055 - DNA, 25 bp, Mus musculus
gagagagtgcccctactacactgac

SEQ ID NO: 32056 - DNA, 25 bp, Mus musculus
gagagagttcagcatggcccagtct

SEQ ID NO: 32057 - DNA, 25 bp, Mus musculus
gagagagttgtacgaaaagtcctgt

SEQ ID NO: 32058 - DNA, 25 bp, Mus musculus
gagagataagactgcgcccagaggc

SEQ ID NO: 32059 - DNA, 25 bp, Mus musculus
gagagatctgagcatgagcacttcc

SEQ ID NO: 32060 - DNA, 25 bp, Mus musculus
gagagatctgtaggcctttctgtcc

SEQ ID NO: 32061 - DNA, 25 bp, Mus musculus
gagagatgctatatcatggtatcag

SEQ ID NO: 32062 - DNA, 25 bp, Mus musculus
gagagatggatgaacagatcagact

SEQ ID NO: 32063 - DNA, 25 bp, Mus musculus
gagagatggctgaggaccctgattc

SEQ ID NO: 32064 - DNA, 25 bp, Mus musculus
gagagatgggaattactatgcgtgc

SEQ ID NO: 32065 - DNA, 25 bp, Mus musculus
gagagatggtacattcatccttaaa

SEQ ID NO: 32066 - DNA, 25 bp, Mus musculus
gagagatgtctgatgaggagatcaa

SEQ ID NO: 32067 - DNA, 25 bp, Mus musculus
gagagatgtgactaagtcgccacag

SEQ ID NO: 32068 - DNA, 25 bp, Mus musculus
gagagatttcactaaggtgctgaag

SEQ ID NO: 32069 - DNA, 25 bp, Mus musculus
gagagcaaacatgcctcctgtacct

SEQ ID NO: 32070 - DNA, 25 bp, Mus musculus
gagagcaatgctgtgcatcaccatg

SEQ ID NO: 32071 - DNA, 25 bp, Mus musculus
gagagcacaacttcccttttcagtt

SEQ ID NO: 32072 - DNA, 25 bp, Mus musculus
gagagcacatcgctaaacgcagatg

SEQ ID NO: 32073 - DNA, 25 bp, Mus musculus
gagagcacggtcagaactattgcta

SEQ ID NO: 32074 - DNA, 25 bp, Mus musculus
gagagcagacacactaacaaccctc

SEQ ID NO: 32075 - DNA, 25 bp, Mus musculus
gagagcagactttaatcccagtggt

SEQ ID NO: 32076 - DNA, 25 bp, Mus musculus
gagagcagagacatcccaatctggg

SEQ ID NO: 32077 - DNA, 25 bp, Mus musculus
gagagcagaggagttatgttatacc

SEQ ID NO: 32078 - DNA, 25 bp, Mus musculus
gagagcagaggcaaccctgaatctc

SEQ ID NO: 32079 - DNA, 25 bp, Mus musculus
gagagcagaggctaccctgaatctc

SEQ ID NO: 32080 - DNA, 25 bp, Mus musculus
gagagcagcaattcatctacaggct

SEQ ID NO: 32081 - DNA, 25 bp, Mus musculus
gagagcagcatgtcaagggtcacca

SEQ ID NO: 32082 - DNA, 25 bp, Mus musculus
gagagcagccaagatgaacgattcc

SEQ ID NO: 32083 - DNA, 25 bp, Mus musculus
gagagcagccgagggcttcaagggc

SEQ ID NO: 32084 - DNA, 25 bp, Mus musculus
gagagcagccggtatcagttccgca

SEQ ID NO: 32085 - DNA, 25 bp, Mus musculus
gagagcagcgttgttagcagacttc

SEQ ID NO: 32086 - DNA, 25 bp, Mus musculus
gagagcagctggtttgtaatcaacg

SEQ ID NO: 32087 - DNA, 25 bp, Mus musculus
gagagcaggaggtctctgacaatga

SEQ ID NO: 32088 - DNA, 25 bp, Mus musculus
gagagcaggatacaaagcagccata

SEQ ID NO: 32089 - DNA, 25 bp, Mus musculus
gagagcaggcttcattgttcctgac

SEQ ID NO: 32090 - DNA, 25 bp, Mus musculus
gagagcagtcggcagcagcttgctg

SEQ ID NO: 32091 - DNA, 25 bp, Mus musculus
gagagcagttcgacttcaacgctga

SEQ ID NO: 32092 - DNA, 25 bp, Mus musculus
gagagcatcaccttcctcaaggact

SEQ ID NO: 32093 - DNA, 25 bp, Mus musculus
gagagcatcatggacctggagaatg

SEQ ID NO: 32094 - DNA, 25 bp, Mus musculus
gagagcatggccgtgttccgctcag

SEQ ID NO: 32095 - DNA, 25 bp, Mus musculus
gagagcattgccgtggccaaatcct

SEQ ID NO: 32096 - DNA, 25 bp, Mus musculus
gagagcattggactccccaggactg

SEQ ID NO: 32097 - DNA, 25 bp, Mus musculus
gagagcattgggaacgctgtcctca

SEQ ID NO: 32098 - DNA, 25 bp, Mus musculus
gagagccaaccagagctgcttttca

SEQ ID NO: 32099 - DNA, 25 bp, Mus musculus
gagagccataagcagcatctagcca

SEQ ID NO: 32100 - DNA, 25 bp, Mus musculus
gagagccatccttccttttttccca

SEQ ID NO: 32101 - DNA, 25 bp, Mus musculus
gagagcccaagcctaatagacccaa

SEQ ID NO: 32102 - DNA, 25 bp, Mus musculus
gagagccctctgaaaggtctcaggt

SEQ ID NO: 32103 - DNA, 25 bp, Mus musculus
gagagccgctttcttcttcgccctt

SEQ ID NO: 32104 - DNA, 25 bp, Mus musculus
gagagccggacttacccttatccgg

SEQ ID NO: 32105 - DNA, 25 bp, Mus musculus
gagagccgtggtccggaacctcaaa

SEQ ID NO: 32106 - DNA, 25 bp, Mus musculus
gagagcctgaaggaaacctttgacc

SEQ ID NO: 32107 - DNA, 25 bp, Mus musculus
gagagcctggctccagtgaagaacc

SEQ ID NO: 32108 - DNA, 25 bp, Mus musculus
gagagcctgttcactgtcacaggaa

SEQ ID NO: 32109 - DNA, 25 bp, Mus musculus
gagagcgagcagcacagcaacagca

SEQ ID NO: 32110 - DNA, 25 bp, Mus musculus
gagagcgcttcactgtccacagaac

SEQ ID NO: 32111 - DNA, 25 bp, Mus musculus
gagagcgcttcagtgtccacagaac

SEQ ID NO: 32112 - DNA, 25 bp, Mus musculus
gagagcgcttctgttctgcagcaga

SEQ ID NO: 32113 - DNA, 25 bp, Mus musculus
gagagcggtcgcatctcattcctga

SEQ ID NO: 32114 - DNA, 25 bp, Mus musculus
gagagcgtgtaagtatgagaaccca

SEQ ID NO: 32115 - DNA, 25 bp, Mus musculus
gagagcgttctatgagtgaaaatgc

SEQ ID NO: 32116 - DNA, 25 bp, Mus musculus
gagagctagacaatcttcagaaact

SEQ ID NO: 32117 - DNA, 25 bp, Mus musculus
gagagctatccagattggtgttaaa

SEQ ID NO: 32118 - DNA, 25 bp, Mus musculus
gagagctcaagatcctggcccggga

SEQ ID NO: 32119 - DNA, 25 bp, Mus musculus
gagagctcacgggaatcctggagca

SEQ ID NO: 32120 - DNA, 25 bp, Mus musculus
gagagctgtttaaaactacagttcc

SEQ ID NO: 32121 - DNA, 25 bp, Mus musculus
gagagcttactacatctattctggg

SEQ ID NO: 32122 - DNA, 25 bp, Mus musculus
gagagcttactagatctattctggg

SEQ ID NO: 32123 - DNA, 25 bp, Mus musculus
gagagcttcaaacagcttccagcta

SEQ ID NO: 32124 - DNA, 25 bp, Mus musculus
gagagcttcaagaaacagtcgtttg

SEQ ID NO: 32125 - DNA, 25 bp, Mus musculus
gagagcttccagaactcaacggcaa

SEQ ID NO: 32126 - DNA, 25 bp, Mus musculus
gagagcttctcccttttctggatgc

SEQ ID NO: 32127 - DNA, 25 bp, Mus musculus
gagaggaaccctactactttgaaga

SEQ ID NO: 32128 - DNA, 25 bp, Mus musculus
gagaggaactcagaaccacagaaaa

SEQ ID NO: 32129 - DNA, 25 bp, Mus musculus
gagaggaccacggtggccaaaattc

SEQ ID NO: 32130 - DNA, 25 bp, Mus musculus
gagaggacccgggaagtctgattaa

SEQ ID NO: 32131 - DNA, 25 bp, Mus musculus
gagaggacgcctgtactgaaaagag

SEQ ID NO: 32132 - DNA, 25 bp, Mus musculus
gagaggactacagcagaggacacct

SEQ ID NO: 32133 - DNA, 25 bp, Mus musculus
gagaggacttgccacagacagaata

SEQ ID NO: 32134 - DNA, 25 bp, Mus musculus
gagaggagaagattcctcagagcca

SEQ ID NO: 32135 - DNA, 25 bp, Mus musculus
gagaggagatgcacacagtgtgttc

SEQ ID NO: 32136 - DNA, 25 bp, Mus musculus
gagaggatctaattctgcaagttgt

SEQ ID NO: 32137 - DNA, 25 bp, Mus musculus
gagaggatctctttgtagtcagtaa

SEQ ID NO: 32138 - DNA, 25 bp, Mus musculus
gagaggattttacgtcgcagaaagc

SEQ ID NO: 32139 - DNA, 25 bp, Mus musculus
gagaggatttttcatcaaacaatgt

SEQ ID NO: 32140 - DNA, 25 bp, Mus musculus
gagaggcaccgaatctactggcaag

SEQ ID NO: 32141 - DNA, 25 bp, Mus musculus
gagaggcactggtctggaccaaacc

SEQ ID NO: 32142 - DNA, 25 bp, Mus musculus
gagaggcagtccatcatcaatgctc

SEQ ID NO: 32143 - DNA, 25 bp, Mus musculus
gagaggcagtctattgcaagttcca

SEQ ID NO: 32144 - DNA, 25 bp, Mus musculus
gagaggccagaattacagctaagga

SEQ ID NO: 32145 - DNA, 25 bp, Mus musculus
gagaggccggtcttgctttgacacg

SEQ ID NO: 32146 - DNA, 25 bp, Mus musculus
gagaggcgtcttgtgacgattcccc

SEQ ID NO: 32147 - DNA, 25 bp, Mus musculus
gagaggctccttttggcattccttg

SEQ ID NO: 32148 - DNA, 25 bp, Mus musculus
gagaggctgcaacacacatatgtgg

SEQ ID NO: 32149 - DNA, 25 bp, Mus musculus
gagaggcttacttccgatgcatagt

SEQ ID NO: 32150 - DNA, 25 bp, Mus musculus
gagagggaaaatgaagagcaccact

SEQ ID NO: 32151 - DNA, 25 bp, Mus musculus
gagagggacgtcctcaggaaccaac

SEQ ID NO: 32152 - DNA, 25 bp, Mus musculus
gagagggatacaccttcactgtatc

SEQ ID NO: 32153 - DNA, 25 bp, Mus musculus
gagagggatcccattcagattttag

SEQ ID NO: 32154 - DNA, 25 bp, Mus musculus
gagagggccatctttacctgcccaa

SEQ ID NO: 32155 - DNA, 25 bp, Mus musculus
gagagggcgcgagtgctcaaactca

SEQ ID NO: 32156 - DNA, 25 bp, Mus musculus
gagagggttgagacaactgttgcaa

SEQ ID NO: 32157 - DNA, 25 bp, Mus musculus
gagaggtactacaagatcttccagt

SEQ ID NO: 32158 - DNA, 25 bp, Mus musculus
gagaggtactactagatcttccagt

SEQ ID NO: 32159 - DNA, 25 bp, Mus musculus
gagaggtactctctgtatgaggaca

SEQ ID NO: 32160 - DNA, 25 bp, Mus musculus
gagaggtcaaccttttctgagtcta

SEQ ID NO: 32161 - DNA, 25 bp, Mus musculus
gagaggtcctccctaatctactcaa

SEQ ID NO: 32162 - DNA, 25 bp, Mus musculus
gagaggtctcccaccttcgtgggat

SEQ ID NO: 32163 - DNA, 25 bp, Mus musculus
gagaggtctccctccttcgtgggat

SEQ ID NO: 32164 - DNA, 25 bp, Mus musculus
gagaggtggcttggtttcctacaac

SEQ ID NO: 32165 - DNA, 25 bp, Mus musculus
gagaggtggtcctgtccgctgaaaa

SEQ ID NO: 32166 - DNA, 25 bp, Mus musculus
gagaggtgtacccaccttccgtgga

SEQ ID NO: 32167 - DNA, 25 bp, Mus musculus
gagaggtgtaccgaccttccgtgga

SEQ ID NO: 32168 - DNA, 25 bp, Mus musculus
gagagtacagtgacttctcatactg

SEQ ID NO: 32169 - DNA, 25 bp, Mus musculus
gagagtacccttcgcatggatgaag

SEQ ID NO: 32170 - DNA, 25 bp, Mus musculus
gagagtacccttggcatggatgaag

SEQ ID NO: 32171 - DNA, 25 bp, Mus musculus
gagagtacctttatcagctccagga

SEQ ID NO: 32172 - DNA, 25 bp, Mus musculus
gagagtactcccatagctgaaacta

SEQ ID NO: 32173 - DNA, 25 bp, Mus musculus
gagagtaggtcccaaactgcttgag

SEQ ID NO: 32174 - DNA, 25 bp, Mus musculus
gagagtagtacaacaaaacttctga

SEQ ID NO: 32175 - DNA, 25 bp, Mus musculus
gagagtagtttaggtgctccacgca

SEQ ID NO: 32176 - DNA, 25 bp, Mus musculus
gagagtcaaacagcggatggtaccc

SEQ ID NO: 32177 - DNA, 25 bp, Mus musculus
gagagtcaggcccacagagcacgcc

SEQ ID NO: 32178 - DNA, 25 bp, Mus musculus
gagagtcagtcgttgtctacacgga

SEQ ID NO: 32179 - DNA, 25 bp, Mus musculus
gagagtccgagttgccattcttcta

SEQ ID NO: 32180 - DNA, 25 bp, Mus musculus
gagagtcctaccacagtgaaactca

SEQ ID NO: 32181 - DNA, 25 bp, Mus musculus
gagagtcctgctgccggcagtatga

SEQ ID NO: 32182 - DNA, 25 bp, Mus musculus
gagagtcctgctgctgaagagcagc

SEQ ID NO: 32183 - DNA, 25 bp, Mus musculus
gagagtcctgtcactcctttgggcc

SEQ ID NO: 32184 - DNA, 25 bp, Mus musculus
gagagtctcaatatggacgtggtca

SEQ ID NO: 32185 - DNA, 25 bp, Mus musculus
gagagtctgaacctgaccttcagct

SEQ ID NO: 32186 - DNA, 25 bp, Mus musculus
gagagtctgcccagtgcttagtgtg

SEQ ID NO: 32187 - DNA, 25 bp, Mus musculus
gagagtctggcaaaagcaccattgt

SEQ ID NO: 32188 - DNA, 25 bp, Mus musculus
gagagtgaactttccatccggatag

SEQ ID NO: 32189 - DNA, 25 bp, Mus musculus
gagagtgagctgcattcatatctca

SEQ ID NO: 32190 - DNA, 25 bp, Mus musculus
gagagtgcagctattgttgatgcca

SEQ ID NO: 32191 - DNA, 25 bp, Mus musculus
gagagtgcggcccacgccattgtct

SEQ ID NO: 32192 - DNA, 25 bp, Mus musculus
gagagtggcacttacttaagaagga

SEQ ID NO: 32193 - DNA, 25 bp, Mus musculus
gagagtggcccaccacacatgaaga

SEQ ID NO: 32194 - DNA, 25 bp, Mus musculus
gagagtgggcccatgggcaatatca

SEQ ID NO: 32195 - DNA, 25 bp, Mus musculus
gagagtggtcgttataggcatttcc

SEQ ID NO: 32196 - DNA, 25 bp, Mus musculus
gagagtgtaaatcattgtcacctaa

SEQ ID NO: 32197 - DNA, 25 bp, Mus musculus
gagagtgtaacagagatgcctactt

SEQ ID NO: 32198 - DNA, 25 bp, Mus musculus
gagagtgttgcgcacagtccctctg

SEQ ID NO: 32199 - DNA, 25 bp, Mus musculus
gagagttcctccagtgaggatggca

SEQ ID NO: 32200 - DNA, 25 bp, Mus musculus
gagagttcggatacctctgcctgta

SEQ ID NO: 32201 - DNA, 25 bp, Mus musculus
gagagttgagccgttgcgcagtcct

SEQ ID NO: 32202 - DNA, 25 bp, Mus musculus
gagagttggacagccaatggtgtcc

SEQ ID NO: 32203 - DNA, 25 bp, Mus musculus
gagagttggctctgactcaagagac

SEQ ID NO: 32204 - DNA, 25 bp, Mus musculus
gagagttgtacgaaaagtcctgtat

SEQ ID NO: 32205 - DNA, 25 bp, Mus musculus
gagagtttcaatgatgccaaggaga

SEQ ID NO: 32206 - DNA, 25 bp, Mus musculus
gagataaacttcctactgaaacagg

SEQ ID NO: 32207 - DNA, 25 bp, Mus musculus
gagataaagttccttcaattaaggc

SEQ ID NO: 32208 - DNA, 25 bp, Mus musculus
gagataaatcctcccttcaatttgc

SEQ ID NO: 32209 - DNA, 25 bp, Mus musculus
gagataagcctcgaagcagccttgc

SEQ ID NO: 32210 - DNA, 25 bp, Mus musculus
gagataagctaaggatcctcccctg

SEQ ID NO: 32211 - DNA, 25 bp, Mus musculus
gagataagtcctctattgggcagct

SEQ ID NO: 32212 - DNA, 25 bp, Mus musculus
gagataatcggacattcacactgag

SEQ ID NO: 32213 - DNA, 25 bp, Mus musculus
gagataatcggagattcacactgag

SEQ ID NO: 32214 - DNA, 25 bp, Mus musculus
gagatacaagaagagccccagctca

SEQ ID NO: 32215 - DNA, 25 bp, Mus musculus
gagatacccctcactctggcggcga

SEQ ID NO: 32216 - DNA, 25 bp, Mus musculus
gagatacttccaggcagagtctacc

SEQ ID NO: 32217 - DNA, 25 bp, Mus musculus
gagatagaacttggaaacagccttg

SEQ ID NO: 32218 - DNA, 25 bp, Mus musculus
gagatagagcacctgcaggcttcaa

SEQ ID NO: 32219 - DNA, 25 bp, Mus musculus
gagatagagctacagtccctcttag

SEQ ID NO: 32220 - DNA, 25 bp, Mus musculus
gagatagatcagctacaagaggaga

SEQ ID NO: 32221 - DNA, 25 bp, Mus musculus
gagatagattcgctcaccagcatgt

SEQ ID NO: 32222 - DNA, 25 bp, Mus musculus
gagatagccatcaacgtcaaggcgc

SEQ ID NO: 32223 - DNA, 25 bp, Mus musculus
gagatagtgcccatcaacctcataa

SEQ ID NO: 32224 - DNA, 25 bp, Mus musculus
gagatataatcagtgtggagaagac

SEQ ID NO: 32225 - DNA, 25 bp, Mus musculus
gagatatccagtctctattccatga

SEQ ID NO: 32226 - DNA, 25 bp, Mus musculus
gagatatcttgtacatggaaatgca

SEQ ID NO: 32227 - DNA, 25 bp, Mus musculus
gagatatgcccggaaacagaaccga

SEQ ID NO: 32228 - DNA, 25 bp, Mus musculus
gagatatgtttgagatccttgtaaa

SEQ ID NO: 32229 - DNA, 25 bp, Mus musculus
gagatattctcctgctgattttaaa

SEQ ID NO: 32230 - DNA, 25 bp, Mus musculus
gagatcaaaaagagccggcgtcacc

SEQ ID NO: 32231 - DNA, 25 bp, Mus musculus
gagatcaaaaagcaccatgccagca

SEQ ID NO: 32232 - DNA, 25 bp, Mus musculus
gagatcaaaactgctcaaccaaaag

SEQ ID NO: 32233 - DNA, 25 bp, Mus musculus
gagatcaaaggtgacgtcctctatc

SEQ ID NO: 32234 - DNA, 25 bp, Mus musculus
gagatcaacctgtcttccaagagag

SEQ ID NO: 32235 - DNA, 25 bp, Mus musculus
gagatcaactttcagctgggaatag

SEQ ID NO: 32236 - DNA, 25 bp, Mus musculus
gagatcaagacacacattctgctgt

SEQ ID NO: 32237 - DNA, 25 bp, Mus musculus
gagatcaagatcgtgtctgccgtgc

SEQ ID NO: 32238 - DNA, 25 bp, Mus musculus
gagatcaattcttggagaacacaaa

SEQ ID NO: 32239 - DNA, 25 bp, Mus musculus
gagatcaccatcctggcagcagagc

SEQ ID NO: 32240 - DNA, 25 bp, Mus musculus
gagatcaccatcgtggcagcagagc

SEQ ID NO: 32241 - DNA, 25 bp, Mus musculus
gagatcacggattagtcaaccttag

SEQ ID NO: 32242 - DNA, 25 bp, Mus musculus
gagatcacgggcacttatgcgcaga

SEQ ID NO: 32243 - DNA, 25 bp, Mus musculus
gagatcactcgctattccttctaca

SEQ ID NO: 32244 - DNA, 25 bp, Mus musculus
gagatcagagtgaaccatgagccag

SEQ ID NO: 32245 - DNA, 25 bp, Mus musculus
gagatcagtaaggaacctgagccta

SEQ ID NO: 32246 - DNA, 25 bp, Mus musculus
gagatcagtcttctcacaccagctc

SEQ ID NO: 32247 - DNA, 25 bp, Mus musculus
gagatcagtcttgtcacaccagctc

SEQ ID NO: 32248 - DNA, 25 bp, Mus musculus
gagatcatcagtacctcatcccgga

SEQ ID NO: 32249 - DNA, 25 bp, Mus musculus
gagatcatcgagctgagacgcacag

SEQ ID NO: 32250 - DNA, 25 bp, Mus musculus
gagatcattcaggaagtccgagaag

SEQ ID NO: 32251 - DNA, 25 bp, Mus musculus
gagatccaagatggcagattcaatc

SEQ ID NO: 32252 - DNA, 25 bp, Mus musculus
gagatccaatctacaagatcaaagg

SEQ ID NO: 32253 - DNA, 25 bp, Mus musculus
gagatccaatcttcaagatcaaagg

SEQ ID NO: 32254 - DNA, 25 bp, Mus musculus
gagatccacagctagtgcgcatgtt

SEQ ID NO: 32255 - DNA, 25 bp, Mus musculus
gagatccagtctcacatgggacgcc

SEQ ID NO: 32256 - DNA, 25 bp, Mus musculus
gagatccatggattcctacctaaac

SEQ ID NO: 32257 - DNA, 25 bp, Mus musculus
gagatcccaagtaaacaacccgagc

SEQ ID NO: 32258 - DNA, 25 bp, Mus musculus
gagatcccacaccaagagtcaagag

SEQ ID NO: 32259 - DNA, 25 bp, Mus musculus
gagatcccatgcatcctggtggcca

SEQ ID NO: 32260 - DNA, 25 bp, Mus musculus
gagatcccatgtaaagaacggtgag

SEQ ID NO: 32261 - DNA, 25 bp, Mus musculus
gagatccctgacgacatgggatcaa

SEQ ID NO: 32262 - DNA, 25 bp, Mus musculus
gagatccctgattgttacaccttca

SEQ ID NO: 32263 - DNA, 25 bp, Mus musculus
gagatccgacagtacagattgaaaa

SEQ ID NO: 32264 - DNA, 25 bp, Mus musculus
gagatcctctccgaagaggaacaga

SEQ ID NO: 32265 - DNA, 25 bp, Mus musculus
gagatcctgacataaacccttgctt

SEQ ID NO: 32266 - DNA, 25 bp, Mus musculus
gagatcctggatggcaatgacgaga

SEQ ID NO: 32267 - DNA, 25 bp, Mus musculus
gagatccttctgtactggaaaatcg

SEQ ID NO: 32268 - DNA, 25 bp, Mus musculus
gagatccttgaagtgttgcacagtc

SEQ ID NO: 32269 - DNA, 25 bp, Mus musculus
gagatccttgttgtcatgcattgca

SEQ ID NO: 32270 - DNA, 25 bp, Mus musculus
gagatcgacctcaacgagtggctgg

SEQ ID NO: 32271 - DNA, 25 bp, Mus musculus
gagatcgactgcactgaagaagaga

SEQ ID NO: 32272 - DNA, 25 bp, Mus musculus
gagatcgccactcctacccattggt

SEQ ID NO: 32273 - DNA, 25 bp, Mus musculus
gagatcggatacagggacattcctt

SEQ ID NO: 32274 - DNA, 25 bp, Mus musculus
gagatcgggcgcatctccattgaga

SEQ ID NO: 32275 - DNA, 25 bp, Mus musculus
gagatcgtctccttcggcagcggct

SEQ ID NO: 32276 - DNA, 25 bp, Mus musculus
gagatctacaaaatcactgccactg

SEQ ID NO: 32277 - DNA, 25 bp, Mus musculus
gagatctaccgtaatggctccagtg

SEQ ID NO: 32278 - DNA, 25 bp, Mus musculus
gagatctactgtaatcgaattcgag

SEQ ID NO: 32279 - DNA, 25 bp, Mus musculus
gagatctcaggacccattcccatgg

SEQ ID NO: 32280 - DNA, 25 bp, Mus musculus
gagatctgccaacctgtgcgcctgg

SEQ ID NO: 32281 - DNA, 25 bp, Mus musculus
gagatctgctcgacaggacttggag

SEQ ID NO: 32282 - DNA, 25 bp, Mus musculus
gagatctgcttagctgagtgtgaca

SEQ ID NO: 32283 - DNA, 25 bp, Mus musculus
gagatcttcctgaccacgcctagga

SEQ ID NO: 32284 - DNA, 25 bp, Mus musculus
gagatcttctattctagaagtggac

SEQ ID NO: 32285 - DNA, 25 bp, Mus musculus
gagatcttgcctaactgggaaacca

SEQ ID NO: 32286 - DNA, 25 bp, Mus musculus
gagatgaacagattttgccagggag

SEQ ID NO: 32287 - DNA, 25 bp, Mus musculus
gagatgaacagcagctgaactcatg

SEQ ID NO: 32288 - DNA, 25 bp, Mus musculus
gagatgaaccgggaaaacccacagc

SEQ ID NO: 32289 - DNA, 25 bp, Mus musculus
gagatgaacttgagcacatagccca

SEQ ID NO: 32290 - DNA, 25 bp, Mus musculus
gagatgaagggtctcctcacactgg

SEQ ID NO: 32291 - DNA, 25 bp, Mus musculus
gagatgaatggctccctcaccagcc

SEQ ID NO: 32292 - DNA, 25 bp, Mus musculus
gagatgacactgaaatttggtccag

SEQ ID NO: 32293 - DNA, 25 bp, Mus musculus
gagatgacagtcctatctttgaaga

SEQ ID NO: 32294 - DNA, 25 bp, Mus musculus
gagatgaccaagtacaaaccagagt

SEQ ID NO: 32295 - DNA, 25 bp, Mus musculus
gagatgacctccatcttgcgaagtc

SEQ ID NO: 32296 - DNA, 25 bp, Mus musculus
gagatgacttgattgtgaccccgtt

SEQ ID NO: 32297 - DNA, 25 bp, Mus musculus
gagatgagataaatcctcccttcaa

SEQ ID NO: 32298 - DNA, 25 bp, Mus musculus
gagatgagccctacaagtgagcaga

SEQ ID NO: 32299 - DNA, 25 bp, Mus musculus
gagatgataaagaaagaagtagcca

SEQ ID NO: 32300 - DNA, 25 bp, Mus musculus
gagatgatataatgtccgtgaatcc

SEQ ID NO: 32301 - DNA, 25 bp, Mus musculus
gagatgatcagagctctggagcacg

SEQ ID NO: 32302 - DNA, 25 bp, Mus musculus
gagatgatgtttggctcagttgcaa

SEQ ID NO: 32303 - DNA, 25 bp, Mus musculus
gagatgatttctccgaattcattaa

SEQ ID NO: 32304 - DNA, 25 bp, Mus musculus
gagatgcaaaacgagattttaatcc

SEQ ID NO: 32305 - DNA, 25 bp, Mus musculus
gagatgcagatggagaaactaaccc

SEQ ID NO: 32306 - DNA, 25 bp, Mus musculus
gagatgccagcatcaatcccccaat

SEQ ID NO: 32307 - DNA, 25 bp, Mus musculus
gagatgcccatgaggccagataagg

SEQ ID NO: 32308 - DNA, 25 bp, Mus musculus
gagatgcctcctatggatccaaaag

SEQ ID NO: 32309 - DNA, 25 bp, Mus musculus
gagatgcctgacaacctctacacct

SEQ ID NO: 32310 - DNA, 25 bp, Mus musculus
gagatgctggaaacagacaccttca

SEQ ID NO: 32311 - DNA, 25 bp, Mus musculus
gagatgcttatatttcccaagaaaa

SEQ ID NO: 32312 - DNA, 25 bp, Mus musculus
gagatggacacttctgaggcaaagc

SEQ ID NO: 32313 - DNA, 25 bp, Mus musculus
gagatggagttctacatgaggacct

SEQ ID NO: 32314 - DNA, 25 bp, Mus musculus
gagatggatgaacagatcagactga

SEQ ID NO: 32315 - DNA, 25 bp, Mus musculus
gagatggcacccattgaggtgaaga

SEQ ID NO: 32316 - DNA, 25 bp, Mus musculus
gagatggcactcagaaacggcgttg

SEQ ID NO: 32317 - DNA, 25 bp, Mus musculus
gagatggcactggtagcagtatttg

SEQ ID NO: 32318 - DNA, 25 bp, Mus musculus
gagatggcccagaatgccgttcgcc

SEQ ID NO: 32319 - DNA, 25 bp, Mus musculus
gagatggcccgtctgttctatggac

SEQ ID NO: 32320 - DNA, 25 bp, Mus musculus
gagatggcgctgattctgaacaacc

SEQ ID NO: 32321 - DNA, 25 bp, Mus musculus
gagatggcggcccaagactttttcc

SEQ ID NO: 32322 - DNA, 25 bp, Mus musculus
gagatggctcctgcccagggtcaaa

SEQ ID NO: 32323 - DNA, 25 bp, Mus musculus
gagatggctgaggaccctgattcaa

SEQ ID NO: 32324 - DNA, 25 bp, Mus musculus
gagatggtgttcaagcggctgcacc

SEQ ID NO: 32325 - DNA, 25 bp, Mus musculus
gagatgtacatcctcaaaggcggct

SEQ ID NO: 32326 - DNA, 25 bp, Mus musculus
gagatgtcatcatgagggaattccg

SEQ ID NO: 32327 - DNA, 25 bp, Mus musculus
gagatgtgatgaatagcccctacca

SEQ ID NO: 32328 - DNA, 25 bp, Mus musculus
gagatgtgcaatattttatcaatgg

SEQ ID NO: 32329 - DNA, 25 bp, Mus musculus
gagatgtggaaacagaaggttttcc

SEQ ID NO: 32330 - DNA, 25 bp, Mus musculus
gagatgtggactcgtagccctatca

SEQ ID NO: 32331 - DNA, 25 bp, Mus musculus
gagatgtggccaaatcagttttgaa

SEQ ID NO: 32332 - DNA, 25 bp, Mus musculus
gagatgttcgtgcactctgcgaaga

SEQ ID NO: 32333 - DNA, 25 bp, Mus musculus
gagatgttgcttgacagatccgccc

SEQ ID NO: 32334 - DNA, 25 bp, Mus musculus
gagatgttgtgagcagtgtacctct

SEQ ID NO: 32335 - DNA, 25 bp, Mus musculus
gagatgtttcgaaatatgcagaacg

SEQ ID NO: 32336 - DNA, 25 bp, Mus musculus
gagattaaaagactgcttcagggag

SEQ ID NO: 32337 - DNA, 25 bp, Mus musculus
gagattaatggagaaacgctggtga

SEQ ID NO: 32338 - DNA, 25 bp, Mus musculus
gagattactccggaccgaagcatga

SEQ ID NO: 32339 - DNA, 25 bp, Mus musculus
gagattataggcactcatcaccctg

SEQ ID NO: 32340 - DNA, 25 bp, Mus musculus
gagattatggctcccatgtacccaa

SEQ ID NO: 32341 - DNA, 25 bp, Mus musculus
gagattatgtacaaactggaagtgc

SEQ ID NO: 32342 - DNA, 25 bp, Mus musculus
gagattccatcctgcgagtcctcag

SEQ ID NO: 32343 - DNA, 25 bp, Mus musculus
gagattcctgctgttactctgggca

SEQ ID NO: 32344 - DNA, 25 bp, Mus musculus
gagattctagacgtaccgcggagtg

SEQ ID NO: 32345 - DNA, 25 bp, Mus musculus
gagattctgatgaacagacctaatg

SEQ ID NO: 32346 - DNA, 25 bp, Mus musculus
gagattctgccttttcagtatgtgc

SEQ ID NO: 32347 - DNA, 25 bp, Mus musculus
gagattctggcagtgagcttgtcag

SEQ ID NO: 32348 - DNA, 25 bp, Mus musculus
gagattctgggaatcagtgaccatc

SEQ ID NO: 32349 - DNA, 25 bp, Mus musculus
gagattgagcagttcagcatagaga

SEQ ID NO: 32350 - DNA, 25 bp, Mus musculus
gagattgagttcaaggagacccaag

SEQ ID NO: 32351 - DNA, 25 bp, Mus musculus
gagattgatgttgcccttaatgatg

SEQ ID NO: 32352 - DNA, 25 bp, Mus musculus
gagattgcaaactatgaggcctgtc

SEQ ID NO: 32353 - DNA, 25 bp, Mus musculus
gagattgcagatgtgtttgcccaaa

SEQ ID NO: 32354 - DNA, 25 bp, Mus musculus
gagattgcctctacctttgatcacc

SEQ ID NO: 32355 - DNA, 25 bp, Mus musculus
gagattgctgcaaagcacaagagga

SEQ ID NO: 32356 - DNA, 25 bp, Mus musculus
gagattgggtcacacacatgtagtc

SEQ ID NO: 32357 - DNA, 25 bp, Mus musculus
gagattgtcacccttggatgctgga

SEQ ID NO: 32358 - DNA, 25 bp, Mus musculus
gagattgtgtctgaaccgtcctgct

SEQ ID NO: 32359 - DNA, 25 bp, Mus musculus
gagattgttcccgagcactgttatt

SEQ ID NO: 32360 - DNA, 25 bp, Mus musculus
gagattgttccctgcagtttgattg

SEQ ID NO: 32361 - DNA, 25 bp, Mus musculus
gagattgttgactttgccaaacagc

SEQ ID NO: 32362 - DNA, 25 bp, Mus musculus
gagattgttggttcacagggaagtc

SEQ ID NO: 32363 - DNA, 25 bp, Mus musculus
gagatttaactgtctcacagtctct

SEQ ID NO: 32364 - DNA, 25 bp, Mus musculus
gagatttacgactacctgcgtcaag

SEQ ID NO: 32365 - DNA, 25 bp, Mus musculus
gagatttagctttggccagcagcag

SEQ ID NO: 32366 - DNA, 25 bp, Mus musculus
gagatttcagaatggcgtttggtgc

SEQ ID NO: 32367 - DNA, 25 bp, Mus musculus
gagatttctttctgttgcctgccca

SEQ ID NO: 32368 - DNA, 25 bp, Mus musculus
gagatttcttttgacacaatgcagc

SEQ ID NO: 32369 - DNA, 25 bp, Mus musculus
gagattttaatccaagtgcctgaga

SEQ ID NO: 32370 - DNA, 25 bp, Mus musculus
gagattttgatctgggtggagctcc

SEQ ID NO: 32371 - DNA, 25 bp, Mus musculus
gagattttgtatgtgtcctgggcag

SEQ ID NO: 32372 - DNA, 25 bp, Mus musculus
gagattttgtcaagcaaggagccct

SEQ ID NO: 32373 - DNA, 25 bp, Mus musculus
gagattttgtcttatcacagttgtg

SEQ ID NO: 32374 - DNA, 25 bp, Mus musculus
gagcaaaaatgccttggcattcaag

SEQ ID NO: 32375 - DNA, 25 bp, Mus musculus
gagcaaaacaccactggcaggagga

SEQ ID NO: 32376 - DNA, 25 bp, Mus musculus
gagcaaaacacctctggcaggagga

SEQ ID NO: 32377 - DNA, 25 bp, Mus musculus
gagcaaaaccgacaagacataaagt

SEQ ID NO: 32378 - DNA, 25 bp, Mus musculus
gagcaaactggactgcaatgccaag

SEQ ID NO: 32379 - DNA, 25 bp, Mus musculus
gagcaaacttgtcctgaaaacccca

SEQ ID NO: 32380 - DNA, 25 bp, Mus musculus
gagcaaacttgtgctgaaaacccca

SEQ ID NO: 32381 - DNA, 25 bp, Mus musculus
gagcaaagaaatggtgacatagcca

SEQ ID NO: 32382 - DNA, 25 bp, Mus musculus
gagcaaagaggaaagcccctgagga

SEQ ID NO: 32383 - DNA, 25 bp, Mus musculus
gagcaaagctgagttccggtcggcc

SEQ ID NO: 32384 - DNA, 25 bp, Mus musculus
gagcaaagttggagacatgctggaa

SEQ ID NO: 32385 - DNA, 25 bp, Mus musculus
gagcaaatcaatgccttggcagatg

SEQ ID NO: 32386 - DNA, 25 bp, Mus musculus
gagcaacaagttcctcattgtacga

SEQ ID NO: 32387 - DNA, 25 bp, Mus musculus
gagcaacaccttcacagtcaaggcc

SEQ ID NO: 32388 - DNA, 25 bp, Mus musculus
gagcaacagggcaccggattccctg

SEQ ID NO: 32389 - DNA, 25 bp, Mus musculus
gagcaacataaacaactaacataag

SEQ ID NO: 32390 - DNA, 25 bp, Mus musculus
gagcaaccaacgtcacctatcaagc

SEQ ID NO: 32391 - DNA, 25 bp, Mus musculus
gagcaaccaactgcgacctggagct

SEQ ID NO: 32392 - DNA, 25 bp, Mus musculus
gagcaacccggccataagtgaagag

SEQ ID NO: 32393 - DNA, 25 bp, Mus musculus
gagcaacccttaccccagtgaagag

SEQ ID NO: 32394 - DNA, 25 bp, Mus musculus
gagcaacgccctcaacatgaacaag

SEQ ID NO: 32395 - DNA, 25 bp, Mus musculus
gagcaactaaagcagcacgtggagc

SEQ ID NO: 32396 - DNA, 25 bp, Mus musculus
gagcaactagaggtatttcaaagag

SEQ ID NO: 32397 - DNA, 25 bp, Mus musculus
gagcaactcctttatgggaatcaca

SEQ ID NO: 32398 - DNA, 25 bp, Mus musculus
gagcaactctctgaaacacctgcaa

SEQ ID NO: 32399 - DNA, 25 bp, Mus musculus
gagcaactggtggatggtttcctag

SEQ ID NO: 32400 - DNA, 25 bp, Mus musculus
gagcaactgttcatgcagatggcag

SEQ ID NO: 32401 - DNA, 25 bp, Mus musculus
gagcaactttgatcaccatcaccaa

SEQ ID NO: 32402 - DNA, 25 bp, Mus musculus
gagcaagaccgtgtttacgaggaac

SEQ ID NO: 32403 - DNA, 25 bp, Mus musculus
gagcaagagcagctctacctgcggt

SEQ ID NO: 32404 - DNA, 25 bp, Mus musculus
gagcaagagtagagtccagttctcc

SEQ ID NO: 32405 - DNA, 25 bp, Mus musculus
gagcaagatgctttcaagcgtttag

SEQ ID NO: 32406 - DNA, 25 bp, Mus musculus
gagcaagccattaagggagtatact

SEQ ID NO: 32407 - DNA, 25 bp, Mus musculus
gagcaagcgcaggaaaagtgtgaca

SEQ ID NO: 32408 - DNA, 25 bp, Mus musculus
gagcaagcgtaagacgtcagtgaag

SEQ ID NO: 32409 - DNA, 25 bp, Mus musculus
gagcaaggctctggctgcaaatcct

SEQ ID NO: 32410 - DNA, 25 bp, Mus musculus
gagcaagtccgtgccagcatttctt

SEQ ID NO: 32411 - DNA, 25 bp, Mus musculus
gagcaatacggccatttgactgtca

SEQ ID NO: 32412 - DNA, 25 bp, Mus musculus
gagcaatatggacaaacaggaactg

SEQ ID NO: 32413 - DNA, 25 bp, Mus musculus
gagcaatgctacagctggccatcct

SEQ ID NO: 32414 - DNA, 25 bp, Mus musculus
gagcaatgctactgctggccatcct

SEQ ID NO: 32415 - DNA, 25 bp, Mus musculus
gagcaattccgaactcatccctcat

SEQ ID NO: 32416 - DNA, 25 bp, Mus musculus
gagcaattcgacctctggtgtccac

SEQ ID NO: 32417 - DNA, 25 bp, Mus musculus
gagcacaacattgtggcaccgtata

SEQ ID NO: 32418 - DNA, 25 bp, Mus musculus
gagcacaacccaactcagtatgaag

SEQ ID NO: 32419 - DNA, 25 bp, Mus musculus
gagcacaacttggtgaacatccaga

SEQ ID NO: 32420 - DNA, 25 bp, Mus musculus
gagcacactgcttacctcatcaagg

SEQ ID NO: 32421 - DNA, 25 bp, Mus musculus
gagcacagatatcggaagttctttc

SEQ ID NO: 32422 - DNA, 25 bp, Mus musculus
gagcacagatatgggaagttctttc

SEQ ID NO: 32423 - DNA, 25 bp, Mus musculus
gagcacagatctcttagccaacagt

SEQ ID NO: 32424 - DNA, 25 bp, Mus musculus
gagcacagggtcttacctttgcttt

SEQ ID NO: 32425 - DNA, 25 bp, Mus musculus
gagcacatgcctagcctcaggctgg

SEQ ID NO: 32426 - DNA, 25 bp, Mus musculus
gagcaccgactacgtccctcgttag

SEQ ID NO: 32427 - DNA, 25 bp, Mus musculus
gagcaccgttgactggtcttcagga

SEQ ID NO: 32428 - DNA, 25 bp, Mus musculus
gagcacctcagtctctgtgagtata

SEQ ID NO: 32429 - DNA, 25 bp, Mus musculus
gagcacctcggagaacatgttcctg

SEQ ID NO: 32430 - DNA, 25 bp, Mus musculus
gagcacctgagctttcgaatagtca

SEQ ID NO: 32431 - DNA, 25 bp, Mus musculus
gagcacctgatggaagactatgaac

SEQ ID NO: 32432 - DNA, 25 bp, Mus musculus
gagcacctgcatagcaagctgtctg

SEQ ID NO: 32433 - DNA, 25 bp, Mus musculus
gagcacctggtggaaaatcaaatgg

SEQ ID NO: 32434 - DNA, 25 bp, Mus musculus
gagcacgacaagttcattgaaagcc

SEQ ID NO: 32435 - DNA, 25 bp, Mus musculus
gagcacgcgctgctcaatgacgcct

SEQ ID NO: 32436 - DNA, 25 bp, Mus musculus
gagcacggagggtcgattgtcaata

SEQ ID NO: 32437 - DNA, 25 bp, Mus musculus
gagcacgggtctggctaagagaaaa

SEQ ID NO: 32438 - DNA, 25 bp, Mus musculus
gagcacggtcagaactattgctatg

SEQ ID NO: 32439 - DNA, 25 bp, Mus musculus
gagcactactcggagacccatactt

SEQ ID NO: 32440 - DNA, 25 bp, Mus musculus
gagcactccagaactagccaacatg

SEQ ID NO: 32441 - DNA, 25 bp, Mus musculus
gagcactgactcctgtaggtgtcct

SEQ ID NO: 32442 - DNA, 25 bp, Mus musculus
gagcactgttgctggaattctgagc

SEQ ID NO: 32443 - DNA, 25 bp, Mus musculus
gagcacttcaggaaccactcgtaga

SEQ ID NO: 32444 - DNA, 25 bp, Mus musculus
gagcactttcactaccttttatgag

SEQ ID NO: 32445 - DNA, 25 bp, Mus musculus
gagcagaaacaatggacctcaagtt

SEQ ID NO: 32446 - DNA, 25 bp, Mus musculus
gagcagaaactatctccattcagca

SEQ ID NO: 32447 - DNA, 25 bp, Mus musculus
gagcagaaagaagacacctttgacg

SEQ ID NO: 32448 - DNA, 25 bp, Mus musculus
gagcagaagtgaggatgcaagcaac

SEQ ID NO: 32449 - DNA, 25 bp, Mus musculus
gagcagaattcgcttaagacaacaa

SEQ ID NO: 32450 - DNA, 25 bp, Mus musculus
gagcagacagatcttcaggtctccc

SEQ ID NO: 32451 - DNA, 25 bp, Mus musculus
gagcagacatgaaccgactcatcat

SEQ ID NO: 32452 - DNA, 25 bp, Mus musculus
gagcagacctttagtcccgctaagt

SEQ ID NO: 32453 - DNA, 25 bp, Mus musculus
gagcagactgtcttcccatcaactt

SEQ ID NO: 32454 - DNA, 25 bp, Mus musculus
gagcagactttaatcccagtggttt

SEQ ID NO: 32455 - DNA, 25 bp, Mus musculus
gagcagagaccaagttgcaggcctt

SEQ ID NO: 32456 - DNA, 25 bp, Mus musculus
gagcagagactatactacattgaac

SEQ ID NO: 32457 - DNA, 25 bp, Mus musculus
gagcagagcaagcagcaatccaatg

SEQ ID NO: 32458 - DNA, 25 bp, Mus musculus
gagcagagcagtagattggcaaaat

SEQ ID NO: 32459 - DNA, 25 bp, Mus musculus
gagcagagcccagtcatgactcagc

SEQ ID NO: 32460 - DNA, 25 bp, Mus musculus
gagcagagcccgaccctaaaaagaa

SEQ ID NO: 32461 - DNA, 25 bp, Mus musculus
gagcagagctctgcggataaagaga

SEQ ID NO: 32462 - DNA, 25 bp, Mus musculus
gagcagaggagttatgttatacctc

SEQ ID NO: 32463 - DNA, 25 bp, Mus musculus
gagcagagtgctacgctgtgaaccc

SEQ ID NO: 32464 - DNA, 25 bp, Mus musculus
gagcagagtgcttcgctgtgaaccc

SEQ ID NO: 32465 - DNA, 25 bp, Mus musculus
gagcagatccagagcactgtggact

SEQ ID NO: 32466 - DNA, 25 bp, Mus musculus
gagcagatgggcaagtttcacccag

SEQ ID NO: 32467 - DNA, 25 bp, Mus musculus
gagcagcaagaacagtttccactcc

SEQ ID NO: 32468 - DNA, 25 bp, Mus musculus
gagcagcactgccttcttatctatg

SEQ ID NO: 32469 - DNA, 25 bp, Mus musculus
gagcagcagcctatgctcttaaacg

SEQ ID NO: 32470 - DNA, 25 bp, Mus musculus
gagcagcagcgctcagccctggagc

SEQ ID NO: 32471 - DNA, 25 bp, Mus musculus
gagcagccaagatcctgcctttcga

SEQ ID NO: 32472 - DNA, 25 bp, Mus musculus
gagcagccatgagatctgaggccac

SEQ ID NO: 32473 - DNA, 25 bp, Mus musculus
gagcagcccaccgtctttatgcttt

SEQ ID NO: 32474 - DNA, 25 bp, Mus musculus
gagcagcctcagcagatttcccaga

SEQ ID NO: 32475 - DNA, 25 bp, Mus musculus
gagcagcctcaggagatttcccaga

SEQ ID NO: 32476 - DNA, 25 bp, Mus musculus
gagcagcctccatgaggccctggac

SEQ ID NO: 32477 - DNA, 25 bp, Mus musculus
gagcagcctcctgttcgtaaagctg

SEQ ID NO: 32478 - DNA, 25 bp, Mus musculus
gagcagcggaaagcacagaatgtct

SEQ ID NO: 32479 - DNA, 25 bp, Mus musculus
gagcagcgttaggaattcagaattt

SEQ ID NO: 32480 - DNA, 25 bp, Mus musculus
gagcagctcatcctcaccatgggtg

SEQ ID NO: 32481 - DNA, 25 bp, Mus musculus
gagcagctgactatgaattctgagc

SEQ ID NO: 32482 - DNA, 25 bp, Mus musculus
gagcagctgggcaggatttcgtact

SEQ ID NO: 32483 - DNA, 25 bp, Mus musculus
gagcagcttaggaggctgccacccc

SEQ ID NO: 32484 - DNA, 25 bp, Mus musculus
gagcaggaaccgacctggatacggc

SEQ ID NO: 32485 - DNA, 25 bp, Mus musculus
gagcaggaaccgtcctggatacggc

SEQ ID NO: 32486 - DNA, 25 bp, Mus musculus
gagcaggaactgattgagcgatttg

SEQ ID NO: 32487 - DNA, 25 bp, Mus musculus
gagcaggaacttcgtgcagtatgcc

SEQ ID NO: 32488 - DNA, 25 bp, Mus musculus
gagcaggaagacatacctgtacttc

SEQ ID NO: 32489 - DNA, 25 bp, Mus musculus
gagcaggagtcccagccaactccag

SEQ ID NO: 32490 - DNA, 25 bp, Mus musculus
gagcaggatattgagaccctacatg

SEQ ID NO: 32491 - DNA, 25 bp, Mus musculus
gagcaggatctgttagaaaagagga

SEQ ID NO: 32492 - DNA, 25 bp, Mus musculus
gagcaggcagtgtgtacttggtact

SEQ ID NO: 32493 - DNA, 25 bp, Mus musculus
gagcaggcctcaaatccgatagagc

SEQ ID NO: 32494 - DNA, 25 bp, Mus musculus
gagcaggcgctgagcatcctcacca

SEQ ID NO: 32495 - DNA, 25 bp, Mus musculus
gagcagggcagacagctttactttt

SEQ ID NO: 32496 - DNA, 25 bp, Mus musculus
gagcagggtcccatctggacgtttc

SEQ ID NO: 32497 - DNA, 25 bp, Mus musculus
gagcaggtggctcgagaatcttacc

SEQ ID NO: 32498 - DNA, 25 bp, Mus musculus
gagcaggtgtgttacggtgcccata

SEQ ID NO: 32499 - DNA, 25 bp, Mus musculus
gagcagtaccacacactgggaggga

SEQ ID NO: 32500 - DNA, 25 bp, Mus musculus
gagcagtagattggcaaaatatagg

SEQ ID NO: 32501 - DNA, 25 bp, Mus musculus
gagcagtaggccaggaagtagcata

SEQ ID NO: 32502 - DNA, 25 bp, Mus musculus
gagcagtcaggttcacaagaaaagc

SEQ ID NO: 32503 - DNA, 25 bp, Mus musculus
gagcagtcgaaatggtcctgagaaa

SEQ ID NO: 32504 - DNA, 25 bp, Mus musculus
gagcagtctggctggtggtttaaca

SEQ ID NO: 32505 - DNA, 25 bp, Mus musculus
gagcagtgaggccagctctctctga

SEQ ID NO: 32506 - DNA, 25 bp, Mus musculus
gagcagtgaggctattgctaccctg

SEQ ID NO: 32507 - DNA, 25 bp, Mus musculus
gagcagtgctactacatctttggcg

SEQ ID NO: 32508 - DNA, 25 bp, Mus musculus
gagcagtgtacgttctgtttcacgg

SEQ ID NO: 32509 - DNA, 25 bp, Mus musculus
gagcagtgtagctggcgtgtcaaaa

SEQ ID NO: 32510 - DNA, 25 bp, Mus musculus
gagcagttgaccttccgcgacgtgg

SEQ ID NO: 32511 - DNA, 25 bp, Mus musculus
gagcagttgccagattgcctcaaag

SEQ ID NO: 32512 - DNA, 25 bp, Mus musculus
gagcagttgtgcagccaagccaagg

SEQ ID NO: 32513 - DNA, 25 bp, Mus musculus
gagcataagattgtcatagctgatg

SEQ ID NO: 32514 - DNA, 25 bp, Mus musculus
gagcataatttgttgtcagcaagca

SEQ ID NO: 32515 - DNA, 25 bp, Mus musculus
gagcatacaatatcctcattggtga

SEQ ID NO: 32516 - DNA, 25 bp, Mus musculus
gagcatactgccagatcaaggtctt

SEQ ID NO: 32517 - DNA, 25 bp, Mus musculus
gagcatatgatcagcagatatggga

SEQ ID NO: 32518 - DNA, 25 bp, Mus musculus
gagcatcagacaaacggatagcttg

SEQ ID NO: 32519 - DNA, 25 bp, Mus musculus
gagcatcatccctgggttacccctg

SEQ ID NO: 32520 - DNA, 25 bp, Mus musculus
gagcatcccaatatcgtaaccttct

SEQ ID NO: 32521 - DNA, 25 bp, Mus musculus
gagcatccccaaatggctccatgag

SEQ ID NO: 32522 - DNA, 25 bp, Mus musculus
gagcatcccttatcagagccttggg

SEQ ID NO: 32523 - DNA, 25 bp, Mus musculus
gagcatcctgccttgataaacttgg

SEQ ID NO: 32524 - DNA, 25 bp, Mus musculus
gagcatcctggagaataatcagcag

SEQ ID NO: 32525 - DNA, 25 bp, Mus musculus
gagcatcgtcaggtctgcagatgaa

SEQ ID NO: 32526 - DNA, 25 bp, Mus musculus
gagcatctatagaccagaagcttga

SEQ ID NO: 32527 - DNA, 25 bp, Mus musculus
gagcatctatctcaacggtctgaca

SEQ ID NO: 32528 - DNA, 25 bp, Mus musculus
gagcatctatctgaacggtctgaca

SEQ ID NO: 32529 - DNA, 25 bp, Mus musculus
gagcatctcagctggttacatgaaa

SEQ ID NO: 32530 - DNA, 25 bp, Mus musculus
gagcatctcgagcaactaaagcagc

SEQ ID NO: 32531 - DNA, 25 bp, Mus musculus
gagcatctgcatctgcatttgtctc

SEQ ID NO: 32532 - DNA, 25 bp, Mus musculus
gagcatctgcatgtgcatttgtctc

SEQ ID NO: 32533 - DNA, 25 bp, Mus musculus
gagcatctgtacttggagaccactg

SEQ ID NO: 32534 - DNA, 25 bp, Mus musculus
gagcatcttcaatcgcttttttggt

SEQ ID NO: 32535 - DNA, 25 bp, Mus musculus
gagcatcttctctatttccagctgg

SEQ ID NO: 32536 - DNA, 25 bp, Mus musculus
gagcatcttgcttgccttggtagag

SEQ ID NO: 32537 - DNA, 25 bp, Mus musculus
gagcatctttatccataacaacaaa

SEQ ID NO: 32538 - DNA, 25 bp, Mus musculus
gagcatgatactgttcttctccgtg

SEQ ID NO: 32539 - DNA, 25 bp, Mus musculus
gagcatgcaaatgattccctagcac

SEQ ID NO: 32540 - DNA, 25 bp, Mus musculus
gagcatgcatgcttcctactaccac

SEQ ID NO: 32541 - DNA, 25 bp, Mus musculus
gagcatgcgaatcttgtcatcctgt

SEQ ID NO: 32542 - DNA, 25 bp, Mus musculus
gagcatgctcaacgtgttcctcaag

SEQ ID NO: 32543 - DNA, 25 bp, Mus musculus
gagcatgctgtatgagaagatcccc

SEQ ID NO: 32544 - DNA, 25 bp, Mus musculus
gagcatggctgccatgtcgtccgca

SEQ ID NO: 32545 - DNA, 25 bp, Mus musculus
gagcatgtgcgcactgagttgcctg

SEQ ID NO: 32546 - DNA, 25 bp, Mus musculus
gagcatgttacctttgaacacagag

SEQ ID NO: 32547 - DNA, 25 bp, Mus musculus
gagcatgttataggaattggcagca

SEQ ID NO: 32548 - DNA, 25 bp, Mus musculus
gagcattatcctgggaatacagctt

SEQ ID NO: 32549 - DNA, 25 bp, Mus musculus
gagcattcctggctcagccgtgctg

SEQ ID NO: 32550 - DNA, 25 bp, Mus musculus
gagcattcggtggatttactaaaac

SEQ ID NO: 32551 - DNA, 25 bp, Mus musculus
gagcattctggaagagttttccgcc

SEQ ID NO: 32552 - DNA, 25 bp, Mus musculus
gagcattgaccagcaacgcaataca

SEQ ID NO: 32553 - DNA, 25 bp, Mus musculus
gagcattgccgtggccaaatccttc

SEQ ID NO: 32554 - DNA, 25 bp, Mus musculus
gagcattggactccccaggactgga

SEQ ID NO: 32555 - DNA, 25 bp, Mus musculus
gagcattggcttactcacggttgta

SEQ ID NO: 32556 - DNA, 25 bp, Mus musculus
gagcattgtgctcctcacggcgagt

SEQ ID NO: 32557 - DNA, 25 bp, Mus musculus
gagcattgtgctgctcacggcgagt

SEQ ID NO: 32558 - DNA, 25 bp, Mus musculus
gagcatttataactctggttgcacg

SEQ ID NO: 32559 - DNA, 25 bp, Mus musculus
gagcattttggcactccagtcatag

SEQ ID NO: 32560 - DNA, 25 bp, Mus musculus
gagccaaaaatactgcacatctctg

SEQ ID NO: 32561 - DNA, 25 bp, Mus musculus
gagccaaaccgggtctctctttaag

SEQ ID NO: 32562 - DNA, 25 bp, Mus musculus
gagccaaactactcatcccacagag

SEQ ID NO: 32563 - DNA, 25 bp, Mus musculus
gagccaaactgcagtagctctgttg

SEQ ID NO: 32564 - DNA, 25 bp, Mus musculus
gagccaaagcggagtctcgcatccg

SEQ ID NO: 32565 - DNA, 25 bp, Mus musculus
gagccaaagtctgcctgatgtctcc

SEQ ID NO: 32566 - DNA, 25 bp, Mus musculus
gagccaaattagaggccaggttgag

SEQ ID NO: 32567 - DNA, 25 bp, Mus musculus
gagccaacaacatttgaagactttg

SEQ ID NO: 32568 - DNA, 25 bp, Mus musculus
gagccaagacgccagtcacactgaa

SEQ ID NO: 32569 - DNA, 25 bp, Mus musculus
gagccaagatactgcaaatacaact

SEQ ID NO: 32570 - DNA, 25 bp, Mus musculus
gagccaagctatggattatgtttcc

SEQ ID NO: 32571 - DNA, 25 bp, Mus musculus
gagccaagcttttatgacacagtga

SEQ ID NO: 32572 - DNA, 25 bp, Mus musculus
gagccaagtacctcatttgaaggga

SEQ ID NO: 32573 - DNA, 25 bp, Mus musculus
gagccaatccggttcaactcagttg

SEQ ID NO: 32574 - DNA, 25 bp, Mus musculus
gagccacaacaccagaactatggag

SEQ ID NO: 32575 - DNA, 25 bp, Mus musculus
gagccacagtgtgagcgctggaaat

SEQ ID NO: 32576 - DNA, 25 bp, Mus musculus
gagccaccaaaacataaacattacc

SEQ ID NO: 32577 - DNA, 25 bp, Mus musculus
gagccaccctttttggcaaattcag

SEQ ID NO: 32578 - DNA, 25 bp, Mus musculus
gagccaccgacagctgcatatctag

SEQ ID NO: 32579 - DNA, 25 bp, Mus musculus
gagccacctgggacattctcaacct

SEQ ID NO: 32580 - DNA, 25 bp, Mus musculus
gagccactgagcgtgccaaagggta

SEQ ID NO: 32581 - DNA, 25 bp, Mus musculus
gagccactggcgacagagataagcc

SEQ ID NO: 32582 - DNA, 25 bp, Mus musculus
gagccagaagagtgttgatgccctg

SEQ ID NO: 32583 - DNA, 25 bp, Mus musculus
gagccagaagccaaggcagaagtct

SEQ ID NO: 32584 - DNA, 25 bp, Mus musculus
gagccagaagcccacaaagaaagtc

SEQ ID NO: 32585 - DNA, 25 bp, Mus musculus
gagccagactctgacaatagtgctg

SEQ ID NO: 32586 - DNA, 25 bp, Mus musculus
gagccagactggaagtgcgtgtaca

SEQ ID NO: 32587 - DNA, 25 bp, Mus musculus
gagccagagccactttccaactctg

SEQ ID NO: 32588 - DNA, 25 bp, Mus musculus
gagccagcagctaaaaagccgccag

SEQ ID NO: 32589 - DNA, 25 bp, Mus musculus
gagccagcccctgattggaatccag

SEQ ID NO: 32590 - DNA, 25 bp, Mus musculus
gagccagcccgcatcatttgttggc

SEQ ID NO: 32591 - DNA, 25 bp, Mus musculus
gagccagccgttcgcattgcacatc

SEQ ID NO: 32592 - DNA, 25 bp, Mus musculus
gagccagccgttggcattgcacatc

SEQ ID NO: 32593 - DNA, 25 bp, Mus musculus
gagccagcggctccgtttatctgca

SEQ ID NO: 32594 - DNA, 25 bp, Mus musculus
gagccagctacccatactaatttat

SEQ ID NO: 32595 - DNA, 25 bp, Mus musculus
gagccagctaccgatactaatttat

SEQ ID NO: 32596 - DNA, 25 bp, Mus musculus
gagccaggaaggagcagaaattgtt

SEQ ID NO: 32597 - DNA, 25 bp, Mus musculus
gagccaggcggctatgacagttcat

SEQ ID NO: 32598 - DNA, 25 bp, Mus musculus
gagccaggctatgtcctcacagatg

SEQ ID NO: 32599 - DNA, 25 bp, Mus musculus
gagccaggctcagatgatgggacac

SEQ ID NO: 32600 - DNA, 25 bp, Mus musculus
gagccagggccggaagtagaacggt

SEQ ID NO: 32601 - DNA, 25 bp, Mus musculus
gagccagtcctgtttgcaacaacca

SEQ ID NO: 32602 - DNA, 25 bp, Mus musculus
gagccagtgtatggcaataaattgc

SEQ ID NO: 32603 - DNA, 25 bp, Mus musculus
gagccagttgctgagccagaaacat

SEQ ID NO: 32604 - DNA, 25 bp, Mus musculus
gagccataagagaagagctgttgta

SEQ ID NO: 32605 - DNA, 25 bp, Mus musculus
gagccatcaaaatcacagtggacgg

SEQ ID NO: 32606 - DNA, 25 bp, Mus musculus
gagccatcctggatcatacctacag

SEQ ID NO: 32607 - DNA, 25 bp, Mus musculus
gagccatctattaccttatcaaaag

SEQ ID NO: 32608 - DNA, 25 bp, Mus musculus
gagccatgaatgagctgcaactcaa

SEQ ID NO: 32609 - DNA, 25 bp, Mus musculus
gagccatgggaggagcattgccttt

SEQ ID NO: 32610 - DNA, 25 bp, Mus musculus
gagccatggtctgggtcctggactt

SEQ ID NO: 32611 - DNA, 25 bp, Mus musculus
gagccattccgtagtgccattcgga

SEQ ID NO: 32612 - DNA, 25 bp, Mus musculus
gagccattgcccagagtagcatcta

SEQ ID NO: 32613 - DNA, 25 bp, Mus musculus
gagccattggatgttccatcagcag

SEQ ID NO: 32614 - DNA, 25 bp, Mus musculus
gagccatttattgaaactcgccagg

SEQ ID NO: 32615 - DNA, 25 bp, Mus musculus
gagcccaaaatcaagtactacgcag

SEQ ID NO: 32616 - DNA, 25 bp, Mus musculus
gagcccaaagaaccgtctccagaaa

SEQ ID NO: 32617 - DNA, 25 bp, Mus musculus
gagcccaagcctaatagacccaagg

SEQ ID NO: 32618 - DNA, 25 bp, Mus musculus
gagcccaagggttgtccaatgtgaa

SEQ ID NO: 32619 - DNA, 25 bp, Mus musculus
gagcccagaaattcacgtgagtacg

SEQ ID NO: 32620 - DNA, 25 bp, Mus musculus
gagcccagacgctctgaatgactac

SEQ ID NO: 32621 - DNA, 25 bp, Mus musculus
gagcccaggcataacgctcacactt

SEQ ID NO: 32622 - DNA, 25 bp, Mus musculus
gagcccagtatcaagtgtgtggaca

SEQ ID NO: 32623 - DNA, 25 bp, Mus musculus
gagcccagtcatgactcagccagag

SEQ ID NO: 32624 - DNA, 25 bp, Mus musculus
gagcccagttctgctgagggcagct

SEQ ID NO: 32625 - DNA, 25 bp, Mus musculus
gagcccatatagagccatctgtaat

SEQ ID NO: 32626 - DNA, 25 bp, Mus musculus
gagcccatccaggaactgctaatca

SEQ ID NO: 32627 - DNA, 25 bp, Mus musculus
gagcccatctagcaactggtggcag

SEQ ID NO: 32628 - DNA, 25 bp, Mus musculus
gagcccatcttagcattctctcagg

SEQ ID NO: 32629 - DNA, 25 bp, Mus musculus
gagccccacgaattaagagaagttt

SEQ ID NO: 32630 - DNA, 25 bp, Mus musculus
gagccccaggaaaccaggtcctggc

SEQ ID NO: 32631 - DNA, 25 bp, Mus musculus
gagccccaggagtccatcagcatgc

SEQ ID NO: 32632 - DNA, 25 bp, Mus musculus
gagccccatctccagtatttccttt

SEQ ID NO: 32633 - DNA, 25 bp, Mus musculus
gagcccctatgtgaagttcttcagc

SEQ ID NO: 32634 - DNA, 25 bp, Mus musculus
gagcccctgtgagcagacagatagg

SEQ ID NO: 32635 - DNA, 25 bp, Mus musculus
gagcccgatttctgaagatcccgag

SEQ ID NO: 32636 - DNA, 25 bp, Mus musculus
gagcccgccccaaaggtgaaagcac

SEQ ID NO: 32637 - DNA, 25 bp, Mus musculus
gagcccggcacccatgagttgtgac

SEQ ID NO: 32638 - DNA, 25 bp, Mus musculus
gagccctccgtgaggccaagaatga

SEQ ID NO: 32639 - DNA, 25 bp, Mus musculus
gagccctgccttgtctcaaagagaa

SEQ ID NO: 32640 - DNA, 25 bp, Mus musculus
gagccctgctggactggatgctatg

SEQ ID NO: 32641 - DNA, 25 bp, Mus musculus
gagccctggaagaccgtgtccatga

SEQ ID NO: 32642 - DNA, 25 bp, Mus musculus
gagccctgtcatcccattgaccggg

SEQ ID NO: 32643 - DNA, 25 bp, Mus musculus
gagccctgttcctggccattggcct

SEQ ID NO: 32644 - DNA, 25 bp, Mus musculus
gagcccttgctattggagatcctcg

SEQ ID NO: 32645 - DNA, 25 bp, Mus musculus
gagcccttggtgattagctgtgtca

SEQ ID NO: 32646 - DNA, 25 bp, Mus musculus
gagccctttgcccgcctactggagg

SEQ ID NO: 32647 - DNA, 25 bp, Mus musculus
gagccgaaagcgtgtttgcaaatgt

SEQ ID NO: 32648 - DNA, 25 bp, Mus musculus
gagccgaggacctgcttcatatatg

SEQ ID NO: 32649 - DNA, 25 bp, Mus musculus
gagccgagtgaatggaaattagaat

SEQ ID NO: 32650 - DNA, 25 bp, Mus musculus
gagccgagttctgcgtaagacttgg

SEQ ID NO: 32651 - DNA, 25 bp, Mus musculus
gagccgcattgaccaagcccagaag

SEQ ID NO: 32652 - DNA, 25 bp, Mus musculus
gagccgccggtagcttctttggctt

SEQ ID NO: 32653 - DNA, 25 bp, Mus musculus
gagccgcctgaagccaagagcttct

SEQ ID NO: 32654 - DNA, 25 bp, Mus musculus
gagccgcgggtcttcactgatggaa

SEQ ID NO: 32655 - DNA, 25 bp, Mus musculus
gagccgcttggatactacccacttg

SEQ ID NO: 32656 - DNA, 25 bp, Mus musculus
gagccgctttccctgccagagagtc

SEQ ID NO: 32657 - DNA, 25 bp, Mus musculus
gagccggagttctctcaagtgctag

SEQ ID NO: 32658 - DNA, 25 bp, Mus musculus
gagccgggagagtctcaatatggac

SEQ ID NO: 32659 - DNA, 25 bp, Mus musculus
gagccggtctctgcgtaacctcaat

SEQ ID NO: 32660 - DNA, 25 bp, Mus musculus
gagccgtcacgacagctaggaacct

SEQ ID NO: 32661 - DNA, 25 bp, Mus musculus
gagccgtctggaacaggaaaagcag

SEQ ID NO: 32662 - DNA, 25 bp, Mus musculus
gagccgtttgtgagataaactatcg

SEQ ID NO: 32663 - DNA, 25 bp, Mus musculus
gagcctaagaacttggtcaaaacca

SEQ ID NO: 32664 - DNA, 25 bp, Mus musculus
gagcctagaggaagccaaacagtta

SEQ ID NO: 32665 - DNA, 25 bp, Mus musculus
gagcctatgggctacagtgccgagc

SEQ ID NO: 32666 - DNA, 25 bp, Mus musculus
gagcctatgggtacccttacatgcc

SEQ ID NO: 32667 - DNA, 25 bp, Mus musculus
gagcctcaaacaaggtcagagcagg

SEQ ID NO: 32668 - DNA, 25 bp, Mus musculus
gagcctcaaaccaccgttatccata

SEQ ID NO: 32669 - DNA, 25 bp, Mus musculus
gagcctcacctttcctgcttcagta

SEQ ID NO: 32670 - DNA, 25 bp, Mus musculus
gagcctcacttgattaccatcttgc

SEQ ID NO: 32671 - DNA, 25 bp, Mus musculus
gagcctcagaaccaggagcaaccat

SEQ ID NO: 32672 - DNA, 25 bp, Mus musculus
gagcctcaggccaccatttctgaaa

SEQ ID NO: 32673 - DNA, 25 bp, Mus musculus
gagcctcagtgatacagtgcaacgc

SEQ ID NO: 32674 - DNA, 25 bp, Mus musculus
gagcctcccaggagatcagcctgga

SEQ ID NO: 32675 - DNA, 25 bp, Mus musculus
gagcctcgaaatttgctgcacagaa

SEQ ID NO: 32676 - DNA, 25 bp, Mus musculus
gagcctcgccccagtgaatgggaga

SEQ ID NO: 32677 - DNA, 25 bp, Mus musculus
gagcctctctgagcagggtttcgct

SEQ ID NO: 32678 - DNA, 25 bp, Mus musculus
gagcctctgagatgtggagtctcta

SEQ ID NO: 32679 - DNA, 25 bp, Mus musculus
gagcctctgttcgagggctacatcg

SEQ ID NO: 32680 - DNA, 25 bp, Mus musculus
gagcctctttcttctccagcgatga

SEQ ID NO: 32681 - DNA, 25 bp, Mus musculus
gagcctctttgtgtggaaaacgaca

SEQ ID NO: 32682 - DNA, 25 bp, Mus musculus
gagcctgaaactcacacggtctgga

SEQ ID NO: 32683 - DNA, 25 bp, Mus musculus
gagcctgaggtgcaatctctggatt

SEQ ID NO: 32684 - DNA, 25 bp, Mus musculus
gagcctgatcatttgcatttcccta

SEQ ID NO: 32685 - DNA, 25 bp, Mus musculus
gagcctgatctggttagtgcaattt

SEQ ID NO: 32686 - DNA, 25 bp, Mus musculus
gagcctgatgaaactgtgcacagtt

SEQ ID NO: 32687 - DNA, 25 bp, Mus musculus
gagcctgcaattggtggagcccact

SEQ ID NO: 32688 - DNA, 25 bp, Mus musculus
gagcctgccaaacctggagatctcc

SEQ ID NO: 32689 - DNA, 25 bp, Mus musculus
gagcctgccaaccacaggagaggcc

SEQ ID NO: 32690 - DNA, 25 bp, Mus musculus
gagcctgcgacgatggcctctgcag

SEQ ID NO: 32691 - DNA, 25 bp, Mus musculus
gagcctgcgccctcagatgagtgcc

SEQ ID NO: 32692 - DNA, 25 bp, Mus musculus
gagcctgctcaccttcagagtctat

SEQ ID NO: 32693 - DNA, 25 bp, Mus musculus
gagcctgcttacttagacatcttgg

SEQ ID NO: 32694 - DNA, 25 bp, Mus musculus
gagcctggattcacctcacactgtg

SEQ ID NO: 32695 - DNA, 25 bp, Mus musculus
gagcctggccacacccatctttgtg

SEQ ID NO: 32696 - DNA, 25 bp, Mus musculus
gagcctggctcctatcttggccgag

SEQ ID NO: 32697 - DNA, 25 bp, Mus musculus
gagcctggtaccactgcgaccagga

SEQ ID NO: 32698 - DNA, 25 bp, Mus musculus
gagcctgtccttgggccgattcaca

SEQ ID NO: 32699 - DNA, 25 bp, Mus musculus
gagcctgtggcacacaaagactcca

SEQ ID NO: 32700 - DNA, 25 bp, Mus musculus
gagcctgtgggttgagaatcaagaa

SEQ ID NO: 32701 - DNA, 25 bp, Mus musculus
gagcctgtgttcacatctgatgata

SEQ ID NO: 32702 - DNA, 25 bp, Mus musculus
gagcctgttcaagcaaaattattca

SEQ ID NO: 32703 - DNA, 25 bp, Mus musculus
gagccttagcctcctcatgctgttg

SEQ ID NO: 32704 - DNA, 25 bp, Mus musculus
gagccttcccatccaactttgtgga

SEQ ID NO: 32705 - DNA, 25 bp, Mus musculus
gagccttctccttctgggcaacaga

SEQ ID NO: 32706 - DNA, 25 bp, Mus musculus
gagccttctggtttccaactgtgcg

SEQ ID NO: 32707 - DNA, 25 bp, Mus musculus
gagccttgcactacaaagggcccag

SEQ ID NO: 32708 - DNA, 25 bp, Mus musculus
gagccttggaacatccttcgcagtg

SEQ ID NO: 32709 - DNA, 25 bp, Mus musculus
gagccttggagacggtacattacag

SEQ ID NO: 32710 - DNA, 25 bp, Mus musculus
gagccttggtggagaatacgacaac

SEQ ID NO: 32711 - DNA, 25 bp, Mus musculus
gagccttgtgtcagttccttcatga

SEQ ID NO: 32712 - DNA, 25 bp, Mus musculus
gagccttgtgtctgttccttcatga

SEQ ID NO: 32713 - DNA, 25 bp, Mus musculus
gagcctttgatagaccctgtgtacg

SEQ ID NO: 32714 - DNA, 25 bp, Mus musculus
gagcctttgccttcttcccagtggc

SEQ ID NO: 32715 - DNA, 25 bp, Mus musculus
gagcctttggaccttcacttgggca

SEQ ID NO: 32716 - DNA, 25 bp, Mus musculus
gagcgaaaaatatctatgcgaaaac

SEQ ID NO: 32717 - DNA, 25 bp, Mus musculus
gagcgaagaggctggaagaccaact

SEQ ID NO: 32718 - DNA, 25 bp, Mus musculus
gagcgaagttctgcgatgcctccga

SEQ ID NO: 32719 - DNA, 25 bp, Mus musculus
gagcgaatacgctaaatactgcaca

SEQ ID NO: 32720 - DNA, 25 bp, Mus musculus
gagcgacaccatccaggtggcctgt

SEQ ID NO: 32721 - DNA, 25 bp, Mus musculus
gagcgacactctctacagagcccaa

SEQ ID NO: 32722 - DNA, 25 bp, Mus musculus
gagcgacagcctgcatgttagccag

SEQ ID NO: 32723 - DNA, 25 bp, Mus musculus
gagcgacagttcctttctggtgaat

SEQ ID NO: 32724 - DNA, 25 bp, Mus musculus
gagcgaccagctcactaggaacatg

SEQ ID NO: 32725 - DNA, 25 bp, Mus musculus
gagcgacccgactccctttggtttg

SEQ ID NO: 32726 - DNA, 25 bp, Mus musculus
gagcgactggacacctggatctgct

SEQ ID NO: 32727 - DNA, 25 bp, Mus musculus
gagcgactggcgttcttaacctctg

SEQ ID NO: 32728 - DNA, 25 bp, Mus musculus
gagcgaggagctgacctatctcaag

SEQ ID NO: 32729 - DNA, 25 bp, Mus musculus
gagcgattcctctgtgagtcggtgt

SEQ ID NO: 32730 - DNA, 25 bp, Mus musculus
gagcgcaaggcaactctgccctcag

SEQ ID NO: 32731 - DNA, 25 bp, Mus musculus
gagcgcacatttgcatggattttaa

SEQ ID NO: 32732 - DNA, 25 bp, Mus musculus
gagcgcagcatcgtggactacaagc

SEQ ID NO: 32733 - DNA, 25 bp, Mus musculus
gagcgcagccgagcgtgccaagaaa

SEQ ID NO: 32734 - DNA, 25 bp, Mus musculus
gagcgcatgaggatacagaaagctg

SEQ ID NO: 32735 - DNA, 25 bp, Mus musculus
gagcgccgtcctccatccctgtaag

SEQ ID NO: 32736 - DNA, 25 bp, Mus musculus
gagcgcctagcctgggagcatgatc

SEQ ID NO: 32737 - DNA, 25 bp, Mus musculus
gagcgcctcccaagttttcatccaa

SEQ ID NO: 32738 - DNA, 25 bp, Mus musculus
gagcgcctggagattttgtcaagca

SEQ ID NO: 32739 - DNA, 25 bp, Mus musculus
gagcgctaccggacaatcaccacgg

SEQ ID NO: 32740 - DNA, 25 bp, Mus musculus
gagcgctactctcgtagattccgga

SEQ ID NO: 32741 - DNA, 25 bp, Mus musculus
gagcgctcctatcagcatatcatga

SEQ ID NO: 32742 - DNA, 25 bp, Mus musculus
gagcgctctgcaggcctgcaaactg

SEQ ID NO: 32743 - DNA, 25 bp, Mus musculus
gagcgctgcaggagtctcgactgct

SEQ ID NO: 32744 - DNA, 25 bp, Mus musculus
gagcgcttccagagtgacagcagct

SEQ ID NO: 32745 - DNA, 25 bp, Mus musculus
gagcgcttctgggaaagctatacgt

SEQ ID NO: 32746 - DNA, 25 bp, Mus musculus
gagcgctttgagctgtttgtcatga

SEQ ID NO: 32747 - DNA, 25 bp, Mus musculus
gagcgctttgcagcaaatgcccatg

SEQ ID NO: 32748 - DNA, 25 bp, Mus musculus
gagcgctttggaacatacatggaac

SEQ ID NO: 32749 - DNA, 25 bp, Mus musculus
gagcgctttttgaaggttccagggc

SEQ ID NO: 32750 - DNA, 25 bp, Mus musculus
gagcggaccccaacctggtgttgga

SEQ ID NO: 32751 - DNA, 25 bp, Mus musculus
gagcggaggtcatgttcgcccctca

SEQ ID NO: 32752 - DNA, 25 bp, Mus musculus
gagcggagttgactaccgaccttgc

SEQ ID NO: 32753 - DNA, 25 bp, Mus musculus
gagcggagttgagtaccgaccttgc

SEQ ID NO: 32754 - DNA, 25 bp, Mus musculus
gagcggatgcagacagagaacaaga

SEQ ID NO: 32755 - DNA, 25 bp, Mus musculus
gagcggattgttcgctgcatcatcc

SEQ ID NO: 32756 - DNA, 25 bp, Mus musculus
gagcggcagcgttcattgctctcca

SEQ ID NO: 32757 - DNA, 25 bp, Mus musculus
gagcggcatgaccattttcttcagc

SEQ ID NO: 32758 - DNA, 25 bp, Mus musculus
gagcggcttcctcagagaccctaat

SEQ ID NO: 32759 - DNA, 25 bp, Mus musculus
gagcgggaagcatcatcgaataatc

SEQ ID NO: 32760 - DNA, 25 bp, Mus musculus
gagcgggaccattcccggtcatcgt

SEQ ID NO: 32761 - DNA, 25 bp, Mus musculus
gagcgggccgtcatccgcattgcag

SEQ ID NO: 32762 - DNA, 25 bp, Mus musculus
gagcggtaccacatccctatatctg

SEQ ID NO: 32763 - DNA, 25 bp, Mus musculus
gagcggtcgagaagtgagcacaact

SEQ ID NO: 32764 - DNA, 25 bp, Mus musculus
gagcggtgacacatcctcatgcctg

SEQ ID NO: 32765 - DNA, 25 bp, Mus musculus
gagcggttccagagcatgcatgctt

SEQ ID NO: 32766 - DNA, 25 bp, Mus musculus
gagcggtttcatatccagatcacca

SEQ ID NO: 32767 - DNA, 25 bp, Mus musculus
gagcgtacaggtcaattatcaaaga

SEQ ID NO: 32768 - DNA, 25 bp, Mus musculus
gagcgtcagacttaacaggaagctt

SEQ ID NO: 32769 - DNA, 25 bp, Mus musculus
gagcgtcatctgtttcaccagtgga

SEQ ID NO: 32770 - DNA, 25 bp, Mus musculus
gagcgtctacgatctgttaatccca

SEQ ID NO: 32771 - DNA, 25 bp, Mus musculus
gagcgtctttgggttttctgtccgc

SEQ ID NO: 32772 - DNA, 25 bp, Mus musculus
gagcgtgaagccatttttagaaccc

SEQ ID NO: 32773 - DNA, 25 bp, Mus musculus
gagcgtgactgctcgtgcatgtcag

SEQ ID NO: 32774 - DNA, 25 bp, Mus musculus
gagcgtgagacgcatcatcacccgt

SEQ ID NO: 32775 - DNA, 25 bp, Mus musculus
gagcgtggacaacatccagttcctg

SEQ ID NO: 32776 - DNA, 25 bp, Mus musculus
gagcgtgtatcacaacagtgcaaag

SEQ ID NO: 32777 - DNA, 25 bp, Mus musculus
gagcgttatgccaccagttgttaca

SEQ ID NO: 32778 - DNA, 25 bp, Mus musculus
gagcgtttacctcactcccaagaca

SEQ ID NO: 32779 - DNA, 25 bp, Mus musculus
gagcgtttgaaacgcacgtctcaga

SEQ ID NO: 32780 - DNA, 25 bp, Mus musculus
gagctaaaagctcgaacagtatggc

SEQ ID NO: 32781 - DNA, 25 bp, Mus musculus
gagctaacccagaaggtggcccagg

SEQ ID NO: 32782 - DNA, 25 bp, Mus musculus
gagctaatctttcctctgcccgtgg

SEQ ID NO: 32783 - DNA, 25 bp, Mus musculus
gagctaatgagcaaggagggcttcc

SEQ ID NO: 32784 - DNA, 25 bp, Mus musculus
gagctacagacatttgtggctgcct

SEQ ID NO: 32785 - DNA, 25 bp, Mus musculus
gagctacagccatattcaatccaag

SEQ ID NO: 32786 - DNA, 25 bp, Mus musculus
gagctacagcgtgtcctgtccaagg

SEQ ID NO: 32787 - DNA, 25 bp, Mus musculus
gagctacagctctgcatggaagaaa

SEQ ID NO: 32788 - DNA, 25 bp, Mus musculus
gagctacctggcagttgcctccact

SEQ ID NO: 32789 - DNA, 25 bp, Mus musculus
gagctacctggtgactcaggcccag

SEQ ID NO: 32790 - DNA, 25 bp, Mus musculus
gagctactatacacgcattctgccc

SEQ ID NO: 32791 - DNA, 25 bp, Mus musculus
gagctactatactcgcattctgccc

SEQ ID NO: 32792 - DNA, 25 bp, Mus musculus
gagctactcagtgtgtaaaccaggg

SEQ ID NO: 32793 - DNA, 25 bp, Mus musculus
gagctagaaaattaccactacaggg

SEQ ID NO: 32794 - DNA, 25 bp, Mus musculus
gagctagaagacttatgctcttatg

SEQ ID NO: 32795 - DNA, 25 bp, Mus musculus
gagctagacaccgagatcctggagg

SEQ ID NO: 32796 - DNA, 25 bp, Mus musculus
gagctagacaccgtccacagagaaa

SEQ ID NO: 32797 - DNA, 25 bp, Mus musculus
gagctagagcaagattcggagaacc

SEQ ID NO: 32798 - DNA, 25 bp, Mus musculus
gagctagcgggctcacctgcatcaa

SEQ ID NO: 32799 - DNA, 25 bp, Mus musculus
gagctaggaaaatgtaacactctac

SEQ ID NO: 32800 - DNA, 25 bp, Mus musculus
gagctaggcacactgctcatgtgtc

SEQ ID NO: 32801 - DNA, 25 bp, Mus musculus
gagctatcgaactgcaaccccattt

SEQ ID NO: 32802 - DNA, 25 bp, Mus musculus
gagctatcgtgctctgtgttggagc

SEQ ID NO: 32803 - DNA, 25 bp, Mus musculus
gagctatgcccaacagaagcgcaag

SEQ ID NO: 32804 - DNA, 25 bp, Mus musculus
gagctatgctggcatctacatcccc

SEQ ID NO: 32805 - DNA, 25 bp, Mus musculus
gagctatggaatcccaacattacat

SEQ ID NO: 32806 - DNA, 25 bp, Mus musculus
gagctatggctgttcttaatagacc

SEQ ID NO: 32807 - DNA, 25 bp, Mus musculus
gagctattctgctgcttcataggac

SEQ ID NO: 32808 - DNA, 25 bp, Mus musculus
gagctcaacacagaagactacatag

SEQ ID NO: 32809 - DNA, 25 bp, Mus musculus
gagctcagaagtccaagatacactg

SEQ ID NO: 32810 - DNA, 25 bp, Mus musculus
gagctcagaagtgcaagatacactg

SEQ ID NO: 32811 - DNA, 25 bp, Mus musculus
gagctcagacatacaagttggagac

SEQ ID NO: 32812 - DNA, 25 bp, Mus musculus
gagctcaggaggatgtagcactaac

SEQ ID NO: 32813 - DNA, 25 bp, Mus musculus
gagctcagggctcaatttgtgcact

SEQ ID NO: 32814 - DNA, 25 bp, Mus musculus
gagctcagtgctggaaagcctagtg

SEQ ID NO: 32815 - DNA, 25 bp, Mus musculus
gagctcatcaaagcccagaaggtgt

SEQ ID NO: 32816 - DNA, 25 bp, Mus musculus
gagctcatggtctctgatggctggc

SEQ ID NO: 32817 - DNA, 25 bp, Mus musculus
gagctccaaagaatgaagatgtatc

SEQ ID NO: 32818 - DNA, 25 bp, Mus musculus
gagctccaagctggataaatctggt

SEQ ID NO: 32819 - DNA, 25 bp, Mus musculus
gagctcctacctggttttcgggcgg

SEQ ID NO: 32820 - DNA, 25 bp, Mus musculus
gagctcctactactgctttgccaca

SEQ ID NO: 32821 - DNA, 25 bp, Mus musculus
gagctcctagacacaaaccggtatc

SEQ ID NO: 32822 - DNA, 25 bp, Mus musculus
gagctcctatgtcatggattctgaa

SEQ ID NO: 32823 - DNA, 25 bp, Mus musculus
gagctcctgcacctgaacaacgtga

SEQ ID NO: 32824 - DNA, 25 bp, Mus musculus
gagctcctggacaaccgaaaactgg

SEQ ID NO: 32825 - DNA, 25 bp, Mus musculus
gagctcctggcacagagtctgtcca

SEQ ID NO: 32826 - DNA, 25 bp, Mus musculus
gagctcctggccagacgggtcacac

SEQ ID NO: 32827 - DNA, 25 bp, Mus musculus
gagctcgaacagtcagcaagggagc

SEQ ID NO: 32828 - DNA, 25 bp, Mus musculus
gagctcggaaggtccagagcaatga

SEQ ID NO: 32829 - DNA, 25 bp, Mus musculus
gagctcggagaagactctgcttttg

SEQ ID NO: 32830 - DNA, 25 bp, Mus musculus
gagctcggatttctataagtgtgag

SEQ ID NO: 32831 - DNA, 25 bp, Mus musculus
gagctcggcacaaggatgctttcct

SEQ ID NO: 32832 - DNA, 25 bp, Mus musculus
gagctcggtaccttgaggatccaga

SEQ ID NO: 32833 - DNA, 25 bp, Mus musculus
gagctctacaaacgcagaagagaga

SEQ ID NO: 32834 - DNA, 25 bp, Mus musculus
gagctctacaaaggcagaagagaga

SEQ ID NO: 32835 - DNA, 25 bp, Mus musculus
gagctctacgtggacaagtctcggg

SEQ ID NO: 32836 - DNA, 25 bp, Mus musculus
gagctctctgttttcttcgtatggg

SEQ ID NO: 32837 - DNA, 25 bp, Mus musculus
gagctctcttacaagacaatagtcc

SEQ ID NO: 32838 - DNA, 25 bp, Mus musculus
gagctctctttttggacagtgcatt

SEQ ID NO: 32839 - DNA, 25 bp, Mus musculus
gagctctgcggataaagagagactt

SEQ ID NO: 32840 - DNA, 25 bp, Mus musculus
gagctctggagcacctgcttctcgc

SEQ ID NO: 32841 - DNA, 25 bp, Mus musculus
gagctcttaagagtcaccaagccag

SEQ ID NO: 32842 - DNA, 25 bp, Mus musculus
gagctcttggagatttcagggaaac

SEQ ID NO: 32843 - DNA, 25 bp, Mus musculus
gagctctttctcgacactgtttcta

SEQ ID NO: 32844 - DNA, 25 bp, Mus musculus
gagctgaaaagaaccttcttagaaa

SEQ ID NO: 32845 - DNA, 25 bp, Mus musculus
gagctgaaactaaagccaaagccca

SEQ ID NO: 32846 - DNA, 25 bp, Mus musculus
gagctgaacatcgaacagagtctgt

SEQ ID NO: 32847 - DNA, 25 bp, Mus musculus
gagctgaagatggatcaggctttgc

SEQ ID NO: 32848 - DNA, 25 bp, Mus musculus
gagctgaaggaggtcgccttgctca

SEQ ID NO: 32849 - DNA, 25 bp, Mus musculus
gagctgaagtacacaggaaatgcca

SEQ ID NO: 32850 - DNA, 25 bp, Mus musculus
gagctgacatgccatccctagagga

SEQ ID NO: 32851 - DNA, 25 bp, Mus musculus
gagctgacatgtgctattgagtcac

SEQ ID NO: 32852 - DNA, 25 bp, Mus musculus
gagctgaccagttccctcttcagga

SEQ ID NO: 32853 - DNA, 25 bp, Mus musculus
gagctgacggttcacctttctgtcc

SEQ ID NO: 32854 - DNA, 25 bp, Mus musculus
gagctgactctggagcacacaggac

SEQ ID NO: 32855 - DNA, 25 bp, Mus musculus
gagctgactgcctatcatccctgtc

SEQ ID NO: 32856 - DNA, 25 bp, Mus musculus
gagctgactgtgtggtattctaact

SEQ ID NO: 32857 - DNA, 25 bp, Mus musculus
gagctgagaatctaatactttgtct

SEQ ID NO: 32858 - DNA, 25 bp, Mus musculus
gagctgagacgcacagtcaatgccc

SEQ ID NO: 32859 - DNA, 25 bp, Mus musculus
gagctgagcgacaccatccaggtgg

SEQ ID NO: 32860 - DNA, 25 bp, Mus musculus
gagctgaggcacctcctgtggtcat

SEQ ID NO: 32861 - DNA, 25 bp, Mus musculus
gagctgatcttttcagtggaaggct

SEQ ID NO: 32862 - DNA, 25 bp, Mus musculus
gagctgatggaacaagtgccgcaca

SEQ ID NO: 32863 - DNA, 25 bp, Mus musculus
gagctgattgctgccttcaaagaac

SEQ ID NO: 32864 - DNA, 25 bp, Mus musculus
gagctgcacattagccttggcctca

SEQ ID NO: 32865 - DNA, 25 bp, Mus musculus
gagctgcacctgcagtatgccatgt

SEQ ID NO: 32866 - DNA, 25 bp, Mus musculus
gagctgcacctggtgatgacggccc

SEQ ID NO: 32867 - DNA, 25 bp, Mus musculus
gagctgcagaacttggtcgccatcc

SEQ ID NO: 32868 - DNA, 25 bp, Mus musculus
gagctgcagaagagcccctatggac

SEQ ID NO: 32869 - DNA, 25 bp, Mus musculus
gagctgcagatcaacaacacccgat

SEQ ID NO: 32870 - DNA, 25 bp, Mus musculus
gagctgcattcatatctcaccaggc

SEQ ID NO: 32871 - DNA, 25 bp, Mus musculus
gagctgccaccttcgatggaacgca

SEQ ID NO: 32872 - DNA, 25 bp, Mus musculus
gagctgcccatcgactttccagaag

SEQ ID NO: 32873 - DNA, 25 bp, Mus musculus
gagctgcctgcgtcccaaagaacag

SEQ ID NO: 32874 - DNA, 25 bp, Mus musculus
gagctgcggtcgaaactcatgaaac

SEQ ID NO: 32875 - DNA, 25 bp, Mus musculus
gagctgctaaagaggatgatgatga

SEQ ID NO: 32876 - DNA, 25 bp, Mus musculus
gagctgctcaatgagacgtccccgt

SEQ ID NO: 32877 - DNA, 25 bp, Mus musculus
gagctgctcacacaccaagctgtct

SEQ ID NO: 32878 - DNA, 25 bp, Mus musculus
gagctgctctggacatgcatcttac

SEQ ID NO: 32879 - DNA, 25 bp, Mus musculus
gagctggaacgttgcttgactgcct

SEQ ID NO: 32880 - DNA, 25 bp, Mus musculus
gagctggacttctccaccttcctga

SEQ ID NO: 32881 - DNA, 25 bp, Mus musculus
gagctggataccaagctggacctga

SEQ ID NO: 32882 - DNA, 25 bp, Mus musculus
gagctggcaccacagaatctgggca

SEQ ID NO: 32883 - DNA, 25 bp, Mus musculus
gagctggcagagtacacggccaaga

SEQ ID NO: 32884 - DNA, 25 bp, Mus musculus
gagctggcaggtgtacagctctgcc

SEQ ID NO: 32885 - DNA, 25 bp, Mus musculus
gagctggcattacaaactggaaaag

SEQ ID NO: 32886 - DNA, 25 bp, Mus musculus
gagctggccctgacacaaggcatga

SEQ ID NO: 32887 - DNA, 25 bp, Mus musculus
gagctggcttctatacttccctagg

SEQ ID NO: 32888 - DNA, 25 bp, Mus musculus
gagctgggagcctcgtgtcttgccc

SEQ ID NO: 32889 - DNA, 25 bp, Mus musculus
gagctgggttttatgttgatgcaac

SEQ ID NO: 32890 - DNA, 25 bp, Mus musculus
gagctggtggagtactaccagtgtc

SEQ ID NO: 32891 - DNA, 25 bp, Mus musculus
gagctgtaaacacaacactagaggg

SEQ ID NO: 32892 - DNA, 25 bp, Mus musculus
gagctgtaacctgaattcttgtcca

SEQ ID NO: 32893 - DNA, 25 bp, Mus musculus
gagctgtattctgcaagaatctggt

SEQ ID NO: 32894 - DNA, 25 bp, Mus musculus
gagctgtcacaaggacgcatctgcc

SEQ ID NO: 32895 - DNA, 25 bp, Mus musculus
gagctgtccaggtttattgctgctg

SEQ ID NO: 32896 - DNA, 25 bp, Mus musculus
gagctgtcgtcctgcgtaccatctt

SEQ ID NO: 32897 - DNA, 25 bp, Mus musculus
gagctgtctctgctgcgtgctccag

SEQ ID NO: 32898 - DNA, 25 bp, Mus musculus
gagctgtctcttcaactaccgtgaa

SEQ ID NO: 32899 - DNA, 25 bp, Mus musculus
gagctgtgaactacctgcagaacaa

SEQ ID NO: 32900 - DNA, 25 bp, Mus musculus
gagctgtgaagcctccagcaaacaa

SEQ ID NO: 32901 - DNA, 25 bp, Mus musculus
gagctgtgataatcgcaaggtcagc

SEQ ID NO: 32902 - DNA, 25 bp, Mus musculus
gagctgtgcttctcactacgctacg

SEQ ID NO: 32903 - DNA, 25 bp, Mus musculus
gagctgtgtacagaggtttgccgct

SEQ ID NO: 32904 - DNA, 25 bp, Mus musculus
gagctgttcaatgctgtttctggcc

SEQ ID NO: 32905 - DNA, 25 bp, Mus musculus
gagctgttcattgttgtagacaagg

SEQ ID NO: 32906 - DNA, 25 bp, Mus musculus
gagctgttctactatgcccagaagg

SEQ ID NO: 32907 - DNA, 25 bp, Mus musculus
gagctgttgagattacagggccaag

SEQ ID NO: 32908 - DNA, 25 bp, Mus musculus
gagctgttgcgaactctcactttga

SEQ ID NO: 32909 - DNA, 25 bp, Mus musculus
gagctgtttgtcatgaagaaggaga

SEQ ID NO: 32910 - DNA, 25 bp, Mus musculus
gagctgtttttcatagttgctgcag

SEQ ID NO: 32911 - DNA, 25 bp, Mus musculus
gagcttatcctagaagacagacaga

SEQ ID NO: 32912 - DNA, 25 bp, Mus musculus
gagcttcaagaaacagtcgtttgtc

SEQ ID NO: 32913 - DNA, 25 bp, Mus musculus
gagcttcagcccactgagagtttac

SEQ ID NO: 32914 - DNA, 25 bp, Mus musculus
gagcttcatccaggcgtctccagtg

SEQ ID NO: 32915 - DNA, 25 bp, Mus musculus
gagcttcattctctctgcggagccg

SEQ ID NO: 32916 - DNA, 25 bp, Mus musculus
gagcttccagaaatcctgcagaatt

SEQ ID NO: 32917 - DNA, 25 bp, Mus musculus
gagcttccagcctggatgctcacga

SEQ ID NO: 32918 - DNA, 25 bp, Mus musculus
gagcttccctcaggactctagagaa

SEQ ID NO: 32919 - DNA, 25 bp, Mus musculus
gagcttcctgaggagggcagcacaa

SEQ ID NO: 32920 - DNA, 25 bp, Mus musculus
gagcttcgaaccatggaccaagccc

SEQ ID NO: 32921 - DNA, 25 bp, Mus musculus
gagcttcgatgacacccctcttggg

SEQ ID NO: 32922 - DNA, 25 bp, Mus musculus
gagcttgaccccagttcgagacagc

SEQ ID NO: 32923 - DNA, 25 bp, Mus musculus
gagcttgagagtcccttacaacagg

SEQ ID NO: 32924 - DNA, 25 bp, Mus musculus
gagcttgagatgaaagacatccatg

SEQ ID NO: 32925 - DNA, 25 bp, Mus musculus
gagcttgcagaaatcacgctggatc

SEQ ID NO: 32926 - DNA, 25 bp, Mus musculus
gagcttgccaattgacgccgttgtg

SEQ ID NO: 32927 - DNA, 25 bp, Mus musculus
gagcttgctgtggagtgtacagtca

SEQ ID NO: 32928 - DNA, 25 bp, Mus musculus
gagcttggaggaaacaatgccatta

SEQ ID NO: 32929 - DNA, 25 bp, Mus musculus
gagcttggccattgccacctgtgtg

SEQ ID NO: 32930 - DNA, 25 bp, Mus musculus
gagcttggcctgctgtcgtttagtt

SEQ ID NO: 32931 - DNA, 25 bp, Mus musculus
gagcttggctttgagcgatttcatg

SEQ ID NO: 32932 - DNA, 25 bp, Mus musculus
gagcttgtggaaaagaaagtttgta

SEQ ID NO: 32933 - DNA, 25 bp, Mus musculus
gagctttaattgtgccaacaacatt

SEQ ID NO: 32934 - DNA, 25 bp, Mus musculus
gagctttatagtacacacaaaacag

SEQ ID NO: 32935 - DNA, 25 bp, Mus musculus
gagctttcaccatgggtgtcattgg

SEQ ID NO: 32936 - DNA, 25 bp, Mus musculus
gagctttgacatcttctgtgacgtg

SEQ ID NO: 32937 - DNA, 25 bp, Mus musculus
gagctttgctcctacagcagttgca

SEQ ID NO: 32938 - DNA, 25 bp, Mus musculus
gagctttgtgaggatggagaactca

SEQ ID NO: 32939 - DNA, 25 bp, Mus musculus
gagctttgtgcagcctgggaagccc

SEQ ID NO: 32940 - DNA, 25 bp, Mus musculus
gagcttttaaggaataccttcccag

SEQ ID NO: 32941 - DNA, 25 bp, Mus musculus
gagcttttcaagcactatcaggccg

SEQ ID NO: 32942 - DNA, 25 bp, Mus musculus
gagcttttctgctcaagactatgca

SEQ ID NO: 32943 - DNA, 25 bp, Mus musculus
gagcttttgtggaaaacatcactgt

SEQ ID NO: 32944 - DNA, 25 bp, Mus musculus
gaggaaaagatctatcaaaggcaga

SEQ ID NO: 32945 - DNA, 25 bp, Mus musculus
gaggaaaagatgacccactgtttaa

SEQ ID NO: 32946 - DNA, 25 bp, Mus musculus
gaggaaaatacagcgcgaattagca

SEQ ID NO: 32947 - DNA, 25 bp, Mus musculus
gaggaaacacctgtagttttgcagt

SEQ ID NO: 32948 - DNA, 25 bp, Mus musculus
gaggaaacagtttacagtcatcaca

SEQ ID NO: 32949 - DNA, 25 bp, Mus musculus
gaggaaaccaacctcagcaagatgg

SEQ ID NO: 32950 - DNA, 25 bp, Mus musculus
gaggaaacccagacttgagaaaact

SEQ ID NO: 32951 - DNA, 25 bp, Mus musculus
gaggaaacttccatggtgaataccc

SEQ ID NO: 32952 - DNA, 25 bp, Mus musculus
gaggaaatacgcaagcaactgctca

SEQ ID NO: 32953 - DNA, 25 bp, Mus musculus
gaggaaatcaatgtcgtcatgaaca

SEQ ID NO: 32954 - DNA, 25 bp, Mus musculus
gaggaaatcctctccatcctggaag

SEQ ID NO: 32955 - DNA, 25 bp, Mus musculus
gaggaaatctcagaaatcaaagagg

SEQ ID NO: 32956 - DNA, 25 bp, Mus musculus
gaggaaatctcttcatggatattaa

SEQ ID NO: 32957 - DNA, 25 bp, Mus musculus
gaggaaatgacatgcaagttggcac

SEQ ID NO: 32958 - DNA, 25 bp, Mus musculus
gaggaaatgatgaggtccccttggc

SEQ ID NO: 32959 - DNA, 25 bp, Mus musculus
gaggaaatggctcttcagagaccac

SEQ ID NO: 32960 - DNA, 25 bp, Mus musculus
gaggaaattccccagaaggaattag

SEQ ID NO: 32961 - DNA, 25 bp, Mus musculus
gaggaaattcccgagaaggaattag

SEQ ID NO: 32962 - DNA, 25 bp, Mus musculus
gaggaacaactcaaccttctcccga

SEQ ID NO: 32963 - DNA, 25 bp, Mus musculus
gaggaacaaggccagtaagcgtaaa

SEQ ID NO: 32964 - DNA, 25 bp, Mus musculus
gaggaacacaagctcacagctgttc

SEQ ID NO: 32965 - DNA, 25 bp, Mus musculus
gaggaaccacaaaatctgcgggcag

SEQ ID NO: 32966 - DNA, 25 bp, Mus musculus
gaggaaccctatgcagcatggcagg

SEQ ID NO: 32967 - DNA, 25 bp, Mus musculus
gaggaaccctgccatgtgtagtgaa

SEQ ID NO: 32968 - DNA, 25 bp, Mus musculus
gaggaacgggcatgtttaaggaact

SEQ ID NO: 32969 - DNA, 25 bp, Mus musculus
gaggaactaatatagttgtgcttgg

SEQ ID NO: 32970 - DNA, 25 bp, Mus musculus
gaggaactactcacttcattaattt

SEQ ID NO: 32971 - DNA, 25 bp, Mus musculus
gaggaactactctcttcattaattt

SEQ ID NO: 32972 - DNA, 25 bp, Mus musculus
gaggaactcagaaccacagaaaacg

SEQ ID NO: 32973 - DNA, 25 bp, Mus musculus
gaggaactcccaacccttggctctg

SEQ ID NO: 32974 - DNA, 25 bp, Mus musculus
gaggaactggctagccccttaaggg

SEQ ID NO: 32975 - DNA, 25 bp, Mus musculus
gaggaactggcttgccccttaaggg

SEQ ID NO: 32976 - DNA, 25 bp, Mus musculus
gaggaagaacacaatggctaccctt

SEQ ID NO: 32977 - DNA, 25 bp, Mus musculus
gaggaagacatcacctactgtgtcc

SEQ ID NO: 32978 - DNA, 25 bp, Mus musculus
gaggaagacccgcacagagttaatg

SEQ ID NO: 32979 - DNA, 25 bp, Mus musculus
gaggaagagagccaaccagcaaaaa

SEQ ID NO: 32980 - DNA, 25 bp, Mus musculus
gaggaagagtcactcatcctcccca

SEQ ID NO: 32981 - DNA, 25 bp, Mus musculus
gaggaagcattgaaaatcctccaaa

SEQ ID NO: 32982 - DNA, 25 bp, Mus musculus
gaggaagccaaacagttatttggac

SEQ ID NO: 32983 - DNA, 25 bp, Mus musculus
gaggaagccattacccactgctgcc

SEQ ID NO: 32984 - DNA, 25 bp, Mus musculus
gaggaagccattctacccagctctt

SEQ ID NO: 32985 - DNA, 25 bp, Mus musculus
gaggaagcctgggtgctttttaatc

SEQ ID NO: 32986 - DNA, 25 bp, Mus musculus
gaggaagcgaatgcacctgggtaca

SEQ ID NO: 32987 - DNA, 25 bp, Mus musculus
gaggaagctcctcaacagaagggta

SEQ ID NO: 32988 - DNA, 25 bp, Mus musculus
gaggaaggaagactgctgcaaactt

SEQ ID NO: 32989 - DNA, 25 bp, Mus musculus
gaggaaggataagactctgctccaa

SEQ ID NO: 32990 - DNA, 25 bp, Mus musculus
gaggaaggctcaacaaggacctacg

SEQ ID NO: 32991 - DNA, 25 bp, Mus musculus
gaggaaggtcagtcatgcctgcaga

SEQ ID NO: 32992 - DNA, 25 bp, Mus musculus
gaggaagtaaaccatgccacatcca

SEQ ID NO: 32993 - DNA, 25 bp, Mus musculus
gaggaagtccaagtctatcattgac

SEQ ID NO: 32994 - DNA, 25 bp, Mus musculus
gaggaagtcccagaaaatggcagag

SEQ ID NO: 32995 - DNA, 25 bp, Mus musculus
gaggaagtgtttgatgttctttata

SEQ ID NO: 32996 - DNA, 25 bp, Mus musculus
gaggaatcagccaggaccaatgctg

SEQ ID NO: 32997 - DNA, 25 bp, Mus musculus
gaggaatctgagagtgacagtactt

SEQ ID NO: 32998 - DNA, 25 bp, Mus musculus
gaggaatgattcatattcacttgac

SEQ ID NO: 32999 - DNA, 25 bp, Mus musculus
gaggaatgcatcacgtctgcatcga

SEQ ID NO: 33000 - DNA, 25 bp, Mus musculus
gaggaattcctggatccccagggcc

SEQ ID NO: 33001 - DNA, 25 bp, Mus musculus
gaggaattcttgctctgcacagaga

SEQ ID NO: 33002 - DNA, 25 bp, Mus musculus
gaggaattcttggtctgcacagaga

SEQ ID NO: 33003 - DNA, 25 bp, Mus musculus
gaggaattggcatccttaagcaagc

SEQ ID NO: 33004 - DNA, 25 bp, Mus musculus
gaggaattgtgcagtattggcatca

SEQ ID NO: 33005 - DNA, 25 bp, Mus musculus
gaggacaaaatgaaacactgctcca

SEQ ID NO: 33006 - DNA, 25 bp, Mus musculus
gaggacaacctgcaagagtcttcca

SEQ ID NO: 33007 - DNA, 25 bp, Mus musculus
gaggacaacggaccaaaagcgatcg

SEQ ID NO: 33008 - DNA, 25 bp, Mus musculus
gaggacaagcaaaccagacgatgca

SEQ ID NO: 33009 - DNA, 25 bp, Mus musculus
gaggacaagcctcccgttagcaagg

SEQ ID NO: 33010 - DNA, 25 bp, Mus musculus
gaggacacacgctggctgactgatg

SEQ ID NO: 33011 - DNA, 25 bp, Mus musculus
gaggacaccttgagggccttcgctt

SEQ ID NO: 33012 - DNA, 25 bp, Mus musculus
gaggacactaagcagatgatgagta

SEQ ID NO: 33013 - DNA, 25 bp, Mus musculus
gaggacagaccctcatcctcaatag

SEQ ID NO: 33014 - DNA, 25 bp, Mus musculus
gaggacagctttgctagcaagacag

SEQ ID NO: 33015 - DNA, 25 bp, Mus musculus
gaggacaggcacagcatcgacatta

SEQ ID NO: 33016 - DNA, 25 bp, Mus musculus
gaggacagtattccagacagaagga

SEQ ID NO: 33017 - DNA, 25 bp, Mus musculus
gaggacagtattttatgtctacccg

SEQ ID NO: 33018 - DNA, 25 bp, Mus musculus
gaggacataaacaatacgggaaccg

SEQ ID NO: 33019 - DNA, 25 bp, Mus musculus
gaggacatagacagcgatcctcccc

SEQ ID NO: 33020 - DNA, 25 bp, Mus musculus
gaggacatagactgcgatcctcccc

SEQ ID NO: 33021 - DNA, 25 bp, Mus musculus
gaggacatcgcagcgaaagagaagc

SEQ ID NO: 33022 - DNA, 25 bp, Mus musculus
gaggacatctggaagaaattcgagc

SEQ ID NO: 33023 - DNA, 25 bp, Mus musculus
gaggacatgcaggagatcacacaac

SEQ ID NO: 33024 - DNA, 25 bp, Mus musculus
gaggacatgggcaaaatgacctgca

SEQ ID NO: 33025 - DNA, 25 bp, Mus musculus
gaggacatttaaaggtccaggactg

SEQ ID NO: 33026 - DNA, 25 bp, Mus musculus
gaggacatttaagctcgactacagc

SEQ ID NO: 33027 - DNA, 25 bp, Mus musculus
gaggaccacggtggccaaaattctt

SEQ ID NO: 33028 - DNA, 25 bp, Mus musculus
gaggaccagattatccaggctaacc

SEQ ID NO: 33029 - DNA, 25 bp, Mus musculus
gaggaccagcctctttgcccagatc

SEQ ID NO: 33030 - DNA, 25 bp, Mus musculus
gaggaccaggaagtgtgcaagaact

SEQ ID NO: 33031 - DNA, 25 bp, Mus musculus
gaggaccaggaccacaagattttcc

SEQ ID NO: 33032 - DNA, 25 bp, Mus musculus
gaggaccatccccagtaaatacata

SEQ ID NO: 33033 - DNA, 25 bp, Mus musculus
gaggacccattatcagctcatgatg

SEQ ID NO: 33034 - DNA, 25 bp, Mus musculus
gaggaccccgaactgcaatcccttt

SEQ ID NO: 33035 - DNA, 25 bp, Mus musculus
gaggacccgggaagtctgattaaag

SEQ ID NO: 33036 - DNA, 25 bp, Mus musculus
gaggaccgaggtctaacttcagcag

SEQ ID NO: 33037 - DNA, 25 bp, Mus musculus
gaggaccgcacacgtttctatggtg

SEQ ID NO: 33038 - DNA, 25 bp, Mus musculus
gaggaccggaaaatgtatcttcaag

SEQ ID NO: 33039 - DNA, 25 bp, Mus musculus
gaggacctcctgaactggaataacc

SEQ ID NO: 33040 - DNA, 25 bp, Mus musculus
gaggacctctcatcatacttgcaca

SEQ ID NO: 33041 - DNA, 25 bp, Mus musculus
gaggacctgagaagcaaaatacaaa

SEQ ID NO: 33042 - DNA, 25 bp, Mus musculus
gaggacctgcttcatatatgcttga

SEQ ID NO: 33043 - DNA, 25 bp, Mus musculus
gaggacctggaaataattgttgacc

SEQ ID NO: 33044 - DNA, 25 bp, Mus musculus
gaggaccttgcagggactatggaaa

SEQ ID NO: 33045 - DNA, 25 bp, Mus musculus
gaggaccttgttgagcctttcctgc

SEQ ID NO: 33046 - DNA, 25 bp, Mus musculus
gaggacgatccctttgcctctgact

SEQ ID NO: 33047 - DNA, 25 bp, Mus musculus
gaggacgatctctacatagattttg

SEQ ID NO: 33048 - DNA, 25 bp, Mus musculus
gaggacgggaccactgcgtacattc

SEQ ID NO: 33049 - DNA, 25 bp, Mus musculus
gaggacggtgagatctgtttgaaca

SEQ ID NO: 33050 - DNA, 25 bp, Mus musculus
gaggacgttcgtaagttgtgcccac

SEQ ID NO: 33051 - DNA, 25 bp, Mus musculus
gaggactaactcagcccagcataaa

SEQ ID NO: 33052 - DNA, 25 bp, Mus musculus
gaggactaatcaacaaggtcaagtc

SEQ ID NO: 33053 - DNA, 25 bp, Mus musculus
gaggactacagcagaggacaccttg

SEQ ID NO: 33054 - DNA, 25 bp, Mus musculus
gaggactacattccctacccaagtg

SEQ ID NO: 33055 - DNA, 25 bp, Mus musculus
gaggactccatctttcagattctgg

SEQ ID NO: 33056 - DNA, 25 bp, Mus musculus
gaggactcgctgaagaacatgctca

SEQ ID NO: 33057 - DNA, 25 bp, Mus musculus
gaggactctcatgtccacatacaga

SEQ ID NO: 33058 - DNA, 25 bp, Mus musculus
gaggactgcaacgtgcattcggccg

SEQ ID NO: 33059 - DNA, 25 bp, Mus musculus
gaggactgctgtatggactggcatc

SEQ ID NO: 33060 - DNA, 25 bp, Mus musculus
gaggactggatctgctgtgcctgcc

SEQ ID NO: 33061 - DNA, 25 bp, Mus musculus
gaggactggtacaggaaccaccagg

SEQ ID NO: 33062 - DNA, 25 bp, Mus musculus
gaggactgtgccaaagcccacatag

SEQ ID NO: 33063 - DNA, 25 bp, Mus musculus
gaggacttacccatcaaacgcggag

SEQ ID NO: 33064 - DNA, 25 bp, Mus musculus
gaggacttacccttcaaacgcggag

SEQ ID NO: 33065 - DNA, 25 bp, Mus musculus
gaggacttcaagacgacagttctgg

SEQ ID NO: 33066 - DNA, 25 bp, Mus musculus
gaggacttccacaccatagactggc

SEQ ID NO: 33067 - DNA, 25 bp, Mus musculus
gaggacttggacttcttggatggca

SEQ ID NO: 33068 - DNA, 25 bp, Mus musculus
gaggagaaagagacggacaacacca

SEQ ID NO: 33069 - DNA, 25 bp, Mus musculus
gaggagaaatagcaggacctccaga

SEQ ID NO: 33070 - DNA, 25 bp, Mus musculus
gaggagaagacgatgacctcagact

SEQ ID NO: 33071 - DNA, 25 bp, Mus musculus
gaggagaagataagagagaccttgc

SEQ ID NO: 33072 - DNA, 25 bp, Mus musculus
gaggagaatcaagatgctgcagttg

SEQ ID NO: 33073 - DNA, 25 bp, Mus musculus
gaggagaatgttgaagaccattata

SEQ ID NO: 33074 - DNA, 25 bp, Mus musculus
gaggagacccaaaactctttgcagg

SEQ ID NO: 33075 - DNA, 25 bp, Mus musculus
gaggagacgctgtcgtttatccgag

SEQ ID NO: 33076 - DNA, 25 bp, Mus musculus
gaggagacgttcgagctgcagctca

SEQ ID NO: 33077 - DNA, 25 bp, Mus musculus
gaggagactgaccttgccccaagtc

SEQ ID NO: 33078 - DNA, 25 bp, Mus musculus
gaggagagaacactaggcaagtcta

SEQ ID NO: 33079 - DNA, 25 bp, Mus musculus
gaggagagaggtggagggctggtat

SEQ ID NO: 33080 - DNA, 25 bp, Mus musculus
gaggagagctacttcaacagctccc

SEQ ID NO: 33081 - DNA, 25 bp, Mus musculus
gaggagatccagcttgtccctgcct

SEQ ID NO: 33082 - DNA, 25 bp, Mus musculus
gaggagatctcccaccagcaatgcc

SEQ ID NO: 33083 - DNA, 25 bp, Mus musculus
gaggagatgcggctggaggcagaaa

SEQ ID NO: 33084 - DNA, 25 bp, Mus musculus
gaggagattgtctacttgccctgca

SEQ ID NO: 33085 - DNA, 25 bp, Mus musculus
gaggagcacgcagctgaacaagaag

SEQ ID NO: 33086 - DNA, 25 bp, Mus musculus
gaggagcagtcaggttcacaagaaa

SEQ ID NO: 33087 - DNA, 25 bp, Mus musculus
gaggagcatccgagtgtcactcagc

SEQ ID NO: 33088 - DNA, 25 bp, Mus musculus
gaggagccaacagctgaaggatgaa

SEQ ID NO: 33089 - DNA, 25 bp, Mus musculus
gaggagccagcccttggcattgcac

SEQ ID NO: 33090 - DNA, 25 bp, Mus musculus
gaggagccagccgttggcattgcac

SEQ ID NO: 33091 - DNA, 25 bp, Mus musculus
gaggagcccaactccaggtctctga

SEQ ID NO: 33092 - DNA, 25 bp, Mus musculus
gaggagcccagtcccgctaccaaat

SEQ ID NO: 33093 - DNA, 25 bp, Mus musculus
gaggagcccttctagggacagtcaa

SEQ ID NO: 33094 - DNA, 25 bp, Mus musculus
gaggagcccttgttccctgcagatg

SEQ ID NO: 33095 - DNA, 25 bp, Mus musculus
gaggagcctcctgcatgtcctgctg

SEQ ID NO: 33096 - DNA, 25 bp, Mus musculus
gaggagccttacatgcctgtctgtc

SEQ ID NO: 33097 - DNA, 25 bp, Mus musculus
gaggagcgctacatggataacaact

SEQ ID NO: 33098 - DNA, 25 bp, Mus musculus
gaggagcggcttctactctgccagc

SEQ ID NO: 33099 - DNA, 25 bp, Mus musculus
gaggagcggcttgtactctgccagc

SEQ ID NO: 33100 - DNA, 25 bp, Mus musculus
gaggagcgtctttgggttttctgtc

SEQ ID NO: 33101 - DNA, 25 bp, Mus musculus
gaggagctaaacctgcccaagttct

SEQ ID NO: 33102 - DNA, 25 bp, Mus musculus
gaggagctcatcaaagcccagaagg

SEQ ID NO: 33103 - DNA, 25 bp, Mus musculus
gaggagctcctggacaaccgaaaac

SEQ ID NO: 33104 - DNA, 25 bp, Mus musculus
gaggagctgaaaattgttaccaaca

SEQ ID NO: 33105 - DNA, 25 bp, Mus musculus
gaggagctgacactcagacattcag

SEQ ID NO: 33106 - DNA, 25 bp, Mus musculus
gaggagctgacggttcacctttctg

SEQ ID NO: 33107 - DNA, 25 bp, Mus musculus
gaggagctgatccacgactacttgg

SEQ ID NO: 33108 - DNA, 25 bp, Mus musculus
gaggagcttaaacagacgttacaca

SEQ ID NO: 33109 - DNA, 25 bp, Mus musculus
gaggagcttcgaaccatggaccaag

SEQ ID NO: 33110 - DNA, 25 bp, Mus musculus
gaggaggaaggagaccttcttcttt

SEQ ID NO: 33111 - DNA, 25 bp, Mus musculus
gaggaggacacctccctgtcggaga

SEQ ID NO: 33112 - DNA, 25 bp, Mus musculus
gaggaggacatcactaccttcgtca

SEQ ID NO: 33113 - DNA, 25 bp, Mus musculus
gaggaggactacattccctacccaa

SEQ ID NO: 33114 - DNA, 25 bp, Mus musculus
gaggaggagctgaaaattgttacca

SEQ ID NO: 33115 - DNA, 25 bp, Mus musculus
gaggaggagctgacggttcaccttt

SEQ ID NO: 33116 - DNA, 25 bp, Mus musculus
gaggaggccttcactgatggacata

SEQ ID NO: 33117 - DNA, 25 bp, Mus musculus
gaggaggctgcctgattttggattc

SEQ ID NO: 33118 - DNA, 25 bp, Mus musculus
gaggaggcttttcagaccaagctta

SEQ ID NO: 33119 - DNA, 25 bp, Mus musculus
gaggaggttcatcctttgagctgtc

SEQ ID NO: 33120 - DNA, 25 bp, Mus musculus
gaggagtacatcaccaagcttttca

SEQ ID NO: 33121 - DNA, 25 bp, Mus musculus
gaggagtacctagcttttgaccaca

SEQ ID NO: 33122 - DNA, 25 bp, Mus musculus
gaggagtagaaacctttgcccacct

SEQ ID NO: 33123 - DNA, 25 bp, Mus musculus
gaggagtatggctgtcccattctag

SEQ ID NO: 33124 - DNA, 25 bp, Mus musculus
gaggagtcagaaaagcagctgcacc

SEQ ID NO: 33125 - DNA, 25 bp, Mus musculus
gaggagtctcatccctacttccacg

SEQ ID NO: 33126 - DNA, 25 bp, Mus musculus
gaggagtgtcccatatggctctgag

SEQ ID NO: 33127 - DNA, 25 bp, Mus musculus
gaggagttctatgatgcactgtcag

SEQ ID NO: 33128 - DNA, 25 bp, Mus musculus
gaggataaaagcagccctgttgatg

SEQ ID NO: 33129 - DNA, 25 bp, Mus musculus
gaggatacattgtctcttcggagcc

SEQ ID NO: 33130 - DNA, 25 bp, Mus musculus
gaggataccactttagaaccagaag

SEQ ID NO: 33131 - DNA, 25 bp, Mus musculus
gaggatcaaattatgtctttgcaca

SEQ ID NO: 33132 - DNA, 25 bp, Mus musculus
gaggatcaccttacaatttgaactt

SEQ ID NO: 33133 - DNA, 25 bp, Mus musculus
gaggatcagtccagctcattccaaa

SEQ ID NO: 33134 - DNA, 25 bp, Mus musculus
gaggatcattacagaggcagcctct

SEQ ID NO: 33135 - DNA, 25 bp, Mus musculus
gaggatccaaagtgggaattcccca

SEQ ID NO: 33136 - DNA, 25 bp, Mus musculus
gaggatccgcctatttccttcctac

SEQ ID NO: 33137 - DNA, 25 bp, Mus musculus
gaggatccgttttcctgtctgtggc

SEQ ID NO: 33138 - DNA, 25 bp, Mus musculus
gaggatcctaagacgcatccctgca

SEQ ID NO: 33139 - DNA, 25 bp, Mus musculus
gaggatcgttctgggaggaacaaca

SEQ ID NO: 33140 - DNA, 25 bp, Mus musculus
gaggatctgagcgtcatctgtttca

SEQ ID NO: 33141 - DNA, 25 bp, Mus musculus
gaggatctgcagaagcgcctagctg

SEQ ID NO: 33142 - DNA, 25 bp, Mus musculus
gaggatctggtgctttcatcaagaa

SEQ ID NO: 33143 - DNA, 25 bp, Mus musculus
gaggatctgtctacttttcctatcc

SEQ ID NO: 33144 - DNA, 25 bp, Mus musculus
gaggatcttgccagagcaactttga

SEQ ID NO: 33145 - DNA, 25 bp, Mus musculus
gaggatgacctttcgctcatggact

SEQ ID NO: 33146 - DNA, 25 bp, Mus musculus
gaggatgactctaacaagctcggga

SEQ ID NO: 33147 - DNA, 25 bp, Mus musculus
gaggatgatcccgaagctgtctaca

SEQ ID NO: 33148 - DNA, 25 bp, Mus musculus
gaggatgcaagcaactcctatataa

SEQ ID NO: 33149 - DNA, 25 bp, Mus musculus
gaggatgcacagtgtgtgccctgca

SEQ ID NO: 33150 - DNA, 25 bp, Mus musculus
gaggatgcagtgtgccagctgctgg

SEQ ID NO: 33151 - DNA, 25 bp, Mus musculus
gaggatgctgctgagggccttcctt

SEQ ID NO: 33152 - DNA, 25 bp, Mus musculus
gaggatggaagttcctctgtaccag

SEQ ID NO: 33153 - DNA, 25 bp, Mus musculus
gaggatggctcagtacaaatagcag

SEQ ID NO: 33154 - DNA, 25 bp, Mus musculus
gaggatgggctcaagtactacagga

SEQ ID NO: 33155 - DNA, 25 bp, Mus musculus
gaggatggtggtatatcagacagca

SEQ ID NO: 33156 - DNA, 25 bp, Mus musculus
gaggatgtagcactaactgcatatg

SEQ ID NO: 33157 - DNA, 25 bp, Mus musculus
gaggatgtgatgtatctcaccattg

SEQ ID NO: 33158 - DNA, 25 bp, Mus musculus
gaggatgtggaaatggaaccgtcct

SEQ ID NO: 33159 - DNA, 25 bp, Mus musculus
gaggattcacgagtctatgagctga

SEQ ID NO: 33160 - DNA, 25 bp, Mus musculus
gaggattcctcacaacattactacg

SEQ ID NO: 33161 - DNA, 25 bp, Mus musculus
gaggattctgcatttagtgggccgt

SEQ ID NO: 33162 - DNA, 25 bp, Mus musculus
gaggattctggctcggcagctcagc

SEQ ID NO: 33163 - DNA, 25 bp, Mus musculus
gaggattctgttccatgtgaactgc

SEQ ID NO: 33164 - DNA, 25 bp, Mus musculus
gaggattcttgcatttcgagaagga

SEQ ID NO: 33165 - DNA, 25 bp, Mus musculus
gaggattgataatgagcctgcttac

SEQ ID NO: 33166 - DNA, 25 bp, Mus musculus
gaggatttcacagcatacggtggtg

SEQ ID NO: 33167 - DNA, 25 bp, Mus musculus
gaggatttttcagattctagatgga

SEQ ID NO: 33168 - DNA, 25 bp, Mus musculus
gaggatttttcatcaaacaatgtct

SEQ ID NO: 33169 - DNA, 25 bp, Mus musculus
gaggcaaaaggtctggcttccgcaa

SEQ ID NO: 33170 - DNA, 25 bp, Mus musculus
gaggcaaaaggtgtggcttccgcaa

SEQ ID NO: 33171 - DNA, 25 bp, Mus musculus
gaggcaaacactacggcatcaagaa

SEQ ID NO: 33172 - DNA, 25 bp, Mus musculus
gaggcaaatccgtagctctgctgca

SEQ ID NO: 33173 - DNA, 25 bp, Mus musculus
gaggcaaattcgacttctccgggaa

SEQ ID NO: 33174 - DNA, 25 bp, Mus musculus
gaggcaacacatctcagtctgctga

SEQ ID NO: 33175 - DNA, 25 bp, Mus musculus
gaggcaacacatgtcagtctgctga

SEQ ID NO: 33176 - DNA, 25 bp, Mus musculus
gaggcaagagacagatttctaccag

SEQ ID NO: 33177 - DNA, 25 bp, Mus musculus
gaggcaagccaagtgatcattaata

SEQ ID NO: 33178 - DNA, 25 bp, Mus musculus
gaggcaagtgtttaactggactcac

SEQ ID NO: 33179 - DNA, 25 bp, Mus musculus
gaggcaatataacaaccccattggc

SEQ ID NO: 33180 - DNA, 25 bp, Mus musculus
gaggcacagaaaatcttcaaagcca

SEQ ID NO: 33181 - DNA, 25 bp, Mus musculus
gaggcacagtacataaagctgtacc

SEQ ID NO: 33182 - DNA, 25 bp, Mus musculus
gaggcacatggatgcagtgagaaca

SEQ ID NO: 33183 - DNA, 25 bp, Mus musculus
gaggcaccaagaatagagatgtccc

SEQ ID NO: 33184 - DNA, 25 bp, Mus musculus
gaggcacctctttgtggcaaaacat

SEQ ID NO: 33185 - DNA, 25 bp, Mus musculus
gaggcacgtgctgtctctagggctc

SEQ ID NO: 33186 - DNA, 25 bp, Mus musculus
gaggcactgggccacacaaagcctt

SEQ ID NO: 33187 - DNA, 25 bp, Mus musculus
gaggcagaatacagagaaagctctg

SEQ ID NO: 33188 - DNA, 25 bp, Mus musculus
gaggcagagacgttaatgaaagatg

SEQ ID NO: 33189 - DNA, 25 bp, Mus musculus
gaggcagagagccatatagtatttc

SEQ ID NO: 33190 - DNA, 25 bp, Mus musculus
gaggcagagcttccgactataaatc

SEQ ID NO: 33191 - DNA, 25 bp, Mus musculus
gaggcagagtttgtccaacaagaac

SEQ ID NO: 33192 - DNA, 25 bp, Mus musculus
gaggcagccaggatttaataaacaa

SEQ ID NO: 33193 - DNA, 25 bp, Mus musculus
gaggcagccgggatgacacttctcc

SEQ ID NO: 33194 - DNA, 25 bp, Mus musculus
gaggcagctaccagagagaaattaa

SEQ ID NO: 33195 - DNA, 25 bp, Mus musculus
gaggcagctgaagcagagcacgtgt

SEQ ID NO: 33196 - DNA, 25 bp, Mus musculus
gaggcagtgaaatccatgtttcaca

SEQ ID NO: 33197 - DNA, 25 bp, Mus musculus
gaggcagttcaagttgaatcattga

SEQ ID NO: 33198 - DNA, 25 bp, Mus musculus
gaggcagttcgcctgtatcgcaaag

SEQ ID NO: 33199 - DNA, 25 bp, Mus musculus
gaggcagttctgcactactcaggcc

SEQ ID NO: 33200 - DNA, 25 bp, Mus musculus
gaggcatcaaggtcagagatcaaaa

SEQ ID NO: 33201 - DNA, 25 bp, Mus musculus
gaggcatctagcaggacccctgctc

SEQ ID NO: 33202 - DNA, 25 bp, Mus musculus
gaggcatgagcaccagcagttttcc

SEQ ID NO: 33203 - DNA, 25 bp, Mus musculus
gaggcatgcttgtgtggtctcctta

SEQ ID NO: 33204 - DNA, 25 bp, Mus musculus
gaggcatgggaagggtcctactatc

SEQ ID NO: 33205 - DNA, 25 bp, Mus musculus
gaggcattagatcccctgaaatgga

SEQ ID NO: 33206 - DNA, 25 bp, Mus musculus
gaggcattagatgccctgaaatgga

SEQ ID NO: 33207 - DNA, 25 bp, Mus musculus
gaggcattcgacttcctaacggaaa

SEQ ID NO: 33208 - DNA, 25 bp, Mus musculus
gaggcattgaatcccatgtgagcca

SEQ ID NO: 33209 - DNA, 25 bp, Mus musculus
gaggcattgatttcccagctgaccc

SEQ ID NO: 33210 - DNA, 25 bp, Mus musculus
gaggcattggcattcaggtcattca

SEQ ID NO: 33211 - DNA, 25 bp, Mus musculus
gaggcatttctcgacctatggagca

SEQ ID NO: 33212 - DNA, 25 bp, Mus musculus
gaggcattttggagcagagtacaaa

SEQ ID NO: 33213 - DNA, 25 bp, Mus musculus
gaggccaaaaaacattgctggtatt

SEQ ID NO: 33214 - DNA, 25 bp, Mus musculus
gaggccacaagcaatgatccctggg

SEQ ID NO: 33215 - DNA, 25 bp, Mus musculus
gaggccacgccatgaagattctcct

SEQ ID NO: 33216 - DNA, 25 bp, Mus musculus
gaggccactgttaccaagtccctgg

SEQ ID NO: 33217 - DNA, 25 bp, Mus musculus
gaggccacttgcaaatctctggaag

SEQ ID NO: 33218 - DNA, 25 bp, Mus musculus
gaggccagacaagagcactgaatct

SEQ ID NO: 33219 - DNA, 25 bp, Mus musculus
gaggccagctttgagaaggagtcaa

SEQ ID NO: 33220 - DNA, 25 bp, Mus musculus
gaggccaggtgggtggagacgtcaa

SEQ ID NO: 33221 - DNA, 25 bp, Mus musculus
gaggccagtgcacctttgacccaat

SEQ ID NO: 33222 - DNA, 25 bp, Mus musculus
gaggccagtggtggacatacagcac

SEQ ID NO: 33223 - DNA, 25 bp, Mus musculus
gaggccataatcaatcctaccaatg

SEQ ID NO: 33224 - DNA, 25 bp, Mus musculus
gaggccataccctgtgtatgttgtg

SEQ ID NO: 33225 - DNA, 25 bp, Mus musculus
gaggccatcaactcacagttgacag

SEQ ID NO: 33226 - DNA, 25 bp, Mus musculus
gaggccatcccaatcctgagggctg

SEQ ID NO: 33227 - DNA, 25 bp, Mus musculus
gaggccatctatggccctggtagtg

SEQ ID NO: 33228 - DNA, 25 bp, Mus musculus
gaggccatgacaccgttttctccct

SEQ ID NO: 33229 - DNA, 25 bp, Mus musculus
gaggccatgcatatcttaaggaatg

SEQ ID NO: 33230 - DNA, 25 bp, Mus musculus
gaggccatgctgaagcaacgggact

SEQ ID NO: 33231 - DNA, 25 bp, Mus musculus
gaggccattgggtaacaacagaaga

SEQ ID NO: 33232 - DNA, 25 bp, Mus musculus
gaggcccaagctggagaaacggccc

SEQ ID NO: 33233 - DNA, 25 bp, Mus musculus
gaggcccagagaactttcctcatct

SEQ ID NO: 33234 - DNA, 25 bp, Mus musculus
gaggccccgagagtacagtgacttc

SEQ ID NO: 33235 - DNA, 25 bp, Mus musculus
gaggccccgtccctcattcaatgaa

SEQ ID NO: 33236 - DNA, 25 bp, Mus musculus
gaggcccgagtacacctgggacata

SEQ ID NO: 33237 - DNA, 25 bp, Mus musculus
gaggcccggatatgccgacttatga

SEQ ID NO: 33238 - DNA, 25 bp, Mus musculus
gaggcccttcaagtggctctacaag

SEQ ID NO: 33239 - DNA, 25 bp, Mus musculus
gaggccgaaaagagagaaacatccg

SEQ ID NO: 33240 - DNA, 25 bp, Mus musculus
gaggccgaggccactcagatgactt

SEQ ID NO: 33241 - DNA, 25 bp, Mus musculus
gaggccgattcctgactgccacctg

SEQ ID NO: 33242 - DNA, 25 bp, Mus musculus
gaggcctatccaagctgagccacag

SEQ ID NO: 33243 - DNA, 25 bp, Mus musculus
gaggcctatccatgctgagccacag

SEQ ID NO: 33244 - DNA, 25 bp, Mus musculus
gaggcctatgaagtactatctgaca

SEQ ID NO: 33245 - DNA, 25 bp, Mus musculus
gaggcctatgagatggctgtgcaag

SEQ ID NO: 33246 - DNA, 25 bp, Mus musculus
gaggcctcaagagtttccggacatc

SEQ ID NO: 33247 - DNA, 25 bp, Mus musculus
gaggcctgcggccacacttgcttat

SEQ ID NO: 33248 - DNA, 25 bp, Mus musculus
gaggcctgcttctcaggtgtttcta

SEQ ID NO: 33249 - DNA, 25 bp, Mus musculus
gaggcctgtcagaacagattcggga

SEQ ID NO: 33250 - DNA, 25 bp, Mus musculus
gaggcctgtccctcagcagatttag

SEQ ID NO: 33251 - DNA, 25 bp, Mus musculus
gaggccttcactgatggacatatag

SEQ ID NO: 33252 - DNA, 25 bp, Mus musculus
gaggccttcatttcatcacgtcttg

SEQ ID NO: 33253 - DNA, 25 bp, Mus musculus
gaggccttctctctaacagccaaag

SEQ ID NO: 33254 - DNA, 25 bp, Mus musculus
gaggccttctggattctatcactaa

SEQ ID NO: 33255 - DNA, 25 bp, Mus musculus
gaggccttgaagtctgaattccggc

SEQ ID NO: 33256 - DNA, 25 bp, Mus musculus
gaggccttgatgtcaagtgcttagc

SEQ ID NO: 33257 - DNA, 25 bp, Mus musculus
gaggcctttaagttatagaacatca

SEQ ID NO: 33258 - DNA, 25 bp, Mus musculus
gaggcctttgaagatctggctctct

SEQ ID NO: 33259 - DNA, 25 bp, Mus musculus
gaggcctttttccaatgccaagtct

SEQ ID NO: 33260 - DNA, 25 bp, Mus musculus
gaggcgaggtttcactcagtaagtt

SEQ ID NO: 33261 - DNA, 25 bp, Mus musculus
gaggcgctaggaagttcaaacacca

SEQ ID NO: 33262 - DNA, 25 bp, Mus musculus
gaggcgctctagcagctccagttcc

SEQ ID NO: 33263 - DNA, 25 bp, Mus musculus
gaggcgctgctagaaaacccaaaga

SEQ ID NO: 33264 - DNA, 25 bp, Mus musculus
gaggcgcttcattcagtcctgtccc

SEQ ID NO: 33265 - DNA, 25 bp, Mus musculus
gaggcgggcgtgacgctcatctctc

SEQ ID NO: 33266 - DNA, 25 bp, Mus musculus
gaggcgttgctgtccctggccatgc

SEQ ID NO: 33267 - DNA, 25 bp, Mus musculus
gaggcgtttctcactcatgacgctg

SEQ ID NO: 33268 - DNA, 25 bp, Mus musculus
gaggctaagggctgtgccatccata

SEQ ID NO: 33269 - DNA, 25 bp, Mus musculus
gaggctacagtagatattacagtca

SEQ ID NO: 33270 - DNA, 25 bp, Mus musculus
gaggctaccctgaatctcctaagca

SEQ ID NO: 33271 - DNA, 25 bp, Mus musculus
gaggctaccctgtatctcctaagca

SEQ ID NO: 33272 - DNA, 25 bp, Mus musculus
gaggctaccttcttctaaagccatt

SEQ ID NO: 33273 - DNA, 25 bp, Mus musculus
gaggctacgaggttgctggctgaga

SEQ ID NO: 33274 - DNA, 25 bp, Mus musculus
gaggctaggaataagcacgctattg

SEQ ID NO: 33275 - DNA, 25 bp, Mus musculus
gaggctaggaccgactggctgtcat

SEQ ID NO: 33276 - DNA, 25 bp, Mus musculus
gaggctcacgcaccatgtggctttg

SEQ ID NO: 33277 - DNA, 25 bp, Mus musculus
gaggctcagacctggatgcagtcct

SEQ ID NO: 33278 - DNA, 25 bp, Mus musculus
gaggctcagcaatgaaggcttccag

SEQ ID NO: 33279 - DNA, 25 bp, Mus musculus
gaggctcaggcatccagtgggactt

SEQ ID NO: 33280 - DNA, 25 bp, Mus musculus
gaggctcatagctccagtgccagga

SEQ ID NO: 33281 - DNA, 25 bp, Mus musculus
gaggctcattttccctgtacagcag

SEQ ID NO: 33282 - DNA, 25 bp, Mus musculus
gaggctccaagaatataggacagca

SEQ ID NO: 33283 - DNA, 25 bp, Mus musculus
gaggctccccagctgtgactctagt

SEQ ID NO: 33284 - DNA, 25 bp, Mus musculus
gaggctcccgagagtcctcacacag

SEQ ID NO: 33285 - DNA, 25 bp, Mus musculus
gaggctccctttggatgccagtgtg

SEQ ID NO: 33286 - DNA, 25 bp, Mus musculus
gaggctccgtgctcttctcgctgcg

SEQ ID NO: 33287 - DNA, 25 bp, Mus musculus
gaggctcctagctgagcacccgcca

SEQ ID NO: 33288 - DNA, 25 bp, Mus musculus
gaggctcctcccaccaagtggagta

SEQ ID NO: 33289 - DNA, 25 bp, Mus musculus
gaggctcctgtcaggctcctgtcct

SEQ ID NO: 33290 - DNA, 25 bp, Mus musculus
gaggctcctgtctggctcctgtcct

SEQ ID NO: 33291 - DNA, 25 bp, Mus musculus
gaggctccttaaagatatgttcaaa

SEQ ID NO: 33292 - DNA, 25 bp, Mus musculus
gaggctcgtatgagtcatgacttga

SEQ ID NO: 33293 - DNA, 25 bp, Mus musculus
gaggctcgtatgtgtcatgacttga

SEQ ID NO: 33294 - DNA, 25 bp, Mus musculus
gaggctctataggactgccaatgaa

SEQ ID NO: 33295 - DNA, 25 bp, Mus musculus
gaggctctccacaccaaagccgtat

SEQ ID NO: 33296 - DNA, 25 bp, Mus musculus
gaggctctctcagtgtctgcatcag

SEQ ID NO: 33297 - DNA, 25 bp, Mus musculus
gaggctctctggagaatcatgagga

SEQ ID NO: 33298 - DNA, 25 bp, Mus musculus
gaggctctgacagtctataacctga

SEQ ID NO: 33299 - DNA, 25 bp, Mus musculus
gaggctctgcaaagagggaccagca

SEQ ID NO: 33300 - DNA, 25 bp, Mus musculus
gaggctctgcctgtaaacctactca

SEQ ID NO: 33301 - DNA, 25 bp, Mus musculus
gaggctgaacggatgtccgcccagt

SEQ ID NO: 33302 - DNA, 25 bp, Mus musculus
gaggctgacattagcaagctggtcc

SEQ ID NO: 33303 - DNA, 25 bp, Mus musculus
gaggctgcaacttttgttctttgta

SEQ ID NO: 33304 - DNA, 25 bp, Mus musculus
gaggctgcaccacatgcacatctac

SEQ ID NO: 33305 - DNA, 25 bp, Mus musculus
gaggctgcacgattgcgcttcaggc

SEQ ID NO: 33306 - DNA, 25 bp, Mus musculus
gaggctgcctgattttggattctca

SEQ ID NO: 33307 - DNA, 25 bp, Mus musculus
gaggctggacaagtatgctgcaagt

SEQ ID NO: 33308 - DNA, 25 bp, Mus musculus
gaggctggagagaaatcgtgtttta

SEQ ID NO: 33309 - DNA, 25 bp, Mus musculus
gaggctggctacttcaatgaggaga

SEQ ID NO: 33310 - DNA, 25 bp, Mus musculus
gaggctgggaactactggtttgaca

SEQ ID NO: 33311 - DNA, 25 bp, Mus musculus
gaggctgtaatatgcttcttctctg

SEQ ID NO: 33312 - DNA, 25 bp, Mus musculus
gaggctgtacagaacatggtgtccc

SEQ ID NO: 33313 - DNA, 25 bp, Mus musculus
gaggctgtacatccgcagcaatcca

SEQ ID NO: 33314 - DNA, 25 bp, Mus musculus
gaggctgtgatgactctacgctcac

SEQ ID NO: 33315 - DNA, 25 bp, Mus musculus
gaggctgtgctacactgccatcaga

SEQ ID NO: 33316 - DNA, 25 bp, Mus musculus
gaggcttacataaaccgagcgtcct

SEQ ID NO: 33317 - DNA, 25 bp, Mus musculus
gaggcttatcttaaaatgaccacaa

SEQ ID NO: 33318 - DNA, 25 bp, Mus musculus
gaggcttcacctgtgcctttctctg

SEQ ID NO: 33319 - DNA, 25 bp, Mus musculus
gaggcttcccagtggcacaggctga

SEQ ID NO: 33320 - DNA, 25 bp, Mus musculus
gaggcttctctcaacctcaatgcca

SEQ ID NO: 33321 - DNA, 25 bp, Mus musculus
gaggcttgaataccataacttctta

SEQ ID NO: 33322 - DNA, 25 bp, Mus musculus
gaggcttgccttctgtctgtcccat

SEQ ID NO: 33323 - DNA, 25 bp, Mus musculus
gaggcttgtcataagctctggcgcc

SEQ ID NO: 33324 - DNA, 25 bp, Mus musculus
gaggcttgtcattagctctggcgcc

SEQ ID NO: 33325 - DNA, 25 bp, Mus musculus
gaggctttggccatgcttccacagg

SEQ ID NO: 33326 - DNA, 25 bp, Mus musculus
gaggcttttcagaccaagcttatcc

SEQ ID NO: 33327 - DNA, 25 bp, Mus musculus
gagggaaaccacagtagtctgggac

SEQ ID NO: 33328 - DNA, 25 bp, Mus musculus
gagggaaagtacatcatccacatgc

SEQ ID NO: 33329 - DNA, 25 bp, Mus musculus
gagggaaatcactgtcaaatcagac

SEQ ID NO: 33330 - DNA, 25 bp, Mus musculus
gagggaacaaccaggctgcaggatt

SEQ ID NO: 33331 - DNA, 25 bp, Mus musculus
gagggaacatgtggaagtatgtccc

SEQ ID NO: 33332 - DNA, 25 bp, Mus musculus
gagggaaccagcttcaagaatttgc

SEQ ID NO: 33333 - DNA, 25 bp, Mus musculus
gagggaacgacacattctgcagcag

SEQ ID NO: 33334 - DNA, 25 bp, Mus musculus
gagggaactcatcggcatgttgtct

SEQ ID NO: 33335 - DNA, 25 bp, Mus musculus
gagggaactcatgggcatgttgtct

SEQ ID NO: 33336 - DNA, 25 bp, Mus musculus
gagggaactttctcaagtgctgacc

SEQ ID NO: 33337 - DNA, 25 bp, Mus musculus
gagggaagccaatgttgatgccgcc

SEQ ID NO: 33338 - DNA, 25 bp, Mus musculus
gagggaaggactgtaagaaaatcat

SEQ ID NO: 33339 - DNA, 25 bp, Mus musculus
gagggaatcttgacttcctcaagcc

SEQ ID NO: 33340 - DNA, 25 bp, Mus musculus
gagggacactatacagccaaggcgg

SEQ ID NO: 33341 - DNA, 25 bp, Mus musculus
gagggacagccccaatgttgaagct

SEQ ID NO: 33342 - DNA, 25 bp, Mus musculus
gagggaccgcctgctcaaattgaaa

SEQ ID NO: 33343 - DNA, 25 bp, Mus musculus
gagggacgaacacgtctggctctca

SEQ ID NO: 33344 - DNA, 25 bp, Mus musculus
gagggacgaacaggtctggctctca

SEQ ID NO: 33345 - DNA, 25 bp, Mus musculus
gagggactatgcatacagctgtgac

SEQ ID NO: 33346 - DNA, 25 bp, Mus musculus
gagggagaagcaagcctatttaaga

SEQ ID NO: 33347 - DNA, 25 bp, Mus musculus
gagggagctgtgaagcctccagcaa

SEQ ID NO: 33348 - DNA, 25 bp, Mus musculus
gagggagtcccagaaagaaccatgc

SEQ ID NO: 33349 - DNA, 25 bp, Mus musculus
gagggatacaccttcactgtatcca

SEQ ID NO: 33350 - DNA, 25 bp, Mus musculus
gagggatccgaacaagctcagaatg

SEQ ID NO: 33351 - DNA, 25 bp, Mus musculus
gagggatgaaagttcctactaggga

SEQ ID NO: 33352 - DNA, 25 bp, Mus musculus
gagggcaataggttagcgacgtttc

SEQ ID NO: 33353 - DNA, 25 bp, Mus musculus
gagggcacctttccaactaccagta

SEQ ID NO: 33354 - DNA, 25 bp, Mus musculus
gagggcactctgcagctagctaacc

SEQ ID NO: 33355 - DNA, 25 bp, Mus musculus
gagggcatcgccagcgagttttatg

SEQ ID NO: 33356 - DNA, 25 bp, Mus musculus
gagggcatgaaccagaaccagagca

SEQ ID NO: 33357 - DNA, 25 bp, Mus musculus
gagggccaagatgtcctgctgttta

SEQ ID NO: 33358 - DNA, 25 bp, Mus musculus
gagggccagctctgcgatctggacc

SEQ ID NO: 33359 - DNA, 25 bp, Mus musculus
gagggccattgagacactcatcaag

SEQ ID NO: 33360 - DNA, 25 bp, Mus musculus
gagggcccagagactgaccttgaag

SEQ ID NO: 33361 - DNA, 25 bp, Mus musculus
gagggcctacagcaacctgggcaat

SEQ ID NO: 33362 - DNA, 25 bp, Mus musculus
gagggcctcaagtgctgttttgtga

SEQ ID NO: 33363 - DNA, 25 bp, Mus musculus
gagggcctttcggaagcttcttata

SEQ ID NO: 33364 - DNA, 25 bp, Mus musculus
gagggcgaccgatgctaccccgatg

SEQ ID NO: 33365 - DNA, 25 bp, Mus musculus
gagggcgcgagtgctcaaactcaag

SEQ ID NO: 33366 - DNA, 25 bp, Mus musculus
gagggctatctatcatagtttggga

SEQ ID NO: 33367 - DNA, 25 bp, Mus musculus
gagggctccttttggctttcgcaga

SEQ ID NO: 33368 - DNA, 25 bp, Mus musculus
gagggctggccactccagtgcctat

SEQ ID NO: 33369 - DNA, 25 bp, Mus musculus
gagggcttcatggatccgccttgat

SEQ ID NO: 33370 - DNA, 25 bp, Mus musculus
gagggcttcattaccgggctcctgg

SEQ ID NO: 33371 - DNA, 25 bp, Mus musculus
gagggcttccagaaacccagcccta

SEQ ID NO: 33372 - DNA, 25 bp, Mus musculus
gagggcttccggcagcttgaccctc

SEQ ID NO: 33373 - DNA, 25 bp, Mus musculus
gagggctttgaggaaccttacccag

SEQ ID NO: 33374 - DNA, 25 bp, Mus musculus
gagggctttggtttgagagcaacaa

SEQ ID NO: 33375 - DNA, 25 bp, Mus musculus
gagggtacagacctgcataagatcc

SEQ ID NO: 33376 - DNA, 25 bp, Mus musculus
gagggtatcatctttggtggccgta

SEQ ID NO: 33377 - DNA, 25 bp, Mus musculus
gagggtcacaggaagctgatagatt

SEQ ID NO: 33378 - DNA, 25 bp, Mus musculus
gagggtccactaagactctcacctt

SEQ ID NO: 33379 - DNA, 25 bp, Mus musculus
gagggtccagtgctttcaagctccc

SEQ ID NO: 33380 - DNA, 25 bp, Mus musculus
gagggtcctttcaacattgagtccg

SEQ ID NO: 33381 - DNA, 25 bp, Mus musculus
gagggtcctttctacattgagtccg

SEQ ID NO: 33382 - DNA, 25 bp, Mus musculus
gagggtctcctgattgcttcagaag

SEQ ID NO: 33383 - DNA, 25 bp, Mus musculus
gagggtctctttggctactgagttg

SEQ ID NO: 33384 - DNA, 25 bp, Mus musculus
gagggtgaatcagacccttcctgac

SEQ ID NO: 33385 - DNA, 25 bp, Mus musculus
gagggtgccccatcttggcttcaag

SEQ ID NO: 33386 - DNA, 25 bp, Mus musculus
gagggttaaggagctctccatccag

SEQ ID NO: 33387 - DNA, 25 bp, Mus musculus
gagggttacaccatctacaagacgc

SEQ ID NO: 33388 - DNA, 25 bp, Mus musculus
gagggttcccaacaccaagacattt

SEQ ID NO: 33389 - DNA, 25 bp, Mus musculus
gagggttgagacaactgttgcaagc

SEQ ID NO: 33390 - DNA, 25 bp, Mus musculus
gagggtttcatcaatggcacatatg

SEQ ID NO: 33391 - DNA, 25 bp, Mus musculus
gaggtaacagctagcagtcgccact

SEQ ID NO: 33392 - DNA, 25 bp, Mus musculus
gaggtaacatggtgatagctcccaa

SEQ ID NO: 33393 - DNA, 25 bp, Mus musculus
gaggtaatcctgtaaggtgtgatca

SEQ ID NO: 33394 - DNA, 25 bp, Mus musculus
gaggtacaatgagctctcttacaag

SEQ ID NO: 33395 - DNA, 25 bp, Mus musculus
gaggtacacttttgcaccaagcgcc

SEQ ID NO: 33396 - DNA, 25 bp, Mus musculus
gaggtactactacatcttccagtag

SEQ ID NO: 33397 - DNA, 25 bp, Mus musculus
gaggtactactagatcttccagtag

SEQ ID NO: 33398 - DNA, 25 bp, Mus musculus
gaggtactctctgtatgaggacaaa

SEQ ID NO: 33399 - DNA, 25 bp, Mus musculus
gaggtactggctttgcaggcaagcc

SEQ ID NO: 33400 - DNA, 25 bp, Mus musculus
gaggtagaacctttgtgcagactgt

SEQ ID NO: 33401 - DNA, 25 bp, Mus musculus
gaggtagaagaagaagggatacaca

SEQ ID NO: 33402 - DNA, 25 bp, Mus musculus
gaggtagaatcttttgcgagacaga

SEQ ID NO: 33403 - DNA, 25 bp, Mus musculus
gaggtagacacacagagcaaccaca

SEQ ID NO: 33404 - DNA, 25 bp, Mus musculus
gaggtagacgacattgatgaagaag

SEQ ID NO: 33405 - DNA, 25 bp, Mus musculus
gaggtagattgtgatgtcatagatg

SEQ ID NO: 33406 - DNA, 25 bp, Mus musculus
gaggtagcagcagttctaagacacc

SEQ ID NO: 33407 - DNA, 25 bp, Mus musculus
gaggtagccatggtgacaagcagac

SEQ ID NO: 33408 - DNA, 25 bp, Mus musculus
gaggtatactacctaattcgttcta

SEQ ID NO: 33409 - DNA, 25 bp, Mus musculus
gaggtatactacgtaattcgttcta

SEQ ID NO: 33410 - DNA, 25 bp, Mus musculus
gaggtattgcctatattcagcagaa

SEQ ID NO: 33411 - DNA, 25 bp, Mus musculus
gaggtcaaccttttctgagtctacc

SEQ ID NO: 33412 - DNA, 25 bp, Mus musculus
gaggtcacaagtggcccataacagt

SEQ ID NO: 33413 - DNA, 25 bp, Mus musculus
gaggtcacagtacctacctcaaatg

SEQ ID NO: 33414 - DNA, 25 bp, Mus musculus
gaggtcagctaccaaagcctttcgc

SEQ ID NO: 33415 - DNA, 25 bp, Mus musculus
gaggtccacagaatcctccatgacg

SEQ ID NO: 33416 - DNA, 25 bp, Mus musculus
gaggtccatctacggaagccgcttt

SEQ ID NO: 33417 - DNA, 25 bp, Mus musculus
gaggtcccaggtaattgagaaattt

SEQ ID NO: 33418 - DNA, 25 bp, Mus musculus
gaggtcctacaggaacaccagggaa

SEQ ID NO: 33419 - DNA, 25 bp, Mus musculus
gaggtcctccctaatctactcaaag

SEQ ID NO: 33420 - DNA, 25 bp, Mus musculus
gaggtcctgcctatgaccagcaaga

SEQ ID NO: 33421 - DNA, 25 bp, Mus musculus
gaggtccttccacagaagcgtccct

SEQ ID NO: 33422 - DNA, 25 bp, Mus musculus
gaggtctattccctacaccccaagg

SEQ ID NO: 33423 - DNA, 25 bp, Mus musculus
gaggtctctgacaatgagctccaag

SEQ ID NO: 33424 - DNA, 25 bp, Mus musculus
gaggtctgtttttccggtgcctgct

SEQ ID NO: 33425 - DNA, 25 bp, Mus musculus
gaggtgaaacgaaaaacgcaccgtg

SEQ ID NO: 33426 - DNA, 25 bp, Mus musculus
gaggtgaactgcctcaccaagatcc

SEQ ID NO: 33427 - DNA, 25 bp, Mus musculus
gaggtgacagccttgaagacattgg

SEQ ID NO: 33428 - DNA, 25 bp, Mus musculus
gaggtgaccctgacagtgaagccga

SEQ ID NO: 33429 - DNA, 25 bp, Mus musculus
gaggtgactttcatctatcagaaac

SEQ ID NO: 33430 - DNA, 25 bp, Mus musculus
gaggtgagacatccgaaatgtatct

SEQ ID NO: 33431 - DNA, 25 bp, Mus musculus
gaggtgataagaggacaagcaaacc

SEQ ID NO: 33432 - DNA, 25 bp, Mus musculus
gaggtgatagcatccctgggctgca

SEQ ID NO: 33433 - DNA, 25 bp, Mus musculus
gaggtgcaagagatccctggagacc

SEQ ID NO: 33434 - DNA, 25 bp, Mus musculus
gaggtgcacacagctcagacgaaac

SEQ ID NO: 33435 - DNA, 25 bp, Mus musculus
gaggtgcagccctgattgcggatta

SEQ ID NO: 33436 - DNA, 25 bp, Mus musculus
gaggtgccagctacacccaaacatg

SEQ ID NO: 33437 - DNA, 25 bp, Mus musculus
gaggtgccccatcttgaccttgatg

SEQ ID NO: 33438 - DNA, 25 bp, Mus musculus
gaggtgctgaccctgttcaatgtga

SEQ ID NO: 33439 - DNA, 25 bp, Mus musculus
gaggtgctgcagaacatgctggacc

SEQ ID NO: 33440 - DNA, 25 bp, Mus musculus
gaggtgctgttctccactcagagcc

SEQ ID NO: 33441 - DNA, 25 bp, Mus musculus
gaggtgcttcatctacggaatgtct

SEQ ID NO: 33442 - DNA, 25 bp, Mus musculus
gaggtggaggccataatcaatccta

SEQ ID NO: 33443 - DNA, 25 bp, Mus musculus
gaggtggataccatctacgtccatg

SEQ ID NO: 33444 - DNA, 25 bp, Mus musculus
gaggtggatccattggtttataaca

SEQ ID NO: 33445 - DNA, 25 bp, Mus musculus
gaggtggatctctatactgccaaag

SEQ ID NO: 33446 - DNA, 25 bp, Mus musculus
gaggtggattatttctacagaggca

SEQ ID NO: 33447 - DNA, 25 bp, Mus musculus
gaggtggcactttttcgtataaggc

SEQ ID NO: 33448 - DNA, 25 bp, Mus musculus
gaggtggccacctagtggagttaac

SEQ ID NO: 33449 - DNA, 25 bp, Mus musculus
gaggtggccttgattgcttcgtcct

SEQ ID NO: 33450 - DNA, 25 bp, Mus musculus
gaggtggctggcgacatctttgaca

SEQ ID NO: 33451 - DNA, 25 bp, Mus musculus
gaggtggtagttctaagtttgtaca

SEQ ID NO: 33452 - DNA, 25 bp, Mus musculus
gaggtggtagttgtaagtttgtaca

SEQ ID NO: 33453 - DNA, 25 bp, Mus musculus
gaggtgtctgccactccctgtggga

SEQ ID NO: 33454 - DNA, 25 bp, Mus musculus
gaggtgtggacctccgatatacagt

SEQ ID NO: 33455 - DNA, 25 bp, Mus musculus
gaggtgtgtactttgcgtactcagt

SEQ ID NO: 33456 - DNA, 25 bp, Mus musculus
gaggtgttcagtgtcttagtgcaga

SEQ ID NO: 33457 - DNA, 25 bp, Mus musculus
gaggtgttccgccttcctacagatg

SEQ ID NO: 33458 - DNA, 25 bp, Mus musculus
gaggttaaacactcgggaatgcacc

SEQ ID NO: 33459 - DNA, 25 bp, Mus musculus
gaggttaatgcagtccagtttgcca

SEQ ID NO: 33460 - DNA, 25 bp, Mus musculus
gaggttactttggagtttcttctgg

SEQ ID NO: 33461 - DNA, 25 bp, Mus musculus
gaggttatgaccatcctgtgtcgct

SEQ ID NO: 33462 - DNA, 25 bp, Mus musculus
gaggttccaggcacgcacagccact

SEQ ID NO: 33463 - DNA, 25 bp, Mus musculus
gaggttcccctgagaaaatattgac

SEQ ID NO: 33464 - DNA, 25 bp, Mus musculus
gaggttctcatgactccaccctgtg

SEQ ID NO: 33465 - DNA, 25 bp, Mus musculus
gaggttctctatattcggaatgtaa

SEQ ID NO: 33466 - DNA, 25 bp, Mus musculus
gaggttctctgtacaagagataccc

SEQ ID NO: 33467 - DNA, 25 bp, Mus musculus
gaggttctgtaccaatgagtcccag

SEQ ID NO: 33468 - DNA, 25 bp, Mus musculus
gaggttcttcagataactctattga

SEQ ID NO: 33469 - DNA, 25 bp, Mus musculus
gaggttgacctggatgaacttgtcc

SEQ ID NO: 33470 - DNA, 25 bp, Mus musculus
gaggttggcgagagtcatgtattac

SEQ ID NO: 33471 - DNA, 25 bp, Mus musculus
gaggttggctgaaacccatcatgcc

SEQ ID NO: 33472 - DNA, 25 bp, Mus musculus
gaggtttacctctgattcctatcca

SEQ ID NO: 33473 - DNA, 25 bp, Mus musculus
gaggtttcaggatcagagtcgttta

SEQ ID NO: 33474 - DNA, 25 bp, Mus musculus
gaggtttggctctggcaccacagaa

SEQ ID NO: 33475 - DNA, 25 bp, Mus musculus
gaggttttatcttaccctgccagag

SEQ ID NO: 33476 - DNA, 25 bp, Mus musculus
gagtaaatccacattcttggatgcc

SEQ ID NO: 33477 - DNA, 25 bp, Mus musculus
gagtaaatgacgtgccactgcactg

SEQ ID NO: 33478 - DNA, 25 bp, Mus musculus
gagtaaatgttacccaaaagattca

SEQ ID NO: 33479 - DNA, 25 bp, Mus musculus
gagtaacaccaatgtgaccagcagt

SEQ ID NO: 33480 - DNA, 25 bp, Mus musculus
gagtaacgagttgggatatccccga

SEQ ID NO: 33481 - DNA, 25 bp, Mus musculus
gagtaacgcagcagctgtcatcttt

SEQ ID NO: 33482 - DNA, 25 bp, Mus musculus
gagtaactgtgaggtgcctcggccc

SEQ ID NO: 33483 - DNA, 25 bp, Mus musculus
gagtaagctagagaagactccgagg

SEQ ID NO: 33484 - DNA, 25 bp, Mus musculus
gagtaataagtccttcgcctcgtaa

SEQ ID NO: 33485 - DNA, 25 bp, Mus musculus
gagtaatatcgccaagctgcagcta

SEQ ID NO: 33486 - DNA, 25 bp, Mus musculus
gagtaatcaattggcccagaagtcc

SEQ ID NO: 33487 - DNA, 25 bp, Mus musculus
gagtaatcagaaagaagacttccaa

SEQ ID NO: 33488 - DNA, 25 bp, Mus musculus
gagtaatccttaaatgaagagtggg

SEQ ID NO: 33489 - DNA, 25 bp, Mus musculus
gagtaatgcggagcagcacgcagat

SEQ ID NO: 33490 - DNA, 25 bp, Mus musculus
gagtaattgccttggaacctgaccg

SEQ ID NO: 33491 - DNA, 25 bp, Mus musculus
gagtacaatggcctgttggtaaaaa

SEQ ID NO: 33492 - DNA, 25 bp, Mus musculus
gagtacaatggcgtgttggtaaaaa

SEQ ID NO: 33493 - DNA, 25 bp, Mus musculus
gagtacaatgtgctgctagacacac

SEQ ID NO: 33494 - DNA, 25 bp, Mus musculus
gagtacacacatcacaaagatcctg

SEQ ID NO: 33495 - DNA, 25 bp, Mus musculus
gagtacacactcctcatttggatag

SEQ ID NO: 33496 - DNA, 25 bp, Mus musculus
gagtacacctgggacataaagctgg

SEQ ID NO: 33497 - DNA, 25 bp, Mus musculus
gagtacactcatttctatggtggca

SEQ ID NO: 33498 - DNA, 25 bp, Mus musculus
gagtacaggaactactccttaaact

SEQ ID NO: 33499 - DNA, 25 bp, Mus musculus
gagtacaggaattcactgtagagac

SEQ ID NO: 33500 - DNA, 25 bp, Mus musculus
gagtacatcctgatgtgctgccagt

SEQ ID NO: 33501 - DNA, 25 bp, Mus musculus
gagtaccaaacttgcagggcccata

SEQ ID NO: 33502 - DNA, 25 bp, Mus musculus
gagtaccaggaggtgatgaactcca

SEQ ID NO: 33503 - DNA, 25 bp, Mus musculus
gagtacccatacacacacttgccat

SEQ ID NO: 33504 - DNA, 25 bp, Mus musculus
gagtacctagcttttgaccacacgg

SEQ ID NO: 33505 - DNA, 25 bp, Mus musculus
gagtacctcatcaagactggctctg

SEQ ID NO: 33506 - DNA, 25 bp, Mus musculus
gagtacctctccacttgactccatt

SEQ ID NO: 33507 - DNA, 25 bp, Mus musculus
gagtacctgatcgagaagctgctga

SEQ ID NO: 33508 - DNA, 25 bp, Mus musculus
gagtacggaaaacacatttcctgtc

SEQ ID NO: 33509 - DNA, 25 bp, Mus musculus
gagtacgtctgtgaggccgagaaca

SEQ ID NO: 33510 - DNA, 25 bp, Mus musculus
gagtactccagattgctgtctggac

SEQ ID NO: 33511 - DNA, 25 bp, Mus musculus
gagtactcctatgacattaaccgtg

SEQ ID NO: 33512 - DNA, 25 bp, Mus musculus
gagtactgcagtctcccttcagagc

SEQ ID NO: 33513 - DNA, 25 bp, Mus musculus
gagtactggctctatgacctctaaa

SEQ ID NO: 33514 - DNA, 25 bp, Mus musculus
gagtactggtctttgatatccccgc

SEQ ID NO: 33515 - DNA, 25 bp, Mus musculus
gagtactttcccattgaggtggtca

SEQ ID NO: 33516 - DNA, 25 bp, Mus musculus
gagtagaaacctttgcccaccttat

SEQ ID NO: 33517 - DNA, 25 bp, Mus musculus
gagtagacccatgtctgcagacaga

SEQ ID NO: 33518 - DNA, 25 bp, Mus musculus
gagtagagtccagttctcctggatt

SEQ ID NO: 33519 - DNA, 25 bp, Mus musculus
gagtagataaatccacgcagactga

SEQ ID NO: 33520 - DNA, 25 bp, Mus musculus
gagtagatagatacatctccaagta

SEQ ID NO: 33521 - DNA, 25 bp, Mus musculus
gagtagccaagctcttaagcatcgt

SEQ ID NO: 33522 - DNA, 25 bp, Mus musculus
gagtagcttggtggatcatcctcct

SEQ ID NO: 33523 - DNA, 25 bp, Mus musculus
gagtaggcattaccaacaccttggc

SEQ ID NO: 33524 - DNA, 25 bp, Mus musculus
gagtagggctttcttctcaggctcc

SEQ ID NO: 33525 - DNA, 25 bp, Mus musculus
gagtagtacaacaaaacttctgatc

SEQ ID NO: 33526 - DNA, 25 bp, Mus musculus
gagtagttctgagacggaagaagac

SEQ ID NO: 33527 - DNA, 25 bp, Mus musculus
gagtagtttacaagagcccctcaga

SEQ ID NO: 33528 - DNA, 25 bp, Mus musculus
gagtagttttcctcaagttgttggc

SEQ ID NO: 33529 - DNA, 25 bp, Mus musculus
gagtataagcatcttcctgaatctc

SEQ ID NO: 33530 - DNA, 25 bp, Mus musculus
gagtataaggacatcttcacgcggc

SEQ ID NO: 33531 - DNA, 25 bp, Mus musculus
gagtataagggtgaactagcctcct

SEQ ID NO: 33532 - DNA, 25 bp, Mus musculus
gagtataatcacaaccacgacaggt

SEQ ID NO: 33533 - DNA, 25 bp, Mus musculus
gagtatacattcagcatcatggatg

SEQ ID NO: 33534 - DNA, 25 bp, Mus musculus
gagtatacccaagccaccatctatg

SEQ ID NO: 33535 - DNA, 25 bp, Mus musculus
gagtatatatgagccaatcccacag

SEQ ID NO: 33536 - DNA, 25 bp, Mus musculus
gagtatatggtgtggaagaccacct

SEQ ID NO: 33537 - DNA, 25 bp, Mus musculus
gagtatattcctcccaaacctgcca

SEQ ID NO: 33538 - DNA, 25 bp, Mus musculus
gagtatcactacatgaaagtctgtc

SEQ ID NO: 33539 - DNA, 25 bp, Mus musculus
gagtatcagatgtggaaagcccact

SEQ ID NO: 33540 - DNA, 25 bp, Mus musculus
gagtatcagtcagaatggaacaggc

SEQ ID NO: 33541 - DNA, 25 bp, Mus musculus
gagtatcatggagttggattctgcc

SEQ ID NO: 33542 - DNA, 25 bp, Mus musculus
gagtatccagaagacatgccattct

SEQ ID NO: 33543 - DNA, 25 bp, Mus musculus
gagtatccatgacacgctatttcta

SEQ ID NO: 33544 - DNA, 25 bp, Mus musculus
gagtatccatgagacgctatttcta

SEQ ID NO: 33545 - DNA, 25 bp, Mus musculus
gagtatcgccagagcctacacactt

SEQ ID NO: 33546 - DNA, 25 bp, Mus musculus
gagtatctccagaggaaaaagttcc

SEQ ID NO: 33547 - DNA, 25 bp, Mus musculus
gagtatcttgaaatgcatccagttt

SEQ ID NO: 33548 - DNA, 25 bp, Mus musculus
gagtatgacagtatatggacagccc

SEQ ID NO: 33549 - DNA, 25 bp, Mus musculus
gagtatgaccccaaggcactcatgg

SEQ ID NO: 33550 - DNA, 25 bp, Mus musculus
gagtatgagaaggtgccctactcat

SEQ ID NO: 33551 - DNA, 25 bp, Mus musculus
gagtatgagcccttgctattggaga

SEQ ID NO: 33552 - DNA, 25 bp, Mus musculus
gagtatgagttcaccgtgttgccca

SEQ ID NO: 33553 - DNA, 25 bp, Mus musculus
gagtatgagttctccgtgttgccca

SEQ ID NO: 33554 - DNA, 25 bp, Mus musculus
gagtatgagtttatcagctctggtc

SEQ ID NO: 33555 - DNA, 25 bp, Mus musculus
gagtatgagtttttcacctatctgg

SEQ ID NO: 33556 - DNA, 25 bp, Mus musculus
gagtatgatgaagacagcccaggag

SEQ ID NO: 33557 - DNA, 25 bp, Mus musculus
gagtatgctgccaagattatcaaca

SEQ ID NO: 33558 - DNA, 25 bp, Mus musculus
gagtatggacaagtagaatccgtac

SEQ ID NO: 33559 - DNA, 25 bp, Mus musculus
gagtatggcctcagaacctaccctc

SEQ ID NO: 33560 - DNA, 25 bp, Mus musculus
gagtatggctgtcccattctagatg

SEQ ID NO: 33561 - DNA, 25 bp, Mus musculus
gagtatgttttagaagactgcaaga

SEQ ID NO: 33562 - DNA, 25 bp, Mus musculus
gagtattacttagcctttccgatca

SEQ ID NO: 33563 - DNA, 25 bp, Mus musculus
gagtattcagctaagaaatttcatg

SEQ ID NO: 33564 - DNA, 25 bp, Mus musculus
gagtattgcctggaaaaagacgtcc

SEQ ID NO: 33565 - DNA, 25 bp, Mus musculus
gagtatttttggaagctcggcaaca

SEQ ID NO: 33566 - DNA, 25 bp, Mus musculus
gagtcaaattctttgtaagtgaccc

SEQ ID NO: 33567 - DNA, 25 bp, Mus musculus
gagtcaacagaagcacaaagtttgg

SEQ ID NO: 33568 - DNA, 25 bp, Mus musculus
gagtcaagctatgacagattatctg

SEQ ID NO: 33569 - DNA, 25 bp, Mus musculus
gagtcaagctggcatcctgccttcc

SEQ ID NO: 33570 - DNA, 25 bp, Mus musculus
gagtcaaggagtatcttgaaatgca

SEQ ID NO: 33571 - DNA, 25 bp, Mus musculus
gagtcaaggcttttgtgtctgtatt

SEQ ID NO: 33572 - DNA, 25 bp, Mus musculus
gagtcaagtctgagttccggcagaa

SEQ ID NO: 33573 - DNA, 25 bp, Mus musculus
gagtcaatcactgagaaaacgtctt

SEQ ID NO: 33574 - DNA, 25 bp, Mus musculus
gagtcacacaagctaaagacgggcc

SEQ ID NO: 33575 - DNA, 25 bp, Mus musculus
gagtcaccaagctccgtcctggagg

SEQ ID NO: 33576 - DNA, 25 bp, Mus musculus
gagtcaccatcacctcctggaagaa

SEQ ID NO: 33577 - DNA, 25 bp, Mus musculus
gagtcacgctggaaaaaccttctga

SEQ ID NO: 33578 - DNA, 25 bp, Mus musculus
gagtcacggcagcatgatctctcgc

SEQ ID NO: 33579 - DNA, 25 bp, Mus musculus
gagtcactactcttctccaggctat

SEQ ID NO: 33580 - DNA, 25 bp, Mus musculus
gagtcactatcctgggcctgcttgt

SEQ ID NO: 33581 - DNA, 25 bp, Mus musculus
gagtcactccagaagctgagcagcc

SEQ ID NO: 33582 - DNA, 25 bp, Mus musculus
gagtcactccctcccgaaatgaagg

SEQ ID NO: 33583 - DNA, 25 bp, Mus musculus
gagtcactcggcacctttgctggta

SEQ ID NO: 33584 - DNA, 25 bp, Mus musculus
gagtcactgcacacccgagtatcgt

SEQ ID NO: 33585 - DNA, 25 bp, Mus musculus
gagtcagaaaagcagctgcacctgg

SEQ ID NO: 33586 - DNA, 25 bp, Mus musculus
gagtcagaacgtcagcatggagtct

SEQ ID NO: 33587 - DNA, 25 bp, Mus musculus
gagtcagaatcagctggcttcctct

SEQ ID NO: 33588 - DNA, 25 bp, Mus musculus
gagtcagacacagacttagaggtgg

SEQ ID NO: 33589 - DNA, 25 bp, Mus musculus
gagtcagaccatcccggaaccacat

SEQ ID NO: 33590 - DNA, 25 bp, Mus musculus
gagtcagacttcatatagagaatcc

SEQ ID NO: 33591 - DNA, 25 bp, Mus musculus
gagtcagaggacagaaagctcttct

SEQ ID NO: 33592 - DNA, 25 bp, Mus musculus
gagtcagagttggaatcagggctac

SEQ ID NO: 33593 - DNA, 25 bp, Mus musculus
gagtcagagtttctgttccttcctg

SEQ ID NO: 33594 - DNA, 25 bp, Mus musculus
gagtcagatgacattactattaaga

SEQ ID NO: 33595 - DNA, 25 bp, Mus musculus
gagtcagatgactttactattaaga

SEQ ID NO: 33596 - DNA, 25 bp, Mus musculus
gagtcagcagctctcttggcctctg

SEQ ID NO: 33597 - DNA, 25 bp, Mus musculus
gagtcagccagctagctgtggatcc

SEQ ID NO: 33598 - DNA, 25 bp, Mus musculus
gagtcagccctttttattgttacag

SEQ ID NO: 33599 - DNA, 25 bp, Mus musculus
gagtcagctctggtgaagatctccg

SEQ ID NO: 33600 - DNA, 25 bp, Mus musculus
gagtcaggaatgctgtaccactgtg

SEQ ID NO: 33601 - DNA, 25 bp, Mus musculus
gagtcaggcctggctttgcaaggaa

SEQ ID NO: 33602 - DNA, 25 bp, Mus musculus
gagtcaggtgtggtgacaatgacca

SEQ ID NO: 33603 - DNA, 25 bp, Mus musculus
gagtcagtacataaaggaccacccc

SEQ ID NO: 33604 - DNA, 25 bp, Mus musculus
gagtcagtcatcagaaatattatgt

SEQ ID NO: 33605 - DNA, 25 bp, Mus musculus
gagtcagtccttcccaaatgtcttc

SEQ ID NO: 33606 - DNA, 25 bp, Mus musculus
gagtcagtgacacagtggctgcaca

SEQ ID NO: 33607 - DNA, 25 bp, Mus musculus
gagtcagtgaggtacattgcagttc

SEQ ID NO: 33608 - DNA, 25 bp, Mus musculus
gagtcagttattaccactgactggg

SEQ ID NO: 33609 - DNA, 25 bp, Mus musculus
gagtcatactacagcttctggacaa

SEQ ID NO: 33610 - DNA, 25 bp, Mus musculus
gagtcatactactgcttctggacaa

SEQ ID NO: 33611 - DNA, 25 bp, Mus musculus
gagtcatcatcttcgaaattataag

SEQ ID NO: 33612 - DNA, 25 bp, Mus musculus
gagtcatccgtgttggcaatgccac

SEQ ID NO: 33613 - DNA, 25 bp, Mus musculus
gagtcatcttctcctggcttcttgt

SEQ ID NO: 33614 - DNA, 25 bp, Mus musculus
gagtcatgacttcactgatatccag

SEQ ID NO: 33615 - DNA, 25 bp, Mus musculus
gagtcatgacttgactgatatccag

SEQ ID NO: 33616 - DNA, 25 bp, Mus musculus
gagtcatgagccagagtttgactat

SEQ ID NO: 33617 - DNA, 25 bp, Mus musculus
gagtcatgcacttccagcggcagaa

SEQ ID NO: 33618 - DNA, 25 bp, Mus musculus
gagtcatggcagcagctgacgaact

SEQ ID NO: 33619 - DNA, 25 bp, Mus musculus
gagtcatgtcagtgttgggcttcgc

SEQ ID NO: 33620 - DNA, 25 bp, Mus musculus
gagtcatgtggctggaactcatcct

SEQ ID NO: 33621 - DNA, 25 bp, Mus musculus
gagtcattgagttatgctcttcaac

SEQ ID NO: 33622 - DNA, 25 bp, Mus musculus
gagtcatttggctgtgactcagccc

SEQ ID NO: 33623 - DNA, 25 bp, Mus musculus
gagtccacacggcagataccaagac

SEQ ID NO: 33624 - DNA, 25 bp, Mus musculus
gagtccacagtgctctaatccaggg

SEQ ID NO: 33625 - DNA, 25 bp, Mus musculus
gagtccacctcctcctatactagaa

SEQ ID NO: 33626 - DNA, 25 bp, Mus musculus
gagtccacgcgctgcagtgatgtaa

SEQ ID NO: 33627 - DNA, 25 bp, Mus musculus
gagtccagaaattacaacagaagat

SEQ ID NO: 33628 - DNA, 25 bp, Mus musculus
gagtccagacgacttagaactcctg

SEQ ID NO: 33629 - DNA, 25 bp, Mus musculus
gagtccagagtgaccacatttccct

SEQ ID NO: 33630 - DNA, 25 bp, Mus musculus
gagtccaggtgccatcacagcttgc

SEQ ID NO: 33631 - DNA, 25 bp, Mus musculus
gagtccatgcacatttgaccaagag

SEQ ID NO: 33632 - DNA, 25 bp, Mus musculus
gagtccatggagggctacaagaaga

SEQ ID NO: 33633 - DNA, 25 bp, Mus musculus
gagtcccaaggagcaatacatggaa

SEQ ID NO: 33634 - DNA, 25 bp, Mus musculus
gagtcccagaatcagctgctgcaag

SEQ ID NO: 33635 - DNA, 25 bp, Mus musculus
gagtcccagatcctaattatattat

SEQ ID NO: 33636 - DNA, 25 bp, Mus musculus
gagtcccagcacactctgtgtggct

SEQ ID NO: 33637 - DNA, 25 bp, Mus musculus
gagtcccagttccaaagttcttaca

SEQ ID NO: 33638 - DNA, 25 bp, Mus musculus
gagtccccaaagaaaagtgctcttt

SEQ ID NO: 33639 - DNA, 25 bp, Mus musculus
gagtccccactacaaccatacattt

SEQ ID NO: 33640 - DNA, 25 bp, Mus musculus
gagtcccctaggtaccagaacttct

SEQ ID NO: 33641 - DNA, 25 bp, Mus musculus
gagtccctgaaccaatctcttccgg

SEQ ID NO: 33642 - DNA, 25 bp, Mus musculus
gagtccctggacttagaacagagga

SEQ ID NO: 33643 - DNA, 25 bp, Mus musculus
gagtccgttatgcatcccatcgatg

SEQ ID NO: 33644 - DNA, 25 bp, Mus musculus
gagtccgttatggatcccatcgatg

SEQ ID NO: 33645 - DNA, 25 bp, Mus musculus
gagtcctactacaaaactgagggcg

SEQ ID NO: 33646 - DNA, 25 bp, Mus musculus
gagtcctagtgagtgcttctccaag

SEQ ID NO: 33647 - DNA, 25 bp, Mus musculus
gagtcctatcagtgcctgttctcag

SEQ ID NO: 33648 - DNA, 25 bp, Mus musculus
gagtcctccgttccatcccagtaat

SEQ ID NO: 33649 - DNA, 25 bp, Mus musculus
gagtcctgccccataaacattgagg

SEQ ID NO: 33650 - DNA, 25 bp, Mus musculus
gagtcctgccctatgaatacttatg

SEQ ID NO: 33651 - DNA, 25 bp, Mus musculus
gagtcctgctggttctccctgccag

SEQ ID NO: 33652 - DNA, 25 bp, Mus musculus
gagtcctggatgatatgacacctat

SEQ ID NO: 33653 - DNA, 25 bp, Mus musculus
gagtcctggatgttatgacacctat

SEQ ID NO: 33654 - DNA, 25 bp, Mus musculus
gagtccttaagcacgaggagctgtg

SEQ ID NO: 33655 - DNA, 25 bp, Mus musculus
gagtccttccgtgggtcaaagtaag

SEQ ID NO: 33656 - DNA, 25 bp, Mus musculus
gagtccttccttatacagctgtccc

SEQ ID NO: 33657 - DNA, 25 bp, Mus musculus
gagtccttctgccaacatccctgag

SEQ ID NO: 33658 - DNA, 25 bp, Mus musculus
gagtcgaccgccagcatcttggcct

SEQ ID NO: 33659 - DNA, 25 bp, Mus musculus
gagtcgacttcaggatagtattatg

SEQ ID NO: 33660 - DNA, 25 bp, Mus musculus
gagtcgatcatcctacatcaattac

SEQ ID NO: 33661 - DNA, 25 bp, Mus musculus
gagtcgcattctgcatgttcctagg

SEQ ID NO: 33662 - DNA, 25 bp, Mus musculus
gagtcgcccgcttggaagataatac

SEQ ID NO: 33663 - DNA, 25 bp, Mus musculus
gagtcgccctagttaccggcgccag

SEQ ID NO: 33664 - DNA, 25 bp, Mus musculus
gagtcgcttgactactgatgtgcaa

SEQ ID NO: 33665 - DNA, 25 bp, Mus musculus
gagtcgctttccttgcctgctatgc

SEQ ID NO: 33666 - DNA, 25 bp, Mus musculus
gagtcggaccgaagcttgtggtttc

SEQ ID NO: 33667 - DNA, 25 bp, Mus musculus
gagtcggagcaatgtcacagtagga

SEQ ID NO: 33668 - DNA, 25 bp, Mus musculus
gagtcgggttggaccgggacggctg

SEQ ID NO: 33669 - DNA, 25 bp, Mus musculus
gagtcgggttggtccgggacggctg

SEQ ID NO: 33670 - DNA, 25 bp, Mus musculus
gagtcggtgcagtatgaccacccca

SEQ ID NO: 33671 - DNA, 25 bp, Mus musculus
gagtcgtttgaagacctgactgagg

SEQ ID NO: 33672 - DNA, 25 bp, Mus musculus
gagtctaatagacagctgcacctag

SEQ ID NO: 33673 - DNA, 25 bp, Mus musculus
gagtctaatagagagctgcacctag

SEQ ID NO: 33674 - DNA, 25 bp, Mus musculus
gagtctaccgcgacgaatatcagcg

SEQ ID NO: 33675 - DNA, 25 bp, Mus musculus
gagtctacgccatgggcttcaatcg

SEQ ID NO: 33676 - DNA, 25 bp, Mus musculus
gagtctactcagtgtccatctctca

SEQ ID NO: 33677 - DNA, 25 bp, Mus musculus
gagtctactctggacccaggctgct

SEQ ID NO: 33678 - DNA, 25 bp, Mus musculus
gagtctatcctgaacttagttcgtg

SEQ ID NO: 33679 - DNA, 25 bp, Mus musculus
gagtctatgcagcacccaaaaagga

SEQ ID NO: 33680 - DNA, 25 bp, Mus musculus
gagtctatttgttgcagtatgtgga

SEQ ID NO: 33681 - DNA, 25 bp, Mus musculus
gagtctcacacagaaaaaagtcttg

SEQ ID NO: 33682 - DNA, 25 bp, Mus musculus
gagtctcacctaaaagtgctccatg

SEQ ID NO: 33683 - DNA, 25 bp, Mus musculus
gagtctcagcatagagaacactctg

SEQ ID NO: 33684 - DNA, 25 bp, Mus musculus
gagtctccctgtcctgcaagtcaat

SEQ ID NO: 33685 - DNA, 25 bp, Mus musculus
gagtctcgactgctgtttctacagg

SEQ ID NO: 33686 - DNA, 25 bp, Mus musculus
gagtctcgagtcatggctgagccca

SEQ ID NO: 33687 - DNA, 25 bp, Mus musculus
gagtctctcgctctggtttcccctg

SEQ ID NO: 33688 - DNA, 25 bp, Mus musculus
gagtctctcgctgtggtttcccctg

SEQ ID NO: 33689 - DNA, 25 bp, Mus musculus
gagtctctgcagtatcgggcttcag

SEQ ID NO: 33690 - DNA, 25 bp, Mus musculus
gagtctcttcaaaccgccaaaaaga

SEQ ID NO: 33691 - DNA, 25 bp, Mus musculus
gagtctgaaagcttcgtctgaaaga

SEQ ID NO: 33692 - DNA, 25 bp, Mus musculus
gagtctgaagtcttgcctgtccgag

SEQ ID NO: 33693 - DNA, 25 bp, Mus musculus
gagtctgagaaacaaacccaagatt

SEQ ID NO: 33694 - DNA, 25 bp, Mus musculus
gagtctgagaaagaaacccaagatt

SEQ ID NO: 33695 - DNA, 25 bp, Mus musculus
gagtctgatattgaaagttaccact

SEQ ID NO: 33696 - DNA, 25 bp, Mus musculus
gagtctgatggctccgtcatggttt

SEQ ID NO: 33697 - DNA, 25 bp, Mus musculus
gagtctgccttctactccatcgtgg

SEQ ID NO: 33698 - DNA, 25 bp, Mus musculus
gagtctgctgactcttctgaatgtg

SEQ ID NO: 33699 - DNA, 25 bp, Mus musculus
gagtctgcttccagtagaccatcca

SEQ ID NO: 33700 - DNA, 25 bp, Mus musculus
gagtctggaaggaaaagtgttatcg

SEQ ID NO: 33701 - DNA, 25 bp, Mus musculus
gagtctggaatcagtgctaaaagtc

SEQ ID NO: 33702 - DNA, 25 bp, Mus musculus
gagtctggtattcacactctctata

SEQ ID NO: 33703 - DNA, 25 bp, Mus musculus
gagtctggttttcttatcccttcag

SEQ ID NO: 33704 - DNA, 25 bp, Mus musculus
gagtctgtatcttttgaggatgtgg

SEQ ID NO: 33705 - DNA, 25 bp, Mus musculus
gagtctgtgcatttgtaaaggtgca

SEQ ID NO: 33706 - DNA, 25 bp, Mus musculus
gagtctgttctggaacctgctctca

SEQ ID NO: 33707 - DNA, 25 bp, Mus musculus
gagtctgttgggagttttcactttc

SEQ ID NO: 33708 - DNA, 25 bp, Mus musculus
gagtcttcaaagggatccatctcag

SEQ ID NO: 33709 - DNA, 25 bp, Mus musculus
gagtcttcagcttcctatttacctg

SEQ ID NO: 33710 - DNA, 25 bp, Mus musculus
gagtcttcccagatggcaaatgtca

SEQ ID NO: 33711 - DNA, 25 bp, Mus musculus
gagtcttcgaatacatggccctgag

SEQ ID NO: 33712 - DNA, 25 bp, Mus musculus
gagtcttgccacagaatgaagatcc

SEQ ID NO: 33713 - DNA, 25 bp, Mus musculus
gagtctttcaaggatgatcataagc

SEQ ID NO: 33714 - DNA, 25 bp, Mus musculus
gagtctttctccaagttgcgtcgaa

SEQ ID NO: 33715 - DNA, 25 bp, Mus musculus
gagtgaaaagcattcctggcttctc

SEQ ID NO: 33716 - DNA, 25 bp, Mus musculus
gagtgaaacgtcaggagaatctgct

SEQ ID NO: 33717 - DNA, 25 bp, Mus musculus
gagtgaaatggatgtacctctggtc

SEQ ID NO: 33718 - DNA, 25 bp, Mus musculus
gagtgaacaacaaccagcagaacgc

SEQ ID NO: 33719 - DNA, 25 bp, Mus musculus
gagtgaacaggaaacgagtgatgct

SEQ ID NO: 33720 - DNA, 25 bp, Mus musculus
gagtgaacatcgtctcctgaaaact

SEQ ID NO: 33721 - DNA, 25 bp, Mus musculus
gagtgaacggaaactagaagcattg

SEQ ID NO: 33722 - DNA, 25 bp, Mus musculus
gagtgaagagagacatactatgaga

SEQ ID NO: 33723 - DNA, 25 bp, Mus musculus
gagtgaagcagagatcccttctaca

SEQ ID NO: 33724 - DNA, 25 bp, Mus musculus
gagtgaagccagtaaacaaacggcc

SEQ ID NO: 33725 - DNA, 25 bp, Mus musculus
gagtgaaggatatatcccaagtaat

SEQ ID NO: 33726 - DNA, 25 bp, Mus musculus
gagtgaaggcatgatgcagactaca

SEQ ID NO: 33727 - DNA, 25 bp, Mus musculus
gagtgaatacctgcatctacagaac

SEQ ID NO: 33728 - DNA, 25 bp, Mus musculus
gagtgaatgtgggaatggctcacca

SEQ ID NO: 33729 - DNA, 25 bp, Mus musculus
gagtgacagtacttgagtgaccacg

SEQ ID NO: 33730 - DNA, 25 bp, Mus musculus
gagtgacattagcatcccgtgccac

SEQ ID NO: 33731 - DNA, 25 bp, Mus musculus
gagtgacgatgaagctgcctgtagc

SEQ ID NO: 33732 - DNA, 25 bp, Mus musculus
gagtgacgatgatgctgcctgtagc

SEQ ID NO: 33733 - DNA, 25 bp, Mus musculus
gagtgactaccaatgggcaatcaac

SEQ ID NO: 33734 - DNA, 25 bp, Mus musculus
gagtgactagcacggtcagggcggg

SEQ ID NO: 33735 - DNA, 25 bp, Mus musculus
gagtgactcagacatctcctctaca

SEQ ID NO: 33736 - DNA, 25 bp, Mus musculus
gagtgacttttgacctgtacctgct

SEQ ID NO: 33737 - DNA, 25 bp, Mus musculus
gagtgagatcaggaacatctctttc

SEQ ID NO: 33738 - DNA, 25 bp, Mus musculus
gagtgagcacctattatttggataa

SEQ ID NO: 33739 - DNA, 25 bp, Mus musculus
gagtgagcaccttttatttggataa

SEQ ID NO: 33740 - DNA, 25 bp, Mus musculus
gagtgagcatgctcaacgtgttcct

SEQ ID NO: 33741 - DNA, 25 bp, Mus musculus
gagtgagccaagacgggcagtttct

SEQ ID NO: 33742 - DNA, 25 bp, Mus musculus
gagtgagccccgcagttaattctcc

SEQ ID NO: 33743 - DNA, 25 bp, Mus musculus
gagtgagcttatcctggacatgttt

SEQ ID NO: 33744 - DNA, 25 bp, Mus musculus
gagtgaggacataaaaatacgccag

SEQ ID NO: 33745 - DNA, 25 bp, Mus musculus
gagtgaggctcgctacagctctcag

SEQ ID NO: 33746 - DNA, 25 bp, Mus musculus
gagtgagtcctgaaaccattcttga

SEQ ID NO: 33747 - DNA, 25 bp, Mus musculus
gagtgagttcagtttttacctaagt

SEQ ID NO: 33748 - DNA, 25 bp, Mus musculus
gagtgagttctttctgcactggtgc

SEQ ID NO: 33749 - DNA, 25 bp, Mus musculus
gagtgataaaaatgaagagccttta

SEQ ID NO: 33750 - DNA, 25 bp, Mus musculus
gagtgatatgacttctaggatcttc

SEQ ID NO: 33751 - DNA, 25 bp, Mus musculus
gagtgatcccgctcctcttagacaa

SEQ ID NO: 33752 - DNA, 25 bp, Mus musculus
gagtgatcgctctcgtgaacgcaag

SEQ ID NO: 33753 - DNA, 25 bp, Mus musculus
gagtgatctctatggtgacaacaga

SEQ ID NO: 33754 - DNA, 25 bp, Mus musculus
gagtgatgacaaaccctttctatgc

SEQ ID NO: 33755 - DNA, 25 bp, Mus musculus
gagtgatgccctcctcatgcagggt

SEQ ID NO: 33756 - DNA, 25 bp, Mus musculus
gagtgatgcctacctcagtggcatg

SEQ ID NO: 33757 - DNA, 25 bp, Mus musculus
gagtgattacagaggtacagttgac

SEQ ID NO: 33758 - DNA, 25 bp, Mus musculus
gagtgatttatgaagcagtactgct

SEQ ID NO: 33759 - DNA, 25 bp, Mus musculus
gagtgatttctgacgtccctagcta

SEQ ID NO: 33760 - DNA, 25 bp, Mus musculus
gagtgatttggtatgctgtttgcaa

SEQ ID NO: 33761 - DNA, 25 bp, Mus musculus
gagtgcaacaaacgaacattatttc

SEQ ID NO: 33762 - DNA, 25 bp, Mus musculus
gagtgcaaggtgttctccaagacca

SEQ ID NO: 33763 - DNA, 25 bp, Mus musculus
gagtgcacaagatcaacaatgtaaa

SEQ ID NO: 33764 - DNA, 25 bp, Mus musculus
gagtgcacagtacagttggtgccca

SEQ ID NO: 33765 - DNA, 25 bp, Mus musculus
gagtgcactaataccgctcctggtt

SEQ ID NO: 33766 - DNA, 25 bp, Mus musculus
gagtgcagccgctgtggccgtcaac

SEQ ID NO: 33767 - DNA, 25 bp, Mus musculus
gagtgcagcgagtcttctgtctgcg

SEQ ID NO: 33768 - DNA, 25 bp, Mus musculus
gagtgcagctgctgcgtcccgagat

SEQ ID NO: 33769 - DNA, 25 bp, Mus musculus
gagtgcaggcttctcagattttctg

SEQ ID NO: 33770 - DNA, 25 bp, Mus musculus
gagtgccacttctcgtaaacggaaa

SEQ ID NO: 33771 - DNA, 25 bp, Mus musculus
gagtgccatggagaccctcatcaat

SEQ ID NO: 33772 - DNA, 25 bp, Mus musculus
gagtgcccataacacagaacccctg

SEQ ID NO: 33773 - DNA, 25 bp, Mus musculus
gagtgccccaacgtgcctgtcttat

SEQ ID NO: 33774 - DNA, 25 bp, Mus musculus
gagtgcccgtgtgttctttgagaac

SEQ ID NO: 33775 - DNA, 25 bp, Mus musculus
gagtgccctattcaatcatcagcct

SEQ ID NO: 33776 - DNA, 25 bp, Mus musculus
gagtgccgcctgctgaaagagaccc

SEQ ID NO: 33777 - DNA, 25 bp, Mus musculus
gagtgccgcctggtgaaagagaccc

SEQ ID NO: 33778 - DNA, 25 bp, Mus musculus
gagtgccgtggtgtcattgcactgt

SEQ ID NO: 33779 - DNA, 25 bp, Mus musculus
gagtgcctaaagcaataggagttca

SEQ ID NO: 33780 - DNA, 25 bp, Mus musculus
gagtgcctcaacagcctgggctcct

SEQ ID NO: 33781 - DNA, 25 bp, Mus musculus
gagtgcctcaactgcctgggctcct

SEQ ID NO: 33782 - DNA, 25 bp, Mus musculus
gagtgcctcaagtatcggctcgtgg

SEQ ID NO: 33783 - DNA, 25 bp, Mus musculus
gagtgcctcacatcaagacgagctg

SEQ ID NO: 33784 - DNA, 25 bp, Mus musculus
gagtgcgcacctcttctgacataag

SEQ ID NO: 33785 - DNA, 25 bp, Mus musculus
gagtgctaaagtccagagtacttta

SEQ ID NO: 33786 - DNA, 25 bp, Mus musculus
gagtgctatagaaaaactgacctta

SEQ ID NO: 33787 - DNA, 25 bp, Mus musculus
gagtgctcaaactcaaggattccag

SEQ ID NO: 33788 - DNA, 25 bp, Mus musculus
gagtgctcgacctagaatgactgtg

SEQ ID NO: 33789 - DNA, 25 bp, Mus musculus
gagtgctcttattctccacagtcac

SEQ ID NO: 33790 - DNA, 25 bp, Mus musculus
gagtgctgagacaggaaagtgttac

SEQ ID NO: 33791 - DNA, 25 bp, Mus musculus
gagtgctgcaccaagacagggcgct

SEQ ID NO: 33792 - DNA, 25 bp, Mus musculus
gagtgctgcatgctgtaccatctcc

SEQ ID NO: 33793 - DNA, 25 bp, Mus musculus
gagtgcttatgacagctctggatca

SEQ ID NO: 33794 - DNA, 25 bp, Mus musculus
gagtgcttcaatcttctgggagctg

SEQ ID NO: 33795 - DNA, 25 bp, Mus musculus
gagtgcttctccctgtacgacaagc

SEQ ID NO: 33796 - DNA, 25 bp, Mus musculus
gagtggaagaaggaacggatttcca

SEQ ID NO: 33797 - DNA, 25 bp, Mus musculus
gagtggaagaagtggcctcgacttc

SEQ ID NO: 33798 - DNA, 25 bp, Mus musculus
gagtggaagcagtgactcctccatg

SEQ ID NO: 33799 - DNA, 25 bp, Mus musculus
gagtggacaagtgcccaggaaccag

SEQ ID NO: 33800 - DNA, 25 bp, Mus musculus
gagtggacatgtcacaagaatggcc

SEQ ID NO: 33801 - DNA, 25 bp, Mus musculus
gagtggactcgttagaaaagtcaaa

SEQ ID NO: 33802 - DNA, 25 bp, Mus musculus
gagtggagaccattgtcaagccaga

SEQ ID NO: 33803 - DNA, 25 bp, Mus musculus
gagtggagagcctctctttctgtcc

SEQ ID NO: 33804 - DNA, 25 bp, Mus musculus
gagtggagtcaacatatcaatggag

SEQ ID NO: 33805 - DNA, 25 bp, Mus musculus
gagtggatctggtaaccatggccac

SEQ ID NO: 33806 - DNA, 25 bp, Mus musculus
gagtggatgttcctgaatgccgccc

SEQ ID NO: 33807 - DNA, 25 bp, Mus musculus
gagtggatttgtctaagatagaaaa

SEQ ID NO: 33808 - DNA, 25 bp, Mus musculus
gagtggcaagatgaagagtttccta

SEQ ID NO: 33809 - DNA, 25 bp, Mus musculus
gagtggcacacactacctgcatctg

SEQ ID NO: 33810 - DNA, 25 bp, Mus musculus
gagtggcatctctggctaccgggct

SEQ ID NO: 33811 - DNA, 25 bp, Mus musculus
gagtggccaggttctacaggtcaag

SEQ ID NO: 33812 - DNA, 25 bp, Mus musculus
gagtggcctacgacagcaatgttct

SEQ ID NO: 33813 - DNA, 25 bp, Mus musculus
gagtggctgaagtgctaaatgaccc

SEQ ID NO: 33814 - DNA, 25 bp, Mus musculus
gagtggctgcgctttggattcctgc

SEQ ID NO: 33815 - DNA, 25 bp, Mus musculus
gagtggcttcgaagtgaactagaaa

SEQ ID NO: 33816 - DNA, 25 bp, Mus musculus
gagtggcttcttgtaagcaaacctg

SEQ ID NO: 33817 - DNA, 25 bp, Mus musculus
gagtggctttcaggaacgtcaagcc

SEQ ID NO: 33818 - DNA, 25 bp, Mus musculus
gagtgggagtcctactacaaaactg

SEQ ID NO: 33819 - DNA, 25 bp, Mus musculus
gagtgggcagcaaactccctagcag

SEQ ID NO: 33820 - DNA, 25 bp, Mus musculus
gagtgggcccatgggcaatatcatg

SEQ ID NO: 33821 - DNA, 25 bp, Mus musculus
gagtgggtgttgacttcgctttgca

SEQ ID NO: 33822 - DNA, 25 bp, Mus musculus
gagtggtaacagtacttgagcatag

SEQ ID NO: 33823 - DNA, 25 bp, Mus musculus
gagtggtcgttataggcatttccgt

SEQ ID NO: 33824 - DNA, 25 bp, Mus musculus
gagtggtggcatcttttaatcatta

SEQ ID NO: 33825 - DNA, 25 bp, Mus musculus
gagtggtgtggtcataaatacaaac

SEQ ID NO: 33826 - DNA, 25 bp, Mus musculus
gagtggttgatctgctggtcattaa

SEQ ID NO: 33827 - DNA, 25 bp, Mus musculus
gagtgtaaagggaccttcggcttga

SEQ ID NO: 33828 - DNA, 25 bp, Mus musculus
gagtgtaatcctccatcatctctca

SEQ ID NO: 33829 - DNA, 25 bp, Mus musculus
gagtgtaccctatagaccaatctga

SEQ ID NO: 33830 - DNA, 25 bp, Mus musculus
gagtgtatgcagaagtttattgaaa

SEQ ID NO: 33831 - DNA, 25 bp, Mus musculus
gagtgtcaagatactaccacttgcc

SEQ ID NO: 33832 - DNA, 25 bp, Mus musculus
gagtgtcagaattatgccaaggagg

SEQ ID NO: 33833 - DNA, 25 bp, Mus musculus
gagtgtcccatatggctctgaggag

SEQ ID NO: 33834 - DNA, 25 bp, Mus musculus
gagtgtccctcacacattgcttgaa

SEQ ID NO: 33835 - DNA, 25 bp, Mus musculus
gagtgtccctcagacattgcttgaa

SEQ ID NO: 33836 - DNA, 25 bp, Mus musculus
gagtgtctgacaattgggatctgcc

SEQ ID NO: 33837 - DNA, 25 bp, Mus musculus
gagtgtctgagtcttctgtaaacaa

SEQ ID NO: 33838 - DNA, 25 bp, Mus musculus
gagtgtctgcgagacttcctgacgc

SEQ ID NO: 33839 - DNA, 25 bp, Mus musculus
gagtgtgaagatgtggaacatctca

SEQ ID NO: 33840 - DNA, 25 bp, Mus musculus
gagtgtgacaaaatctccttggaga

SEQ ID NO: 33841 - DNA, 25 bp, Mus musculus
gagtgtgagaaggaggctcatctac

SEQ ID NO: 33842 - DNA, 25 bp, Mus musculus
gagtgtgagatcaacacgtataggg

SEQ ID NO: 33843 - DNA, 25 bp, Mus musculus
gagtgtgcagactatgactccctgc

SEQ ID NO: 33844 - DNA, 25 bp, Mus musculus
gagtgtgcagcagtcagtgtgatca

SEQ ID NO: 33845 - DNA, 25 bp, Mus musculus
gagtgtgcatgtgagccccagttct

SEQ ID NO: 33846 - DNA, 25 bp, Mus musculus
gagtgtgccttgttgtttctggtcc

SEQ ID NO: 33847 - DNA, 25 bp, Mus musculus
gagtgtggcatcagcctgcagtgca

SEQ ID NO: 33848 - DNA, 25 bp, Mus musculus
gagtgtgtaagctttactctgaaca

SEQ ID NO: 33849 - DNA, 25 bp, Mus musculus
gagtgtgtgaacacagaaggctcct

SEQ ID NO: 33850 - DNA, 25 bp, Mus musculus
gagtgtgtgaactcagaaggctcct

SEQ ID NO: 33851 - DNA, 25 bp, Mus musculus
gagtgtgtggtttctctctgacaat

SEQ ID NO: 33852 - DNA, 25 bp, Mus musculus
gagtgtgttgagttagagcttgccc

SEQ ID NO: 33853 - DNA, 25 bp, Mus musculus
gagtgtgtttgccaacaacgacccc

SEQ ID NO: 33854 - DNA, 25 bp, Mus musculus
gagtgttactagatgtccagaagta

SEQ ID NO: 33855 - DNA, 25 bp, Mus musculus
gagtgttgccaagatgatagattca

SEQ ID NO: 33856 - DNA, 25 bp, Mus musculus
gagtgtttactaggattaaattcaa

SEQ ID NO: 33857 - DNA, 25 bp, Mus musculus
gagtgtttgtagacacctatcccaa

SEQ ID NO: 33858 - DNA, 25 bp, Mus musculus
gagttaaaaataaaggatgaccagt

SEQ ID NO: 33859 - DNA, 25 bp, Mus musculus
gagttaaaggaccagattcaggatg

SEQ ID NO: 33860 - DNA, 25 bp, Mus musculus
gagttaataggaaaccgcaagaaat

SEQ ID NO: 33861 - DNA, 25 bp, Mus musculus
gagttaatcagtcaaatgcttcagg

SEQ ID NO: 33862 - DNA, 25 bp, Mus musculus
gagttacaaaggctccaccctgaag

SEQ ID NO: 33863 - DNA, 25 bp, Mus musculus
gagttaccatgccaactcaccgcag

SEQ ID NO: 33864 - DNA, 25 bp, Mus musculus
gagttaccgctgacactgaacaggg

SEQ ID NO: 33865 - DNA, 25 bp, Mus musculus
gagttaccgtaacgtcgctggtcct

SEQ ID NO: 33866 - DNA, 25 bp, Mus musculus
gagttacctctttccttagcggcag

SEQ ID NO: 33867 - DNA, 25 bp, Mus musculus
gagttacgtcgtgatttgtgacagc

SEQ ID NO: 33868 - DNA, 25 bp, Mus musculus
gagttacttctaaagaaattgctcg

SEQ ID NO: 33869 - DNA, 25 bp, Mus musculus
gagttagagcttgccctgaagctgg

SEQ ID NO: 33870 - DNA, 25 bp, Mus musculus
gagttagatatgactcccgtgcacc

SEQ ID NO: 33871 - DNA, 25 bp, Mus musculus
gagttagcacacctgttgtcttggg

SEQ ID NO: 33872 - DNA, 25 bp, Mus musculus
gagttagcagaccacgaggaacctt

SEQ ID NO: 33873 - DNA, 25 bp, Mus musculus
gagttagcgagctcatcctcctcct

SEQ ID NO: 33874 - DNA, 25 bp, Mus musculus
gagttagctaaagaacaccctcatg

SEQ ID NO: 33875 - DNA, 25 bp, Mus musculus
gagttagtggaccacaatgctcctt

SEQ ID NO: 33876 - DNA, 25 bp, Mus musculus
gagttatcattggaaatgaagcggc

SEQ ID NO: 33877 - DNA, 25 bp, Mus musculus
gagttcaaccggatcatgagtgtgg

SEQ ID NO: 33878 - DNA, 25 bp, Mus musculus
gagttcaagctctggaaccccgtct

SEQ ID NO: 33879 - DNA, 25 bp, Mus musculus
gagttcaaggagacccaagcactag

SEQ ID NO: 33880 - DNA, 25 bp, Mus musculus
gagttcaatcagaacaacggaaata

SEQ ID NO: 33881 - DNA, 25 bp, Mus musculus
gagttcaattcaaagcaactatacg

SEQ ID NO: 33882 - DNA, 25 bp, Mus musculus
gagttcacaagaagcaacgctgtct

SEQ ID NO: 33883 - DNA, 25 bp, Mus musculus
gagttcacaagagaatttgagtctg

SEQ ID NO: 33884 - DNA, 25 bp, Mus musculus
gagttcacacctgactgagggtcca

SEQ ID NO: 33885 - DNA, 25 bp, Mus musculus
gagttcaccttcaccaagccagtgc

SEQ ID NO: 33886 - DNA, 25 bp, Mus musculus
gagttcagatgcctggaagaaagac

SEQ ID NO: 33887 - DNA, 25 bp, Mus musculus
gagttcagcaggttaagctggcact

SEQ ID NO: 33888 - DNA, 25 bp, Mus musculus
gagttcagcttctggaatgagccac

SEQ ID NO: 33889 - DNA, 25 bp, Mus musculus
gagttcagtaagtgctggcccagga

SEQ ID NO: 33890 - DNA, 25 bp, Mus musculus
gagttcatagagatgagtgttgagc

SEQ ID NO: 33891 - DNA, 25 bp, Mus musculus
gagttcatcagcagcttccccgatg

SEQ ID NO: 33892 - DNA, 25 bp, Mus musculus
gagttcatccgtgtgggctactatg

SEQ ID NO: 33893 - DNA, 25 bp, Mus musculus
gagttcatcgagagccttcagctga

SEQ ID NO: 33894 - DNA, 25 bp, Mus musculus
gagttcatgatcctcccagtgggtg

SEQ ID NO: 33895 - DNA, 25 bp, Mus musculus
gagttcatggttacgcatgctcggc

SEQ ID NO: 33896 - DNA, 25 bp, Mus musculus
gagttcatgttttctacacctcgga

SEQ ID NO: 33897 - DNA, 25 bp, Mus musculus
gagttccactggtctagaacacggc

SEQ ID NO: 33898 - DNA, 25 bp, Mus musculus
gagttccactgtgcatgaggccata

SEQ ID NO: 33899 - DNA, 25 bp, Mus musculus
gagttccagattcttcttgatgccc

SEQ ID NO: 33900 - DNA, 25 bp, Mus musculus
gagttccagcctctgtactatgtgg

SEQ ID NO: 33901 - DNA, 25 bp, Mus musculus
gagttccagtgcagcaaccgctcct

SEQ ID NO: 33902 - DNA, 25 bp, Mus musculus
gagttccatagggaggacgctccat

SEQ ID NO: 33903 - DNA, 25 bp, Mus musculus
gagttcccaggacttcatggacgag

SEQ ID NO: 33904 - DNA, 25 bp, Mus musculus
gagttccgggcatagatggcattga

SEQ ID NO: 33905 - DNA, 25 bp, Mus musculus
gagttccgggcatccttcaaccatt

SEQ ID NO: 33906 - DNA, 25 bp, Mus musculus
gagttccgggccagtcttctggcaa

SEQ ID NO: 33907 - DNA, 25 bp, Mus musculus
gagttcctcatctgaagccccgagc

SEQ ID NO: 33908 - DNA, 25 bp, Mus musculus
gagttcctccgagagtatgtgctct

SEQ ID NO: 33909 - DNA, 25 bp, Mus musculus
gagttcctcgaagtcacatgcatca

SEQ ID NO: 33910 - DNA, 25 bp, Mus musculus
gagttcctgaactttaagaggctac

SEQ ID NO: 33911 - DNA, 25 bp, Mus musculus
gagttcctgaggatcttcgtactag

SEQ ID NO: 33912 - DNA, 25 bp, Mus musculus
gagttcctgcctgcgaacaatgcca

SEQ ID NO: 33913 - DNA, 25 bp, Mus musculus
gagttcctgtgggacccttcaaaga

SEQ ID NO: 33914 - DNA, 25 bp, Mus musculus
gagttcgacatcagtcagcagaaca

SEQ ID NO: 33915 - DNA, 25 bp, Mus musculus
gagttcgaggaagtggacatcacca

SEQ ID NO: 33916 - DNA, 25 bp, Mus musculus
gagttcgggaactctgcaccaggca

SEQ ID NO: 33917 - DNA, 25 bp, Mus musculus
gagttcgtcctaggtacgccagtga

SEQ ID NO: 33918 - DNA, 25 bp, Mus musculus
gagttctaagaataaaggaaagagc

SEQ ID NO: 33919 - DNA, 25 bp, Mus musculus
gagttctacctccaggtggatcgct

SEQ ID NO: 33920 - DNA, 25 bp, Mus musculus
gagttctacgaagcttcgccctatg

SEQ ID NO: 33921 - DNA, 25 bp, Mus musculus
gagttctagaagcatcctgttttga

SEQ ID NO: 33922 - DNA, 25 bp, Mus musculus
gagttctcaaggcaggcctcctcag

SEQ ID NO: 33923 - DNA, 25 bp, Mus musculus
gagttctcccctctgaagaatgatg

SEQ ID NO: 33924 - DNA, 25 bp, Mus musculus
gagttctgcccgctctcttgtagga

SEQ ID NO: 33925 - DNA, 25 bp, Mus musculus
gagttcttaagctcactcatgtggt

SEQ ID NO: 33926 - DNA, 25 bp, Mus musculus
gagttcttcaagtctgctctacaag

SEQ ID NO: 33927 - DNA, 25 bp, Mus musculus
gagttcttgagcgtgactttgcaga

SEQ ID NO: 33928 - DNA, 25 bp, Mus musculus
gagttctttctgcactggtgcttgg

SEQ ID NO: 33929 - DNA, 25 bp, Mus musculus
gagttcttttcaaccctctgcacgc

SEQ ID NO: 33930 - DNA, 25 bp, Mus musculus
gagttcttttcatccctctgcacgc

SEQ ID NO: 33931 - DNA, 25 bp, Mus musculus
gagttgaaaaagatgtaaacaaagc

SEQ ID NO: 33932 - DNA, 25 bp, Mus musculus
gagttgaaagaaccagagaaaaatg

SEQ ID NO: 33933 - DNA, 25 bp, Mus musculus
gagttgaatgaacttaggactccac

SEQ ID NO: 33934 - DNA, 25 bp, Mus musculus
gagttgacaaccttaaccaccacaa

SEQ ID NO: 33935 - DNA, 25 bp, Mus musculus
gagttgactacccaccttgcgcgac

SEQ ID NO: 33936 - DNA, 25 bp, Mus musculus
gagttgactaccgaccttgcgcgac

SEQ ID NO: 33937 - DNA, 25 bp, Mus musculus
gagttgagcagcaacttcacgagca

SEQ ID NO: 33938 - DNA, 25 bp, Mus musculus
gagttgagcagctacggctcagcac

SEQ ID NO: 33939 - DNA, 25 bp, Mus musculus
gagttgaggccatcaaggctgccct

SEQ ID NO: 33940 - DNA, 25 bp, Mus musculus
gagttgaggcttgaataccataact

SEQ ID NO: 33941 - DNA, 25 bp, Mus musculus
gagttgatccaactcaacctattga

SEQ ID NO: 33942 - DNA, 25 bp, Mus musculus
gagttgcagaaaagcctcatgttca

SEQ ID NO: 33943 - DNA, 25 bp, Mus musculus
gagttgcagacattatgttacatca

SEQ ID NO: 33944 - DNA, 25 bp, Mus musculus
gagttgccattcttctagttaagag

SEQ ID NO: 33945 - DNA, 25 bp, Mus musculus
gagttgctaaaagtgagcctgactt

SEQ ID NO: 33946 - DNA, 25 bp, Mus musculus
gagttgctaaagcaaggacagtact

SEQ ID NO: 33947 - DNA, 25 bp, Mus musculus
gagttgctagatgcattcagtgaag

SEQ ID NO: 33948 - DNA, 25 bp, Mus musculus
gagttgctttggatatgaccacact

SEQ ID NO: 33949 - DNA, 25 bp, Mus musculus
gagttggacctcatgcaccagggtg

SEQ ID NO: 33950 - DNA, 25 bp, Mus musculus
gagttggattctgcctctgtcaaga

SEQ ID NO: 33951 - DNA, 25 bp, Mus musculus
gagttggcacatcgagaatatcagg

SEQ ID NO: 33952 - DNA, 25 bp, Mus musculus
gagttgggagtttatcgacttcggc

SEQ ID NO: 33953 - DNA, 25 bp, Mus musculus
gagttgggcagatgccccacaagtc

SEQ ID NO: 33954 - DNA, 25 bp, Mus musculus
gagttggtgaaaacagaagactaaa

SEQ ID NO: 33955 - DNA, 25 bp, Mus musculus
gagttggtgcgctacctgttggcta

SEQ ID NO: 33956 - DNA, 25 bp, Mus musculus
gagttggtgttcacactgtgccatg

SEQ ID NO: 33957 - DNA, 25 bp, Mus musculus
gagttgtcaggagccctggaagacc

SEQ ID NO: 33958 - DNA, 25 bp, Mus musculus
gagttgtgcagaagttgggcttccc

SEQ ID NO: 33959 - DNA, 25 bp, Mus musculus
gagttgttctgggactctcatttga

SEQ ID NO: 33960 - DNA, 25 bp, Mus musculus
gagtttaagaatcgtgacaagtaca

SEQ ID NO: 33961 - DNA, 25 bp, Mus musculus
gagtttacactcatcagagcgatgt

SEQ ID NO: 33962 - DNA, 25 bp, Mus musculus
gagtttacatataagaccatttcta

SEQ ID NO: 33963 - DNA, 25 bp, Mus musculus
gagtttacatcacaaattatcgtct

SEQ ID NO: 33964 - DNA, 25 bp, Mus musculus
gagtttaccactggagttcagtgat

SEQ ID NO: 33965 - DNA, 25 bp, Mus musculus
gagtttagaggctccttgtggcccc

SEQ ID NO: 33966 - DNA, 25 bp, Mus musculus
gagtttatcgacttcggcatggacc

SEQ ID NO: 33967 - DNA, 25 bp, Mus musculus
gagtttcaccataactcaggcctag

SEQ ID NO: 33968 - DNA, 25 bp, Mus musculus
gagtttcagaaaggccccgcattcg

SEQ ID NO: 33969 - DNA, 25 bp, Mus musculus
gagtttcatcctcaacaaggctgag

SEQ ID NO: 33970 - DNA, 25 bp, Mus musculus
gagtttcatcctgaacaaggctgag

SEQ ID NO: 33971 - DNA, 25 bp, Mus musculus
gagtttccagaccttcaacatctcc

SEQ ID NO: 33972 - DNA, 25 bp, Mus musculus
gagtttcctttgattggtgcgctac

SEQ ID NO: 33973 - DNA, 25 bp, Mus musculus
gagtttcggtatcgcccaagcttcg

SEQ ID NO: 33974 - DNA, 25 bp, Mus musculus
gagtttcgttctcagcataccacag

SEQ ID NO: 33975 - DNA, 25 bp, Mus musculus
gagtttcgttctgagcataccacag

SEQ ID NO: 33976 - DNA, 25 bp, Mus musculus
gagtttcttctcctgagagatctgc

SEQ ID NO: 33977 - DNA, 25 bp, Mus musculus
gagtttgaactacggaaagccaagg

SEQ ID NO: 33978 - DNA, 25 bp, Mus musculus
gagtttgacaattatgcagaatggg

SEQ ID NO: 33979 - DNA, 25 bp, Mus musculus
gagtttgacccaatgatccctgatg

SEQ ID NO: 33980 - DNA, 25 bp, Mus musculus
gagtttgagaaagagatcaccaccc

SEQ ID NO: 33981 - DNA, 25 bp, Mus musculus
gagtttgagagtgctgctgaagtcc

SEQ ID NO: 33982 - DNA, 25 bp, Mus musculus
gagtttgagcctactgctgacaaca

SEQ ID NO: 33983 - DNA, 25 bp, Mus musculus
gagtttgagccttctgctgacaaca

SEQ ID NO: 33984 - DNA, 25 bp, Mus musculus
gagtttgatcttgtcttcacatcca

SEQ ID NO: 33985 - DNA, 25 bp, Mus musculus
gagtttgatgttcctatcggttctc

SEQ ID NO: 33986 - DNA, 25 bp, Mus musculus
gagtttgatttagatattgacccca

SEQ ID NO: 33987 - DNA, 25 bp, Mus musculus
gagtttgccaactcgggatgcaggc

SEQ ID NO: 33988 - DNA, 25 bp, Mus musculus
gagtttgctaagaggccaaaaaggg

SEQ ID NO: 33989 - DNA, 25 bp, Mus musculus
gagtttgggcgagtcaaagatgcac

SEQ ID NO: 33990 - DNA, 25 bp, Mus musculus
gagtttggtcacgtcatgcatcaga

SEQ ID NO: 33991 - DNA, 25 bp, Mus musculus
gagtttgtaatagctgccactgact

SEQ ID NO: 33992 - DNA, 25 bp, Mus musculus
gagtttgtagcctttgagtctgtcc

SEQ ID NO: 33993 - DNA, 25 bp, Mus musculus
gagtttgtcacctggctcgatggca

SEQ ID NO: 33994 - DNA, 25 bp, Mus musculus
gagtttgtccctaattcattcttag

SEQ ID NO: 33995 - DNA, 25 bp, Mus musculus
gagttttactgtagccagtgccata

SEQ ID NO: 33996 - DNA, 25 bp, Mus musculus
gagttttatcagcttgtaagtaccg

SEQ ID NO: 33997 - DNA, 25 bp, Mus musculus
gagttttatcctgtattcatcgtaa

SEQ ID NO: 33998 - DNA, 25 bp, Mus musculus
gagttttcagcaacaaatttttagc

SEQ ID NO: 33999 - DNA, 25 bp, Mus musculus
gagttttcatccctcattatcatca

SEQ ID NO: 34000 - DNA, 25 bp, Mus musculus
gagttttccgcctccagtttgatga

SEQ ID NO: 34001 - DNA, 25 bp, Mus musculus
gagttttcggccaggtgacatagtt

SEQ ID NO: 34002 - DNA, 25 bp, Mus musculus
gagttttgggaatgcacttggaaac

SEQ ID NO: 34003 - DNA, 25 bp, Mus musculus
gagtttttcacctatctggataagc

SEQ ID NO: 34004 - DNA, 25 bp, Mus musculus
gagtttttggtgacagacaacagta

SEQ ID NO: 34005 - DNA, 25 bp, Mus musculus
gagttttttcgaaaaagcattcagc

SEQ ID NO: 34006 - DNA, 25 bp, Mus musculus
gataaaaaagtggaaagtgagcata

SEQ ID NO: 34007 - DNA, 25 bp, Mus musculus
gataaaaagagctggcatgtctaag

SEQ ID NO: 34008 - DNA, 25 bp, Mus musculus
gataaaagacataaatggtcccacc

SEQ ID NO: 34009 - DNA, 25 bp, Mus musculus
gataaaagagccagagccactttcc

SEQ ID NO: 34010 - DNA, 25 bp, Mus musculus
gataaaatggcaaaccccaaagaga

SEQ ID NO: 34011 - DNA, 25 bp, Mus musculus
gataaacaaaactgacctgatttct

SEQ ID NO: 34012 - DNA, 25 bp, Mus musculus
gataaaccacagttacaagggattc

SEQ ID NO: 34013 - DNA, 25 bp, Mus musculus
gataaaccacggcacatccaacaga

SEQ ID NO: 34014 - DNA, 25 bp, Mus musculus
gataaaccagaaggcagcgctagtg

SEQ ID NO: 34015 - DNA, 25 bp, Mus musculus
gataaacctgcaagtcccaagttta

SEQ ID NO: 34016 - DNA, 25 bp, Mus musculus
gataaacgtcattgttaatcttctg

SEQ ID NO: 34017 - DNA, 25 bp, Mus musculus
gataaactatcgtgacaaagctgct

SEQ ID NO: 34018 - DNA, 25 bp, Mus musculus
gataaactcccatggaattattgca

SEQ ID NO: 34019 - DNA, 25 bp, Mus musculus
gataaacttgcttgatcaggatgga

SEQ ID NO: 34020 - DNA, 25 bp, Mus musculus
gataaacttggtgaccaaatggcca

SEQ ID NO: 34021 - DNA, 25 bp, Mus musculus
gataaagacagaaagggcaaaagag

SEQ ID NO: 34022 - DNA, 25 bp, Mus musculus
gataaagacagatagggcaaaagag

SEQ ID NO: 34023 - DNA, 25 bp, Mus musculus
gataaagacttagaagaacaggacc

SEQ ID NO: 34024 - DNA, 25 bp, Mus musculus
gataaagctataaattcagcattgg

SEQ ID NO: 34025 - DNA, 25 bp, Mus musculus
gataaaggtggataaaaccaaaatg

SEQ ID NO: 34026 - DNA, 25 bp, Mus musculus
gataaagtatccagtgtagccagct

SEQ ID NO: 34027 - DNA, 25 bp, Mus musculus
gataaagttcttatcagcatcttat

SEQ ID NO: 34028 - DNA, 25 bp, Mus musculus
gataaataacccaacactggcctca

SEQ ID NO: 34029 - DNA, 25 bp, Mus musculus
gataaatattgatggcactgtggca

SEQ ID NO: 34030 - DNA, 25 bp, Mus musculus
gataaatatttcagtagctttgaag

SEQ ID NO: 34031 - DNA, 25 bp, Mus musculus
gataaatcagcagtgggaacggacc

SEQ ID NO: 34032 - DNA, 25 bp, Mus musculus
gataaatccctgaaatcttcaaatg

SEQ ID NO: 34033 - DNA, 25 bp, Mus musculus
gataaatgacacgatggagcttcga

SEQ ID NO: 34034 - DNA, 25 bp, Mus musculus
gataaatgactgtggactagtgagc

SEQ ID NO: 34035 - DNA, 25 bp, Mus musculus
gataaatgcacatggttcaaaattc

SEQ ID NO: 34036 - DNA, 25 bp, Mus musculus
gataaatgccttctatgataccagc

SEQ ID NO: 34037 - DNA, 25 bp, Mus musculus
gataaatggattgacatccacaacc

SEQ ID NO: 34038 - DNA, 25 bp, Mus musculus
gataacaacacccagtgtaagcata

SEQ ID NO: 34039 - DNA, 25 bp, Mus musculus
gataacaactctcgcttgtggcaga

SEQ ID NO: 34040 - DNA, 25 bp, Mus musculus
gataacacagtgatgctctgggtgg

SEQ ID NO: 34041 - DNA, 25 bp, Mus musculus
gataacagattccaatataagtgag

SEQ ID NO: 34042 - DNA, 25 bp, Mus musculus
gataaccacgaaatgactaatcagg

SEQ ID NO: 34043 - DNA, 25 bp, Mus musculus
gataaccagcgcatacttgagttct

SEQ ID NO: 34044 - DNA, 25 bp, Mus musculus
gataacccactgcattggacaatat

SEQ ID NO: 34045 - DNA, 25 bp, Mus musculus
gataaccccggctttgtggagtctg

SEQ ID NO: 34046 - DNA, 25 bp, Mus musculus
gataaccggcgtgtcgccttggcca

SEQ ID NO: 34047 - DNA, 25 bp, Mus musculus
gataaccgtgccacaaaaactggtc

SEQ ID NO: 34048 - DNA, 25 bp, Mus musculus
gataaccttctgctttaaggaacag

SEQ ID NO: 34049 - DNA, 25 bp, Mus musculus
gataacgacaattaccaaggaaact

SEQ ID NO: 34050 - DNA, 25 bp, Mus musculus
gataacgctccggagtttgagccgc

SEQ ID NO: 34051 - DNA, 25 bp, Mus musculus
gataacgtctctgtcactgtgcttc

SEQ ID NO: 34052 - DNA, 25 bp, Mus musculus
gataacgttaaggagctagacaccg

SEQ ID NO: 34053 - DNA, 25 bp, Mus musculus
gataacgttgaatccattgatgccc

SEQ ID NO: 34054 - DNA, 25 bp, Mus musculus
gataactaccagaacacctcaactg

SEQ ID NO: 34055 - DNA, 25 bp, Mus musculus
gataactcgctgctcagagactcag

SEQ ID NO: 34056 - DNA, 25 bp, Mus musculus
gataactgcctttaacgatggcctg

SEQ ID NO: 34057 - DNA, 25 bp, Mus musculus
gataactgcggtgtctgctcaacag

SEQ ID NO: 34058 - DNA, 25 bp, Mus musculus
gataacttcaccttcaaatgccatc

SEQ ID NO: 34059 - DNA, 25 bp, Mus musculus
gataacttccacaaccaacacagtt

SEQ ID NO: 34060 - DNA, 25 bp, Mus musculus
gataacttccactaccaacacagtt

SEQ ID NO: 34061 - DNA, 25 bp, Mus musculus
gataacttcctgaaatggaggcgcc

SEQ ID NO: 34062 - DNA, 25 bp, Mus musculus
gataactttgaacttcagactcgac

SEQ ID NO: 34063 - DNA, 25 bp, Mus musculus
gataagaaaagcagtgagagcgtaa

SEQ ID NO: 34064 - DNA, 25 bp, Mus musculus
gataagaaagctagccccaatgcca

SEQ ID NO: 34065 - DNA, 25 bp, Mus musculus
gataagaaatcttggtaagcgaaac

SEQ ID NO: 34066 - DNA, 25 bp, Mus musculus
gataagaagtctgaggatgataaag

SEQ ID NO: 34067 - DNA, 25 bp, Mus musculus
gataagatagctgagatcaagtctc

SEQ ID NO: 34068 - DNA, 25 bp, Mus musculus
gataagatcatagaagaaggcagag

SEQ ID NO: 34069 - DNA, 25 bp, Mus musculus
gataagattccctcctcgatctacg

SEQ ID NO: 34070 - DNA, 25 bp, Mus musculus
gataagcacgaattgctcagtcttg

SEQ ID NO: 34071 - DNA, 25 bp, Mus musculus
gataagccttctgagatagtagatg

SEQ ID NO: 34072 - DNA, 25 bp, Mus musculus
gataagctaaggatcctcccctgct

SEQ ID NO: 34073 - DNA, 25 bp, Mus musculus
gataaggaccgcaccaaaggcccag

SEQ ID NO: 34074 - DNA, 25 bp, Mus musculus
gataaggcattcgaaggaaccaact

SEQ ID NO: 34075 - DNA, 25 bp, Mus musculus
gataaggccccgtgcggcgttaact

SEQ ID NO: 34076 - DNA, 25 bp, Mus musculus
gataaggcgtatgagaaaaacaaga

SEQ ID NO: 34077 - DNA, 25 bp, Mus musculus
gataagggtgcacatgagagtaccc

SEQ ID NO: 34078 - DNA, 25 bp, Mus musculus
gataagggtgcagatgagagtaccc

SEQ ID NO: 34079 - DNA, 25 bp, Mus musculus
gataaggttggccaatctcgcacag

SEQ ID NO: 34080 - DNA, 25 bp, Mus musculus
gataagtatctgtatgccatgcggc

SEQ ID NO: 34081 - DNA, 25 bp, Mus musculus
gataagtcctctattgggcagctac

SEQ ID NO: 34082 - DNA, 25 bp, Mus musculus
gataagtgaccaaacatctgaaact

SEQ ID NO: 34083 - DNA, 25 bp, Mus musculus
gataataaagaaagcgagtcctggg

SEQ ID NO: 34084 - DNA, 25 bp, Mus musculus
gataataagaaattggtgactcggc

SEQ ID NO: 34085 - DNA, 25 bp, Mus musculus
gataataccagagaagaattcactt

SEQ ID NO: 34086 - DNA, 25 bp, Mus musculus
gataatatcaaacacgtcccgggtg

SEQ ID NO: 34087 - DNA, 25 bp, Mus musculus
gataatcagccttaagctgtgtgtt

SEQ ID NO: 34088 - DNA, 25 bp, Mus musculus
gataatcagctgacatctcttcctt

SEQ ID NO: 34089 - DNA, 25 bp, Mus musculus
gataatcagttttcccaccctgaca

SEQ ID NO: 34090 - DNA, 25 bp, Mus musculus
gataatcggacaatcacactgagag

SEQ ID NO: 34091 - DNA, 25 bp, Mus musculus
gataatcggacattcacactgagag

SEQ ID NO: 34092 - DNA, 25 bp, Mus musculus
gataatgacacacgtccatggtgct

SEQ ID NO: 34093 - DNA, 25 bp, Mus musculus
gataatgagcctgcttacttagaca

SEQ ID NO: 34094 - DNA, 25 bp, Mus musculus
gataatgccatcattcgtcctctgc

SEQ ID NO: 34095 - DNA, 25 bp, Mus musculus
gataatgcctcatatctctgctccc

SEQ ID NO: 34096 - DNA, 25 bp, Mus musculus
gataatggaagtccctgttataaag

SEQ ID NO: 34097 - DNA, 25 bp, Mus musculus
gataatggtgtattgtataaacgac

SEQ ID NO: 34098 - DNA, 25 bp, Mus musculus
gataattagtacttgtgagtcctct

SEQ ID NO: 34099 - DNA, 25 bp, Mus musculus
gataattgctgctgtggcggtggct

SEQ ID NO: 34100 - DNA, 25 bp, Mus musculus
gataatttaatgtggattccttcca

SEQ ID NO: 34101 - DNA, 25 bp, Mus musculus
gataatttccagtatgtgggcgcct

SEQ ID NO: 34102 - DNA, 25 bp, Mus musculus
gatacaaatgaatgtataccaggaa

SEQ ID NO: 34103 - DNA, 25 bp, Mus musculus
gatacaacaagggacagttgatggc

SEQ ID NO: 34104 - DNA, 25 bp, Mus musculus
gatacaagaaaccttaaggagattt

SEQ ID NO: 34105 - DNA, 25 bp, Mus musculus
gatacaatgccaccagggacgttgt

SEQ ID NO: 34106 - DNA, 25 bp, Mus musculus
gatacaatgccagcagggacgttgt

SEQ ID NO: 34107 - DNA, 25 bp, Mus musculus
gatacaattcccacatggtgcctga

SEQ ID NO: 34108 - DNA, 25 bp, Mus musculus
gatacacaagttgcatacatcctca

SEQ ID NO: 34109 - DNA, 25 bp, Mus musculus
gatacaccccaaaaggcaacaatgc

SEQ ID NO: 34110 - DNA, 25 bp, Mus musculus
gatacaccggagattatgctggcaa

SEQ ID NO: 34111 - DNA, 25 bp, Mus musculus
gatacaccttcactgtatccagaac

SEQ ID NO: 34112 - DNA, 25 bp, Mus musculus
gatacacgcattccttccctgaagc

SEQ ID NO: 34113 - DNA, 25 bp, Mus musculus
gatacactacttgtggatgttgaac

SEQ ID NO: 34114 - DNA, 25 bp, Mus musculus
gatacactcctttgatggaagcagc

SEQ ID NO: 34115 - DNA, 25 bp, Mus musculus
gatacactgaagctttgtccacgtg

SEQ ID NO: 34116 - DNA, 25 bp, Mus musculus
gatacactgaaggtttgtccacgtg

SEQ ID NO: 34117 - DNA, 25 bp, Mus musculus
gatacagaaagctggagggaatgtc

SEQ ID NO: 34118 - DNA, 25 bp, Mus musculus
gatacagaaccctctcagatggttg

SEQ ID NO: 34119 - DNA, 25 bp, Mus musculus
gatacagacagcagcgtcctctgga

SEQ ID NO: 34120 - DNA, 25 bp, Mus musculus
gatacagagcttttgattggctacc

SEQ ID NO: 34121 - DNA, 25 bp, Mus musculus
gatacagatccatcagttcttcagc

SEQ ID NO: 34122 - DNA, 25 bp, Mus musculus
gatacagcagatcttattcatcctt

SEQ ID NO: 34123 - DNA, 25 bp, Mus musculus
gatacagtgcaacgcctccgccggg

SEQ ID NO: 34124 - DNA, 25 bp, Mus musculus
gatacagttgctaatcagggcacaa

SEQ ID NO: 34125 - DNA, 25 bp, Mus musculus
gatacatctgctctgcgccagacca

SEQ ID NO: 34126 - DNA, 25 bp, Mus musculus
gatacatgaggatccagcagtttcg

SEQ ID NO: 34127 - DNA, 25 bp, Mus musculus
gatacatggatgaagtacgaatatg

SEQ ID NO: 34128 - DNA, 25 bp, Mus musculus
gatacatggcatgggagacaccttc

SEQ ID NO: 34129 - DNA, 25 bp, Mus musculus
gatacatgtcactccgacctcagag

SEQ ID NO: 34130 - DNA, 25 bp, Mus musculus
gatacatgtcagatcaagaggagga

SEQ ID NO: 34131 - DNA, 25 bp, Mus musculus
gatacattcagcagggactcgtgaa

SEQ ID NO: 34132 - DNA, 25 bp, Mus musculus
gatacattgtctcttcggagccttg

SEQ ID NO: 34133 - DNA, 25 bp, Mus musculus
gataccaaaaagcaatctgagccac

SEQ ID NO: 34134 - DNA, 25 bp, Mus musculus
gataccacctacttctccgtcaatg

SEQ ID NO: 34135 - DNA, 25 bp, Mus musculus
gataccagaataccattgttgctgg

SEQ ID NO: 34136 - DNA, 25 bp, Mus musculus
gataccaggagctccctgtgagctg

SEQ ID NO: 34137 - DNA, 25 bp, Mus musculus
gataccatgaacgacgtagccattg

SEQ ID NO: 34138 - DNA, 25 bp, Mus musculus
gataccatggagatagttgctacgg

SEQ ID NO: 34139 - DNA, 25 bp, Mus musculus
gataccccgcttctactgggaggac

SEQ ID NO: 34140 - DNA, 25 bp, Mus musculus
gatacccgtagatggctggattgca

SEQ ID NO: 34141 - DNA, 25 bp, Mus musculus
gatacccgtcagtcaggctgtgctt

SEQ ID NO: 34142 - DNA, 25 bp, Mus musculus
gataccctatttgtgcccctgttgg

SEQ ID NO: 34143 - DNA, 25 bp, Mus musculus
gataccctgggagctgtcatagcta

SEQ ID NO: 34144 - DNA, 25 bp, Mus musculus
gataccctgtgtcatcaagtacgga

SEQ ID NO: 34145 - DNA, 25 bp, Mus musculus
gataccgatgggaaaacatgtatag

SEQ ID NO: 34146 - DNA, 25 bp, Mus musculus
gataccggagttcagcaagatccag

SEQ ID NO: 34147 - DNA, 25 bp, Mus musculus
gatacctataaaaagggccttgata

SEQ ID NO: 34148 - DNA, 25 bp, Mus musculus
gatacctcgcagaccagaataacca

SEQ ID NO: 34149 - DNA, 25 bp, Mus musculus
gatacctcttcatgggtgcctcaga

SEQ ID NO: 34150 - DNA, 25 bp, Mus musculus
gatacctgacaggagttcgggaact

SEQ ID NO: 34151 - DNA, 25 bp, Mus musculus
gatacctggctgtagtcatgcctaa

SEQ ID NO: 34152 - DNA, 25 bp, Mus musculus
gataccttcacgaaaacagaatcat

SEQ ID NO: 34153 - DNA, 25 bp, Mus musculus
gataccttgtatggccggaaggagt

SEQ ID NO: 34154 - DNA, 25 bp, Mus musculus
gatacctttgacattgatccaaggg

SEQ ID NO: 34155 - DNA, 25 bp, Mus musculus
gatacctttgatccagaacttgcag

SEQ ID NO: 34156 - DNA, 25 bp, Mus musculus
gatacgaaatatcccgccccactta

SEQ ID NO: 34157 - DNA, 25 bp, Mus musculus
gatacgacacgggtcttacacagcc

SEQ ID NO: 34158 - DNA, 25 bp, Mus musculus
gatacgagatgtgaaagaaactgag

SEQ ID NO: 34159 - DNA, 25 bp, Mus musculus
gatacgcacctgttgccaaggacct

SEQ ID NO: 34160 - DNA, 25 bp, Mus musculus
gatacggaagtcacactattagcca

SEQ ID NO: 34161 - DNA, 25 bp, Mus musculus
gatacggcaccgcttacttccagta

SEQ ID NO: 34162 - DNA, 25 bp, Mus musculus
gatacggcaccggttacttccagta

SEQ ID NO: 34163 - DNA, 25 bp, Mus musculus
gatacggtgaaggaaaagtcctgag

SEQ ID NO: 34164 - DNA, 25 bp, Mus musculus
gatacgtatacggaaagctacatca

SEQ ID NO: 34165 - DNA, 25 bp, Mus musculus
gatacgttgtaggttgtcgtcgtca

SEQ ID NO: 34166 - DNA, 25 bp, Mus musculus
gatactacagccaaattatgggaca

SEQ ID NO: 34167 - DNA, 25 bp, Mus musculus
gatactaccacttgcccagcttatg

SEQ ID NO: 34168 - DNA, 25 bp, Mus musculus
gatactacccacttgctagccaaag

SEQ ID NO: 34169 - DNA, 25 bp, Mus musculus
gatactatccccagatgtctcccaa

SEQ ID NO: 34170 - DNA, 25 bp, Mus musculus
gatactcacaggcttcctggacaaa

SEQ ID NO: 34171 - DNA, 25 bp, Mus musculus
gatactccttcgcagttccgaaaga

SEQ ID NO: 34172 - DNA, 25 bp, Mus musculus
gatactccttcggagttccgaaaga

SEQ ID NO: 34173 - DNA, 25 bp, Mus musculus
gatactctccaggaattatgtagaa

SEQ ID NO: 34174 - DNA, 25 bp, Mus musculus
gatactctggacagcccaagaaagg

SEQ ID NO: 34175 - DNA, 25 bp, Mus musculus
gatactctgtggagttaaaggaaaa

SEQ ID NO: 34176 - DNA, 25 bp, Mus musculus
gatactctgtggtgttaaaggaaaa

SEQ ID NO: 34177 - DNA, 25 bp, Mus musculus
gatactgacgtcaactgtgtcccct

SEQ ID NO: 34178 - DNA, 25 bp, Mus musculus
gatactgacgtctactgtgtcccct

SEQ ID NO: 34179 - DNA, 25 bp, Mus musculus
gatactgagaactcacccacgactt

SEQ ID NO: 34180 - DNA, 25 bp, Mus musculus
gatactgcagctccaacagctgctg

SEQ ID NO: 34181 - DNA, 25 bp, Mus musculus
gatactgcatgcagaggaccttgca

SEQ ID NO: 34182 - DNA, 25 bp, Mus musculus
gatactgccagatatgttacatcca

SEQ ID NO: 34183 - DNA, 25 bp, Mus musculus
gatactgccctgaatgtgattgtcg

SEQ ID NO: 34184 - DNA, 25 bp, Mus musculus
gatactggctcctctaacctgtggg

SEQ ID NO: 34185 - DNA, 25 bp, Mus musculus
gatactgggcttagaaaatctacag

SEQ ID NO: 34186 - DNA, 25 bp, Mus musculus
gatactgtgataaactacaaagaca

SEQ ID NO: 34187 - DNA, 25 bp, Mus musculus
gatactgttcttctccgtgcttggc

SEQ ID NO: 34188 - DNA, 25 bp, Mus musculus
gatacttccaagatgaaccatgcct

SEQ ID NO: 34189 - DNA, 25 bp, Mus musculus
gatacttccctgagtaacggtgcaa

SEQ ID NO: 34190 - DNA, 25 bp, Mus musculus
gatacttctcggtcttctacctctc

SEQ ID NO: 34191 - DNA, 25 bp, Mus musculus
gatacttggaccagcgagtgcccta

SEQ ID NO: 34192 - DNA, 25 bp, Mus musculus
gatactttccataagatcaagctgg

SEQ ID NO: 34193 - DNA, 25 bp, Mus musculus
gatactttgacaatactaacaccta

SEQ ID NO: 34194 - DNA, 25 bp, Mus musculus
gatactttgacattactaacaccta

SEQ ID NO: 34195 - DNA, 25 bp, Mus musculus
gatacttttaagcacaccgatgaag

SEQ ID NO: 34196 - DNA, 25 bp, Mus musculus
gatagaaacgtctgggcaagggttc

SEQ ID NO: 34197 - DNA, 25 bp, Mus musculus
gatagaagatacaaagctgtcagaa

SEQ ID NO: 34198 - DNA, 25 bp, Mus musculus
gatagaagcctctcgaaatgaactg

SEQ ID NO: 34199 - DNA, 25 bp, Mus musculus
gatagaagctttgcccagttttctc

SEQ ID NO: 34200 - DNA, 25 bp, Mus musculus
gatagaataaaagtgtccctctcca

SEQ ID NO: 34201 - DNA, 25 bp, Mus musculus
gatagaattctaggtcttgggagga

SEQ ID NO: 34202 - DNA, 25 bp, Mus musculus
gatagacaaaagtttcccaaatgcc

SEQ ID NO: 34203 - DNA, 25 bp, Mus musculus
gatagacaccagataagctctggct

SEQ ID NO: 34204 - DNA, 25 bp, Mus musculus
gatagaccagtgtcatctctcagga

SEQ ID NO: 34205 - DNA, 25 bp, Mus musculus
gatagacgccggtcaagtgacagat

SEQ ID NO: 34206 - DNA, 25 bp, Mus musculus
gatagactctcatggtttatgatcc

SEQ ID NO: 34207 - DNA, 25 bp, Mus musculus
gatagactggatatctttgaatttc

SEQ ID NO: 34208 - DNA, 25 bp, Mus musculus
gatagactgtcacagagctctgtaa

SEQ ID NO: 34209 - DNA, 25 bp, Mus musculus
gatagagaatatccttcaagaacaa

SEQ ID NO: 34210 - DNA, 25 bp, Mus musculus
gatagagaatatgcttcaagaacaa

SEQ ID NO: 34211 - DNA, 25 bp, Mus musculus
gatagagagatggtacattcatcct

SEQ ID NO: 34212 - DNA, 25 bp, Mus musculus
gatagagcatggttgcttgatccca

SEQ ID NO: 34213 - DNA, 25 bp, Mus musculus
gatagagccagcctgggttgcccac

SEQ ID NO: 34214 - DNA, 25 bp, Mus musculus
gatagagcctgctcgcattgaggag

SEQ ID NO: 34215 - DNA, 25 bp, Mus musculus
gatagaggaacttctggtaccatcc

SEQ ID NO: 34216 - DNA, 25 bp, Mus musculus
gatagagtatgagtcgccagaacag

SEQ ID NO: 34217 - DNA, 25 bp, Mus musculus
gatagagtctgcactgggattctgg

SEQ ID NO: 34218 - DNA, 25 bp, Mus musculus
gatagagtttacactcatcagagcg

SEQ ID NO: 34219 - DNA, 25 bp, Mus musculus
gatagatatgattgtgggcccccca

SEQ ID NO: 34220 - DNA, 25 bp, Mus musculus
gatagatcaagaagtgaagaatggc

SEQ ID NO: 34221 - DNA, 25 bp, Mus musculus
gatagatcagaatctaagagggatg

SEQ ID NO: 34222 - DNA, 25 bp, Mus musculus
gatagatcctaacaaccagctcttg

SEQ ID NO: 34223 - DNA, 25 bp, Mus musculus
gatagatgctaaatgcccaggccca

SEQ ID NO: 34224 - DNA, 25 bp, Mus musculus
gatagatgctaattgcccaggccca

SEQ ID NO: 34225 - DNA, 25 bp, Mus musculus
gatagcaaaataaaggaatcactgc

SEQ ID NO: 34226 - DNA, 25 bp, Mus musculus
gatagcaaattacaataatacagcc

SEQ ID NO: 34227 - DNA, 25 bp, Mus musculus
gatagcaatgatcccaatttccaga

SEQ ID NO: 34228 - DNA, 25 bp, Mus musculus
gatagcaggcaccactcgagcccgg

SEQ ID NO: 34229 - DNA, 25 bp, Mus musculus
gatagcatccctgggctgcactgtg

SEQ ID NO: 34230 - DNA, 25 bp, Mus musculus
gatagcccgtaaccctcacagaatc

SEQ ID NO: 34231 - DNA, 25 bp, Mus musculus
gatagcctacccgatgtgaagattg

SEQ ID NO: 34232 - DNA, 25 bp, Mus musculus
gatagcctatggaaagaagggacta

SEQ ID NO: 34233 - DNA, 25 bp, Mus musculus
gatagcctccaagagttacaaccag

SEQ ID NO: 34234 - DNA, 25 bp, Mus musculus
gatagcctggatctgattacaaaag

SEQ ID NO: 34235 - DNA, 25 bp, Mus musculus
gatagcgaccacactgataaccagc

SEQ ID NO: 34236 - DNA, 25 bp, Mus musculus
gatagcgaccattttttgaacactg

SEQ ID NO: 34237 - DNA, 25 bp, Mus musculus
gatagcgcggtacacataattctca

SEQ ID NO: 34238 - DNA, 25 bp, Mus musculus
gatagcgcggtagacataattctca

SEQ ID NO: 34239 - DNA, 25 bp, Mus musculus
gatagcgggagtaacaccaatgtga

SEQ ID NO: 34240 - DNA, 25 bp, Mus musculus
gatagctcaataccatccctgtttt

SEQ ID NO: 34241 - DNA, 25 bp, Mus musculus
gatagctcagcgctataccacttgc

SEQ ID NO: 34242 - DNA, 25 bp, Mus musculus
gatagctcagcggtataccacttgc

SEQ ID NO: 34243 - DNA, 25 bp, Mus musculus
gatagctcagggactacatttcact

SEQ ID NO: 34244 - DNA, 25 bp, Mus musculus
gatagctcagggtctacatttcact

SEQ ID NO: 34245 - DNA, 25 bp, Mus musculus
gatagctgagatcaagtctctgttg

SEQ ID NO: 34246 - DNA, 25 bp, Mus musculus
gatagctgtcaccaggataacctgt

SEQ ID NO: 34247 - DNA, 25 bp, Mus musculus
gatagctgtgctctacttcacctgg

SEQ ID NO: 34248 - DNA, 25 bp, Mus musculus
gatagcttgcgatgaagagttttca

SEQ ID NO: 34249 - DNA, 25 bp, Mus musculus
gataggaacagcttgtctgatgagg

SEQ ID NO: 34250 - DNA, 25 bp, Mus musculus
gataggattcactccatgcacccag

SEQ ID NO: 34251 - DNA, 25 bp, Mus musculus
gataggcgtagaagaggaccattgc

SEQ ID NO: 34252 - DNA, 25 bp, Mus musculus
gataggcttgtaagtgcccgaagtg

SEQ ID NO: 34253 - DNA, 25 bp, Mus musculus
gataggtagcactgggcttctttca

SEQ ID NO: 34254 - DNA, 25 bp, Mus musculus
gatagtaaatatagacctcatgctg

SEQ ID NO: 34255 - DNA, 25 bp, Mus musculus
gatagtaattcacaatcagattcag

SEQ ID NO: 34256 - DNA, 25 bp, Mus musculus
gatagtagatgattggctaaacctg

SEQ ID NO: 34257 - DNA, 25 bp, Mus musculus
gatagtattttcctcaagtcccatg

SEQ ID NO: 34258 - DNA, 25 bp, Mus musculus
gatagtcaccaacccaggatctttg

SEQ ID NO: 34259 - DNA, 25 bp, Mus musculus
gatagtcctcatcctggtctttctc

SEQ ID NO: 34260 - DNA, 25 bp, Mus musculus
gatagtcggaattctagacaaaatg

SEQ ID NO: 34261 - DNA, 25 bp, Mus musculus
gatagtcgtcccttcatctctaaga

SEQ ID NO: 34262 - DNA, 25 bp, Mus musculus
gatagtgaagctaagaaactactgg

SEQ ID NO: 34263 - DNA, 25 bp, Mus musculus
gatagtgaccaggactctgctgagg

SEQ ID NO: 34264 - DNA, 25 bp, Mus musculus
gatagtgagatcaccatcgctccac

SEQ ID NO: 34265 - DNA, 25 bp, Mus musculus
gatagtggcatccaggctgcatgaa

SEQ ID NO: 34266 - DNA, 25 bp, Mus musculus
gatagttcctctccaatcttgccca

SEQ ID NO: 34267 - DNA, 25 bp, Mus musculus
gatagttctgccaatcaagctccct

SEQ ID NO: 34268 - DNA, 25 bp, Mus musculus
gatagtttactagtccagtatggag

SEQ ID NO: 34269 - DNA, 25 bp, Mus musculus
gatataaatgtggtcacctgtgcag

SEQ ID NO: 34270 - DNA, 25 bp, Mus musculus
gatataacagccaaggttacggagg

SEQ ID NO: 34271 - DNA, 25 bp, Mus musculus
gatataatgtccgtgaatcctacct

SEQ ID NO: 34272 - DNA, 25 bp, Mus musculus
gatatacgtgcagagggcagaggtt

SEQ ID NO: 34273 - DNA, 25 bp, Mus musculus
gatatactacttaatcatcggccaa

SEQ ID NO: 34274 - DNA, 25 bp, Mus musculus
gatatactccattttgcgatagccg

SEQ ID NO: 34275 - DNA, 25 bp, Mus musculus
gatatactggagtgatgtcagcgaa

SEQ ID NO: 34276 - DNA, 25 bp, Mus musculus
gatataggagatgccacccaagttt

SEQ ID NO: 34277 - DNA, 25 bp, Mus musculus
gatatagtactgcactttgctgcac

SEQ ID NO: 34278 - DNA, 25 bp, Mus musculus
gatatagtagtcattttcccgggag

SEQ ID NO: 34279 - DNA, 25 bp, Mus musculus
gatatagtgagcagatgacttatgg

SEQ ID NO: 34280 - DNA, 25 bp, Mus musculus
gatatatatgtcaccagctttgggc

SEQ ID NO: 34281 - DNA, 25 bp, Mus musculus
gatatcaccccggagctgcgggaag

SEQ ID NO: 34282 - DNA, 25 bp, Mus musculus
gatatcacggagtatcagagcattc

SEQ ID NO: 34283 - DNA, 25 bp, Mus musculus
gatatcacggtgaaacaaggacggg

SEQ ID NO: 34284 - DNA, 25 bp, Mus musculus
gatatcacgtatgagatagcagtgg

SEQ ID NO: 34285 - DNA, 25 bp, Mus musculus
gatatcactgaagagagcttctccc

SEQ ID NO: 34286 - DNA, 25 bp, Mus musculus
gatatcagacgctgccagctgaccc

SEQ ID NO: 34287 - DNA, 25 bp, Mus musculus
gatatcagtgcgatagctgtctcct

SEQ ID NO: 34288 - DNA, 25 bp, Mus musculus
gatatccagtctctattccatgatc

SEQ ID NO: 34289 - DNA, 25 bp, Mus musculus
gatatcccactgcatcttttaaagt

SEQ ID NO: 34290 - DNA, 25 bp, Mus musculus
gatatccccaagatgttggatgctg

SEQ ID NO: 34291 - DNA, 25 bp, Mus musculus
gatatccgagcaactgaaaaagaca

SEQ ID NO: 34292 - DNA, 25 bp, Mus musculus
gatatccgcctcactcttatggaag

SEQ ID NO: 34293 - DNA, 25 bp, Mus musculus
gatatcctctgggaagaggtcaaag

SEQ ID NO: 34294 - DNA, 25 bp, Mus musculus
gatatcctgactttgaagattctac

SEQ ID NO: 34295 - DNA, 25 bp, Mus musculus
gatatcctgctgatccttattctta

SEQ ID NO: 34296 - DNA, 25 bp, Mus musculus
gatatcctggcggagggcatcacca

SEQ ID NO: 34297 - DNA, 25 bp, Mus musculus
gatatcctggtctccaatgctgctg

SEQ ID NO: 34298 - DNA, 25 bp, Mus musculus
gatatccttgtgatgctgggagaag

SEQ ID NO: 34299 - DNA, 25 bp, Mus musculus
gatatcgctgctgtctcctatgtcc

SEQ ID NO: 34300 - DNA, 25 bp, Mus musculus
gatatctatcattccaggttaaaag

SEQ ID NO: 34301 - DNA, 25 bp, Mus musculus
gatatctcagatgtggctctccagc

SEQ ID NO: 34302 - DNA, 25 bp, Mus musculus
gatatctcggataccaggagctccc

SEQ ID NO: 34303 - DNA, 25 bp, Mus musculus
gatatctgcacacttccagagaagg

SEQ ID NO: 34304 - DNA, 25 bp, Mus musculus
gatatctggccatgaataaactgaa

SEQ ID NO: 34305 - DNA, 25 bp, Mus musculus
gatatctttgactccccaagtcccg

SEQ ID NO: 34306 - DNA, 25 bp, Mus musculus
gatatgaacatcctttatgctttcc

SEQ ID NO: 34307 - DNA, 25 bp, Mus musculus
gatatgaacatcgtttatgctttcc

SEQ ID NO: 34308 - DNA, 25 bp, Mus musculus
gatatgaatgggaccccataagaca

SEQ ID NO: 34309 - DNA, 25 bp, Mus musculus
gatatgaattggctccctctgaccg

SEQ ID NO: 34310 - DNA, 25 bp, Mus musculus
gatatgaccctgaccttgcctttgg

SEQ ID NO: 34311 - DNA, 25 bp, Mus musculus
gatatgaccggtataaaatggtggt

SEQ ID NO: 34312 - DNA, 25 bp, Mus musculus
gatatgactccaggaccacaatatt

SEQ ID NO: 34313 - DNA, 25 bp, Mus musculus
gatatgaggactccaacaacttggg

SEQ ID NO: 34314 - DNA, 25 bp, Mus musculus
gatatgcaaagtaaacagggtgcct

SEQ ID NO: 34315 - DNA, 25 bp, Mus musculus
gatatgcaatgcctatactgagctg

SEQ ID NO: 34316 - DNA, 25 bp, Mus musculus
gatatgcatcagtacagccagtggc

SEQ ID NO: 34317 - DNA, 25 bp, Mus musculus
gatatgccacaaaaggatccatgcc

SEQ ID NO: 34318 - DNA, 25 bp, Mus musculus
gatatgccacatcagccgcatttac

SEQ ID NO: 34319 - DNA, 25 bp, Mus musculus
gatatgcccggaaacagaaccgatg

SEQ ID NO: 34320 - DNA, 25 bp, Mus musculus
gatatgccgacttatgaaacatcca

SEQ ID NO: 34321 - DNA, 25 bp, Mus musculus
gatatgctccgccacttccagcgtt

SEQ ID NO: 34322 - DNA, 25 bp, Mus musculus
gatatgctgcatcgatgagtttgac

SEQ ID NO: 34323 - DNA, 25 bp, Mus musculus
gatatggactattcacggatcattg

SEQ ID NO: 34324 - DNA, 25 bp, Mus musculus
gatatggccgaatatttcttccctt

SEQ ID NO: 34325 - DNA, 25 bp, Mus musculus
gatatgggacacaatggtgggcacc

SEQ ID NO: 34326 - DNA, 25 bp, Mus musculus
gatatgggcatctgtccgaggctct

SEQ ID NO: 34327 - DNA, 25 bp, Mus musculus
gatatgggctcctgattctcatgaa

SEQ ID NO: 34328 - DNA, 25 bp, Mus musculus
gatatggtccgtgttctcatctgta

SEQ ID NO: 34329 - DNA, 25 bp, Mus musculus
gatatggttactggacttagtcctc

SEQ ID NO: 34330 - DNA, 25 bp, Mus musculus
gatatgtcaccagaagtcacgacct

SEQ ID NO: 34331 - DNA, 25 bp, Mus musculus
gatatgtgcagatacattcagagca

SEQ ID NO: 34332 - DNA, 25 bp, Mus musculus
gatatgtgccacgttggtctttgcc

SEQ ID NO: 34333 - DNA, 25 bp, Mus musculus
gatatgtgctcgatctcatcgtcac

SEQ ID NO: 34334 - DNA, 25 bp, Mus musculus
gatatgtggtccttcagaccgaggg

SEQ ID NO: 34335 - DNA, 25 bp, Mus musculus
gatatgttacatccaaaattcttca

SEQ ID NO: 34336 - DNA, 25 bp, Mus musculus
gatattaatgaagaatggatctctg

SEQ ID NO: 34337 - DNA, 25 bp, Mus musculus
gatattacaaatgaagaccatcaaa

SEQ ID NO: 34338 - DNA, 25 bp, Mus musculus
gatattacagatctacaacctggaa

SEQ ID NO: 34339 - DNA, 25 bp, Mus musculus
gatattacagatgtacaacctggaa

SEQ ID NO: 34340 - DNA, 25 bp, Mus musculus
gatattacatcgagctgggactttg

SEQ ID NO: 34341 - DNA, 25 bp, Mus musculus
gatattactcaggatcttcgaaacc

SEQ ID NO: 34342 - DNA, 25 bp, Mus musculus
gatattatctctagaagccacttcc

SEQ ID NO: 34343 - DNA, 25 bp, Mus musculus
gatattatgctatccacaggctcct

SEQ ID NO: 34344 - DNA, 25 bp, Mus musculus
gatattattgttcatccctgtgtga

SEQ ID NO: 34345 - DNA, 25 bp, Mus musculus
gatattcaccgcactctggtatatg

SEQ ID NO: 34346 - DNA, 25 bp, Mus musculus
gatattcctagtgcccttcgcattg

SEQ ID NO: 34347 - DNA, 25 bp, Mus musculus
gatattctaaaaaccaagccgtcgc

SEQ ID NO: 34348 - DNA, 25 bp, Mus musculus
gatattctcttcaacaaacgcttcg

SEQ ID NO: 34349 - DNA, 25 bp, Mus musculus
gatattgaaagttaccacttcattg

SEQ ID NO: 34350 - DNA, 25 bp, Mus musculus
gatattgaccccaacctctatttgg

SEQ ID NO: 34351 - DNA, 25 bp, Mus musculus
gatattgactagactggcccttgga

SEQ ID NO: 34352 - DNA, 25 bp, Mus musculus
gatattgactccctttgaacggaac

SEQ ID NO: 34353 - DNA, 25 bp, Mus musculus
gatattgagaccctacatggctccc

SEQ ID NO: 34354 - DNA, 25 bp, Mus musculus
gatattgagctctcccctgtcagtg

SEQ ID NO: 34355 - DNA, 25 bp, Mus musculus
gatattgcagctcgccgccacacag

SEQ ID NO: 34356 - DNA, 25 bp, Mus musculus
gatattgggcaatcttctggtcact

SEQ ID NO: 34357 - DNA, 25 bp, Mus musculus
gatattgtagagagtgcttatgaca

SEQ ID NO: 34358 - DNA, 25 bp, Mus musculus
gatattgtctctggaactcgataca

SEQ ID NO: 34359 - DNA, 25 bp, Mus musculus
gatatttgcagtgtagttggccaac

SEQ ID NO: 34360 - DNA, 25 bp, Mus musculus
gatattttcaatcctgttatcaaac

SEQ ID NO: 34361 - DNA, 25 bp, Mus musculus
gatattttcaatgctgttatcaaac

SEQ ID NO: 34362 - DNA, 25 bp, Mus musculus
gatcaaaaaactcatacagaacaag

SEQ ID NO: 34363 - DNA, 25 bp, Mus musculus
gatcaaagagaatgctgtgaagcgg

SEQ ID NO: 34364 - DNA, 25 bp, Mus musculus
gatcaaagctgcgaagagtgggaaa

SEQ ID NO: 34365 - DNA, 25 bp, Mus musculus
gatcaaaggatcagacaaagacgag

SEQ ID NO: 34366 - DNA, 25 bp, Mus musculus
gatcaaaggtttcgccaaggacatg

SEQ ID NO: 34367 - DNA, 25 bp, Mus musculus
gatcaaaggtttggccaaggacatg

SEQ ID NO: 34368 - DNA, 25 bp, Mus musculus
gatcaacaaatatgggaaaagtctg

SEQ ID NO: 34369 - DNA, 25 bp, Mus musculus
gatcaacagtgctaatcgagatatt

SEQ ID NO: 34370 - DNA, 25 bp, Mus musculus
gatcaacatcgatgttcttttcccg

SEQ ID NO: 34371 - DNA, 25 bp, Mus musculus
gatcaacccagagctattgccttag

SEQ ID NO: 34372 - DNA, 25 bp, Mus musculus
gatcaacctgaatgtccggctagac

SEQ ID NO: 34373 - DNA, 25 bp, Mus musculus
gatcaacttcttggtcaacaatgga

SEQ ID NO: 34374 - DNA, 25 bp, Mus musculus
gatcaacttggaaaaatgccagacg

SEQ ID NO: 34375 - DNA, 25 bp, Mus musculus
gatcaactttcagctgggaatagag

SEQ ID NO: 34376 - DNA, 25 bp, Mus musculus
gatcaagaaactgatctcagaactg

SEQ ID NO: 34377 - DNA, 25 bp, Mus musculus
gatcaagaagtgaagaatggcattc

SEQ ID NO: 34378 - DNA, 25 bp, Mus musculus
gatcaagaggaggatacaaagcgaa

SEQ ID NO: 34379 - DNA, 25 bp, Mus musculus
gatcaagatcgtgtctgccgtgcgg

SEQ ID NO: 34380 - DNA, 25 bp, Mus musculus
gatcaagcacggcacggagtgtacc

SEQ ID NO: 34381 - DNA, 25 bp, Mus musculus
gatcaaggacgaggaccagctagaa

SEQ ID NO: 34382 - DNA, 25 bp, Mus musculus
gatcaaggccacagatcttctggtg

SEQ ID NO: 34383 - DNA, 25 bp, Mus musculus
gatcaaggtgaaagggatggaccct

SEQ ID NO: 34384 - DNA, 25 bp, Mus musculus
gatcaagtagacatgaaacagcccc

SEQ ID NO: 34385 - DNA, 25 bp, Mus musculus
gatcaagtgcagacaggtggtccac

SEQ ID NO: 34386 - DNA, 25 bp, Mus musculus
gatcaagtgcagactgagctgtggc

SEQ ID NO: 34387 - DNA, 25 bp, Mus musculus
gatcaagtgcctattgaaagagact

SEQ ID NO: 34388 - DNA, 25 bp, Mus musculus
gatcaagtggaatttgtagaacacc

SEQ ID NO: 34389 - DNA, 25 bp, Mus musculus
gatcaatcctactgtgcatcccagg

SEQ ID NO: 34390 - DNA, 25 bp, Mus musculus
gatcaatgaaggagaggtactctct

SEQ ID NO: 34391 - DNA, 25 bp, Mus musculus
gatcaatgcttttgtcatgctcacc

SEQ ID NO: 34392 - DNA, 25 bp, Mus musculus
gatcaattcctcaatgactagaacc

SEQ ID NO: 34393 - DNA, 25 bp, Mus musculus
gatcaattcttggagaacacaaaga

SEQ ID NO: 34394 - DNA, 25 bp, Mus musculus
gatcaattggttgaggccgcgctct

SEQ ID NO: 34395 - DNA, 25 bp, Mus musculus
gatcacaagatcagagggccgattt

SEQ ID NO: 34396 - DNA, 25 bp, Mus musculus
gatcacaagttcctgggaaagtcaa

SEQ ID NO: 34397 - DNA, 25 bp, Mus musculus
gatcacactatggattttccaagtc

SEQ ID NO: 34398 - DNA, 25 bp, Mus musculus
gatcacagatgcagctaccatgaag

SEQ ID NO: 34399 - DNA, 25 bp, Mus musculus
gatcacagcttatttcctcaagaga

SEQ ID NO: 34400 - DNA, 25 bp, Mus musculus
gatcacagggaaatgggagaaaccc

SEQ ID NO: 34401 - DNA, 25 bp, Mus musculus
gatcacaggtgcctgcagaagcata

SEQ ID NO: 34402 - DNA, 25 bp, Mus musculus
gatcacagtcaagactgggacctca

SEQ ID NO: 34403 - DNA, 25 bp, Mus musculus
gatcacatagcaagaatcccaaaag

SEQ ID NO: 34404 - DNA, 25 bp, Mus musculus
gatcacatagcagaaaacattctct

SEQ ID NO: 34405 - DNA, 25 bp, Mus musculus
gatcacatagcatggtcatccactc

SEQ ID NO: 34406 - DNA, 25 bp, Mus musculus
gatcacatcctataatcactgccta

SEQ ID NO: 34407 - DNA, 25 bp, Mus musculus
gatcacatgagattgtgttgcctcc

SEQ ID NO: 34408 - DNA, 25 bp, Mus musculus
gatcaccaaacactgggaatggctg

SEQ ID NO: 34409 - DNA, 25 bp, Mus musculus
gatcaccaaggagaagcttctagac

SEQ ID NO: 34410 - DNA, 25 bp, Mus musculus
gatcaccatcgctccacttgcaaaa

SEQ ID NO: 34411 - DNA, 25 bp, Mus musculus
gatcacccacagatcatgagtcctt

SEQ ID NO: 34412 - DNA, 25 bp, Mus musculus
gatcacccacggactcatggctggg

SEQ ID NO: 34413 - DNA, 25 bp, Mus musculus
gatcacccagtgcagaccttttctt

SEQ ID NO: 34414 - DNA, 25 bp, Mus musculus
gatcaccgcgtcagggtccttattt

SEQ ID NO: 34415 - DNA, 25 bp, Mus musculus
gatcaccttacaatttgaactttag

SEQ ID NO: 34416 - DNA, 25 bp, Mus musculus
gatcaccttctcatactagaccaag

SEQ ID NO: 34417 - DNA, 25 bp, Mus musculus
gatcacgacgttggctttccaagtt

SEQ ID NO: 34418 - DNA, 25 bp, Mus musculus
gatcacgccgatccatgaaaatgct

SEQ ID NO: 34419 - DNA, 25 bp, Mus musculus
gatcacggattagtcaaccttagga

SEQ ID NO: 34420 - DNA, 25 bp, Mus musculus
gatcacgtatgtccttcgatccgga

SEQ ID NO: 34421 - DNA, 25 bp, Mus musculus
gatcactagaagaacctctacccct

SEQ ID NO: 34422 - DNA, 25 bp, Mus musculus
gatcactccggcacgttgggtcccg

SEQ ID NO: 34423 - DNA, 25 bp, Mus musculus
gatcactgaagagtctaaggctctc

SEQ ID NO: 34424 - DNA, 25 bp, Mus musculus
gatcactgcccagcgtctgtgtgga

SEQ ID NO: 34425 - DNA, 25 bp, Mus musculus
gatcacttagtccaccactgtccaa

SEQ ID NO: 34426 - DNA, 25 bp, Mus musculus
gatcacttgctcacatgtcaagttg

SEQ ID NO: 34427 - DNA, 25 bp, Mus musculus
gatcagaacccatactatggaggag

SEQ ID NO: 34428 - DNA, 25 bp, Mus musculus
gatcagacattccaagacttcatgg

SEQ ID NO: 34429 - DNA, 25 bp, Mus musculus
gatcagaccgacagctctgggcaga

SEQ ID NO: 34430 - DNA, 25 bp, Mus musculus
gatcagacctgcagccactttaact

SEQ ID NO: 34431 - DNA, 25 bp, Mus musculus
gatcagaccttgaaagcattaatgg

SEQ ID NO: 34432 - DNA, 25 bp, Mus musculus
gatcagacgtgggttttgggatttt

SEQ ID NO: 34433 - DNA, 25 bp, Mus musculus
gatcagactcctagtgaaccacaga

SEQ ID NO: 34434 - DNA, 25 bp, Mus musculus
gatcagagggccgatttccagggaa

SEQ ID NO: 34435 - DNA, 25 bp, Mus musculus
gatcagaggtggagtccacacggca

SEQ ID NO: 34436 - DNA, 25 bp, Mus musculus
gatcagagtgatgcaggacttcttc

SEQ ID NO: 34437 - DNA, 25 bp, Mus musculus
gatcagatgccaaagagtcagcagc

SEQ ID NO: 34438 - DNA, 25 bp, Mus musculus
gatcagcaatctcactgccacagct

SEQ ID NO: 34439 - DNA, 25 bp, Mus musculus
gatcagcagatatgggaaaagtcaa

SEQ ID NO: 34440 - DNA, 25 bp, Mus musculus
gatcagcagatgttcctgagcctag

SEQ ID NO: 34441 - DNA, 25 bp, Mus musculus
gatcagcagctggtgagtgccacgc

SEQ ID NO: 34442 - DNA, 25 bp, Mus musculus
gatcagcaggtagcctggtttccag

SEQ ID NO: 34443 - DNA, 25 bp, Mus musculus
gatcagccctcaaggctatggccgc

SEQ ID NO: 34444 - DNA, 25 bp, Mus musculus
gatcagccctcatggctatggccgc

SEQ ID NO: 34445 - DNA, 25 bp, Mus musculus
gatcagccgtttaacctgtccacag

SEQ ID NO: 34446 - DNA, 25 bp, Mus musculus
gatcagccttcacttgtccacggaa

SEQ ID NO: 34447 - DNA, 25 bp, Mus musculus
gatcagcgagtactcccgcaaagtg

SEQ ID NO: 34448 - DNA, 25 bp, Mus musculus
gatcagctctgacttggacgggcat

SEQ ID NO: 34449 - DNA, 25 bp, Mus musculus
gatcagctgccgaccccgagggcta

SEQ ID NO: 34450 - DNA, 25 bp, Mus musculus
gatcagctggagaaagtgctccctc

SEQ ID NO: 34451 - DNA, 25 bp, Mus musculus
gatcagctggtttgtgaacaacgtg

SEQ ID NO: 34452 - DNA, 25 bp, Mus musculus
gatcagcttgatgacgaaactcttt

SEQ ID NO: 34453 - DNA, 25 bp, Mus musculus
gatcaggaaacttccccagctgaag

SEQ ID NO: 34454 - DNA, 25 bp, Mus musculus
gatcaggagttagaagttcaccaca

SEQ ID NO: 34455 - DNA, 25 bp, Mus musculus
gatcaggatctacagccaatcagcc

SEQ ID NO: 34456 - DNA, 25 bp, Mus musculus
gatcagggatgcagtaccacttgca

SEQ ID NO: 34457 - DNA, 25 bp, Mus musculus
gatcagggcagtctgtgcacgtcat

SEQ ID NO: 34458 - DNA, 25 bp, Mus musculus
gatcagggtctttggactactacca

SEQ ID NO: 34459 - DNA, 25 bp, Mus musculus
gatcaggtgctaggccgctttttcc

SEQ ID NO: 34460 - DNA, 25 bp, Mus musculus
gatcagtaagcaaggcctttctggg

SEQ ID NO: 34461 - DNA, 25 bp, Mus musculus
gatcagtatgagactattctgggca

SEQ ID NO: 34462 - DNA, 25 bp, Mus musculus
gatcagtatgagtctattctgggca

SEQ ID NO: 34463 - DNA, 25 bp, Mus musculus
gatcagtggagacctaacatgccct

SEQ ID NO: 34464 - DNA, 25 bp, Mus musculus
gatcagtggagagctaacatgccct

SEQ ID NO: 34465 - DNA, 25 bp, Mus musculus
gatcagttgaagctcattttaagac

SEQ ID NO: 34466 - DNA, 25 bp, Mus musculus
gatcagttggctgaaatgcttcctg

SEQ ID NO: 34467 - DNA, 25 bp, Mus musculus
gatcatacaacagacttactttcac

SEQ ID NO: 34468 - DNA, 25 bp, Mus musculus
gatcatagcttcctctatatcgagg

SEQ ID NO: 34469 - DNA, 25 bp, Mus musculus
gatcataggagtaaatgacgtgcca

SEQ ID NO: 34470 - DNA, 25 bp, Mus musculus
gatcatagtcctagggcaccacatc

SEQ ID NO: 34471 - DNA, 25 bp, Mus musculus
gatcatatatgtgcagtattcaacc

SEQ ID NO: 34472 - DNA, 25 bp, Mus musculus
gatcatcaagccacaaatgtacctt

SEQ ID NO: 34473 - DNA, 25 bp, Mus musculus
gatcatcagacttctctgtccaaga

SEQ ID NO: 34474 - DNA, 25 bp, Mus musculus
gatcatcattgaccgggaggccttc

SEQ ID NO: 34475 - DNA, 25 bp, Mus musculus
gatcatccaactccagcgtggtgag

SEQ ID NO: 34476 - DNA, 25 bp, Mus musculus
gatcatccatctcagcctcgaaagg

SEQ ID NO: 34477 - DNA, 25 bp, Mus musculus
gatcatccatctgagcctcgaaagg

SEQ ID NO: 34478 - DNA, 25 bp, Mus musculus
gatcatccgccctggcagtctggat

SEQ ID NO: 34479 - DNA, 25 bp, Mus musculus
gatcatccgcttcctgctcctgttt

SEQ ID NO: 34480 - DNA, 25 bp, Mus musculus
gatcatcgagctgagacgcacagtc

SEQ ID NO: 34481 - DNA, 25 bp, Mus musculus
gatcatcggagccacggtgttcaag

SEQ ID NO: 34482 - DNA, 25 bp, Mus musculus
gatcatcggagcgacggtgttcaag

SEQ ID NO: 34483 - DNA, 25 bp, Mus musculus
gatcatctcatcaaaggaaggctta

SEQ ID NO: 34484 - DNA, 25 bp, Mus musculus
gatcatctctgggttcaccaagaag

SEQ ID NO: 34485 - DNA, 25 bp, Mus musculus
gatcatctgtccctatcgggtgagt

SEQ ID NO: 34486 - DNA, 25 bp, Mus musculus
gatcatgaagctgacagagcctcag

SEQ ID NO: 34487 - DNA, 25 bp, Mus musculus
gatcatgacagtgggaagccttcca

SEQ ID NO: 34488 - DNA, 25 bp, Mus musculus
gatcatgagtgtggttgatcccaac

SEQ ID NO: 34489 - DNA, 25 bp, Mus musculus
gatcatgatgtttctcccagtaaca

SEQ ID NO: 34490 - DNA, 25 bp, Mus musculus
gatcatggaccaacaagcactagtg

SEQ ID NO: 34491 - DNA, 25 bp, Mus musculus
gatcatggatctgaaagtgacaagc

SEQ ID NO: 34492 - DNA, 25 bp, Mus musculus
gatcattaccaatgcctcgggcagc

SEQ ID NO: 34493 - DNA, 25 bp, Mus musculus
gatcattacgcagaagatcactagt

SEQ ID NO: 34494 - DNA, 25 bp, Mus musculus
gatcattatacccaaagattatcca

SEQ ID NO: 34495 - DNA, 25 bp, Mus musculus
gatcattcgtgactgcatgtacggc

SEQ ID NO: 34496 - DNA, 25 bp, Mus musculus
gatcattcttctctgacaagcaaat

SEQ ID NO: 34497 - DNA, 25 bp, Mus musculus
gatcattgagcgtctcttaaagctg

SEQ ID NO: 34498 - DNA, 25 bp, Mus musculus
gatcattgcagtaaatgagcttcta

SEQ ID NO: 34499 - DNA, 25 bp, Mus musculus
gatcattgtgggtgccctcagtgag

SEQ ID NO: 34500 - DNA, 25 bp, Mus musculus
gatcatttatatggtgttcacaatc

SEQ ID NO: 34501 - DNA, 25 bp, Mus musculus
gatcatttcaaacctttgtgggcca

SEQ ID NO: 34502 - DNA, 25 bp, Mus musculus
gatcatttgtcagggataccagagg

SEQ ID NO: 34503 - DNA, 25 bp, Mus musculus
gatccaaacgaagatacagaatgga

SEQ ID NO: 34504 - DNA, 25 bp, Mus musculus
gatccaacaaaacacattcgacctg

SEQ ID NO: 34505 - DNA, 25 bp, Mus musculus
gatccaacagtatctgtcaggcggc

SEQ ID NO: 34506 - DNA, 25 bp, Mus musculus
gatccaacggtaccaacacttcggc

SEQ ID NO: 34507 - DNA, 25 bp, Mus musculus
gatccaagacactttgcaaacatgg

SEQ ID NO: 34508 - DNA, 25 bp, Mus musculus
gatccaagcaagcatagagcaaata

SEQ ID NO: 34509 - DNA, 25 bp, Mus musculus
gatccaatgcggaaaaatctctggc

SEQ ID NO: 34510 - DNA, 25 bp, Mus musculus
gatccaattaagaagaatagttctg

SEQ ID NO: 34511 - DNA, 25 bp, Mus musculus
gatccacaactttatcagcaccagc

SEQ ID NO: 34512 - DNA, 25 bp, Mus musculus
gatccacactagttatgggaatcca

SEQ ID NO: 34513 - DNA, 25 bp, Mus musculus
gatccaccctaaccagatcgcagtg

SEQ ID NO: 34514 - DNA, 25 bp, Mus musculus
gatccacctgccttaccaatcaagt

SEQ ID NO: 34515 - DNA, 25 bp, Mus musculus
gatccacgactacttggacaacagc

SEQ ID NO: 34516 - DNA, 25 bp, Mus musculus
gatccacgtgtacgagcagcacgag

SEQ ID NO: 34517 - DNA, 25 bp, Mus musculus
gatccacttgtgaccagctacaccg

SEQ ID NO: 34518 - DNA, 25 bp, Mus musculus
gatccactttggagctactggaaag

SEQ ID NO: 34519 - DNA, 25 bp, Mus musculus
gatccagaaaaaccgccgggtagtg

SEQ ID NO: 34520 - DNA, 25 bp, Mus musculus
gatccagaacttgcagcaacaatag

SEQ ID NO: 34521 - DNA, 25 bp, Mus musculus
gatccagacatgtactctctgatag

SEQ ID NO: 34522 - DNA, 25 bp, Mus musculus
gatccagagcactgtggactggagt

SEQ ID NO: 34523 - DNA, 25 bp, Mus musculus
gatccagcagcagcggcttcagagt

SEQ ID NO: 34524 - DNA, 25 bp, Mus musculus
gatccagctcgagtcaacgtgcctg

SEQ ID NO: 34525 - DNA, 25 bp, Mus musculus
gatccaggcatttaacctacaaaag

SEQ ID NO: 34526 - DNA, 25 bp, Mus musculus
gatccagtcaccaacctaaacaatg

SEQ ID NO: 34527 - DNA, 25 bp, Mus musculus
gatccagtctcacatgggacgcctg

SEQ ID NO: 34528 - DNA, 25 bp, Mus musculus
gatccagtgaggcatttctcgacct

SEQ ID NO: 34529 - DNA, 25 bp, Mus musculus
gatccagttgatccgcataaggtgt

SEQ ID NO: 34530 - DNA, 25 bp, Mus musculus
gatccagttttctggtggtctccag

SEQ ID NO: 34531 - DNA, 25 bp, Mus musculus
gatccatattccacgttggtgaata

SEQ ID NO: 34532 - DNA, 25 bp, Mus musculus
gatccatcaggaagtagaagaacag

SEQ ID NO: 34533 - DNA, 25 bp, Mus musculus
gatccatcagttcttcagcttcact

SEQ ID NO: 34534 - DNA, 25 bp, Mus musculus
gatccatcctgaatgccaacgttgc

SEQ ID NO: 34535 - DNA, 25 bp, Mus musculus
gatccatgccagaaacaagcctgtg

SEQ ID NO: 34536 - DNA, 25 bp, Mus musculus
gatccatggacctcagcaccttcga

SEQ ID NO: 34537 - DNA, 25 bp, Mus musculus
gatccatgtgggaccagctagagga

SEQ ID NO: 34538 - DNA, 25 bp, Mus musculus
gatccattaacctgcttcatcagag

SEQ ID NO: 34539 - DNA, 25 bp, Mus musculus
gatccatttgctcccaagacggact

SEQ ID NO: 34540 - DNA, 25 bp, Mus musculus
gatcccaaagactgggctgctcagt

SEQ ID NO: 34541 - DNA, 25 bp, Mus musculus
gatcccaaccaagtccaggagtgaa

SEQ ID NO: 34542 - DNA, 25 bp, Mus musculus
gatcccaaccactatggcagctgct

SEQ ID NO: 34543 - DNA, 25 bp, Mus musculus
gatcccaaccctgagaactttgtgg

SEQ ID NO: 34544 - DNA, 25 bp, Mus musculus
gatcccaacgagataccaaagattg

SEQ ID NO: 34545 - DNA, 25 bp, Mus musculus
gatcccaaggaatgggcagctcagt

SEQ ID NO: 34546 - DNA, 25 bp, Mus musculus
gatcccaagtaaacaacccgagcca

SEQ ID NO: 34547 - DNA, 25 bp, Mus musculus
gatcccacaggttaacatcatgacg

SEQ ID NO: 34548 - DNA, 25 bp, Mus musculus
gatcccacccagctggcagaagtag

SEQ ID NO: 34549 - DNA, 25 bp, Mus musculus
gatcccagactttttgcagatcaag

SEQ ID NO: 34550 - DNA, 25 bp, Mus musculus
gatcccagcaacgtggattctctct

SEQ ID NO: 34551 - DNA, 25 bp, Mus musculus
gatcccagcggaccacgtgattgtg

SEQ ID NO: 34552 - DNA, 25 bp, Mus musculus
gatcccaggctcctgttgcacatgc

SEQ ID NO: 34553 - DNA, 25 bp, Mus musculus
gatcccagggtctcctctgagaatc

SEQ ID NO: 34554 - DNA, 25 bp, Mus musculus
gatcccatcgatctgaagatttctg

SEQ ID NO: 34555 - DNA, 25 bp, Mus musculus
gatcccatcgatgtgaagatttctg

SEQ ID NO: 34556 - DNA, 25 bp, Mus musculus
gatcccatttctctggctggagaca

SEQ ID NO: 34557 - DNA, 25 bp, Mus musculus
gatccccacgaactttgtatttaag

SEQ ID NO: 34558 - DNA, 25 bp, Mus musculus
gatccccaggattggaattacctgt

SEQ ID NO: 34559 - DNA, 25 bp, Mus musculus
gatccccatggaaggtatcccatct

SEQ ID NO: 34560 - DNA, 25 bp, Mus musculus
gatccccgcctttcaaagagagaag

SEQ ID NO: 34561 - DNA, 25 bp, Mus musculus
gatccccgtggaataccagacggtg

SEQ ID NO: 34562 - DNA, 25 bp, Mus musculus
gatcccctgttatctgtacgaacct

SEQ ID NO: 34563 - DNA, 25 bp, Mus musculus
gatccctgacgacatgggatcaaaa

SEQ ID NO: 34564 - DNA, 25 bp, Mus musculus
gatccctgctgctccagaatgtcac

SEQ ID NO: 34565 - DNA, 25 bp, Mus musculus
gatccctgggaccaagaagacatgg

SEQ ID NO: 34566 - DNA, 25 bp, Mus musculus
gatccgaacaagctcagaatgaaaa

SEQ ID NO: 34567 - DNA, 25 bp, Mus musculus
gatccgaagcacagctgagtttcag

SEQ ID NO: 34568 - DNA, 25 bp, Mus musculus
gatccgacaacagcagcagaaaatt

SEQ ID NO: 34569 - DNA, 25 bp, Mus musculus
gatccgacagatttaccactctgag

SEQ ID NO: 34570 - DNA, 25 bp, Mus musculus
gatccgacccatcctcaagaggcta

SEQ ID NO: 34571 - DNA, 25 bp, Mus musculus
gatccgagagactggagatgactac

SEQ ID NO: 34572 - DNA, 25 bp, Mus musculus
gatccgagctcctactactgctttg

SEQ ID NO: 34573 - DNA, 25 bp, Mus musculus
gatccgagggaagcacgtctgtgat

SEQ ID NO: 34574 - DNA, 25 bp, Mus musculus
gatccgattcttctttgaaaaaggc

SEQ ID NO: 34575 - DNA, 25 bp, Mus musculus
gatccgccaggccattgaacggcaa

SEQ ID NO: 34576 - DNA, 25 bp, Mus musculus
gatccgcctggcgagtctccacagc

SEQ ID NO: 34577 - DNA, 25 bp, Mus musculus
gatccggccaatggcaagttcagta

SEQ ID NO: 34578 - DNA, 25 bp, Mus musculus
gatccggccactgtgtacagtctcg

SEQ ID NO: 34579 - DNA, 25 bp, Mus musculus
gatccgggcccatgtgacgtcatgt

SEQ ID NO: 34580 - DNA, 25 bp, Mus musculus
gatccggggttctaaggagactgca

SEQ ID NO: 34581 - DNA, 25 bp, Mus musculus
gatccggtgaccatcgagaacaaag

SEQ ID NO: 34582 - DNA, 25 bp, Mus musculus
gatccggttcttggtgatacacagc

SEQ ID NO: 34583 - DNA, 25 bp, Mus musculus
gatccgtcatgtgactcagggagct

SEQ ID NO: 34584 - DNA, 25 bp, Mus musculus
gatccgtgccggtggagctggagtc

SEQ ID NO: 34585 - DNA, 25 bp, Mus musculus
gatccgtttattccattctacacag

SEQ ID NO: 34586 - DNA, 25 bp, Mus musculus
gatccgtttctcatttcagacgaac

SEQ ID NO: 34587 - DNA, 25 bp, Mus musculus
gatcctaagacacgcttacttatgt

SEQ ID NO: 34588 - DNA, 25 bp, Mus musculus
gatcctaagggtggagccctctgta

SEQ ID NO: 34589 - DNA, 25 bp, Mus musculus
gatcctaatgccaagctgctccagc

SEQ ID NO: 34590 - DNA, 25 bp, Mus musculus
gatcctactgacagccattgttcag

SEQ ID NO: 34591 - DNA, 25 bp, Mus musculus
gatcctagcttccttctggcctgtg

SEQ ID NO: 34592 - DNA, 25 bp, Mus musculus
gatcctagtttccaatggcacagat

SEQ ID NO: 34593 - DNA, 25 bp, Mus musculus
gatcctataacatttgcaccattta

SEQ ID NO: 34594 - DNA, 25 bp, Mus musculus
gatcctatgacattgatgcgcagac

SEQ ID NO: 34595 - DNA, 25 bp, Mus musculus
gatcctcaaggagtccagagtgacc

SEQ ID NO: 34596 - DNA, 25 bp, Mus musculus
gatcctcaggctggaaaactgaaca

SEQ ID NO: 34597 - DNA, 25 bp, Mus musculus
gatcctcagtctgttagagtctgcg

SEQ ID NO: 34598 - DNA, 25 bp, Mus musculus
gatcctccagatagccactgccttt

SEQ ID NO: 34599 - DNA, 25 bp, Mus musculus
gatcctccctctcatggtagcaagc

SEQ ID NO: 34600 - DNA, 25 bp, Mus musculus
gatcctcctccggaagggtgtgcag

SEQ ID NO: 34601 - DNA, 25 bp, Mus musculus
gatcctcgatgcaaactctgtgtgt

SEQ ID NO: 34602 - DNA, 25 bp, Mus musculus
gatcctctaggactggaattaagac

SEQ ID NO: 34603 - DNA, 25 bp, Mus musculus
gatcctctccgaagaggaacagaag

SEQ ID NO: 34604 - DNA, 25 bp, Mus musculus
gatcctctcggaattagttgtgtaa

SEQ ID NO: 34605 - DNA, 25 bp, Mus musculus
gatcctcttgatcaagctgacttca

SEQ ID NO: 34606 - DNA, 25 bp, Mus musculus
gatcctgaatatgtctctagtgttg

SEQ ID NO: 34607 - DNA, 25 bp, Mus musculus
gatcctgacataaacccttgcttgt

SEQ ID NO: 34608 - DNA, 25 bp, Mus musculus
gatcctgaccgagctgctcatggtg

SEQ ID NO: 34609 - DNA, 25 bp, Mus musculus
gatcctgacggaaatcccaagtgta

SEQ ID NO: 34610 - DNA, 25 bp, Mus musculus
gatcctgcacacagggccgtgatgc

SEQ ID NO: 34611 - DNA, 25 bp, Mus musculus
gatcctgcccgttggatggtgcctc

SEQ ID NO: 34612 - DNA, 25 bp, Mus musculus
gatcctgccggctgaagctgaactg

SEQ ID NO: 34613 - DNA, 25 bp, Mus musculus
gatcctggaatatataaatgtgttg

SEQ ID NO: 34614 - DNA, 25 bp, Mus musculus
gatcctggctgagtatctcaacctg

SEQ ID NO: 34615 - DNA, 25 bp, Mus musculus
gatcctggtgacagttctggtgcag

SEQ ID NO: 34616 - DNA, 25 bp, Mus musculus
gatcctggtgatccagcccaacagg

SEQ ID NO: 34617 - DNA, 25 bp, Mus musculus
gatcctggtgatgcagcccaacagg

SEQ ID NO: 34618 - DNA, 25 bp, Mus musculus
gatcctgtcatccttaccaatggcc

SEQ ID NO: 34619 - DNA, 25 bp, Mus musculus
gatcctgtccaacaagaagccggag

SEQ ID NO: 34620 - DNA, 25 bp, Mus musculus
gatcctgtccccatcagactacggt

SEQ ID NO: 34621 - DNA, 25 bp, Mus musculus
gatcctgttaacatgcaggtccaga

SEQ ID NO: 34622 - DNA, 25 bp, Mus musculus
gatcctgttcaagttgaaggcttgg

SEQ ID NO: 34623 - DNA, 25 bp, Mus musculus
gatccttaaatttagagcattcgca

SEQ ID NO: 34624 - DNA, 25 bp, Mus musculus
gatccttactagatgttcgtttacc

SEQ ID NO: 34625 - DNA, 25 bp, Mus musculus
gatccttatgcacttgatgttccaa

SEQ ID NO: 34626 - DNA, 25 bp, Mus musculus
gatccttcaaggtccagctacattg

SEQ ID NO: 34627 - DNA, 25 bp, Mus musculus
gatccttcacttcatcctatgctgt

SEQ ID NO: 34628 - DNA, 25 bp, Mus musculus
gatccttcaggctctggcttgggca

SEQ ID NO: 34629 - DNA, 25 bp, Mus musculus
gatccttccaccagcatcaacgtag

SEQ ID NO: 34630 - DNA, 25 bp, Mus musculus
gatccttgcacagtcatagacttgc

SEQ ID NO: 34631 - DNA, 25 bp, Mus musculus
gatccttgcctgagacggttatgga

SEQ ID NO: 34632 - DNA, 25 bp, Mus musculus
gatccttgctcccttcttcctggaa

SEQ ID NO: 34633 - DNA, 25 bp, Mus musculus
gatccttggccatccggcagatggg

SEQ ID NO: 34634 - DNA, 25 bp, Mus musculus
gatccttggggaccagctgacagct

SEQ ID NO: 34635 - DNA, 25 bp, Mus musculus
gatccttgtaaaacatgcctttcct

SEQ ID NO: 34636 - DNA, 25 bp, Mus musculus
gatcctttgtgtataatggacaagc

SEQ ID NO: 34637 - DNA, 25 bp, Mus musculus
gatcgaaaacgggagctggagcatc

SEQ ID NO: 34638 - DNA, 25 bp, Mus musculus
gatcgaaaccacagcctatgccctg

SEQ ID NO: 34639 - DNA, 25 bp, Mus musculus
gatcgaaagatacctcctcccattg

SEQ ID NO: 34640 - DNA, 25 bp, Mus musculus
gatcgaaggatgacagcccatccgc

SEQ ID NO: 34641 - DNA, 25 bp, Mus musculus
gatcgaatcatcagggtctggaatc

SEQ ID NO: 34642 - DNA, 25 bp, Mus musculus
gatcgaattctagagcacctgcctg

SEQ ID NO: 34643 - DNA, 25 bp, Mus musculus
gatcgacccctggaccttgcagatg

SEQ ID NO: 34644 - DNA, 25 bp, Mus musculus
gatcgacctcaacgagtggctggcc

SEQ ID NO: 34645 - DNA, 25 bp, Mus musculus
gatcgacgacatcaatgactcccgg

SEQ ID NO: 34646 - DNA, 25 bp, Mus musculus
gatcgactatggtgcccacagcttc

SEQ ID NO: 34647 - DNA, 25 bp, Mus musculus
gatcgactgccactggtcggctcca

SEQ ID NO: 34648 - DNA, 25 bp, Mus musculus
gatcgactggaagagagttgaaaaa

SEQ ID NO: 34649 - DNA, 25 bp, Mus musculus
gatcgactgtgtaagcagttagaaa

SEQ ID NO: 34650 - DNA, 25 bp, Mus musculus
gatcgagagcatagagacttcttgc

SEQ ID NO: 34651 - DNA, 25 bp, Mus musculus
gatcgaggcagaattgctgagccct

SEQ ID NO: 34652 - DNA, 25 bp, Mus musculus
gatcgatacgtacttcaccggtcct

SEQ ID NO: 34653 - DNA, 25 bp, Mus musculus
gatcgatgattactctggaagtgga

SEQ ID NO: 34654 - DNA, 25 bp, Mus musculus
gatcgatgcataaatatcaccaaac

SEQ ID NO: 34655 - DNA, 25 bp, Mus musculus
gatcgatgtgatggcgccctcctca

SEQ ID NO: 34656 - DNA, 25 bp, Mus musculus
gatcgattgcctctgattcttgaat

SEQ ID NO: 34657 - DNA, 25 bp, Mus musculus
gatcgccaatggtgagctttggagc

SEQ ID NO: 34658 - DNA, 25 bp, Mus musculus
gatcgccacaaccagagctgcgagt

SEQ ID NO: 34659 - DNA, 25 bp, Mus musculus
gatcgcctctcaaggagtcttgtga

SEQ ID NO: 34660 - DNA, 25 bp, Mus musculus
gatcgcctgccagaagctggttgtg

SEQ ID NO: 34661 - DNA, 25 bp, Mus musculus
gatcgcctgtaatggctttaaaaag

SEQ ID NO: 34662 - DNA, 25 bp, Mus musculus
gatcgccttcgggacattgctgacc

SEQ ID NO: 34663 - DNA, 25 bp, Mus musculus
gatcgccttggtgctgagtccaaag

SEQ ID NO: 34664 - DNA, 25 bp, Mus musculus
gatcggaaagcccagtgccgctgtc

SEQ ID NO: 34665 - DNA, 25 bp, Mus musculus
gatcggaaagccgagtgccgctgtc

SEQ ID NO: 34666 - DNA, 25 bp, Mus musculus
gatcggaaagtagagcttgaaaagg

SEQ ID NO: 34667 - DNA, 25 bp, Mus musculus
gatcggaatgtcaacctgtgggacc

SEQ ID NO: 34668 - DNA, 25 bp, Mus musculus
gatcggagtctactctggacccagg

SEQ ID NO: 34669 - DNA, 25 bp, Mus musculus
gatcggatcttctactcagtgttga

SEQ ID NO: 34670 - DNA, 25 bp, Mus musculus
gatcgggcagctttcgaggccgaat

SEQ ID NO: 34671 - DNA, 25 bp, Mus musculus
gatcgggcgcggtactcagcctttt

SEQ ID NO: 34672 - DNA, 25 bp, Mus musculus
gatcgggtcctttggagcccacact

SEQ ID NO: 34673 - DNA, 25 bp, Mus musculus
gatcggtacctgaccatcagttgcc

SEQ ID NO: 34674 - DNA, 25 bp, Mus musculus
gatcgtagacatggaaggtgcacca

SEQ ID NO: 34675 - DNA, 25 bp, Mus musculus
gatcgtagagctagctcacagcggg

SEQ ID NO: 34676 - DNA, 25 bp, Mus musculus
gatcgtaggtggtctgattcagaag

SEQ ID NO: 34677 - DNA, 25 bp, Mus musculus
gatcgtatgctgctagactacttct

SEQ ID NO: 34678 - DNA, 25 bp, Mus musculus
gatcgtcaatgcctggacagccagc

SEQ ID NO: 34679 - DNA, 25 bp, Mus musculus
gatcgtgactatggccatggatcct

SEQ ID NO: 34680 - DNA, 25 bp, Mus musculus
gatcgtgctcaggagcgtctggcca

SEQ ID NO: 34681 - DNA, 25 bp, Mus musculus
gatcgtgtcgaagaaggcatgaacc

SEQ ID NO: 34682 - DNA, 25 bp, Mus musculus
gatcgtgtgatctcactctcaggag

SEQ ID NO: 34683 - DNA, 25 bp, Mus musculus
gatcgtgttttcgatgttaacgaca

SEQ ID NO: 34684 - DNA, 25 bp, Mus musculus
gatcgttcatctaacaaaggtaact

SEQ ID NO: 34685 - DNA, 25 bp, Mus musculus
gatcgttcttactgaacttcgcagg

SEQ ID NO: 34686 - DNA, 25 bp, Mus musculus
gatctaacagttcaccgggcaactc

SEQ ID NO: 34687 - DNA, 25 bp, Mus musculus
gatctaaggtggaaaaacagctgca

SEQ ID NO: 34688 - DNA, 25 bp, Mus musculus
gatctacacttttcatgcacatggg

SEQ ID NO: 34689 - DNA, 25 bp, Mus musculus
gatctacagactacacttggaaaca

SEQ ID NO: 34690 - DNA, 25 bp, Mus musculus
gatctacatgatacgaccagccgag

SEQ ID NO: 34691 - DNA, 25 bp, Mus musculus
gatctacgatgcctaccggaaagcc

SEQ ID NO: 34692 - DNA, 25 bp, Mus musculus
gatctactaccagacagacatgcag

SEQ ID NO: 34693 - DNA, 25 bp, Mus musculus
gatctactactggtcctgggatagg

SEQ ID NO: 34694 - DNA, 25 bp, Mus musculus
gatctactgctgagccagtttctca

SEQ ID NO: 34695 - DNA, 25 bp, Mus musculus
gatctagaagcaagactttctggat

SEQ ID NO: 34696 - DNA, 25 bp, Mus musculus
gatctagcagagatagacctttccc

SEQ ID NO: 34697 - DNA, 25 bp, Mus musculus
gatctaggagattcagcatcacgcg

SEQ ID NO: 34698 - DNA, 25 bp, Mus musculus
gatctagtcagtgcctctgacgatg

SEQ ID NO: 34699 - DNA, 25 bp, Mus musculus
gatctatcagtcttacctgcccaga

SEQ ID NO: 34700 - DNA, 25 bp, Mus musculus
gatctatccaagcaggtcaaaggat

SEQ ID NO: 34701 - DNA, 25 bp, Mus musculus
gatctatcgggctgctctctaacac

SEQ ID NO: 34702 - DNA, 25 bp, Mus musculus
gatctatgaccgctatggccgggaa

SEQ ID NO: 34703 - DNA, 25 bp, Mus musculus
gatctatgccagagcggcgaacatg

SEQ ID NO: 34704 - DNA, 25 bp, Mus musculus
gatctatggcctttcctctctctgg

SEQ ID NO: 34705 - DNA, 25 bp, Mus musculus
gatctcaacgggaagccccgagaag

SEQ ID NO: 34706 - DNA, 25 bp, Mus musculus
gatctcacctgattccgtttggaaa

SEQ ID NO: 34707 - DNA, 25 bp, Mus musculus
gatctcagaagggatgctttggaag

SEQ ID NO: 34708 - DNA, 25 bp, Mus musculus
gatctcagatggatttcacatgctc

SEQ ID NO: 34709 - DNA, 25 bp, Mus musculus
gatctcagcatcacagcaactcaaa

SEQ ID NO: 34710 - DNA, 25 bp, Mus musculus
gatctcagcccatgaccagttcaag

SEQ ID NO: 34711 - DNA, 25 bp, Mus musculus
gatctcagtgaagagacccagcctg

SEQ ID NO: 34712 - DNA, 25 bp, Mus musculus
gatctcatcatgttcagcaagtgcc

SEQ ID NO: 34713 - DNA, 25 bp, Mus musculus
gatctccagggctcgacacttcttt

SEQ ID NO: 34714 - DNA, 25 bp, Mus musculus
gatctccctcagctgggaggcttgt

SEQ ID NO: 34715 - DNA, 25 bp, Mus musculus
gatctccgaggtgacttttcgacag

SEQ ID NO: 34716 - DNA, 25 bp, Mus musculus
gatctccggcttggagcagcataca

SEQ ID NO: 34717 - DNA, 25 bp, Mus musculus
gatctcctgcttcgaattttggaag

SEQ ID NO: 34718 - DNA, 25 bp, Mus musculus
gatctcctgtcaggctccctgggtg

SEQ ID NO: 34719 - DNA, 25 bp, Mus musculus
gatctcgatcaccttctcatactag

SEQ ID NO: 34720 - DNA, 25 bp, Mus musculus
gatctcggaactcacccaggaactt

SEQ ID NO: 34721 - DNA, 25 bp, Mus musculus
gatctcgtatccagtttgagttcct

SEQ ID NO: 34722 - DNA, 25 bp, Mus musculus
gatctctatgcacggatgagttttc

SEQ ID NO: 34723 - DNA, 25 bp, Mus musculus
gatctctatggctcacagatgtgcc

SEQ ID NO: 34724 - DNA, 25 bp, Mus musculus
gatctctctccttcttacgattatg

SEQ ID NO: 34725 - DNA, 25 bp, Mus musculus
gatctctgaaagagaactatcctga

SEQ ID NO: 34726 - DNA, 25 bp, Mus musculus
gatctctgggaatgtcagcacctca

SEQ ID NO: 34727 - DNA, 25 bp, Mus musculus
gatctctgggggtcttcctgctgcc

SEQ ID NO: 34728 - DNA, 25 bp, Mus musculus
gatctcttagagctgaatacgacga

SEQ ID NO: 34729 - DNA, 25 bp, Mus musculus
gatctgaaatgctttacacacctga

SEQ ID NO: 34730 - DNA, 25 bp, Mus musculus
gatctgaagtgcaaaatactttcca

SEQ ID NO: 34731 - DNA, 25 bp, Mus musculus
gatctgaataatgtacgtttctctg

SEQ ID NO: 34732 - DNA, 25 bp, Mus musculus
gatctgaatctcaactctatgtcag

SEQ ID NO: 34733 - DNA, 25 bp, Mus musculus
gatctgaatctctactctatgtcag

SEQ ID NO: 34734 - DNA, 25 bp, Mus musculus
gatctgacctatctaaggatcaagg

SEQ ID NO: 34735 - DNA, 25 bp, Mus musculus
gatctgacctatggaagagattcca

SEQ ID NO: 34736 - DNA, 25 bp, Mus musculus
gatctgacgtggaccttccctggag

SEQ ID NO: 34737 - DNA, 25 bp, Mus musculus
gatctgagcatgagcacttccacag

SEQ ID NO: 34738 - DNA, 25 bp, Mus musculus
gatctgagcgggaagcatcatcgaa

SEQ ID NO: 34739 - DNA, 25 bp, Mus musculus
gatctgagcgtcatctgtttcacca

SEQ ID NO: 34740 - DNA, 25 bp, Mus musculus
gatctgatatttggctataagcaaa

SEQ ID NO: 34741 - DNA, 25 bp, Mus musculus
gatctgatgaacgacctggcctgtt

SEQ ID NO: 34742 - DNA, 25 bp, Mus musculus
gatctgcaagtgctacctgttggag

SEQ ID NO: 34743 - DNA, 25 bp, Mus musculus
gatctgcacacaaatgttgccactg

SEQ ID NO: 34744 - DNA, 25 bp, Mus musculus
gatctgcatgatccggagacacttg

SEQ ID NO: 34745 - DNA, 25 bp, Mus musculus
gatctgccaacctgtgcgcctgggt

SEQ ID NO: 34746 - DNA, 25 bp, Mus musculus
gatctgccagagtccttggaggcga

SEQ ID NO: 34747 - DNA, 25 bp, Mus musculus
gatctgcccctggatgggactctca

SEQ ID NO: 34748 - DNA, 25 bp, Mus musculus
gatctgcgaccagtgggataacctg

SEQ ID NO: 34749 - DNA, 25 bp, Mus musculus
gatctgcgggatccaagccagatcg

SEQ ID NO: 34750 - DNA, 25 bp, Mus musculus
gatctgcgtgcttgctggttctggc

SEQ ID NO: 34751 - DNA, 25 bp, Mus musculus
gatctgctcagcagacactcacaca

SEQ ID NO: 34752 - DNA, 25 bp, Mus musculus
gatctgctccgacaagtgtctcatt

SEQ ID NO: 34753 - DNA, 25 bp, Mus musculus
gatctgctggaagtcacatctggtt

SEQ ID NO: 34754 - DNA, 25 bp, Mus musculus
gatctggaaacctctagaacaagta

SEQ ID NO: 34755 - DNA, 25 bp, Mus musculus
gatctggaatatgtctccagtcctc

SEQ ID NO: 34756 - DNA, 25 bp, Mus musculus
gatctggacggtgactgtgagccca

SEQ ID NO: 34757 - DNA, 25 bp, Mus musculus
gatctggagactcaccactagaaga

SEQ ID NO: 34758 - DNA, 25 bp, Mus musculus
gatctggcacacgacgagtgcaggc

SEQ ID NO: 34759 - DNA, 25 bp, Mus musculus
gatctggcccagatgacctacctga

SEQ ID NO: 34760 - DNA, 25 bp, Mus musculus
gatctggcctgagcctgtccttggg

SEQ ID NO: 34761 - DNA, 25 bp, Mus musculus
gatctggcttcgagaacataaccgc

SEQ ID NO: 34762 - DNA, 25 bp, Mus musculus
gatctggcttcgtgaacataaccgc

SEQ ID NO: 34763 - DNA, 25 bp, Mus musculus
gatctgggaaactcccatggaagcc

SEQ ID NO: 34764 - DNA, 25 bp, Mus musculus
gatctgggaccatctgagcactatg

SEQ ID NO: 34765 - DNA, 25 bp, Mus musculus
gatctgggcaaactcatgaagcatg

SEQ ID NO: 34766 - DNA, 25 bp, Mus musculus
gatctgggtatctcagtagccctga

SEQ ID NO: 34767 - DNA, 25 bp, Mus musculus
gatctgggttgaagcagaagaaaca

SEQ ID NO: 34768 - DNA, 25 bp, Mus musculus
gatctgggttgatgcagaagaaaca

SEQ ID NO: 34769 - DNA, 25 bp, Mus musculus
gatctggtgacaaacgtactccctt

SEQ ID NO: 34770 - DNA, 25 bp, Mus musculus
gatctggttagtgcaatttatggcc

SEQ ID NO: 34771 - DNA, 25 bp, Mus musculus
gatctgtaggcctttctgtccagcg

SEQ ID NO: 34772 - DNA, 25 bp, Mus musculus
gatctgtcagagcagagactatact

SEQ ID NO: 34773 - DNA, 25 bp, Mus musculus
gatctgtcctactgtcctctgcttc

SEQ ID NO: 34774 - DNA, 25 bp, Mus musculus
gatctgtcctctcggagtgaaaccg

SEQ ID NO: 34775 - DNA, 25 bp, Mus musculus
gatctgtggatgatgggtgtccata

SEQ ID NO: 34776 - DNA, 25 bp, Mus musculus
gatctgtggatgttgggtgtccata

SEQ ID NO: 34777 - DNA, 25 bp, Mus musculus
gatctgtttgctcagcttcacgtct

SEQ ID NO: 34778 - DNA, 25 bp, Mus musculus
gatcttaaaaagctatagcttctcc

SEQ ID NO: 34779 - DNA, 25 bp, Mus musculus
gatcttactcagatccccatctttg

SEQ ID NO: 34780 - DNA, 25 bp, Mus musculus
gatcttagacggaagcctgggcttt

SEQ ID NO: 34781 - DNA, 25 bp, Mus musculus
gatcttaggcatcgacttacagaag

SEQ ID NO: 34782 - DNA, 25 bp, Mus musculus
gatcttatcctgtagatatccctgg

SEQ ID NO: 34783 - DNA, 25 bp, Mus musculus
gatcttattcatccttcccatttga

SEQ ID NO: 34784 - DNA, 25 bp, Mus musculus
gatcttcaaaactctacttcgccat

SEQ ID NO: 34785 - DNA, 25 bp, Mus musculus
gatcttcaacttggacatctctcgg

SEQ ID NO: 34786 - DNA, 25 bp, Mus musculus
gatcttcatagtgcaatcggaccaa

SEQ ID NO: 34787 - DNA, 25 bp, Mus musculus
gatcttcctgaccacgcctaggaat

SEQ ID NO: 34788 - DNA, 25 bp, Mus musculus
gatcttcctgaggacgtcagagaaa

SEQ ID NO: 34789 - DNA, 25 bp, Mus musculus
gatcttcgagactttgttaggagcc

SEQ ID NO: 34790 - DNA, 25 bp, Mus musculus
gatcttcggatctatgtttacgtga

SEQ ID NO: 34791 - DNA, 25 bp, Mus musculus
gatcttcggtgtgacaacccttgac

SEQ ID NO: 34792 - DNA, 25 bp, Mus musculus
gatcttctggtgtccatgaggtgcc

SEQ ID NO: 34793 - DNA, 25 bp, Mus musculus
gatcttctgtagttttggaggaaca

SEQ ID NO: 34794 - DNA, 25 bp, Mus musculus
gatcttcttgatgccaacagcgagg

SEQ ID NO: 34795 - DNA, 25 bp, Mus musculus
gatcttcttgtctcagagagcagta

SEQ ID NO: 34796 - DNA, 25 bp, Mus musculus
gatcttgaagcttactgctgatgcc

SEQ ID NO: 34797 - DNA, 25 bp, Mus musculus
gatcttgacaagaaaagtgccaatg

SEQ ID NO: 34798 - DNA, 25 bp, Mus musculus
gatcttgacttgtccaggccacttt

SEQ ID NO: 34799 - DNA, 25 bp, Mus musculus
gatcttgagcactgggatccacaga

SEQ ID NO: 34800 - DNA, 25 bp, Mus musculus
gatcttgataaagagctccagcagg

SEQ ID NO: 34801 - DNA, 25 bp, Mus musculus
gatcttgatcgaacaacccaattta

SEQ ID NO: 34802 - DNA, 25 bp, Mus musculus
gatcttgccaatcaagtctctgtgt

SEQ ID NO: 34803 - DNA, 25 bp, Mus musculus
gatcttgcccgaggtgctggagaaa

SEQ ID NO: 34804 - DNA, 25 bp, Mus musculus
gatcttgctgcataggcaaagctgg

SEQ ID NO: 34805 - DNA, 25 bp, Mus musculus
gatcttgcttccttggcctttatac

SEQ ID NO: 34806 - DNA, 25 bp, Mus musculus
gatcttggaggcatatcaactgtcg

SEQ ID NO: 34807 - DNA, 25 bp, Mus musculus
gatcttgtcctcattactgtacact

SEQ ID NO: 34808 - DNA, 25 bp, Mus musculus
gatctttagagatggtgaagaagcg

SEQ ID NO: 34809 - DNA, 25 bp, Mus musculus
gatctttccgagacaggacgatgtg

SEQ ID NO: 34810 - DNA, 25 bp, Mus musculus
gatctttcggccctgcggtggtcat

SEQ ID NO: 34811 - DNA, 25 bp, Mus musculus
gatctttgaacttggacctcgaggg

SEQ ID NO: 34812 - DNA, 25 bp, Mus musculus
gatctttgatgaactttacaggcag

SEQ ID NO: 34813 - DNA, 25 bp, Mus musculus
gatctttgatgatgaacctactatc

SEQ ID NO: 34814 - DNA, 25 bp, Mus musculus
gatctttgcccgagccagaaacggg

SEQ ID NO: 34815 - DNA, 25 bp, Mus musculus
gatctttttataccccgccaacaag

SEQ ID NO: 34816 - DNA, 25 bp, Mus musculus
gatgaaaaaaggaacgtggagctga

SEQ ID NO: 34817 - DNA, 25 bp, Mus musculus
gatgaaaaactcatgttggaatgga

SEQ ID NO: 34818 - DNA, 25 bp, Mus musculus
gatgaaaacaacctaacagaccctg

SEQ ID NO: 34819 - DNA, 25 bp, Mus musculus
gatgaaaagaatcagctgatgacaa

SEQ ID NO: 34820 - DNA, 25 bp, Mus musculus
gatgaaacatactgtgaccctgcat

SEQ ID NO: 34821 - DNA, 25 bp, Mus musculus
gatgaaacgcagacaacagataaga

SEQ ID NO: 34822 - DNA, 25 bp, Mus musculus
gatgaaagatattgacatgggaaaa

SEQ ID NO: 34823 - DNA, 25 bp, Mus musculus
gatgaaagcagttttggagttacag

SEQ ID NO: 34824 - DNA, 25 bp, Mus musculus
gatgaaaggcagcagtcctagctga

SEQ ID NO: 34825 - DNA, 25 bp, Mus musculus
gatgaaagtgggatcaagttgtcag

SEQ ID NO: 34826 - DNA, 25 bp, Mus musculus
gatgaaatatctggtgaggtgacac

SEQ ID NO: 34827 - DNA, 25 bp, Mus musculus
gatgaaatcaaactagagaacccag

SEQ ID NO: 34828 - DNA, 25 bp, Mus musculus
gatgaaatcaccctgtgccgcactg

SEQ ID NO: 34829 - DNA, 25 bp, Mus musculus
gatgaaatccatgttcgcgattggc

SEQ ID NO: 34830 - DNA, 25 bp, Mus musculus
gatgaaatgcagagaagaattgatg

SEQ ID NO: 34831 - DNA, 25 bp, Mus musculus
gatgaaatggagaaacacagacagg

SEQ ID NO: 34832 - DNA, 25 bp, Mus musculus
gatgaacaaactggaggaaccttac

SEQ ID NO: 34833 - DNA, 25 bp, Mus musculus
gatgaacaagatgaataagagtcgc

SEQ ID NO: 34834 - DNA, 25 bp, Mus musculus
gatgaacagacctaatgcccgcaat

SEQ ID NO: 34835 - DNA, 25 bp, Mus musculus
gatgaacagattttgccagggagat

SEQ ID NO: 34836 - DNA, 25 bp, Mus musculus
gatgaacagcaaatcaacagtgcag

SEQ ID NO: 34837 - DNA, 25 bp, Mus musculus
gatgaacaggagaaagtccggcctg

SEQ ID NO: 34838 - DNA, 25 bp, Mus musculus
gatgaacataccattggtgatccag

SEQ ID NO: 34839 - DNA, 25 bp, Mus musculus
gatgaacatggctctcatgtgcagg

SEQ ID NO: 34840 - DNA, 25 bp, Mus musculus
gatgaaccagggtactgcacgcctt

SEQ ID NO: 34841 - DNA, 25 bp, Mus musculus
gatgaacccagtcttcaacaacgaa

SEQ ID NO: 34842 - DNA, 25 bp, Mus musculus
gatgaacccagtgttcaacaacgaa

SEQ ID NO: 34843 - DNA, 25 bp, Mus musculus
gatgaacgaaccacctggcgctcga

SEQ ID NO: 34844 - DNA, 25 bp, Mus musculus
gatgaacgacatgatcgggaacatg

SEQ ID NO: 34845 - DNA, 25 bp, Mus musculus
gatgaacgacctggcctgttccaca

SEQ ID NO: 34846 - DNA, 25 bp, Mus musculus
gatgaacgccatcattgatactgtg

SEQ ID NO: 34847 - DNA, 25 bp, Mus musculus
gatgaacgtcattccatctgtcccg

SEQ ID NO: 34848 - DNA, 25 bp, Mus musculus
gatgaactacaagacccaagagact

SEQ ID NO: 34849 - DNA, 25 bp, Mus musculus
gatgaactccatcctggtgtatgtt

SEQ ID NO: 34850 - DNA, 25 bp, Mus musculus
gatgaactgctaagcgagaagcccg

SEQ ID NO: 34851 - DNA, 25 bp, Mus musculus
gatgaactggacaaatactccgagg

SEQ ID NO: 34852 - DNA, 25 bp, Mus musculus
gatgaactgtactctctgagagatg

SEQ ID NO: 34853 - DNA, 25 bp, Mus musculus
gatgaacttgtcctccaaactgaca

SEQ ID NO: 34854 - DNA, 25 bp, Mus musculus
gatgaagaatgtgagagactttcga

SEQ ID NO: 34855 - DNA, 25 bp, Mus musculus
gatgaagacacgctggagttcgaca

SEQ ID NO: 34856 - DNA, 25 bp, Mus musculus
gatgaagacctttcggagatcactg

SEQ ID NO: 34857 - DNA, 25 bp, Mus musculus
gatgaagacggacttctcagacagt

SEQ ID NO: 34858 - DNA, 25 bp, Mus musculus
gatgaagagtttgacgaactgtgtt

SEQ ID NO: 34859 - DNA, 25 bp, Mus musculus
gatgaagatatcacggagtatcaga

SEQ ID NO: 34860 - DNA, 25 bp, Mus musculus
gatgaagatggacgacttcgagacc

SEQ ID NO: 34861 - DNA, 25 bp, Mus musculus
gatgaagatggagctaagccgagta

SEQ ID NO: 34862 - DNA, 25 bp, Mus musculus
gatgaagatggcaatcacagtgaca

SEQ ID NO: 34863 - DNA, 25 bp, Mus musculus
gatgaagattgtcactcccctggac

SEQ ID NO: 34864 - DNA, 25 bp, Mus musculus
gatgaagattgtgactcccctggac

SEQ ID NO: 34865 - DNA, 25 bp, Mus musculus
gatgaagcagtcttgcagcaaaagc

SEQ ID NO: 34866 - DNA, 25 bp, Mus musculus
gatgaagcagtggataaaactattt

SEQ ID NO: 34867 - DNA, 25 bp, Mus musculus
gatgaagcctatttgatcttgatga

SEQ ID NO: 34868 - DNA, 25 bp, Mus musculus
gatgaagctgccagtagctttgctg

SEQ ID NO: 34869 - DNA, 25 bp, Mus musculus
gatgaagctgcctgtagctttgctg

SEQ ID NO: 34870 - DNA, 25 bp, Mus musculus
gatgaaggacaacgaccttctcgtc

SEQ ID NO: 34871 - DNA, 25 bp, Mus musculus
gatgaaggccgcaacaactttgagg

SEQ ID NO: 34872 - DNA, 25 bp, Mus musculus
gatgaaggccttcgaaaataatgaa

SEQ ID NO: 34873 - DNA, 25 bp, Mus musculus
gatgaaggccttggaaaataatgaa

SEQ ID NO: 34874 - DNA, 25 bp, Mus musculus
gatgaaggcttacttggtgtctgca

SEQ ID NO: 34875 - DNA, 25 bp, Mus musculus
gatgaagggcaggtatgtcccctgt

SEQ ID NO: 34876 - DNA, 25 bp, Mus musculus
gatgaagggtctcctcacactggct

SEQ ID NO: 34877 - DNA, 25 bp, Mus musculus
gatgaaggtggaagtgctcaacagc

SEQ ID NO: 34878 - DNA, 25 bp, Mus musculus
gatgaagtacgaatatgaagtagac

SEQ ID NO: 34879 - DNA, 25 bp, Mus musculus
gatgaagtcattgaatatgacggcg

SEQ ID NO: 34880 - DNA, 25 bp, Mus musculus
gatgaagtgatacagtttatgaaac

SEQ ID NO: 34881 - DNA, 25 bp, Mus musculus
gatgaataagattgcccttgtcccc

SEQ ID NO: 34882 - DNA, 25 bp, Mus musculus
gatgaataccaaccaactgacctca

SEQ ID NO: 34883 - DNA, 25 bp, Mus musculus
gatgaataccaatttgtggagcgcc

SEQ ID NO: 34884 - DNA, 25 bp, Mus musculus
gatgaataccacaaggatcattaag

SEQ ID NO: 34885 - DNA, 25 bp, Mus musculus
gatgaatacctagacaatggctcag

SEQ ID NO: 34886 - DNA, 25 bp, Mus musculus
gatgaatcagctacaaggtatgccc

SEQ ID NO: 34887 - DNA, 25 bp, Mus musculus
gatgaatccaataacatcggccctc

SEQ ID NO: 34888 - DNA, 25 bp, Mus musculus
gatgaatgcagttcagactgaggca

SEQ ID NO: 34889 - DNA, 25 bp, Mus musculus
gatgaatgtctaccaagaactgacc

SEQ ID NO: 34890 - DNA, 25 bp, Mus musculus
gatgaattcagtactaaaaggtgct

SEQ ID NO: 34891 - DNA, 25 bp, Mus musculus
gatgacaacaaacgtgtggctgaag

SEQ ID NO: 34892 - DNA, 25 bp, Mus musculus
gatgacaacaacaggcatgcaacca

SEQ ID NO: 34893 - DNA, 25 bp, Mus musculus
gatgacaagaatcggcgtaattcca

SEQ ID NO: 34894 - DNA, 25 bp, Mus musculus
gatgacaagcctgccttcagaaagg

SEQ ID NO: 34895 - DNA, 25 bp, Mus musculus
gatgacaagctacttacgaggcctg

SEQ ID NO: 34896 - DNA, 25 bp, Mus musculus
gatgacacaattctcatctgggact

SEQ ID NO: 34897 - DNA, 25 bp, Mus musculus
gatgacacagatgacgatgaccctt

SEQ ID NO: 34898 - DNA, 25 bp, Mus musculus
gatgacacccactcaagaatagagc

SEQ ID NO: 34899 - DNA, 25 bp, Mus musculus
gatgacacgtggctccaaaacacca

SEQ ID NO: 34900 - DNA, 25 bp, Mus musculus
gatgacaggatatgtggtaacccgg

SEQ ID NO: 34901 - DNA, 25 bp, Mus musculus
gatgacaggtcaatcagaagtgttc

SEQ ID NO: 34902 - DNA, 25 bp, Mus musculus
gatgacaggtcattcagaagtgttc

SEQ ID NO: 34903 - DNA, 25 bp, Mus musculus
gatgacagtgtcatggccgtggacc

SEQ ID NO: 34904 - DNA, 25 bp, Mus musculus
gatgacataaggaacatgagcagct

SEQ ID NO: 34905 - DNA, 25 bp, Mus musculus
gatgacatccgtagggcctttttcc

SEQ ID NO: 34906 - DNA, 25 bp, Mus musculus
gatgacatcgatatgtccaacccaa

SEQ ID NO: 34907 - DNA, 25 bp, Mus musculus
gatgacatgaaccaaagatggaatg

SEQ ID NO: 34908 - DNA, 25 bp, Mus musculus
gatgacatgttgtgtgcaggagata

SEQ ID NO: 34909 - DNA, 25 bp, Mus musculus
gatgacattccttcttcaaccaaga

SEQ ID NO: 34910 - DNA, 25 bp, Mus musculus
gatgacatttgcaccattacaaagg

SEQ ID NO: 34911 - DNA, 25 bp, Mus musculus
gatgaccaccctaagcatcagtgct

SEQ ID NO: 34912 - DNA, 25 bp, Mus musculus
gatgaccagcaatagaatcttagct

SEQ ID NO: 34913 - DNA, 25 bp, Mus musculus
gatgaccagctctttgtgtcctaca

SEQ ID NO: 34914 - DNA, 25 bp, Mus musculus
gatgaccaggattgctgttctgaag

SEQ ID NO: 34915 - DNA, 25 bp, Mus musculus
gatgaccagtcctttcatgctgatc

SEQ ID NO: 34916 - DNA, 25 bp, Mus musculus
gatgacccactcgtgccagaaatag

SEQ ID NO: 34917 - DNA, 25 bp, Mus musculus
gatgaccccaatgatgaggactttg

SEQ ID NO: 34918 - DNA, 25 bp, Mus musculus
gatgacccctagttcttcctatggt

SEQ ID NO: 34919 - DNA, 25 bp, Mus musculus
gatgaccctaagaagtatcaatcct

SEQ ID NO: 34920 - DNA, 25 bp, Mus musculus
gatgaccctgaagttaggatcctcc

SEQ ID NO: 34921 - DNA, 25 bp, Mus musculus
gatgaccctgggaatgatctggacc

SEQ ID NO: 34922 - DNA, 25 bp, Mus musculus
gatgaccgaggtctctataaacaag

SEQ ID NO: 34923 - DNA, 25 bp, Mus musculus
gatgacctccatcttgcgaagtccc

SEQ ID NO: 34924 - DNA, 25 bp, Mus musculus
gatgacctccgccaacattctgtgg

SEQ ID NO: 34925 - DNA, 25 bp, Mus musculus
gatgacctcgtgatatgcatggaag

SEQ ID NO: 34926 - DNA, 25 bp, Mus musculus
gatgacctcgtgttatgcatggaag

SEQ ID NO: 34927 - DNA, 25 bp, Mus musculus
gatgacctgaacaagtcctcagcca

SEQ ID NO: 34928 - DNA, 25 bp, Mus musculus
gatgacctgattagcatgggatcca

SEQ ID NO: 34929 - DNA, 25 bp, Mus musculus
gatgacctgcctccattgtctccgt

SEQ ID NO: 34930 - DNA, 25 bp, Mus musculus
gatgacctggaatcaaagatggaag

SEQ ID NO: 34931 - DNA, 25 bp, Mus musculus
gatgacctggaattggttgcattta

SEQ ID NO: 34932 - DNA, 25 bp, Mus musculus
gatgacctgttcaacaccaacgcta

SEQ ID NO: 34933 - DNA, 25 bp, Mus musculus
gatgaccttacgtgggtactcaaaa

SEQ ID NO: 34934 - DNA, 25 bp, Mus musculus
gatgaccttagaggagagacgcaaa

SEQ ID NO: 34935 - DNA, 25 bp, Mus musculus
gatgaccttcaaggacttggtgtcc

SEQ ID NO: 34936 - DNA, 25 bp, Mus musculus
gatgaccttctatggccattttgtg

SEQ ID NO: 34937 - DNA, 25 bp, Mus musculus
gatgaccttggacagctagtgtgca

SEQ ID NO: 34938 - DNA, 25 bp, Mus musculus
gatgacctttcgctcatggacttcc

SEQ ID NO: 34939 - DNA, 25 bp, Mus musculus
gatgacgaccaatcaagtctagact

SEQ ID NO: 34940 - DNA, 25 bp, Mus musculus
gatgacgcatttgtccctgagatca

SEQ ID NO: 34941 - DNA, 25 bp, Mus musculus
gatgacggagaaggatgcacagcca

SEQ ID NO: 34942 - DNA, 25 bp, Mus musculus
gatgacggatttgtggacatcctgg

SEQ ID NO: 34943 - DNA, 25 bp, Mus musculus
gatgacggtcacagccattgatgcg

SEQ ID NO: 34944 - DNA, 25 bp, Mus musculus
gatgacggtcactgccattgatgcg

SEQ ID NO: 34945 - DNA, 25 bp, Mus musculus
gatgacggtctagacattagaaagg

SEQ ID NO: 34946 - DNA, 25 bp, Mus musculus
gatgacgtggcaaagaacagcagca

SEQ ID NO: 34947 - DNA, 25 bp, Mus musculus
gatgacgtgttcctgagagaagcca

SEQ ID NO: 34948 - DNA, 25 bp, Mus musculus
gatgactacaaaagccatgtgaagt

SEQ ID NO: 34949 - DNA, 25 bp, Mus musculus
gatgactacgatgacacagatgacg

SEQ ID NO: 34950 - DNA, 25 bp, Mus musculus
gatgactactccgatccctttgatg

SEQ ID NO: 34951 - DNA, 25 bp, Mus musculus
gatgactatgaggtcagctgccctg

SEQ ID NO: 34952 - DNA, 25 bp, Mus musculus
gatgactcaaatcataccataggag

SEQ ID NO: 34953 - DNA, 25 bp, Mus musculus
gatgactcaaatgataccataggag

SEQ ID NO: 34954 - DNA, 25 bp, Mus musculus
gatgactcagagaaagatttcaacc

SEQ ID NO: 34955 - DNA, 25 bp, Mus musculus
gatgactcagctgtttctatgggaa

SEQ ID NO: 34956 - DNA, 25 bp, Mus musculus
gatgactcctcctcggaggagaaag

SEQ ID NO: 34957 - DNA, 25 bp, Mus musculus
gatgactcctgccttgacccgttct

SEQ ID NO: 34958 - DNA, 25 bp, Mus musculus
gatgactcggatagcatgagccgga

SEQ ID NO: 34959 - DNA, 25 bp, Mus musculus
gatgactcggattgcatgagccgga

SEQ ID NO: 34960 - DNA, 25 bp, Mus musculus
gatgactctaacaagctcgggaaga

SEQ ID NO: 34961 - DNA, 25 bp, Mus musculus
gatgactctacgctcacggttcctg

SEQ ID NO: 34962 - DNA, 25 bp, Mus musculus
gatgactgagattgctgacctgacc

SEQ ID NO: 34963 - DNA, 25 bp, Mus musculus
gatgactgccggagaactttccaga

SEQ ID NO: 34964 - DNA, 25 bp, Mus musculus
gatgacttctatctggtcgtgtgca

SEQ ID NO: 34965 - DNA, 25 bp, Mus musculus
gatgacttgattgtgaccccgtttg

SEQ ID NO: 34966 - DNA, 25 bp, Mus musculus
gatgacttggacactcaggagagcg

SEQ ID NO: 34967 - DNA, 25 bp, Mus musculus
gatgactttgcccagctgctacagg

SEQ ID NO: 34968 - DNA, 25 bp, Mus musculus
gatgactttgctgagggaggtctca

SEQ ID NO: 34969 - DNA, 25 bp, Mus musculus
gatgagaaaaagaaacctctgtttg

SEQ ID NO: 34970 - DNA, 25 bp, Mus musculus
gatgagaaacctgcgcacggtagtg

SEQ ID NO: 34971 - DNA, 25 bp, Mus musculus
gatgagaaatccacccacagtactg

SEQ ID NO: 34972 - DNA, 25 bp, Mus musculus
gatgagaacacagacagtgagaccc

SEQ ID NO: 34973 - DNA, 25 bp, Mus musculus
gatgagaacactcctgtccacgtcc

SEQ ID NO: 34974 - DNA, 25 bp, Mus musculus
gatgagaacagaagcacggcgaaaa

SEQ ID NO: 34975 - DNA, 25 bp, Mus musculus
gatgagaagagagtgactaacacac

SEQ ID NO: 34976 - DNA, 25 bp, Mus musculus
gatgagaaggccatcatgacttacg

SEQ ID NO: 34977 - DNA, 25 bp, Mus musculus
gatgagaataacgatgtcagcgagg

SEQ ID NO: 34978 - DNA, 25 bp, Mus musculus
gatgagaattgtctgtccttgtcaa

SEQ ID NO: 34979 - DNA, 25 bp, Mus musculus
gatgagacaaagctagaatgatctg

SEQ ID NO: 34980 - DNA, 25 bp, Mus musculus
gatgagacccatgcgggctgtcttc

SEQ ID NO: 34981 - DNA, 25 bp, Mus musculus
gatgagacctggagctacaatcacc

SEQ ID NO: 34982 - DNA, 25 bp, Mus musculus
gatgagacttcaggacacgtacaaa

SEQ ID NO: 34983 - DNA, 25 bp, Mus musculus
gatgagagacaatgatgtcgtagaa

SEQ ID NO: 34984 - DNA, 25 bp, Mus musculus
gatgagagaggtcctatcaaaacca

SEQ ID NO: 34985 - DNA, 25 bp, Mus musculus
gatgagagagtcctaccacagtgaa

SEQ ID NO: 34986 - DNA, 25 bp, Mus musculus
gatgagaggcttggtccatgtctcc

SEQ ID NO: 34987 - DNA, 25 bp, Mus musculus
gatgagagtcctctgagcgacaagt

SEQ ID NO: 34988 - DNA, 25 bp, Mus musculus
gatgagatagagcacctgcaggctt

SEQ ID NO: 34989 - DNA, 25 bp, Mus musculus
gatgagatcattcaggaagtccgag

SEQ ID NO: 34990 - DNA, 25 bp, Mus musculus
gatgagatcctcagacatactctac

SEQ ID NO: 34991 - DNA, 25 bp, Mus musculus
gatgagattgcagatgtgtttgccc

SEQ ID NO: 34992 - DNA, 25 bp, Mus musculus
gatgagcaagatgctttcaagcgtt

SEQ ID NO: 34993 - DNA, 25 bp, Mus musculus
gatgagcagttaaggcgacgtcttc

SEQ ID NO: 34994 - DNA, 25 bp, Mus musculus
gatgagcatgccctcatccagcagt

SEQ ID NO: 34995 - DNA, 25 bp, Mus musculus
gatgagcccacgatggacagaacgt

SEQ ID NO: 34996 - DNA, 25 bp, Mus musculus
gatgagccccttcgtcggccagtca

SEQ ID NO: 34997 - DNA, 25 bp, Mus musculus
gatgagcctcaccattgcagacctg

SEQ ID NO: 34998 - DNA, 25 bp, Mus musculus
gatgagcctcagatcccaggaacag

SEQ ID NO: 34999 - DNA, 25 bp, Mus musculus
gatgagcggatgaagaaattggtta

SEQ ID NO: 35000 - DNA, 25 bp, Mus musculus
gatgagcgtggaggaacaacatctt

SEQ ID NO: 35001 - DNA, 25 bp, Mus musculus
gatgagctaaccaaggatacattcc

SEQ ID NO: 35002 - DNA, 25 bp, Mus musculus
gatgagctcacagagttgctggccg

SEQ ID NO: 35003 - DNA, 25 bp, Mus musculus
gatgagctgctgtatgatcctgaga

SEQ ID NO: 35004 - DNA, 25 bp, Mus musculus
gatgaggaagagaacgaaatgtttc

SEQ ID NO: 35005 - DNA, 25 bp, Mus musculus
gatgaggaagccaagcctcagagag

SEQ ID NO: 35006 - DNA, 25 bp, Mus musculus
gatgaggaagtctcagctgcagaat

SEQ ID NO: 35007 - DNA, 25 bp, Mus musculus
gatgaggaccggaaaatgtatcttc

SEQ ID NO: 35008 - DNA, 25 bp, Mus musculus
gatgaggacgacacagatagctccg

SEQ ID NO: 35009 - DNA, 25 bp, Mus musculus
gatgaggacttcctgctggagcaca

SEQ ID NO: 35010 - DNA, 25 bp, Mus musculus
gatgaggagattaaaagactgcttc

SEQ ID NO: 35011 - DNA, 25 bp, Mus musculus
gatgaggagctatcgtgctctgtgt

SEQ ID NO: 35012 - DNA, 25 bp, Mus musculus
gatgaggagtatggctgtcccattc

SEQ ID NO: 35013 - DNA, 25 bp, Mus musculus
gatgaggatacaagaaaccttaagg

SEQ ID NO: 35014 - DNA, 25 bp, Mus musculus
gatgaggatcctgcatgttaatggg

SEQ ID NO: 35015 - DNA, 25 bp, Mus musculus
gatgaggatcggctccgggaggagc

SEQ ID NO: 35016 - DNA, 25 bp, Mus musculus
gatgaggatgaggtatacagcctga

SEQ ID NO: 35017 - DNA, 25 bp, Mus musculus
gatgaggcacccctctctctgcaga

SEQ ID NO: 35018 - DNA, 25 bp, Mus musculus
gatgaggcacccgtctctctgcaga

SEQ ID NO: 35019 - DNA, 25 bp, Mus musculus
gatgaggcatatgaccggcgtctag

SEQ ID NO: 35020 - DNA, 25 bp, Mus musculus
gatgaggcccaggactgtaccccag

SEQ ID NO: 35021 - DNA, 25 bp, Mus musculus
gatgaggcccttggcaatgttcgga

SEQ ID NO: 35022 - DNA, 25 bp, Mus musculus
gatgaggccttagctgccactcaag

SEQ ID NO: 35023 - DNA, 25 bp, Mus musculus
gatgaggccttgctacactgtgtcc

SEQ ID NO: 35024 - DNA, 25 bp, Mus musculus
gatgaggctgtaatcaataaaaaac

SEQ ID NO: 35025 - DNA, 25 bp, Mus musculus
gatgagggagtctcctgtgtcagca

SEQ ID NO: 35026 - DNA, 25 bp, Mus musculus
gatgaggtatacagcctgacagcca

SEQ ID NO: 35027 - DNA, 25 bp, Mus musculus
gatgaggtccccaatacctcagagg

SEQ ID NO: 35028 - DNA, 25 bp, Mus musculus
gatgagtacattgagaaactggcca

SEQ ID NO: 35029 - DNA, 25 bp, Mus musculus
gatgagtagacccttggattcagag

SEQ ID NO: 35030 - DNA, 25 bp, Mus musculus
gatgagtatgattactccaagccca

SEQ ID NO: 35031 - DNA, 25 bp, Mus musculus
gatgagtcacactacatgaagtcca

SEQ ID NO: 35032 - DNA, 25 bp, Mus musculus
gatgagtccccaaagaaaagtgctc

SEQ ID NO: 35033 - DNA, 25 bp, Mus musculus
gatgagtcctcctattatagacacc

SEQ ID NO: 35034 - DNA, 25 bp, Mus musculus
gatgagtcctttgagccttacccag

SEQ ID NO: 35035 - DNA, 25 bp, Mus musculus
gatgagtctctggacgacttcacag

SEQ ID NO: 35036 - DNA, 25 bp, Mus musculus
gatgagtctgcccatttggatgaaa

SEQ ID NO: 35037 - DNA, 25 bp, Mus musculus
gatgagtgccaggatccggctgctt

SEQ ID NO: 35038 - DNA, 25 bp, Mus musculus
gatgagttcttcttcggcagcagcg

SEQ ID NO: 35039 - DNA, 25 bp, Mus musculus
gatgagttggtagagctccacagaa

SEQ ID NO: 35040 - DNA, 25 bp, Mus musculus
gatgagtttggtttccgtgtggaca

SEQ ID NO: 35041 - DNA, 25 bp, Mus musculus
gatgagtttgtcctgtgttatgcac

SEQ ID NO: 35042 - DNA, 25 bp, Mus musculus
gatgagttttctaaacttgggaaca

SEQ ID NO: 35043 - DNA, 25 bp, Mus musculus
gatgataaaatgtttgagagagcag

SEQ ID NO: 35044 - DNA, 25 bp, Mus musculus
gatgataaagaagagcctgccaacc

SEQ ID NO: 35045 - DNA, 25 bp, Mus musculus
gatgataagtgaccaaacatctgaa

SEQ ID NO: 35046 - DNA, 25 bp, Mus musculus
gatgatacacctattgatgaaccac

SEQ ID NO: 35047 - DNA, 25 bp, Mus musculus
gatgatacaccttttgatgaaccac

SEQ ID NO: 35048 - DNA, 25 bp, Mus musculus
gatgatacctttgatccagaacttg

SEQ ID NO: 35049 - DNA, 25 bp, Mus musculus
gatgatacgtatacggaaagctaca

SEQ ID NO: 35050 - DNA, 25 bp, Mus musculus
gatgatagagaattgaccaagaaaa

SEQ ID NO: 35051 - DNA, 25 bp, Mus musculus
gatgatataatgtccgtgaatccta

SEQ ID NO: 35052 - DNA, 25 bp, Mus musculus
gatgatatcatcaacgtgctgcaag

SEQ ID NO: 35053 - DNA, 25 bp, Mus musculus
gatgatatgggcatctgtccgaggc

SEQ ID NO: 35054 - DNA, 25 bp, Mus musculus
gatgatattcctagtgcccttcgca

SEQ ID NO: 35055 - DNA, 25 bp, Mus musculus
gatgatcaagaaactgatctcagaa

SEQ ID NO: 35056 - DNA, 25 bp, Mus musculus
gatgatcacagaatcctgcctggaa

SEQ ID NO: 35057 - DNA, 25 bp, Mus musculus
gatgatcaggctcagaaaattttgg

SEQ ID NO: 35058 - DNA, 25 bp, Mus musculus
gatgatccaatcgaagtgtctaaag

SEQ ID NO: 35059 - DNA, 25 bp, Mus musculus
gatgatccacggtcacatggtgcag

SEQ ID NO: 35060 - DNA, 25 bp, Mus musculus
gatgatccagtcaccaacctaaaca

SEQ ID NO: 35061 - DNA, 25 bp, Mus musculus
gatgatcccctgttatctgtacgaa

SEQ ID NO: 35062 - DNA, 25 bp, Mus musculus
gatgatcccgaggtccagttcagct

SEQ ID NO: 35063 - DNA, 25 bp, Mus musculus
gatgatccctcctaaaatcgctgca

SEQ ID NO: 35064 - DNA, 25 bp, Mus musculus
gatgatcgatgcataaatatcacca

SEQ ID NO: 35065 - DNA, 25 bp, Mus musculus
gatgatcgggcgatgcaaccgagct

SEQ ID NO: 35066 - DNA, 25 bp, Mus musculus
gatgatctcagaaggactggacccg

SEQ ID NO: 35067 - DNA, 25 bp, Mus musculus
gatgatcttcttgatgccaacagcg

SEQ ID NO: 35068 - DNA, 25 bp, Mus musculus
gatgatgaaccagctgtaaagttac

SEQ ID NO: 35069 - DNA, 25 bp, Mus musculus
gatgatgaacgacatgatcgggaac

SEQ ID NO: 35070 - DNA, 25 bp, Mus musculus
gatgatgagacctttgtcaccttgg

SEQ ID NO: 35071 - DNA, 25 bp, Mus musculus
gatgatgagatctgtggaactaaaa

SEQ ID NO: 35072 - DNA, 25 bp, Mus musculus
gatgatgaggacaccagaaagcgca

SEQ ID NO: 35073 - DNA, 25 bp, Mus musculus
gatgatgaggacgacacagatagct

SEQ ID NO: 35074 - DNA, 25 bp, Mus musculus
gatgatgcagagttatagactggcc

SEQ ID NO: 35075 - DNA, 25 bp, Mus musculus
gatgatgcaggagcatcaaccacag

SEQ ID NO: 35076 - DNA, 25 bp, Mus musculus
gatgatgcatcccaggagaacaata

SEQ ID NO: 35077 - DNA, 25 bp, Mus musculus
gatgatgccccctatgggagggcct

SEQ ID NO: 35078 - DNA, 25 bp, Mus musculus
gatgatgctccggtaactgtttctt

SEQ ID NO: 35079 - DNA, 25 bp, Mus musculus
gatgatgctcgtgattgatgtgacc

SEQ ID NO: 35080 - DNA, 25 bp, Mus musculus
gatgatgtctgaagaaggctttgag

SEQ ID NO: 35081 - DNA, 25 bp, Mus musculus
gatgatgtgaccatatcctaccttc

SEQ ID NO: 35082 - DNA, 25 bp, Mus musculus
gatgattatattgatgcagaagacc

SEQ ID NO: 35083 - DNA, 25 bp, Mus musculus
gatgattatcgtgaggagaccgagc

SEQ ID NO: 35084 - DNA, 25 bp, Mus musculus
gatgattattggagctatgactacg

SEQ ID NO: 35085 - DNA, 25 bp, Mus musculus
gatgattcgcttagcaaactacctg

SEQ ID NO: 35086 - DNA, 25 bp, Mus musculus
gatgattcgggagtaccggcaaatg

SEQ ID NO: 35087 - DNA, 25 bp, Mus musculus
gatgattctctgttgccagcgccag

SEQ ID NO: 35088 - DNA, 25 bp, Mus musculus
gatgattgacatccagaccaagatg

SEQ ID NO: 35089 - DNA, 25 bp, Mus musculus
gatgattgcagaccaccagatcgag

SEQ ID NO: 35090 - DNA, 25 bp, Mus musculus
gatgattgggaaacataagaacatt

SEQ ID NO: 35091 - DNA, 25 bp, Mus musculus
gatgattgtcactcagaagatcacg

SEQ ID NO: 35092 - DNA, 25 bp, Mus musculus
gatgatttagataccgttcctgtgt

SEQ ID NO: 35093 - DNA, 25 bp, Mus musculus
gatgatttcaaaaccgtggtcagcg

SEQ ID NO: 35094 - DNA, 25 bp, Mus musculus
gatgatttcaaatccgtggtcagcg

SEQ ID NO: 35095 - DNA, 25 bp, Mus musculus
gatgatttggccaacaccttccgtg

SEQ ID NO: 35096 - DNA, 25 bp, Mus musculus
gatgatttgggaacaacaggaagag

SEQ ID NO: 35097 - DNA, 25 bp, Mus musculus
gatgcaaaacgtctgcatggccttg

SEQ ID NO: 35098 - DNA, 25 bp, Mus musculus
gatgcaaagacagaacaactccgaa

SEQ ID NO: 35099 - DNA, 25 bp, Mus musculus
gatgcaacagccatcatagatactg

SEQ ID NO: 35100 - DNA, 25 bp, Mus musculus
gatgcaacccgaaagggcaacaaaa

SEQ ID NO: 35101 - DNA, 25 bp, Mus musculus
gatgcaactaagttaaggccaaagg

SEQ ID NO: 35102 - DNA, 25 bp, Mus musculus
gatgcaactcactgcttgctaaagg

SEQ ID NO: 35103 - DNA, 25 bp, Mus musculus
gatgcaagaaacatctcttccttct

SEQ ID NO: 35104 - DNA, 25 bp, Mus musculus
gatgcaagaatgcttgttctcagag

SEQ ID NO: 35105 - DNA, 25 bp, Mus musculus
gatgcaagccaaccccatctgcatt

SEQ ID NO: 35106 - DNA, 25 bp, Mus musculus
gatgcaaggcctacacagtttggaa

SEQ ID NO: 35107 - DNA, 25 bp, Mus musculus
gatgcaaggtcacaacacacccact

SEQ ID NO: 35108 - DNA, 25 bp, Mus musculus
gatgcaataccagttgtacttcacg

SEQ ID NO: 35109 - DNA, 25 bp, Mus musculus
gatgcacacagcaatctggcctcca

SEQ ID NO: 35110 - DNA, 25 bp, Mus musculus
gatgcacagacagaatatagatgcc

SEQ ID NO: 35111 - DNA, 25 bp, Mus musculus
gatgcacagtcaagattggccgccg

SEQ ID NO: 35112 - DNA, 25 bp, Mus musculus
gatgcacctgacctctgatgaactg

SEQ ID NO: 35113 - DNA, 25 bp, Mus musculus
gatgcacgatttcgccatctttgga

SEQ ID NO: 35114 - DNA, 25 bp, Mus musculus
gatgcactgcagaaggtaacaggga

SEQ ID NO: 35115 - DNA, 25 bp, Mus musculus
gatgcactggatccttccaccagca

SEQ ID NO: 35116 - DNA, 25 bp, Mus musculus
gatgcactggtctgcagtaccttcc

SEQ ID NO: 35117 - DNA, 25 bp, Mus musculus
gatgcacttcgcctgctgcaatgcg

SEQ ID NO: 35118 - DNA, 25 bp, Mus musculus
gatgcagactcaaagagggtcctgg

SEQ ID NO: 35119 - DNA, 25 bp, Mus musculus
gatgcagagaatgcaattgtgcata

SEQ ID NO: 35120 - DNA, 25 bp, Mus musculus
gatgcagaggacagggccctcatag

SEQ ID NO: 35121 - DNA, 25 bp, Mus musculus
gatgcagatggagaaactaacccta

SEQ ID NO: 35122 - DNA, 25 bp, Mus musculus
gatgcagcactcagagggttaccgg

SEQ ID NO: 35123 - DNA, 25 bp, Mus musculus
gatgcagcagcgcatcgactccttc

SEQ ID NO: 35124 - DNA, 25 bp, Mus musculus
gatgcagccacctgctttgtggacg

SEQ ID NO: 35125 - DNA, 25 bp, Mus musculus
gatgcagcctccctgcatagataca

SEQ ID NO: 35126 - DNA, 25 bp, Mus musculus
gatgcagccttatgtgcagatggtc

SEQ ID NO: 35127 - DNA, 25 bp, Mus musculus
gatgcagctaccatgaagacattct

SEQ ID NO: 35128 - DNA, 25 bp, Mus musculus
gatgcaggaaaccttcaggaatttg

SEQ ID NO: 35129 - DNA, 25 bp, Mus musculus
gatgcaggagcatcaaccacaggct

SEQ ID NO: 35130 - DNA, 25 bp, Mus musculus
gatgcaggctccaaagctcctgtgg

SEQ ID NO: 35131 - DNA, 25 bp, Mus musculus
gatgcaggcttcactgtggaagata

SEQ ID NO: 35132 - DNA, 25 bp, Mus musculus
gatgcagggctaaagaatggagtac

SEQ ID NO: 35133 - DNA, 25 bp, Mus musculus
gatgcagtcatgaacgtgagcgtgc

SEQ ID NO: 35134 - DNA, 25 bp, Mus musculus
gatgcagtcatgtacgtgagcgtgc

SEQ ID NO: 35135 - DNA, 25 bp, Mus musculus
gatgcatactctcagggtctccagc

SEQ ID NO: 35136 - DNA, 25 bp, Mus musculus
gatgcatagtattgatctacttcca

SEQ ID NO: 35137 - DNA, 25 bp, Mus musculus
gatgcatgggctcccgtgatccttc

SEQ ID NO: 35138 - DNA, 25 bp, Mus musculus
gatgcatgtaaagccttgttccgca

SEQ ID NO: 35139 - DNA, 25 bp, Mus musculus
gatgcattagcacaacaggcctttg

SEQ ID NO: 35140 - DNA, 25 bp, Mus musculus
gatgcatttgcttaacaacattggg

SEQ ID NO: 35141 - DNA, 25 bp, Mus musculus
gatgccaaaaagacagggcagctag

SEQ ID NO: 35142 - DNA, 25 bp, Mus musculus
gatgccaaaggtctgctgttctccg

SEQ ID NO: 35143 - DNA, 25 bp, Mus musculus
gatgccaacattcgatgagagcccc

SEQ ID NO: 35144 - DNA, 25 bp, Mus musculus
gatgccaacattggatgagagcccc

SEQ ID NO: 35145 - DNA, 25 bp, Mus musculus
gatgccaactcactcatggccaatg

SEQ ID NO: 35146 - DNA, 25 bp, Mus musculus
gatgccaagaagaaagcagctcatg

SEQ ID NO: 35147 - DNA, 25 bp, Mus musculus
gatgccaagagcgacctcaagagca

SEQ ID NO: 35148 - DNA, 25 bp, Mus musculus
gatgccaagggtatcagccaggagc

SEQ ID NO: 35149 - DNA, 25 bp, Mus musculus
gatgccaatggatcccgagattttc

SEQ ID NO: 35150 - DNA, 25 bp, Mus musculus
gatgccaatgtctgaggcccctttg

SEQ ID NO: 35151 - DNA, 25 bp, Mus musculus
gatgccacagaagagtctgacctgg

SEQ ID NO: 35152 - DNA, 25 bp, Mus musculus
gatgccaccctttatgagatgaaat

SEQ ID NO: 35153 - DNA, 25 bp, Mus musculus
gatgccacctatcacaaggctgaga

SEQ ID NO: 35154 - DNA, 25 bp, Mus musculus
gatgccaccttcaacatcattggac

SEQ ID NO: 35155 - DNA, 25 bp, Mus musculus
gatgccagagctccgaagtgctacg

SEQ ID NO: 35156 - DNA, 25 bp, Mus musculus
gatgccagagctgcgaagtgctacg

SEQ ID NO: 35157 - DNA, 25 bp, Mus musculus
gatgccagccaccaatgccagcagt

SEQ ID NO: 35158 - DNA, 25 bp, Mus musculus
gatgccagcttacatgcaggccgtg

SEQ ID NO: 35159 - DNA, 25 bp, Mus musculus
gatgccaggcaatgcatggtccagc

SEQ ID NO: 35160 - DNA, 25 bp, Mus musculus
gatgccaggccaggcatgcccatgt

SEQ ID NO: 35161 - DNA, 25 bp, Mus musculus
gatgccataaagttggagcggatgc

SEQ ID NO: 35162 - DNA, 25 bp, Mus musculus
gatgccataagtcttaatcctgaca

SEQ ID NO: 35163 - DNA, 25 bp, Mus musculus
gatgccatccaagacgtcagtgtgc

SEQ ID NO: 35164 - DNA, 25 bp, Mus musculus
gatgccatccagatccctaggcagc

SEQ ID NO: 35165 - DNA, 25 bp, Mus musculus
gatgccatgctggtccatggacaag

SEQ ID NO: 35166 - DNA, 25 bp, Mus musculus
gatgccattccaagcttaaaccctt

SEQ ID NO: 35167 - DNA, 25 bp, Mus musculus
gatgccatttagagtggaaagcctt

SEQ ID NO: 35168 - DNA, 25 bp, Mus musculus
gatgccatttctgctagagtctaca

SEQ ID NO: 35169 - DNA, 25 bp, Mus musculus
gatgcccaaactgcagggttttgag

SEQ ID NO: 35170 - DNA, 25 bp, Mus musculus
gatgcccaaccatgacagcagcgtt

SEQ ID NO: 35171 - DNA, 25 bp, Mus musculus
gatgcccacggcgtgttcctggtgc

SEQ ID NO: 35172 - DNA, 25 bp, Mus musculus
gatgcccacttcacagatggagaag

SEQ ID NO: 35173 - DNA, 25 bp, Mus musculus
gatgcccagtctggagcagcaacag

SEQ ID NO: 35174 - DNA, 25 bp, Mus musculus
gatgcccatagaagcctggcacgca

SEQ ID NO: 35175 - DNA, 25 bp, Mus musculus
gatgcccatgtcatcctgaacgata

SEQ ID NO: 35176 - DNA, 25 bp, Mus musculus
gatgccccatgcttgttctctggct

SEQ ID NO: 35177 - DNA, 25 bp, Mus musculus
gatgccccgttagcagtagtgaaaa

SEQ ID NO: 35178 - DNA, 25 bp, Mus musculus
gatgcccgagaaggcaaggactcca

SEQ ID NO: 35179 - DNA, 25 bp, Mus musculus
gatgcccgccataaaggaaagcgtg

SEQ ID NO: 35180 - DNA, 25 bp, Mus musculus
gatgccctcaaggtctcagtttctc

SEQ ID NO: 35181 - DNA, 25 bp, Mus musculus
gatgccctcctcatgcagggtgaaa

SEQ ID NO: 35182 - DNA, 25 bp, Mus musculus
gatgccctgacagagctgctcggca

SEQ ID NO: 35183 - DNA, 25 bp, Mus musculus
gatgcccttctgcacagtgacagca

SEQ ID NO: 35184 - DNA, 25 bp, Mus musculus
gatgccctttcctctatcataagtc

SEQ ID NO: 35185 - DNA, 25 bp, Mus musculus
gatgccgaccggcaagtcacttcta

SEQ ID NO: 35186 - DNA, 25 bp, Mus musculus
gatgccgaccgggaagtcacttcta

SEQ ID NO: 35187 - DNA, 25 bp, Mus musculus
gatgccgcgagcgaatacgctaaat

SEQ ID NO: 35188 - DNA, 25 bp, Mus musculus
gatgcctacctcagtggcatgcctg

SEQ ID NO: 35189 - DNA, 25 bp, Mus musculus
gatgcctacttttactgaagaaaca

SEQ ID NO: 35190 - DNA, 25 bp, Mus musculus
gatgcctagatcatgaaaatggaaa

SEQ ID NO: 35191 - DNA, 25 bp, Mus musculus
gatgcctcaacaaagtgcctggcta

SEQ ID NO: 35192 - DNA, 25 bp, Mus musculus
gatgcctcaacatagtgcctggcta

SEQ ID NO: 35193 - DNA, 25 bp, Mus musculus
gatgcctcagatctgacgtggacct

SEQ ID NO: 35194 - DNA, 25 bp, Mus musculus
gatgcctccgaggatgtgcagcgca

SEQ ID NO: 35195 - DNA, 25 bp, Mus musculus
gatgcctcggaagatgcatcacctc

SEQ ID NO: 35196 - DNA, 25 bp, Mus musculus
gatgcctgaagtttccccacttctg

SEQ ID NO: 35197 - DNA, 25 bp, Mus musculus
gatgcctgacagtgctttcaacctt

SEQ ID NO: 35198 - DNA, 25 bp, Mus musculus
gatgcctgccagctcaattatgaca

SEQ ID NO: 35199 - DNA, 25 bp, Mus musculus
gatgcctgctttacatgatgctagt

SEQ ID NO: 35200 - DNA, 25 bp, Mus musculus
gatgcctggcatactgcataaatgg

SEQ ID NO: 35201 - DNA, 25 bp, Mus musculus
gatgcctggtatcaagacagtgtct

SEQ ID NO: 35202 - DNA, 25 bp, Mus musculus
gatgcctggtccatgggcacaaaga

SEQ ID NO: 35203 - DNA, 25 bp, Mus musculus
gatgcctggtctttgctccagggtc

SEQ ID NO: 35204 - DNA, 25 bp, Mus musculus
gatgcctgtataacccagggactgg

SEQ ID NO: 35205 - DNA, 25 bp, Mus musculus
gatgcctgtgtatttgtctgactag

SEQ ID NO: 35206 - DNA, 25 bp, Mus musculus
gatgccttggaaagcggttacgtgt

SEQ ID NO: 35207 - DNA, 25 bp, Mus musculus
gatgcctttcgggtcaatgtcattc

SEQ ID NO: 35208 - DNA, 25 bp, Mus musculus
gatgcgaatcggatgtggcaccccg

SEQ ID NO: 35209 - DNA, 25 bp, Mus musculus
gatgcgaatcggttgtggcaccccg

SEQ ID NO: 35210 - DNA, 25 bp, Mus musculus
gatgcgagtgcacaagatcaacaat

SEQ ID NO: 35211 - DNA, 25 bp, Mus musculus
gatgcgcagactgccaacgatgtgg

SEQ ID NO: 35212 - DNA, 25 bp, Mus musculus
gatgcgcctacaccccttcaatgaa

SEQ ID NO: 35213 - DNA, 25 bp, Mus musculus
gatgcgcctacagcccttcaatgaa

SEQ ID NO: 35214 - DNA, 25 bp, Mus musculus
gatgcgcctatgtaccagtgctaca

SEQ ID NO: 35215 - DNA, 25 bp, Mus musculus
gatgcgctgcggaagaaaactgcct

SEQ ID NO: 35216 - DNA, 25 bp, Mus musculus
gatgcgctgcggtagaaaactgcct

SEQ ID NO: 35217 - DNA, 25 bp, Mus musculus
gatgcggcagctgtgcattgccatg

SEQ ID NO: 35218 - DNA, 25 bp, Mus musculus
gatgcggtgatcaaggtccttcagc

SEQ ID NO: 35219 - DNA, 25 bp, Mus musculus
gatgcgtatggtgtaggtagctacc

SEQ ID NO: 35220 - DNA, 25 bp, Mus musculus
gatgcgtcgatactcttctcatgcg

SEQ ID NO: 35221 - DNA, 25 bp, Mus musculus
gatgcgttacaccactgctgggcag

SEQ ID NO: 35222 - DNA, 25 bp, Mus musculus
gatgctaactgtcttgctttgagtg

SEQ ID NO: 35223 - DNA, 25 bp, Mus musculus
gatgctaagagcactccaactgctg

SEQ ID NO: 35224 - DNA, 25 bp, Mus musculus
gatgctaagattagagctacccgcc

SEQ ID NO: 35225 - DNA, 25 bp, Mus musculus
gatgctaccactgtgttgtcccggg

SEQ ID NO: 35226 - DNA, 25 bp, Mus musculus
gatgctactggcttagatgcagaag

SEQ ID NO: 35227 - DNA, 25 bp, Mus musculus
gatgctaggcaaccccagccggctg

SEQ ID NO: 35228 - DNA, 25 bp, Mus musculus
gatgctagtgatgagaagattctgt

SEQ ID NO: 35229 - DNA, 25 bp, Mus musculus
gatgctatagctacaccattcctgc

SEQ ID NO: 35230 - DNA, 25 bp, Mus musculus
gatgctatagcttcaccattcctgc

SEQ ID NO: 35231 - DNA, 25 bp, Mus musculus
gatgctatatcatggtatcagaaga

SEQ ID NO: 35232 - DNA, 25 bp, Mus musculus
gatgctatcatggacgccatcgcgg

SEQ ID NO: 35233 - DNA, 25 bp, Mus musculus
gatgctcacgctctcgaatgctgcc

SEQ ID NO: 35234 - DNA, 25 bp, Mus musculus
gatgctcagattgcagatatactgt

SEQ ID NO: 35235 - DNA, 25 bp, Mus musculus
gatgctcatgtggacgtgtttcgag

SEQ ID NO: 35236 - DNA, 25 bp, Mus musculus
gatgctcatgtttgatccagtccct

SEQ ID NO: 35237 - DNA, 25 bp, Mus musculus
gatgctccagtgacaagaaataccg

SEQ ID NO: 35238 - DNA, 25 bp, Mus musculus
gatgctccagtgcttgctcgcgcta

SEQ ID NO: 35239 - DNA, 25 bp, Mus musculus
gatgctccagtgtcaagaaataccg

SEQ ID NO: 35240 - DNA, 25 bp, Mus musculus
gatgctccgaactgtcacctgggta

SEQ ID NO: 35241 - DNA, 25 bp, Mus musculus
gatgctccggtaactgtttcttcaa

SEQ ID NO: 35242 - DNA, 25 bp, Mus musculus
gatgctctcagctttttatgagggt

SEQ ID NO: 35243 - DNA, 25 bp, Mus musculus
gatgctctctatattgtgtcgcact

SEQ ID NO: 35244 - DNA, 25 bp, Mus musculus
gatgctctgcgaccagtattatcta

SEQ ID NO: 35245 - DNA, 25 bp, Mus musculus
gatgctctgcgagcagtattatcta

SEQ ID NO: 35246 - DNA, 25 bp, Mus musculus
gatgctctggaaagaacgctggagc

SEQ ID NO: 35247 - DNA, 25 bp, Mus musculus
gatgctcttagttcagccattttgt

SEQ ID NO: 35248 - DNA, 25 bp, Mus musculus
gatgctctttgtgttcttgctcaga

SEQ ID NO: 35249 - DNA, 25 bp, Mus musculus
gatgctgaaagccttgtaccctggc

SEQ ID NO: 35250 - DNA, 25 bp, Mus musculus
gatgctgaagccttagtagctctga

SEQ ID NO: 35251 - DNA, 25 bp, Mus musculus
gatgctgagaggcacaaatactggc

SEQ ID NO: 35252 - DNA, 25 bp, Mus musculus
gatgctgagcaagagatacccgtag

SEQ ID NO: 35253 - DNA, 25 bp, Mus musculus
gatgctgcagccgaactcatcgact

SEQ ID NO: 35254 - DNA, 25 bp, Mus musculus
gatgctgcaggccatcaagtgccct

SEQ ID NO: 35255 - DNA, 25 bp, Mus musculus
gatgctgcctggtaccagctgctgg

SEQ ID NO: 35256 - DNA, 25 bp, Mus musculus
gatgctgctgtccaggagaaaccag

SEQ ID NO: 35257 - DNA, 25 bp, Mus musculus
gatgctgcttctgacaggtgccgag

SEQ ID NO: 35258 - DNA, 25 bp, Mus musculus
gatgctgctttaccttgtaggaggt

SEQ ID NO: 35259 - DNA, 25 bp, Mus musculus
gatgctggcaattcctgctagtcta

SEQ ID NO: 35260 - DNA, 25 bp, Mus musculus
gatgctggcatctcagcagacatgg

SEQ ID NO: 35261 - DNA, 25 bp, Mus musculus
gatgctggcggccataacctacaca

SEQ ID NO: 35262 - DNA, 25 bp, Mus musculus
gatgctggctatgaaatatctctgg

SEQ ID NO: 35263 - DNA, 25 bp, Mus musculus
gatgctggctctattagtgttttta

SEQ ID NO: 35264 - DNA, 25 bp, Mus musculus
gatgctgggaattgtatcccagtcc

SEQ ID NO: 35265 - DNA, 25 bp, Mus musculus
gatgctgggtatcgccacattgact

SEQ ID NO: 35266 - DNA, 25 bp, Mus musculus
gatgctgtcgttcacccgacaaaca

SEQ ID NO: 35267 - DNA, 25 bp, Mus musculus
gatgctgtgactccaggatgttcca

SEQ ID NO: 35268 - DNA, 25 bp, Mus musculus
gatgctgtgcgcactgcagaccata

SEQ ID NO: 35269 - DNA, 25 bp, Mus musculus
gatgcttaactagagcctgaggtgc

SEQ ID NO: 35270 - DNA, 25 bp, Mus musculus
gatgcttactgcaacctagcaaatg

SEQ ID NO: 35271 - DNA, 25 bp, Mus musculus
gatgcttataaaacccaggtgagga

SEQ ID NO: 35272 - DNA, 25 bp, Mus musculus
gatgcttcaggcagtatgtgtcaca

SEQ ID NO: 35273 - DNA, 25 bp, Mus musculus
gatgcttgccaacacactggaagtt

SEQ ID NO: 35274 - DNA, 25 bp, Mus musculus
gatgcttgcggtctcattcactgca

SEQ ID NO: 35275 - DNA, 25 bp, Mus musculus
gatgctttaatggtggattcccaaa

SEQ ID NO: 35276 - DNA, 25 bp, Mus musculus
gatgctttatgctctacattacgag

SEQ ID NO: 35277 - DNA, 25 bp, Mus musculus
gatgctttggaagaagctgattgag

SEQ ID NO: 35278 - DNA, 25 bp, Mus musculus
gatgctttgtaacatgtccatatgc

SEQ ID NO: 35279 - DNA, 25 bp, Mus musculus
gatgctttttatacattggtgagag

SEQ ID NO: 35280 - DNA, 25 bp, Mus musculus
gatggaaaaccagtgaatctgggcc

SEQ ID NO: 35281 - DNA, 25 bp, Mus musculus
gatggaaaagaactgtcgaagcttg

SEQ ID NO: 35282 - DNA, 25 bp, Mus musculus
gatggaaaaggcaaatccggtaagc

SEQ ID NO: 35283 - DNA, 25 bp, Mus musculus
gatggaaaattgtcggtgatctggc

SEQ ID NO: 35284 - DNA, 25 bp, Mus musculus
gatggaaactcactcacctgtactg

SEQ ID NO: 35285 - DNA, 25 bp, Mus musculus
gatggaaactttgtggaagccactg

SEQ ID NO: 35286 - DNA, 25 bp, Mus musculus
gatggaaagcgcactccagcagggt

SEQ ID NO: 35287 - DNA, 25 bp, Mus musculus
gatggaaagcgctctccagcagggt

SEQ ID NO: 35288 - DNA, 25 bp, Mus musculus
gatggaaaggaatatccacacagga

SEQ ID NO: 35289 - DNA, 25 bp, Mus musculus
gatggaacaaatcaccagcaattgg

SEQ ID NO: 35290 - DNA, 25 bp, Mus musculus
gatggaacaagtgccgcacattgca

SEQ ID NO: 35291 - DNA, 25 bp, Mus musculus
gatggaacatttgagccaggaagac

SEQ ID NO: 35292 - DNA, 25 bp, Mus musculus
gatggaacccggtgaccccatcact

SEQ ID NO: 35293 - DNA, 25 bp, Mus musculus
gatggaacctttgctgcaggaggct

SEQ ID NO: 35294 - DNA, 25 bp, Mus musculus
gatggaagacattgtggatttggca

SEQ ID NO: 35295 - DNA, 25 bp, Mus musculus
gatggaagactatgaacgcctggcc

SEQ ID NO: 35296 - DNA, 25 bp, Mus musculus
gatggaagattctggaaaacagctc

SEQ ID NO: 35297 - DNA, 25 bp, Mus musculus
gatggaagccatcccctgcgttgtc

SEQ ID NO: 35298 - DNA, 25 bp, Mus musculus
gatggaagcctctggtcattcaact

SEQ ID NO: 35299 - DNA, 25 bp, Mus musculus
gatggaaggcctccttgggactcta

SEQ ID NO: 35300 - DNA, 25 bp, Mus musculus
gatggaagtagaggagctgagcccg

SEQ ID NO: 35301 - DNA, 25 bp, Mus musculus
gatggaataccaggaatgcccggga

SEQ ID NO: 35302 - DNA, 25 bp, Mus musculus
gatggaatccacaaatactgctctg

SEQ ID NO: 35303 - DNA, 25 bp, Mus musculus
gatggaattagatataggagatgcc

SEQ ID NO: 35304 - DNA, 25 bp, Mus musculus
gatggaattggaaaagcatatgcag

SEQ ID NO: 35305 - DNA, 25 bp, Mus musculus
gatggacaacgaagaagagaaccac

SEQ ID NO: 35306 - DNA, 25 bp, Mus musculus
gatggacaaggatgacgagagtcta

SEQ ID NO: 35307 - DNA, 25 bp, Mus musculus
gatggacacttctcacactacaaag

SEQ ID NO: 35308 - DNA, 25 bp, Mus musculus
gatggacagcgaaccgagtacttct

SEQ ID NO: 35309 - DNA, 25 bp, Mus musculus
gatggacagtcatacagaaccgtca

SEQ ID NO: 35310 - DNA, 25 bp, Mus musculus
gatggacatatagggatcttgaagg

SEQ ID NO: 35311 - DNA, 25 bp, Mus musculus
gatggacatccattatgccaaagag

SEQ ID NO: 35312 - DNA, 25 bp, Mus musculus
gatggaccaaatcaataaggacatg

SEQ ID NO: 35313 - DNA, 25 bp, Mus musculus
gatggaccatagttactcctccaac

SEQ ID NO: 35314 - DNA, 25 bp, Mus musculus
gatggacctgctgagtaagaaagcc

SEQ ID NO: 35315 - DNA, 25 bp, Mus musculus
gatggacgacttcgagacccattta

SEQ ID NO: 35316 - DNA, 25 bp, Mus musculus
gatggacgatgactccttagaagaa

SEQ ID NO: 35317 - DNA, 25 bp, Mus musculus
gatggactcaacagccaatgaggtg

SEQ ID NO: 35318 - DNA, 25 bp, Mus musculus
gatggactcttgctctcctagaacc

SEQ ID NO: 35319 - DNA, 25 bp, Mus musculus
gatggactgcgcagcgcccacgatc

SEQ ID NO: 35320 - DNA, 25 bp, Mus musculus
gatggacttctcagttggcttcata

SEQ ID NO: 35321 - DNA, 25 bp, Mus musculus
gatggacttgtacacacaaatgacc

SEQ ID NO: 35322 - DNA, 25 bp, Mus musculus
gatggagaaccagatgaaaggcctg

SEQ ID NO: 35323 - DNA, 25 bp, Mus musculus
gatggagaacctggtacccctggaa

SEQ ID NO: 35324 - DNA, 25 bp, Mus musculus
gatggagaactaccacaatgtggcc

SEQ ID NO: 35325 - DNA, 25 bp, Mus musculus
gatggagaactcaaagcagttatgg

SEQ ID NO: 35326 - DNA, 25 bp, Mus musculus
gatggagaactcaaatcttcgacaa

SEQ ID NO: 35327 - DNA, 25 bp, Mus musculus
gatggagaagccatcccatgccgct

SEQ ID NO: 35328 - DNA, 25 bp, Mus musculus
gatggagaagccttcccatgccgct

SEQ ID NO: 35329 - DNA, 25 bp, Mus musculus
gatggagaagttatcagctggtgtt

SEQ ID NO: 35330 - DNA, 25 bp, Mus musculus
gatggagaatctattggacatatgc

SEQ ID NO: 35331 - DNA, 25 bp, Mus musculus
gatggagaatcttttggacatatgc

SEQ ID NO: 35332 - DNA, 25 bp, Mus musculus
gatggagagacagactggaagcttc

SEQ ID NO: 35333 - DNA, 25 bp, Mus musculus
gatggagatattctagcctccagct

SEQ ID NO: 35334 - DNA, 25 bp, Mus musculus
gatggagattcaggagatccagctg

SEQ ID NO: 35335 - DNA, 25 bp, Mus musculus
gatggagcatcccaatatcgtaacc

SEQ ID NO: 35336 - DNA, 25 bp, Mus musculus
gatggagctacggacatggaagcct

SEQ ID NO: 35337 - DNA, 25 bp, Mus musculus
gatggagcttcaccactggacaaag

SEQ ID NO: 35338 - DNA, 25 bp, Mus musculus
gatggaggacactatgacggaagta

SEQ ID NO: 35339 - DNA, 25 bp, Mus musculus
gatggaggactaatcaacaaggtca

SEQ ID NO: 35340 - DNA, 25 bp, Mus musculus
gatggaggctctgtctctgacgtca

SEQ ID NO: 35341 - DNA, 25 bp, Mus musculus
gatggagggaaagtacatcatccac

SEQ ID NO: 35342 - DNA, 25 bp, Mus musculus
gatggagtacctcatcaagactggc

SEQ ID NO: 35343 - DNA, 25 bp, Mus musculus
gatggagtctggtattcacactctc

SEQ ID NO: 35344 - DNA, 25 bp, Mus musculus
gatggagtcttcagcttcctattta

SEQ ID NO: 35345 - DNA, 25 bp, Mus musculus
gatggataaactgaagcccagactg

SEQ ID NO: 35346 - DNA, 25 bp, Mus musculus
gatggatatatcttcaagatgccac

SEQ ID NO: 35347 - DNA, 25 bp, Mus musculus
gatggatatcagtcagttctcagta

SEQ ID NO: 35348 - DNA, 25 bp, Mus musculus
gatggatatcccctatgagctgtgg

SEQ ID NO: 35349 - DNA, 25 bp, Mus musculus
gatggatatgaatgggaccccataa

SEQ ID NO: 35350 - DNA, 25 bp, Mus musculus
gatggatcaggctttgctgcttatt

SEQ ID NO: 35351 - DNA, 25 bp, Mus musculus
gatggatcagtactaaaacccgatt

SEQ ID NO: 35352 - DNA, 25 bp, Mus musculus
gatggatctaaaaggctggagatgc

SEQ ID NO: 35353 - DNA, 25 bp, Mus musculus
gatggatgaacagatcagactgatg

SEQ ID NO: 35354 - DNA, 25 bp, Mus musculus
gatggatgctcattcatgcccactg

SEQ ID NO: 35355 - DNA, 25 bp, Mus musculus
gatggatggacaccagcagaagcac

SEQ ID NO: 35356 - DNA, 25 bp, Mus musculus
gatggattcctctcataaatgaaag

SEQ ID NO: 35357 - DNA, 25 bp, Mus musculus
gatggattctccatggagtcaggag

SEQ ID NO: 35358 - DNA, 25 bp, Mus musculus
gatggattctggacgagctccaaag

SEQ ID NO: 35359 - DNA, 25 bp, Mus musculus
gatggatttattgctcgaaactggg

SEQ ID NO: 35360 - DNA, 25 bp, Mus musculus
gatggcaaagtctgtagcaacagag

SEQ ID NO: 35361 - DNA, 25 bp, Mus musculus
gatggcaagatctcttttgcagact

SEQ ID NO: 35362 - DNA, 25 bp, Mus musculus
gatggcaagtggctcaatgtccact

SEQ ID NO: 35363 - DNA, 25 bp, Mus musculus
gatggcaataaggaagatccccaga

SEQ ID NO: 35364 - DNA, 25 bp, Mus musculus
gatggcaatcacagtgacaaagaag

SEQ ID NO: 35365 - DNA, 25 bp, Mus musculus
gatggcaatgcaaagatgaccctgg

SEQ ID NO: 35366 - DNA, 25 bp, Mus musculus
gatggcacaccatgtgtggactggt

SEQ ID NO: 35367 - DNA, 25 bp, Mus musculus
gatggcacgaacatgacttatggaa

SEQ ID NO: 35368 - DNA, 25 bp, Mus musculus
gatggcactggatctttaaagcgca

SEQ ID NO: 35369 - DNA, 25 bp, Mus musculus
gatggcactggtagcagtatttgag

SEQ ID NO: 35370 - DNA, 25 bp, Mus musculus
gatggcactgtaacgctgcatgcag

SEQ ID NO: 35371 - DNA, 25 bp, Mus musculus
gatggcagacgttggcaccatctgt

SEQ ID NO: 35372 - DNA, 25 bp, Mus musculus
gatggcagatctgctacacgggagc

SEQ ID NO: 35373 - DNA, 25 bp, Mus musculus
gatggcagcacctggagcaggctga

SEQ ID NO: 35374 - DNA, 25 bp, Mus musculus
gatggcagcgccagttacaagaacc

SEQ ID NO: 35375 - DNA, 25 bp, Mus musculus
gatggcataaatggaacagttaact

SEQ ID NO: 35376 - DNA, 25 bp, Mus musculus
gatggcatacaatgaaagtgagaac

SEQ ID NO: 35377 - DNA, 25 bp, Mus musculus
gatggcatccgccagcagctctatg

SEQ ID NO: 35378 - DNA, 25 bp, Mus musculus
gatggcatcgacttatagacgaata

SEQ ID NO: 35379 - DNA, 25 bp, Mus musculus
gatggcatcgtttttgccctcagaa

SEQ ID NO: 35380 - DNA, 25 bp, Mus musculus
gatggcattgtagcagatgaatccc

SEQ ID NO: 35381 - DNA, 25 bp, Mus musculus
gatggccaagcggaattccagacag

SEQ ID NO: 35382 - DNA, 25 bp, Mus musculus
gatggccacaggactctggatgctg

SEQ ID NO: 35383 - DNA, 25 bp, Mus musculus
gatggccactctcgtgctggaacgc

SEQ ID NO: 35384 - DNA, 25 bp, Mus musculus
gatggccaggcttttcttacagctc

SEQ ID NO: 35385 - DNA, 25 bp, Mus musculus
gatggccagtatgtccccagaattg

SEQ ID NO: 35386 - DNA, 25 bp, Mus musculus
gatggccatggcataaggagcatta

SEQ ID NO: 35387 - DNA, 25 bp, Mus musculus
gatggccatttcagtttcacagagg

SEQ ID NO: 35388 - DNA, 25 bp, Mus musculus
gatggccattttgctgaccgtggag

SEQ ID NO: 35389 - DNA, 25 bp, Mus musculus
gatggcccaatggagccagtttgca

SEQ ID NO: 35390 - DNA, 25 bp, Mus musculus
gatggccccatgtgcatgcatgaca

SEQ ID NO: 35391 - DNA, 25 bp, Mus musculus
gatggcccctaacattcctttggaa

SEQ ID NO: 35392 - DNA, 25 bp, Mus musculus
gatggcccctgaagtcatggaacag

SEQ ID NO: 35393 - DNA, 25 bp, Mus musculus
gatggccctcagtacaattcgtctc

SEQ ID NO: 35394 - DNA, 25 bp, Mus musculus
gatggccctgaatacaattcttctc

SEQ ID NO: 35395 - DNA, 25 bp, Mus musculus
gatggccgagatggaataccaggaa

SEQ ID NO: 35396 - DNA, 25 bp, Mus musculus
gatggcctcagttcatgaaccttct

SEQ ID NO: 35397 - DNA, 25 bp, Mus musculus
gatggcctctatccagtccttcagt

SEQ ID NO: 35398 - DNA, 25 bp, Mus musculus
gatggcctgaatcacttggacagcc

SEQ ID NO: 35399 - DNA, 25 bp, Mus musculus
gatggcctgacactgaagctctttc

SEQ ID NO: 35400 - DNA, 25 bp, Mus musculus
gatggccttgttagcatgggcagca

SEQ ID NO: 35401 - DNA, 25 bp, Mus musculus
gatggcgcctgcttcgatctgacca

SEQ ID NO: 35402 - DNA, 25 bp, Mus musculus
gatggcggcccaagactttttccag

SEQ ID NO: 35403 - DNA, 25 bp, Mus musculus
gatggcgtgatgtcactactttctt

SEQ ID NO: 35404 - DNA, 25 bp, Mus musculus
gatggcgtggttgtactctatgacc

SEQ ID NO: 35405 - DNA, 25 bp, Mus musculus
gatggctaaacttcaaggcattgct

SEQ ID NO: 35406 - DNA, 25 bp, Mus musculus
gatggctataaagtacaagagaaga

SEQ ID NO: 35407 - DNA, 25 bp, Mus musculus
gatggctcacatgtttcccacaaaa

SEQ ID NO: 35408 - DNA, 25 bp, Mus musculus
gatggctcaccctgcgctgagggtc

SEQ ID NO: 35409 - DNA, 25 bp, Mus musculus
gatggctcacgcgagctcctcaagt

SEQ ID NO: 35410 - DNA, 25 bp, Mus musculus
gatggctcagccaaaaactcctgtg

SEQ ID NO: 35411 - DNA, 25 bp, Mus musculus
gatggctcaggagtctgcagacctt

SEQ ID NO: 35412 - DNA, 25 bp, Mus musculus
gatggctcaggcgattccttcattg

SEQ ID NO: 35413 - DNA, 25 bp, Mus musculus
gatggctccaaacgccgaagactta

SEQ ID NO: 35414 - DNA, 25 bp, Mus musculus
gatggctccccaggcaatggcattg

SEQ ID NO: 35415 - DNA, 25 bp, Mus musculus
gatggctccgtcatggtttattggc

SEQ ID NO: 35416 - DNA, 25 bp, Mus musculus
gatggctcctgaagccctttttgat

SEQ ID NO: 35417 - DNA, 25 bp, Mus musculus
gatggctcgagttgtacctgtaccc

SEQ ID NO: 35418 - DNA, 25 bp, Mus musculus
gatggctcggagatcctcagtctgt

SEQ ID NO: 35419 - DNA, 25 bp, Mus musculus
gatggctcgggcttcctcatcaacc

SEQ ID NO: 35420 - DNA, 25 bp, Mus musculus
gatggctctaccaaaggccacaggc

SEQ ID NO: 35421 - DNA, 25 bp, Mus musculus
gatggctctccttcagggcagcaac

SEQ ID NO: 35422 - DNA, 25 bp, Mus musculus
gatggctgacactggctaatgggaa

SEQ ID NO: 35423 - DNA, 25 bp, Mus musculus
gatggctgacgtccacttcatcgtg

SEQ ID NO: 35424 - DNA, 25 bp, Mus musculus
gatggctgaggaccctgattcaatt

SEQ ID NO: 35425 - DNA, 25 bp, Mus musculus
gatggctgatccctggaatggacaa

SEQ ID NO: 35426 - DNA, 25 bp, Mus musculus
gatggctgtgaatattctcttggac

SEQ ID NO: 35427 - DNA, 25 bp, Mus musculus
gatggctgtttctccagctccagag

SEQ ID NO: 35428 - DNA, 25 bp, Mus musculus
gatggcttcacctatgtcctctaca

SEQ ID NO: 35429 - DNA, 25 bp, Mus musculus
gatggcttccttgtttactcaagaa

SEQ ID NO: 35430 - DNA, 25 bp, Mus musculus
gatggcttcttcagagtttgctact

SEQ ID NO: 35431 - DNA, 25 bp, Mus musculus
gatggcttttattatctggctcaga

SEQ ID NO: 35432 - DNA, 25 bp, Mus musculus
gatgggaaagtgtcaaaactacaga

SEQ ID NO: 35433 - DNA, 25 bp, Mus musculus
gatgggaacatatgctctgggaaaa

SEQ ID NO: 35434 - DNA, 25 bp, Mus musculus
gatgggaagttacaacaaacatagc

SEQ ID NO: 35435 - DNA, 25 bp, Mus musculus
gatgggaattactatgcgtgcaaac

SEQ ID NO: 35436 - DNA, 25 bp, Mus musculus
gatgggaattctcaaagtagctcag

SEQ ID NO: 35437 - DNA, 25 bp, Mus musculus
gatgggacactttcggagatgctgc

SEQ ID NO: 35438 - DNA, 25 bp, Mus musculus
gatgggaccctcctgttacatcggc

SEQ ID NO: 35439 - DNA, 25 bp, Mus musculus
gatgggacctgcttcttctttggcc

SEQ ID NO: 35440 - DNA, 25 bp, Mus musculus
gatgggactgtttatcggagccagc

SEQ ID NO: 35441 - DNA, 25 bp, Mus musculus
gatgggagaaggatgtcttttcaga

SEQ ID NO: 35442 - DNA, 25 bp, Mus musculus
gatgggagctcagacaagttattgc

SEQ ID NO: 35443 - DNA, 25 bp, Mus musculus
gatgggagttaaaaggctggctacc

SEQ ID NO: 35444 - DNA, 25 bp, Mus musculus
gatgggatgatgaccgatggtttcc

SEQ ID NO: 35445 - DNA, 25 bp, Mus musculus
gatgggatgatgtccgatggtttcc

SEQ ID NO: 35446 - DNA, 25 bp, Mus musculus
gatgggatgctcagcaagctgtgcc

SEQ ID NO: 35447 - DNA, 25 bp, Mus musculus
gatgggattaccgtccacgtggaga

SEQ ID NO: 35448 - DNA, 25 bp, Mus musculus
gatgggcaaactgcataaagagatt

SEQ ID NO: 35449 - DNA, 25 bp, Mus musculus
gatgggcacctctcatgtgtctgtg

SEQ ID NO: 35450 - DNA, 25 bp, Mus musculus
gatgggcatcatcaataactctgta

SEQ ID NO: 35451 - DNA, 25 bp, Mus musculus
gatgggcccgtgattcaccaagaaa

SEQ ID NO: 35452 - DNA, 25 bp, Mus musculus
gatgggccggactgtgatagtactt

SEQ ID NO: 35453 - DNA, 25 bp, Mus musculus
gatgggcgcttatatgcctcggaga

SEQ ID NO: 35454 - DNA, 25 bp, Mus musculus
gatgggctactttatgattcagacg

SEQ ID NO: 35455 - DNA, 25 bp, Mus musculus
gatgggctccttcatttcaggacag

SEQ ID NO: 35456 - DNA, 25 bp, Mus musculus
gatgggctgatacccctggagatcc

SEQ ID NO: 35457 - DNA, 25 bp, Mus musculus
gatgggggcctcgtctccaatgctc

SEQ ID NO: 35458 - DNA, 25 bp, Mus musculus
gatgggtaacaagcttggatctgga

SEQ ID NO: 35459 - DNA, 25 bp, Mus musculus
gatgggtccatacaccgaataagag

SEQ ID NO: 35460 - DNA, 25 bp, Mus musculus
gatgggttctacaacggccgtagcc

SEQ ID NO: 35461 - DNA, 25 bp, Mus musculus
gatggtacaaaaagcctcctcctgc

SEQ ID NO: 35462 - DNA, 25 bp, Mus musculus
gatggtacaaactttcgagtgaagg

SEQ ID NO: 35463 - DNA, 25 bp, Mus musculus
gatggtacatctcaatgattccact

SEQ ID NO: 35464 - DNA, 25 bp, Mus musculus
gatggtacctgcagtgcgagtagac

SEQ ID NO: 35465 - DNA, 25 bp, Mus musculus
gatggtacctgctgtgcgagtagac

SEQ ID NO: 35466 - DNA, 25 bp, Mus musculus
gatggtacctgtcttaaccctgtat

SEQ ID NO: 35467 - DNA, 25 bp, Mus musculus
gatggtacctgtgttaaccctgtat

SEQ ID NO: 35468 - DNA, 25 bp, Mus musculus
gatggtaccttggatgatggtgaat

SEQ ID NO: 35469 - DNA, 25 bp, Mus musculus
gatggtagtacaccctcgtgcacag

SEQ ID NO: 35470 - DNA, 25 bp, Mus musculus
gatggtattccaggtgcacaatcca

SEQ ID NO: 35471 - DNA, 25 bp, Mus musculus
gatggtcaccccaaatctgcagcag

SEQ ID NO: 35472 - DNA, 25 bp, Mus musculus
gatggtcaccggcacatgaatggct

SEQ ID NO: 35473 - DNA, 25 bp, Mus musculus
gatggtcacctcaaccctcatgcat

SEQ ID NO: 35474 - DNA, 25 bp, Mus musculus
gatggtcacgtacaaggaccaggca

SEQ ID NO: 35475 - DNA, 25 bp, Mus musculus
gatggtcacttatttgaagatgagg

SEQ ID NO: 35476 - DNA, 25 bp, Mus musculus
gatggtcagaaggacaactggagct

SEQ ID NO: 35477 - DNA, 25 bp, Mus musculus
gatggtcagtctgtcatggtggaac

SEQ ID NO: 35478 - DNA, 25 bp, Mus musculus
gatggtcatgaactccataaacggc

SEQ ID NO: 35479 - DNA, 25 bp, Mus musculus
gatggtcccagctcttcttgcaaaa

SEQ ID NO: 35480 - DNA, 25 bp, Mus musculus
gatggtccccacattcagcagtgag

SEQ ID NO: 35481 - DNA, 25 bp, Mus musculus
gatggtccccggtgcatctgtcctg

SEQ ID NO: 35482 - DNA, 25 bp, Mus musculus
gatggtcctcatggtcacgtgctgc

SEQ ID NO: 35483 - DNA, 25 bp, Mus musculus
gatggtgaaaacatttatatcagac

SEQ ID NO: 35484 - DNA, 25 bp, Mus musculus
gatggtgaagatcatcgtgcacacc

SEQ ID NO: 35485 - DNA, 25 bp, Mus musculus
gatggtgacctccatccgcacacat

SEQ ID NO: 35486 - DNA, 25 bp, Mus musculus
gatggtgacctcgatccgcacacat

SEQ ID NO: 35487 - DNA, 25 bp, Mus musculus
gatggtgagatgaacagattttgcc

SEQ ID NO: 35488 - DNA, 25 bp, Mus musculus
gatggtgatgaaattctgggccaac

SEQ ID NO: 35489 - DNA, 25 bp, Mus musculus
gatggtgcgatctttgaacttggac

SEQ ID NO: 35490 - DNA, 25 bp, Mus musculus
gatggtgctcgtagacaatttgaat

SEQ ID NO: 35491 - DNA, 25 bp, Mus musculus
gatggtgctgcaggccaagaaacga

SEQ ID NO: 35492 - DNA, 25 bp, Mus musculus
gatggtggaaaattcaccgtcgcca

SEQ ID NO: 35493 - DNA, 25 bp, Mus musculus
gatggtggccaacaagaaaagtcag

SEQ ID NO: 35494 - DNA, 25 bp, Mus musculus
gatggtggtgacgttcctcatgtct

SEQ ID NO: 35495 - DNA, 25 bp, Mus musculus
gatggtgtctctcgaagattcatcc

SEQ ID NO: 35496 - DNA, 25 bp, Mus musculus
gatggttatattaacctggcagcag

SEQ ID NO: 35497 - DNA, 25 bp, Mus musculus
gatggttcccaaagccgtggactga

SEQ ID NO: 35498 - DNA, 25 bp, Mus musculus
gatggttctgagattcacatcaagg

SEQ ID NO: 35499 - DNA, 25 bp, Mus musculus
gatggtttagagagaccttcgagca

SEQ ID NO: 35500 - DNA, 25 bp, Mus musculus
gatggtttcctggaatttgatgacc

SEQ ID NO: 35501 - DNA, 25 bp, Mus musculus
gatggtttctaactgccgtttgggt

SEQ ID NO: 35502 - DNA, 25 bp, Mus musculus
gatggtttgaaggaccattatgata

SEQ ID NO: 35503 - DNA, 25 bp, Mus musculus
gatgtaaacaaagcaaagagacaga

SEQ ID NO: 35504 - DNA, 25 bp, Mus musculus
gatgtaaacacaccagtgaggactg

SEQ ID NO: 35505 - DNA, 25 bp, Mus musculus
gatgtaaagaatgtcattatctggg

SEQ ID NO: 35506 - DNA, 25 bp, Mus musculus
gatgtaaagccagcagcgtcatgtg

SEQ ID NO: 35507 - DNA, 25 bp, Mus musculus
gatgtaacaaatatttctaccccta

SEQ ID NO: 35508 - DNA, 25 bp, Mus musculus
gatgtaagtgaaaaatcttgcttga

SEQ ID NO: 35509 - DNA, 25 bp, Mus musculus
gatgtaatagagagagctatccaga

SEQ ID NO: 35510 - DNA, 25 bp, Mus musculus
gatgtacctgtttgtgaggcaaaaa

SEQ ID NO: 35511 - DNA, 25 bp, Mus musculus
gatgtacggcttatgttctccaact

SEQ ID NO: 35512 - DNA, 25 bp, Mus musculus
gatgtactacaagcacactcgaagg

SEQ ID NO: 35513 - DNA, 25 bp, Mus musculus
gatgtagaagaagatttggagctcc

SEQ ID NO: 35514 - DNA, 25 bp, Mus musculus
gatgtagagaaaatgatcaacagca

SEQ ID NO: 35515 - DNA, 25 bp, Mus musculus
gatgtagcactaactgcatatggta

SEQ ID NO: 35516 - DNA, 25 bp, Mus musculus
gatgtagccatgttcctagagatta

SEQ ID NO: 35517 - DNA, 25 bp, Mus musculus
gatgtagtaaaccagtcaagtccaa

SEQ ID NO: 35518 - DNA, 25 bp, Mus musculus
gatgtataccgaggcccagccatca

SEQ ID NO: 35519 - DNA, 25 bp, Mus musculus
gatgtatcagatgagcctccgaggg

SEQ ID NO: 35520 - DNA, 25 bp, Mus musculus
gatgtatccacttttactactagga

SEQ ID NO: 35521 - DNA, 25 bp, Mus musculus
gatgtatcctccatccatgatcgcc

SEQ ID NO: 35522 - DNA, 25 bp, Mus musculus
gatgtatgcccaaaactcaaggctt

SEQ ID NO: 35523 - DNA, 25 bp, Mus musculus
gatgtatgcccataactcaaggctt

SEQ ID NO: 35524 - DNA, 25 bp, Mus musculus
gatgtatggcaagctgcctcgcctg

SEQ ID NO: 35525 - DNA, 25 bp, Mus musculus
gatgtatttatacctcaagatggga

SEQ ID NO: 35526 - DNA, 25 bp, Mus musculus
gatgtcaactgagacagaacttcaa

SEQ ID NO: 35527 - DNA, 25 bp, Mus musculus
gatgtcaatgccataatcctggccc

SEQ ID NO: 35528 - DNA, 25 bp, Mus musculus
gatgtcaatgttgcagctgatcatg

SEQ ID NO: 35529 - DNA, 25 bp, Mus musculus
gatgtcacaaaacttgcaagaactc

SEQ ID NO: 35530 - DNA, 25 bp, Mus musculus
gatgtcactaaggagcccatcccag

SEQ ID NO: 35531 - DNA, 25 bp, Mus musculus
gatgtcactctgctgaagacgcaac

SEQ ID NO: 35532 - DNA, 25 bp, Mus musculus
gatgtcactgtagaagaagatgcac

SEQ ID NO: 35533 - DNA, 25 bp, Mus musculus
gatgtcactttcctggcaagcctgc

SEQ ID NO: 35534 - DNA, 25 bp, Mus musculus
gatgtcagaacactgcccaatgcca

SEQ ID NO: 35535 - DNA, 25 bp, Mus musculus
gatgtcagccttcggtgttgttcca

SEQ ID NO: 35536 - DNA, 25 bp, Mus musculus
gatgtcagccttgggtgttgttcca

SEQ ID NO: 35537 - DNA, 25 bp, Mus musculus
gatgtcagctcggtgcttacaaaca

SEQ ID NO: 35538 - DNA, 25 bp, Mus musculus
gatgtcaggcagtcaagttcttcag

SEQ ID NO: 35539 - DNA, 25 bp, Mus musculus
gatgtcaggttcaaaaagagcccag

SEQ ID NO: 35540 - DNA, 25 bp, Mus musculus
gatgtcatcatgagggaattccgat

SEQ ID NO: 35541 - DNA, 25 bp, Mus musculus
gatgtcatgcagacagttgcaagca

SEQ ID NO: 35542 - DNA, 25 bp, Mus musculus
gatgtcatgcagtcagttgcaagca

SEQ ID NO: 35543 - DNA, 25 bp, Mus musculus
gatgtcattcattatcggaaaacgg

SEQ ID NO: 35544 - DNA, 25 bp, Mus musculus
gatgtcattgcccagtgtatcctcc

SEQ ID NO: 35545 - DNA, 25 bp, Mus musculus
gatgtccaacgcattgccttcagga

SEQ ID NO: 35546 - DNA, 25 bp, Mus musculus
gatgtccaacgctttgccttcagga

SEQ ID NO: 35547 - DNA, 25 bp, Mus musculus
gatgtccaagccctgtggtacttcg

SEQ ID NO: 35548 - DNA, 25 bp, Mus musculus
gatgtccacatcctggaatggcacg

SEQ ID NO: 35549 - DNA, 25 bp, Mus musculus
gatgtccactctccaagctttatct

SEQ ID NO: 35550 - DNA, 25 bp, Mus musculus
gatgtccccgtaactaagcaaaggc

SEQ ID NO: 35551 - DNA, 25 bp, Mus musculus
gatgtccccttggatcttcacacag

SEQ ID NO: 35552 - DNA, 25 bp, Mus musculus
gatgtccctgagatcgtcatatcag

SEQ ID NO: 35553 - DNA, 25 bp, Mus musculus
gatgtccgaagaatgaaatgagcag

SEQ ID NO: 35554 - DNA, 25 bp, Mus musculus
gatgtccgggaagccactgcgcatg

SEQ ID NO: 35555 - DNA, 25 bp, Mus musculus
gatgtcctcgcattgcccattttta

SEQ ID NO: 35556 - DNA, 25 bp, Mus musculus
gatgtcctcttaccggcacatgcat

SEQ ID NO: 35557 - DNA, 25 bp, Mus musculus
gatgtcctggacaaacggctcttct

SEQ ID NO: 35558 - DNA, 25 bp, Mus musculus
gatgtcctggtcagcctagagaagc

SEQ ID NO: 35559 - DNA, 25 bp, Mus musculus
gatgtcctgtggatccaaaactatg

SEQ ID NO: 35560 - DNA, 25 bp, Mus musculus
gatgtcgcacctgttattttagctg

SEQ ID NO: 35561 - DNA, 25 bp, Mus musculus
gatgtctactcatgaatttgagaag

SEQ ID NO: 35562 - DNA, 25 bp, Mus musculus
gatgtctatggttcctctgcatgag

SEQ ID NO: 35563 - DNA, 25 bp, Mus musculus
gatgtctcagccaatgccgtgcggc

SEQ ID NO: 35564 - DNA, 25 bp, Mus musculus
gatgtctcatgttccatcatatcag

SEQ ID NO: 35565 - DNA, 25 bp, Mus musculus
gatgtctccacggattgaaaagcgc

SEQ ID NO: 35566 - DNA, 25 bp, Mus musculus
gatgtctcccaacgacagacttgag

SEQ ID NO: 35567 - DNA, 25 bp, Mus musculus
gatgtctcgccagctggatgacctt

SEQ ID NO: 35568 - DNA, 25 bp, Mus musculus
gatgtctgacagtgaaatggatgga

SEQ ID NO: 35569 - DNA, 25 bp, Mus musculus
gatgtctgcagtattctcttgggta

SEQ ID NO: 35570 - DNA, 25 bp, Mus musculus
gatgtctgccagagttgcttctttt

SEQ ID NO: 35571 - DNA, 25 bp, Mus musculus
gatgtctgcgtctgaaaacacgcaa

SEQ ID NO: 35572 - DNA, 25 bp, Mus musculus
gatgtcttcaatagcaaacaactta

SEQ ID NO: 35573 - DNA, 25 bp, Mus musculus
gatgtcttcagcacctgatcctcca

SEQ ID NO: 35574 - DNA, 25 bp, Mus musculus
gatgtcttgtcattgccctgtgtca

SEQ ID NO: 35575 - DNA, 25 bp, Mus musculus
gatgtgaactactttgaacacaagc

SEQ ID NO: 35576 - DNA, 25 bp, Mus musculus
gatgtgaagattactgatgctatca

SEQ ID NO: 35577 - DNA, 25 bp, Mus musculus
gatgtgaagatttctgatgctatca

SEQ ID NO: 35578 - DNA, 25 bp, Mus musculus
gatgtgaagctcgttgcagatttcc

SEQ ID NO: 35579 - DNA, 25 bp, Mus musculus
gatgtgacagcatatgacaatcgtc

SEQ ID NO: 35580 - DNA, 25 bp, Mus musculus
gatgtgaccatatcctaccttccct

SEQ ID NO: 35581 - DNA, 25 bp, Mus musculus
gatgtgacctttctacctgagaagg

SEQ ID NO: 35582 - DNA, 25 bp, Mus musculus
gatgtgacttaattcaggaaggtgg

SEQ ID NO: 35583 - DNA, 25 bp, Mus musculus
gatgtgagcctcaaacaaggtcaga

SEQ ID NO: 35584 - DNA, 25 bp, Mus musculus
gatgtgatcctactgacagccattg

SEQ ID NO: 35585 - DNA, 25 bp, Mus musculus
gatgtgatggagaagttatcagctg

SEQ ID NO: 35586 - DNA, 25 bp, Mus musculus
gatgtgatggcggacagggtgcccc

SEQ ID NO: 35587 - DNA, 25 bp, Mus musculus
gatgtgattattataccttcagccc

SEQ ID NO: 35588 - DNA, 25 bp, Mus musculus
gatgtgcaactaattaaaggcagac

SEQ ID NO: 35589 - DNA, 25 bp, Mus musculus
gatgtgcagctcgtggtcaatacca

SEQ ID NO: 35590 - DNA, 25 bp, Mus musculus
gatgtgcccagggaagctcccagag

SEQ ID NO: 35591 - DNA, 25 bp, Mus musculus
gatgtgcgctgctccaatcagtctc

SEQ ID NO: 35592 - DNA, 25 bp, Mus musculus
gatgtgctggaaaatataacctcac

SEQ ID NO: 35593 - DNA, 25 bp, Mus musculus
gatgtgctggaatatataacctcac

SEQ ID NO: 35594 - DNA, 25 bp, Mus musculus
gatgtggaacatctcaaagaacacg

SEQ ID NO: 35595 - DNA, 25 bp, Mus musculus
gatgtggaatgaaaggaagccttgt

SEQ ID NO: 35596 - DNA, 25 bp, Mus musculus
gatgtggacaccactggttttcagt

SEQ ID NO: 35597 - DNA, 25 bp, Mus musculus
gatgtggacacctctggttttcagt

SEQ ID NO: 35598 - DNA, 25 bp, Mus musculus
gatgtggacgccactatgtccatcc

SEQ ID NO: 35599 - DNA, 25 bp, Mus musculus
gatgtggagccgtctcctctcaacc

SEQ ID NO: 35600 - DNA, 25 bp, Mus musculus
gatgtggaggccatgaactttccga

SEQ ID NO: 35601 - DNA, 25 bp, Mus musculus
gatgtggatagtgaagctaagaaac

SEQ ID NO: 35602 - DNA, 25 bp, Mus musculus
gatgtggccaaatcagttttgaagg

SEQ ID NO: 35603 - DNA, 25 bp, Mus musculus
gatgtggccacgtgtcctagctgct

SEQ ID NO: 35604 - DNA, 25 bp, Mus musculus
gatgtggccatggactttacgccag

SEQ ID NO: 35605 - DNA, 25 bp, Mus musculus
gatgtggcggcaacaggaacaactt

SEQ ID NO: 35606 - DNA, 25 bp, Mus musculus
gatgtggctgtgcatcttacacgag

SEQ ID NO: 35607 - DNA, 25 bp, Mus musculus
gatgtgggtatcaactatatacaag

SEQ ID NO: 35608 - DNA, 25 bp, Mus musculus
gatgtggtcctcactgtcaacagtg

SEQ ID NO: 35609 - DNA, 25 bp, Mus musculus
gatgtggttcggtttctggaagcca

SEQ ID NO: 35610 - DNA, 25 bp, Mus musculus
gatgtggttgctgtctccaggaata

SEQ ID NO: 35611 - DNA, 25 bp, Mus musculus
gatgtgtactgcagggcacctcctg

SEQ ID NO: 35612 - DNA, 25 bp, Mus musculus
gatgtgtcagagagagtacggatcc

SEQ ID NO: 35613 - DNA, 25 bp, Mus musculus
gatgtgtccgcttacattccaacaa

SEQ ID NO: 35614 - DNA, 25 bp, Mus musculus
gatgtgtctaatgggaaagtccatg

SEQ ID NO: 35615 - DNA, 25 bp, Mus musculus
gatgtgtgagatcttctattctaga

SEQ ID NO: 35616 - DNA, 25 bp, Mus musculus
gatgtgtgtgatatttgagaatagc

SEQ ID NO: 35617 - DNA, 25 bp, Mus musculus
gatgtgtgtgatttttgagaatagc

SEQ ID NO: 35618 - DNA, 25 bp, Mus musculus
gatgtgttcacacctgatgagtctc

SEQ ID NO: 35619 - DNA, 25 bp, Mus musculus
gatgtgttccattgacaatttgcca

SEQ ID NO: 35620 - DNA, 25 bp, Mus musculus
gatgtgttcttcagacagacatgga

SEQ ID NO: 35621 - DNA, 25 bp, Mus musculus
gatgtgttgcttagtaaccatccca

SEQ ID NO: 35622 - DNA, 25 bp, Mus musculus
gatgtgttgtccagggcagcctctc

SEQ ID NO: 35623 - DNA, 25 bp, Mus musculus
gatgtgtttgacgtagatgatgcaa

SEQ ID NO: 35624 - DNA, 25 bp, Mus musculus
gatgttaagaaacagcgctcagatc

SEQ ID NO: 35625 - DNA, 25 bp, Mus musculus
gatgttacaagacacagacaagccc

SEQ ID NO: 35626 - DNA, 25 bp, Mus musculus
gatgttacagagtcccagatcctaa

SEQ ID NO: 35627 - DNA, 25 bp, Mus musculus
gatgttaccacgtttttcaaagcgg

SEQ ID NO: 35628 - DNA, 25 bp, Mus musculus
gatgttactgagtctcagggcttca

SEQ ID NO: 35629 - DNA, 25 bp, Mus musculus
gatgttaggatgaaatcagatctac

SEQ ID NO: 35630 - DNA, 25 bp, Mus musculus
gatgttatccctgcatgatgcggag

SEQ ID NO: 35631 - DNA, 25 bp, Mus musculus
gatgttatgacacctatgcggcaga

SEQ ID NO: 35632 - DNA, 25 bp, Mus musculus
gatgttatgacagctatgcggcaga

SEQ ID NO: 35633 - DNA, 25 bp, Mus musculus
gatgttcaactggatggtgacacgc

SEQ ID NO: 35634 - DNA, 25 bp, Mus musculus
gatgttcagactgctcatggccagc

SEQ ID NO: 35635 - DNA, 25 bp, Mus musculus
gatgttcagcttctggcccaacagc

SEQ ID NO: 35636 - DNA, 25 bp, Mus musculus
gatgttcagcttgtggcccaacagc

SEQ ID NO: 35637 - DNA, 25 bp, Mus musculus
gatgttcatctcactcctcggataa

SEQ ID NO: 35638 - DNA, 25 bp, Mus musculus
gatgttccatcagcaggcgctgcag

SEQ ID NO: 35639 - DNA, 25 bp, Mus musculus
gatgttcccagaacagcagaaagag

SEQ ID NO: 35640 - DNA, 25 bp, Mus musculus
gatgttcctcagttccggatattgg

SEQ ID NO: 35641 - DNA, 25 bp, Mus musculus
gatgttcctggaaaccagtgcactg

SEQ ID NO: 35642 - DNA, 25 bp, Mus musculus
gatgttcctggataccagtgcactg

SEQ ID NO: 35643 - DNA, 25 bp, Mus musculus
gatgttcctgggaaatattggtccc

SEQ ID NO: 35644 - DNA, 25 bp, Mus musculus
gatgttcggactgtagactcagctg

SEQ ID NO: 35645 - DNA, 25 bp, Mus musculus
gatgttcgtttacctatggaataca

SEQ ID NO: 35646 - DNA, 25 bp, Mus musculus
gatgttctgtgctggctatcctgag

SEQ ID NO: 35647 - DNA, 25 bp, Mus musculus
gatgttcttggaaagggacaagaag

SEQ ID NO: 35648 - DNA, 25 bp, Mus musculus
gatgttgaacttgcaactgtttgcc

SEQ ID NO: 35649 - DNA, 25 bp, Mus musculus
gatgttgaattcatgaaggccctgc

SEQ ID NO: 35650 - DNA, 25 bp, Mus musculus
gatgttgagaaggagctgaatgccc

SEQ ID NO: 35651 - DNA, 25 bp, Mus musculus
gatgttgattctaagagtcccaact

SEQ ID NO: 35652 - DNA, 25 bp, Mus musculus
gatgttgcagctagtcaccagtgtt

SEQ ID NO: 35653 - DNA, 25 bp, Mus musculus
gatgttgcattgttggacctccata

SEQ ID NO: 35654 - DNA, 25 bp, Mus musculus
gatgttgcctacaatcctggtgttc

SEQ ID NO: 35655 - DNA, 25 bp, Mus musculus
gatgttgggacagtcatctgtccat

SEQ ID NO: 35656 - DNA, 25 bp, Mus musculus
gatgttgtcaaatacctccggagac

SEQ ID NO: 35657 - DNA, 25 bp, Mus musculus
gatgttgtcatcaacctggctggag

SEQ ID NO: 35658 - DNA, 25 bp, Mus musculus
gatgttgtgagcagtgtacctctcc

SEQ ID NO: 35659 - DNA, 25 bp, Mus musculus
gatgttgttaccctgtgtcgctgtg

SEQ ID NO: 35660 - DNA, 25 bp, Mus musculus
gatgtttatagtcagttcttggtgg

SEQ ID NO: 35661 - DNA, 25 bp, Mus musculus
gatgtttatcgtttgtctcccagta

SEQ ID NO: 35662 - DNA, 25 bp, Mus musculus
gatgtttatgattacctacgaccca

SEQ ID NO: 35663 - DNA, 25 bp, Mus musculus
gatgtttccaaaggcttcctcaacg

SEQ ID NO: 35664 - DNA, 25 bp, Mus musculus
gatgtttcgaaatatgcagaacgca

SEQ ID NO: 35665 - DNA, 25 bp, Mus musculus
gatgtttggagaaactgcctttgcg

SEQ ID NO: 35666 - DNA, 25 bp, Mus musculus
gatgtttggctcagttgcaatgagt

SEQ ID NO: 35667 - DNA, 25 bp, Mus musculus
gatgtttgggaactcatgtcccagg

SEQ ID NO: 35668 - DNA, 25 bp, Mus musculus
gatgttttattcaatagagttcgga

SEQ ID NO: 35669 - DNA, 25 bp, Mus musculus
gatgttttctttcggcaaaaatgga

SEQ ID NO: 35670 - DNA, 25 bp, Mus musculus
gattaaaacaagcttggcactcagt

SEQ ID NO: 35671 - DNA, 25 bp, Mus musculus
gattaaaatggtcgtcccttccatg

SEQ ID NO: 35672 - DNA, 25 bp, Mus musculus
gattaaaccagaagatgcaatggac

SEQ ID NO: 35673 - DNA, 25 bp, Mus musculus
gattaaagtcatccacttgctggtc

SEQ ID NO: 35674 - DNA, 25 bp, Mus musculus
gattaaagtcattaacaagcactcc

SEQ ID NO: 35675 - DNA, 25 bp, Mus musculus
gattaacctccatccatcctttgtg

SEQ ID NO: 35676 - DNA, 25 bp, Mus musculus
gattaacctgcatcagctgaacgat

SEQ ID NO: 35677 - DNA, 25 bp, Mus musculus
gattaactcaaaaccagagaatgcg

SEQ ID NO: 35678 - DNA, 25 bp, Mus musculus
gattaagttctctacctctgaggct

SEQ ID NO: 35679 - DNA, 25 bp, Mus musculus
gattaatcctgcctttgctgatgca

SEQ ID NO: 35680 - DNA, 25 bp, Mus musculus
gattacaacggcgagcggacactgg

SEQ ID NO: 35681 - DNA, 25 bp, Mus musculus
gattacaagatcaaccaccaccaac

SEQ ID NO: 35682 - DNA, 25 bp, Mus musculus
gattacagagccaaattgacccaga

SEQ ID NO: 35683 - DNA, 25 bp, Mus musculus
gattaccacacattacctcgagcta

SEQ ID NO: 35684 - DNA, 25 bp, Mus musculus
gattaccagggtacaggcaaaccac

SEQ ID NO: 35685 - DNA, 25 bp, Mus musculus
gattaccagggttcaggcaaaccac

SEQ ID NO: 35686 - DNA, 25 bp, Mus musculus
gattaccggcaggaaattcaaaaga

SEQ ID NO: 35687 - DNA, 25 bp, Mus musculus
gattacctacgacccatcgctctga

SEQ ID NO: 35688 - DNA, 25 bp, Mus musculus
gattacctacggctcaaaaaactct

SEQ ID NO: 35689 - DNA, 25 bp, Mus musculus
gattacctggggaaaactgttcaag

SEQ ID NO: 35690 - DNA, 25 bp, Mus musculus
gattactccggaccgaagcatgatt

SEQ ID NO: 35691 - DNA, 25 bp, Mus musculus
gattactcgggacagatcaccctgc

SEQ ID NO: 35692 - DNA, 25 bp, Mus musculus
gattacttcacctctgcgtgccctg

SEQ ID NO: 35693 - DNA, 25 bp, Mus musculus
gattagaacgactccgcaaagagag

SEQ ID NO: 35694 - DNA, 25 bp, Mus musculus
gattagacaatcagaaattaagaca

SEQ ID NO: 35695 - DNA, 25 bp, Mus musculus
gattagagacccaagagcagttgcc

SEQ ID NO: 35696 - DNA, 25 bp, Mus musculus
gattagatggatgcaatctgcccga

SEQ ID NO: 35697 - DNA, 25 bp, Mus musculus
gattagcacttcctccaaaacgctg

SEQ ID NO: 35698 - DNA, 25 bp, Mus musculus
gattagcagatatctccaggagggc

SEQ ID NO: 35699 - DNA, 25 bp, Mus musculus
gattagcatttatgatgcaaagaca

SEQ ID NO: 35700 - DNA, 25 bp, Mus musculus
gattagccagtggatcgccgttgag

SEQ ID NO: 35701 - DNA, 25 bp, Mus musculus
gattagctgtggcttacaaagagag

SEQ ID NO: 35702 - DNA, 25 bp, Mus musculus
gattaggaacccacgaaggcttgtc

SEQ ID NO: 35703 - DNA, 25 bp, Mus musculus
gattagtcaaccttaggaagttccg

SEQ ID NO: 35704 - DNA, 25 bp, Mus musculus
gattagttctgtgatccgtttctca

SEQ ID NO: 35705 - DNA, 25 bp, Mus musculus
gattagttgtagtgttccaagcacc

SEQ ID NO: 35706 - DNA, 25 bp, Mus musculus
gattataaccagtttgattcccaag

SEQ ID NO: 35707 - DNA, 25 bp, Mus musculus
gattataacccaacggcctccgtca

SEQ ID NO: 35708 - DNA, 25 bp, Mus musculus
gattataagagatcacggattagtc

SEQ ID NO: 35709 - DNA, 25 bp, Mus musculus
gattataggcactcatcaccctgcc

SEQ ID NO: 35710 - DNA, 25 bp, Mus musculus
gattataggttaacttcatagtcca

SEQ ID NO: 35711 - DNA, 25 bp, Mus musculus
gattataggttatcttcatagtcca

SEQ ID NO: 35712 - DNA, 25 bp, Mus musculus
gattatatctcagaagagggacact

SEQ ID NO: 35713 - DNA, 25 bp, Mus musculus
gattatattgatgcagaagacctga

SEQ ID NO: 35714 - DNA, 25 bp, Mus musculus
gattatatttctagagctgagtctc

SEQ ID NO: 35715 - DNA, 25 bp, Mus musculus
gattatcgagcataagattgtcata

SEQ ID NO: 35716 - DNA, 25 bp, Mus musculus
gattatctttgaatgcgctgctccc

SEQ ID NO: 35717 - DNA, 25 bp, Mus musculus
gattatgaatgcgagccagggatga

SEQ ID NO: 35718 - DNA, 25 bp, Mus musculus
gattatgacgacttttctccttcaa

SEQ ID NO: 35719 - DNA, 25 bp, Mus musculus
gattatgagaaaatggtggatcaca

SEQ ID NO: 35720 - DNA, 25 bp, Mus musculus
gattatgagaccaacaacaacagtg

SEQ ID NO: 35721 - DNA, 25 bp, Mus musculus
gattatgatagttcagatgacagtg

SEQ ID NO: 35722 - DNA, 25 bp, Mus musculus
gattatgcataaggaagctcaagat

SEQ ID NO: 35723 - DNA, 25 bp, Mus musculus
gattatgctggcaaggcagaacaga

SEQ ID NO: 35724 - DNA, 25 bp, Mus musculus
gattatggccagtgtcgactccgtg

SEQ ID NO: 35725 - DNA, 25 bp, Mus musculus
gattatgtcaatgactgctagcacc

SEQ ID NO: 35726 - DNA, 25 bp, Mus musculus
gattatgtcaatgggactgatcagg

SEQ ID NO: 35727 - DNA, 25 bp, Mus musculus
gattatgtccatggaggtgcagacg

SEQ ID NO: 35728 - DNA, 25 bp, Mus musculus
gattatgtcccttccatagtgatgc

SEQ ID NO: 35729 - DNA, 25 bp, Mus musculus
gattatgtgtctgcatactcttcac

SEQ ID NO: 35730 - DNA, 25 bp, Mus musculus
gattatgtttccatacggagccacc

SEQ ID NO: 35731 - DNA, 25 bp, Mus musculus
gattattaccctgatctttgtgtac

SEQ ID NO: 35732 - DNA, 25 bp, Mus musculus
gattattataccttcagccctggac

SEQ ID NO: 35733 - DNA, 25 bp, Mus musculus
gattattcctcctcgcaaaggtctg

SEQ ID NO: 35734 - DNA, 25 bp, Mus musculus
gattattgatctactccccaaggtg

SEQ ID NO: 35735 - DNA, 25 bp, Mus musculus
gattattggagctatgactacgtgg

SEQ ID NO: 35736 - DNA, 25 bp, Mus musculus
gattatttctacagaggcagacatt

SEQ ID NO: 35737 - DNA, 25 bp, Mus musculus
gattatttgccagggtttcacaggc

SEQ ID NO: 35738 - DNA, 25 bp, Mus musculus
gattcaaaagaccagaagtaatctg

SEQ ID NO: 35739 - DNA, 25 bp, Mus musculus
gattcaaccggtgacttaagaagcc

SEQ ID NO: 35740 - DNA, 25 bp, Mus musculus
gattcaaggcgtgtgttatcatgct

SEQ ID NO: 35741 - DNA, 25 bp, Mus musculus
gattcaagtgatgctgcccaggact

SEQ ID NO: 35742 - DNA, 25 bp, Mus musculus
gattcaatacctcattcctgggtac

SEQ ID NO: 35743 - DNA, 25 bp, Mus musculus
gattcacaaactcgaaatgctccag

SEQ ID NO: 35744 - DNA, 25 bp, Mus musculus
gattcacacagatgattcgagaagg

SEQ ID NO: 35745 - DNA, 25 bp, Mus musculus
gattcacatcaaggttggacagttt

SEQ ID NO: 35746 - DNA, 25 bp, Mus musculus
gattcactaatccaggtggcttgtt

SEQ ID NO: 35747 - DNA, 25 bp, Mus musculus
gattcactaatcgaggtggcttgtt

SEQ ID NO: 35748 - DNA, 25 bp, Mus musculus
gattcactgagtgagcaggtgtcct

SEQ ID NO: 35749 - DNA, 25 bp, Mus musculus
gattcagaaattgcagccctacgat

SEQ ID NO: 35750 - DNA, 25 bp, Mus musculus
gattcagaaggctcagaagacgacg

SEQ ID NO: 35751 - DNA, 25 bp, Mus musculus
gattcagatcgacacgtacagctac

SEQ ID NO: 35752 - DNA, 25 bp, Mus musculus
gattcagattgtctagaagtaagcg

SEQ ID NO: 35753 - DNA, 25 bp, Mus musculus
gattcagcatcacgcgctcccttga

SEQ ID NO: 35754 - DNA, 25 bp, Mus musculus
gattcaggccacagtcagaagcctg

SEQ ID NO: 35755 - DNA, 25 bp, Mus musculus
gattcaggccactgtcagaagcctg

SEQ ID NO: 35756 - DNA, 25 bp, Mus musculus
gattcagggaatatcccagaagcaa

SEQ ID NO: 35757 - DNA, 25 bp, Mus musculus
gattcagggacaagaagttgttgca

SEQ ID NO: 35758 - DNA, 25 bp, Mus musculus
gattcagtcccagatcttacttctt

SEQ ID NO: 35759 - DNA, 25 bp, Mus musculus
gattcagtccttctccagttgcaca

SEQ ID NO: 35760 - DNA, 25 bp, Mus musculus
gattcatcactcactctttggagat

SEQ ID NO: 35761 - DNA, 25 bp, Mus musculus
gattcatgatgtagaagggcggtac

SEQ ID NO: 35762 - DNA, 25 bp, Mus musculus
gattcatggtgcatggctaccgcag

SEQ ID NO: 35763 - DNA, 25 bp, Mus musculus
gattcatgtgtatgaaaagcatgct

SEQ ID NO: 35764 - DNA, 25 bp, Mus musculus
gattccaaaatgatgcaaatcaacc

SEQ ID NO: 35765 - DNA, 25 bp, Mus musculus
gattccaacaaacgatgagctgctg

SEQ ID NO: 35766 - DNA, 25 bp, Mus musculus
gattccacagagtcagatactgcca

SEQ ID NO: 35767 - DNA, 25 bp, Mus musculus
gattccacgttctatctgtacttca

SEQ ID NO: 35768 - DNA, 25 bp, Mus musculus
gattccagagagaaaatgggacctt

SEQ ID NO: 35769 - DNA, 25 bp, Mus musculus
gattccagagttaaggagtatgtgg

SEQ ID NO: 35770 - DNA, 25 bp, Mus musculus
gattccagatccgagtcaccagaac

SEQ ID NO: 35771 - DNA, 25 bp, Mus musculus
gattccagccgccacatgtacatat

SEQ ID NO: 35772 - DNA, 25 bp, Mus musculus
gattccagctgaacggatgctaaca

SEQ ID NO: 35773 - DNA, 25 bp, Mus musculus
gattccagcttcacttcttccttga

SEQ ID NO: 35774 - DNA, 25 bp, Mus musculus
gattccagggattcccacatcaaag

SEQ ID NO: 35775 - DNA, 25 bp, Mus musculus
gattccagtttatggcgtttccaaa

SEQ ID NO: 35776 - DNA, 25 bp, Mus musculus
gattccatggctttgcaccttgcac

SEQ ID NO: 35777 - DNA, 25 bp, Mus musculus
gattcccaaaagtgctccgatgtgt

SEQ ID NO: 35778 - DNA, 25 bp, Mus musculus
gattcccaaggcttgattgcatctt

SEQ ID NO: 35779 - DNA, 25 bp, Mus musculus
gattcccaaggtttactcaagcctg

SEQ ID NO: 35780 - DNA, 25 bp, Mus musculus
gattcccacatcaaagaaaagctgc

SEQ ID NO: 35781 - DNA, 25 bp, Mus musculus
gattccctagcacccattactctaa

SEQ ID NO: 35782 - DNA, 25 bp, Mus musculus
gattccctcttggaagataacccac

SEQ ID NO: 35783 - DNA, 25 bp, Mus musculus
gattccctggaaaatatcattagca

SEQ ID NO: 35784 - DNA, 25 bp, Mus musculus
gattccctgggatattgagaaatac

SEQ ID NO: 35785 - DNA, 25 bp, Mus musculus
gattcccttggttgtgtgcattacg

SEQ ID NO: 35786 - DNA, 25 bp, Mus musculus
gattccgatgaggatgattccacca

SEQ ID NO: 35787 - DNA, 25 bp, Mus musculus
gattccgccggctctttggagctaa

SEQ ID NO: 35788 - DNA, 25 bp, Mus musculus
gattccgtcaaattaaagttattct

SEQ ID NO: 35789 - DNA, 25 bp, Mus musculus
gattccgtccagacttcaagcgcaa

SEQ ID NO: 35790 - DNA, 25 bp, Mus musculus
gattccgtctaatgactgtgaaaac

SEQ ID NO: 35791 - DNA, 25 bp, Mus musculus
gattccgtgtatgctgcggagaaga

SEQ ID NO: 35792 - DNA, 25 bp, Mus musculus
gattcctaccgaagctgccatttat

SEQ ID NO: 35793 - DNA, 25 bp, Mus musculus
gattcctacctaaaccagtcctatg

SEQ ID NO: 35794 - DNA, 25 bp, Mus musculus
gattcctagctacattcgagactcc

SEQ ID NO: 35795 - DNA, 25 bp, Mus musculus
gattcctagggagaatcaaaccaca

SEQ ID NO: 35796 - DNA, 25 bp, Mus musculus
gattcctatagtgcaccgagtcctg

SEQ ID NO: 35797 - DNA, 25 bp, Mus musculus
gattcctcagtctgcctcagcctga

SEQ ID NO: 35798 - DNA, 25 bp, Mus musculus
gattcctctattgaagctctggctg

SEQ ID NO: 35799 - DNA, 25 bp, Mus musculus
gattcctgaactgcgagaagcatgt

SEQ ID NO: 35800 - DNA, 25 bp, Mus musculus
gattcctgctgttactctgggcacg

SEQ ID NO: 35801 - DNA, 25 bp, Mus musculus
gattcctgggatggatgaaggctta

SEQ ID NO: 35802 - DNA, 25 bp, Mus musculus
gattcctgggcagcctgtttttcct

SEQ ID NO: 35803 - DNA, 25 bp, Mus musculus
gattcctgtcacctgaggctatcgt

SEQ ID NO: 35804 - DNA, 25 bp, Mus musculus
gattcctgtcactgggttttactgc

SEQ ID NO: 35805 - DNA, 25 bp, Mus musculus
gattccttccacaaattcacattca

SEQ ID NO: 35806 - DNA, 25 bp, Mus musculus
gattccttggctgaaccgtgtttca

SEQ ID NO: 35807 - DNA, 25 bp, Mus musculus
gattcctttcacaagtttgtggctc

SEQ ID NO: 35808 - DNA, 25 bp, Mus musculus
gattccttttagcagagcaggcctc

SEQ ID NO: 35809 - DNA, 25 bp, Mus musculus
gattccttttcctgtgagtgtccag

SEQ ID NO: 35810 - DNA, 25 bp, Mus musculus
gattcgagaccgcagcgggatcttc

SEQ ID NO: 35811 - DNA, 25 bp, Mus musculus
gattcgagaccggagcgggatcttc

SEQ ID NO: 35812 - DNA, 25 bp, Mus musculus
gattcgagcagaaaatgagtaagcg

SEQ ID NO: 35813 - DNA, 25 bp, Mus musculus
gattcgcaggagaaactggtccacg

SEQ ID NO: 35814 - DNA, 25 bp, Mus musculus
gattcgccaatcagattctcagcta

SEQ ID NO: 35815 - DNA, 25 bp, Mus musculus
gattcgcttagcaaactacctggat

SEQ ID NO: 35816 - DNA, 25 bp, Mus musculus
gattcgggtaccttcctaggcctag

SEQ ID NO: 35817 - DNA, 25 bp, Mus musculus
gattctaaaatgaggaagaccatgg

SEQ ID NO: 35818 - DNA, 25 bp, Mus musculus
gattctaacggaagacactgaaaag

SEQ ID NO: 35819 - DNA, 25 bp, Mus musculus
gattctaagagtcccaacttgtcca

SEQ ID NO: 35820 - DNA, 25 bp, Mus musculus
gattctacaattgctgatgaaggaa

SEQ ID NO: 35821 - DNA, 25 bp, Mus musculus
gattctacacaaacaaatggaattg

SEQ ID NO: 35822 - DNA, 25 bp, Mus musculus
gattctacagctactacaagcaggc

SEQ ID NO: 35823 - DNA, 25 bp, Mus musculus
gattctacgtgcctcaaggaaccca

SEQ ID NO: 35824 - DNA, 25 bp, Mus musculus
gattctagcccgaattctggcctgg

SEQ ID NO: 35825 - DNA, 25 bp, Mus musculus
gattctcagatgacccctttaaaag

SEQ ID NO: 35826 - DNA, 25 bp, Mus musculus
gattctcagctatggagccgaactg

SEQ ID NO: 35827 - DNA, 25 bp, Mus musculus
gattctcatcatccaggcctgcaga

SEQ ID NO: 35828 - DNA, 25 bp, Mus musculus
gattctcatcatgcaggcctgcaga

SEQ ID NO: 35829 - DNA, 25 bp, Mus musculus
gattctcattgtcgactgggatgtc

SEQ ID NO: 35830 - DNA, 25 bp, Mus musculus
gattctccagaacttcaagcacaac

SEQ ID NO: 35831 - DNA, 25 bp, Mus musculus
gattctccagatcacaaacgattat

SEQ ID NO: 35832 - DNA, 25 bp, Mus musculus
gattctccagtaccttgattcagag

SEQ ID NO: 35833 - DNA, 25 bp, Mus musculus
gattctcctcaaggcaagaccctgt

SEQ ID NO: 35834 - DNA, 25 bp, Mus musculus
gattctcgccacaaggagcttccct

SEQ ID NO: 35835 - DNA, 25 bp, Mus musculus
gattctcttaacacaagactcttga

SEQ ID NO: 35836 - DNA, 25 bp, Mus musculus
gattctgaccactccatcaagtgac

SEQ ID NO: 35837 - DNA, 25 bp, Mus musculus
gattctgaggctgatttgcctcgga

SEQ ID NO: 35838 - DNA, 25 bp, Mus musculus
gattctgagtttggcccaggaacag

SEQ ID NO: 35839 - DNA, 25 bp, Mus musculus
gattctggacgagctccaaaggaga

SEQ ID NO: 35840 - DNA, 25 bp, Mus musculus
gattctggagatgccatccaagacg

SEQ ID NO: 35841 - DNA, 25 bp, Mus musculus
gattctgggattatggccgcatagc

SEQ ID NO: 35842 - DNA, 25 bp, Mus musculus
gattctgggcacatgtctgtccgca

SEQ ID NO: 35843 - DNA, 25 bp, Mus musculus
gattctggtcactggatcctctgga

SEQ ID NO: 35844 - DNA, 25 bp, Mus musculus
gattctgtactgttctacgccatca

SEQ ID NO: 35845 - DNA, 25 bp, Mus musculus
gattctgtcgtgcttcgggctctaa

SEQ ID NO: 35846 - DNA, 25 bp, Mus musculus
gattctgtctcctttggctacctac

SEQ ID NO: 35847 - DNA, 25 bp, Mus musculus
gattctgttaccatgaaaggttgtc

SEQ ID NO: 35848 - DNA, 25 bp, Mus musculus
gattctgttctgtcaaaagctgaga

SEQ ID NO: 35849 - DNA, 25 bp, Mus musculus
gattcttaccaagggtcccaagtcg

SEQ ID NO: 35850 - DNA, 25 bp, Mus musculus
gattcttcatattagctctgaggac

SEQ ID NO: 35851 - DNA, 25 bp, Mus musculus
gattcttcggacagagatgtttgga

SEQ ID NO: 35852 - DNA, 25 bp, Mus musculus
gattcttcgtggtgtgatctcagca

SEQ ID NO: 35853 - DNA, 25 bp, Mus musculus
gattcttgcagacaagaacagcttc

SEQ ID NO: 35854 - DNA, 25 bp, Mus musculus
gattcttggacattaatctctataa

SEQ ID NO: 35855 - DNA, 25 bp, Mus musculus
gattcttggcagtcagcagtctgcg

SEQ ID NO: 35856 - DNA, 25 bp, Mus musculus
gattctttctcaagtttccttctgg

SEQ ID NO: 35857 - DNA, 25 bp, Mus musculus
gattctttggtggactatcaacccc

SEQ ID NO: 35858 - DNA, 25 bp, Mus musculus
gattctttttgttgacaagccaggg

SEQ ID NO: 35859 - DNA, 25 bp, Mus musculus
gattgaaaccgacatgcagtggcct

SEQ ID NO: 35860 - DNA, 25 bp, Mus musculus
gattgaacaaatagaagtgggcccc

SEQ ID NO: 35861 - DNA, 25 bp, Mus musculus
gattgaacatgcacagaaagagctt

SEQ ID NO: 35862 - DNA, 25 bp, Mus musculus
gattgaaccagctgccctttgaccc

SEQ ID NO: 35863 - DNA, 25 bp, Mus musculus
gattgaacgcctgtacagagagatc

SEQ ID NO: 35864 - DNA, 25 bp, Mus musculus
gattgaagaagacctttccatggga

SEQ ID NO: 35865 - DNA, 25 bp, Mus musculus
gattgaattgcgcattcttgcacat

SEQ ID NO: 35866 - DNA, 25 bp, Mus musculus
gattgacaatgccaggctcacggct

SEQ ID NO: 35867 - DNA, 25 bp, Mus musculus
gattgacaccgtgaaaaaagcaaca

SEQ ID NO: 35868 - DNA, 25 bp, Mus musculus
gattgacatcctccctgaccgctta

SEQ ID NO: 35869 - DNA, 25 bp, Mus musculus
gattgacatcctgcctgaccgctta

SEQ ID NO: 35870 - DNA, 25 bp, Mus musculus
gattgacattttgaaaaggcagaag

SEQ ID NO: 35871 - DNA, 25 bp, Mus musculus
gattgacgtgcccaacaaatttggc

SEQ ID NO: 35872 - DNA, 25 bp, Mus musculus
gattgacgtttctccttaggtgagg

SEQ ID NO: 35873 - DNA, 25 bp, Mus musculus
gattgactacttaacagacactttg

SEQ ID NO: 35874 - DNA, 25 bp, Mus musculus
gattgactggaaggcctacatggcc

SEQ ID NO: 35875 - DNA, 25 bp, Mus musculus
gattgactgtctcgtaatctactta

SEQ ID NO: 35876 - DNA, 25 bp, Mus musculus
gattgagaacatcctggatagtgac

SEQ ID NO: 35877 - DNA, 25 bp, Mus musculus
gattgagaccttcctatagccaagg

SEQ ID NO: 35878 - DNA, 25 bp, Mus musculus
gattgagagagtcaaacgcaaccaa

SEQ ID NO: 35879 - DNA, 25 bp, Mus musculus
gattgagatcaagattgtgcgaccc

SEQ ID NO: 35880 - DNA, 25 bp, Mus musculus
gattgagccttctgcatccttggtc

SEQ ID NO: 35881 - DNA, 25 bp, Mus musculus
gattgagcgatttgacgtggagacc

SEQ ID NO: 35882 - DNA, 25 bp, Mus musculus
gattgagctggagaagcatatctcc

SEQ ID NO: 35883 - DNA, 25 bp, Mus musculus
gattgaggactggtacaggaaccac

SEQ ID NO: 35884 - DNA, 25 bp, Mus musculus
gattgagtcctgcatgttatgacac

SEQ ID NO: 35885 - DNA, 25 bp, Mus musculus
gattgagtcctggatgttatgacac

SEQ ID NO: 35886 - DNA, 25 bp, Mus musculus
gattgagttcaaggagacccaagca

SEQ ID NO: 35887 - DNA, 25 bp, Mus musculus
gattgatacagaactgaactcaagg

SEQ ID NO: 35888 - DNA, 25 bp, Mus musculus
gattgatctccacagattggatggt

SEQ ID NO: 35889 - DNA, 25 bp, Mus musculus
gattgatctttccagagtgccagga

SEQ ID NO: 35890 - DNA, 25 bp, Mus musculus
gattgatgagaataacgatgtcagc

SEQ ID NO: 35891 - DNA, 25 bp, Mus musculus
gattgatgaggacagaacatttcca

SEQ ID NO: 35892 - DNA, 25 bp, Mus musculus
gattgatgcacatcgaatccgagga

SEQ ID NO: 35893 - DNA, 25 bp, Mus musculus
gattgatggagttccgggccagtct

SEQ ID NO: 35894 - DNA, 25 bp, Mus musculus
gattgcaaaaataaagtcctccgag

SEQ ID NO: 35895 - DNA, 25 bp, Mus musculus
gattgcaaactatgaggcctgtctc

SEQ ID NO: 35896 - DNA, 25 bp, Mus musculus
gattgcaattatgggacacagcagg

SEQ ID NO: 35897 - DNA, 25 bp, Mus musculus
gattgcacccctgtgtagaagccat

SEQ ID NO: 35898 - DNA, 25 bp, Mus musculus
gattgcacgtgaagcgattgatgaa

SEQ ID NO: 35899 - DNA, 25 bp, Mus musculus
gattgcactgaagacaatccgtcag

SEQ ID NO: 35900 - DNA, 25 bp, Mus musculus
gattgcagagaaggtctgctgtgcc

SEQ ID NO: 35901 - DNA, 25 bp, Mus musculus
gattgcagattcaaacaaatacata

SEQ ID NO: 35902 - DNA, 25 bp, Mus musculus
gattgcaggagccattggtccatgc

SEQ ID NO: 35903 - DNA, 25 bp, Mus musculus
gattgcaggaggcttggtggatgct

SEQ ID NO: 35904 - DNA, 25 bp, Mus musculus
gattgccatccgtgtatataacact

SEQ ID NO: 35905 - DNA, 25 bp, Mus musculus
gattgccctgtaactgccatgcaga

SEQ ID NO: 35906 - DNA, 25 bp, Mus musculus
gattgcccttccaagcattaaggca

SEQ ID NO: 35907 - DNA, 25 bp, Mus musculus
gattgcgaaagaagggcagttaact

SEQ ID NO: 35908 - DNA, 25 bp, Mus musculus
gattgcgactcactgctcgaaccct

SEQ ID NO: 35909 - DNA, 25 bp, Mus musculus
gattgcggacgttctgagcgtgact

SEQ ID NO: 35910 - DNA, 25 bp, Mus musculus
gattgcgtcaccttgtctcctgtac

SEQ ID NO: 35911 - DNA, 25 bp, Mus musculus
gattgcgtccgtccatcttgcggca

SEQ ID NO: 35912 - DNA, 25 bp, Mus musculus
gattgcgttgtaggaagatttggaa

SEQ ID NO: 35913 - DNA, 25 bp, Mus musculus
gattgctaaggtaatgctggttttt

SEQ ID NO: 35914 - DNA, 25 bp, Mus musculus
gattgctatatgaaaaactgctgtc

SEQ ID NO: 35915 - DNA, 25 bp, Mus musculus
gattgctatatgtaaaactgctgtc

SEQ ID NO: 35916 - DNA, 25 bp, Mus musculus
gattgctcatctctctgatacaaag

SEQ ID NO: 35917 - DNA, 25 bp, Mus musculus
gattgctcttctccggaccacaaga

SEQ ID NO: 35918 - DNA, 25 bp, Mus musculus
gattgctgcaaagcacaagaggact

SEQ ID NO: 35919 - DNA, 25 bp, Mus musculus
gattgctgcaattgctcaggagctc

SEQ ID NO: 35920 - DNA, 25 bp, Mus musculus
gattgctgccgatttatagcttgaa

SEQ ID NO: 35921 - DNA, 25 bp, Mus musculus
gattgctgccttcaaagaacaccag

SEQ ID NO: 35922 - DNA, 25 bp, Mus musculus
gattgcttacgccttcgaggtgaca

SEQ ID NO: 35923 - DNA, 25 bp, Mus musculus
gattgcttcacctgcattgtctgtg

SEQ ID NO: 35924 - DNA, 25 bp, Mus musculus
gattgcttgtgttgaatcccgaacc

SEQ ID NO: 35925 - DNA, 25 bp, Mus musculus
gattggaaacgaatggctgcccagc

SEQ ID NO: 35926 - DNA, 25 bp, Mus musculus
gattggaatctgattgggaccatcc

SEQ ID NO: 35927 - DNA, 25 bp, Mus musculus
gattggacacgctatggtaaacaaa

SEQ ID NO: 35928 - DNA, 25 bp, Mus musculus
gattggacagactatgatgagcgga

SEQ ID NO: 35929 - DNA, 25 bp, Mus musculus
gattggaccaatgaaaacgaccgtc

SEQ ID NO: 35930 - DNA, 25 bp, Mus musculus
gattggaccggtgggtttccctcag

SEQ ID NO: 35931 - DNA, 25 bp, Mus musculus
gattggacgagccatgaagtgccaa

SEQ ID NO: 35932 - DNA, 25 bp, Mus musculus
gattggagaaagctatagacttcag

SEQ ID NO: 35933 - DNA, 25 bp, Mus musculus
gattggagaatgatctctttggacc

SEQ ID NO: 35934 - DNA, 25 bp, Mus musculus
gattggaggaccacctttttggcaa

SEQ ID NO: 35935 - DNA, 25 bp, Mus musculus
gattggaggcctgtcagaacagatt

SEQ ID NO: 35936 - DNA, 25 bp, Mus musculus
gattggagtcaagtctgagttccgg

SEQ ID NO: 35937 - DNA, 25 bp, Mus musculus
gattggattacccacctcttacggc

SEQ ID NO: 35938 - DNA, 25 bp, Mus musculus
gattggcaaaatataggacactacg

SEQ ID NO: 35939 - DNA, 25 bp, Mus musculus
gattggcacacagctttgaaagcca

SEQ ID NO: 35940 - DNA, 25 bp, Mus musculus
gattggcacttcagagaggatgctg

SEQ ID NO: 35941 - DNA, 25 bp, Mus musculus
gattggcacttctgagaggatgctg

SEQ ID NO: 35942 - DNA, 25 bp, Mus musculus
gattggcatcgctttaacttaaaac

SEQ ID NO: 35943 - DNA, 25 bp, Mus musculus
gattggccagcctctggctctagct

SEQ ID NO: 35944 - DNA, 25 bp, Mus musculus
gattggccgtttgatgatggagctc

SEQ ID NO: 35945 - DNA, 25 bp, Mus musculus
gattggctatggctcagcagcccag

SEQ ID NO: 35946 - DNA, 25 bp, Mus musculus
gattggctctactgagaacctgaag

SEQ ID NO: 35947 - DNA, 25 bp, Mus musculus
gattggctctcctaattttgggtac

SEQ ID NO: 35948 - DNA, 25 bp, Mus musculus
gattggctggatctacttcatggcg

SEQ ID NO: 35949 - DNA, 25 bp, Mus musculus
gattgggaaacataagaacattatc

SEQ ID NO: 35950 - DNA, 25 bp, Mus musculus
gattgggatgaggagtatccaccac

SEQ ID NO: 35951 - DNA, 25 bp, Mus musculus
gattgggatgctggcggccataacc

SEQ ID NO: 35952 - DNA, 25 bp, Mus musculus
gattgggcatcctgctagatttggg

SEQ ID NO: 35953 - DNA, 25 bp, Mus musculus
gattggtccactgggaaatctgtca

SEQ ID NO: 35954 - DNA, 25 bp, Mus musculus
gattggtgcaaaactcagcccctga

SEQ ID NO: 35955 - DNA, 25 bp, Mus musculus
gattggtgcaaatctcagcccctga

SEQ ID NO: 35956 - DNA, 25 bp, Mus musculus
gattggtgtttggagctgctccagc

SEQ ID NO: 35957 - DNA, 25 bp, Mus musculus
gattggttcatcttgcttagcttca

SEQ ID NO: 35958 - DNA, 25 bp, Mus musculus
gattggtttccgtgtgatcctcctg

SEQ ID NO: 35959 - DNA, 25 bp, Mus musculus
gattgtaatccgtgggcatgtccct

SEQ ID NO: 35960 - DNA, 25 bp, Mus musculus
gattgtactcgcacgggctactcag

SEQ ID NO: 35961 - DNA, 25 bp, Mus musculus
gattgtactcgctcgggctactcag

SEQ ID NO: 35962 - DNA, 25 bp, Mus musculus
gattgtagccttgatggaaactcac

SEQ ID NO: 35963 - DNA, 25 bp, Mus musculus
gattgtcactcagaagatcacgacg

SEQ ID NO: 35964 - DNA, 25 bp, Mus musculus
gattgtcagactccttttctctgta

SEQ ID NO: 35965 - DNA, 25 bp, Mus musculus
gattgtcatggctctatacgcagca

SEQ ID NO: 35966 - DNA, 25 bp, Mus musculus
gattgtccaagaattcctcacagca

SEQ ID NO: 35967 - DNA, 25 bp, Mus musculus
gattgtcccagcatttgaaacgctg

SEQ ID NO: 35968 - DNA, 25 bp, Mus musculus
gattgtcccagcttttgaaacgctg

SEQ ID NO: 35969 - DNA, 25 bp, Mus musculus
gattgtcctatttgtgaccagggag

SEQ ID NO: 35970 - DNA, 25 bp, Mus musculus
gattgtgaacgatgaccagtccttt

SEQ ID NO: 35971 - DNA, 25 bp, Mus musculus
gattgtgacaatggagaagatgaag

SEQ ID NO: 35972 - DNA, 25 bp, Mus musculus
gattgtgagtcaccgtgtagatgca

SEQ ID NO: 35973 - DNA, 25 bp, Mus musculus
gattgtgcctggtctgtatgcctgt

SEQ ID NO: 35974 - DNA, 25 bp, Mus musculus
gattgtggattaccacggctgtgac

SEQ ID NO: 35975 - DNA, 25 bp, Mus musculus
gattgtggccctccctgatgaccta

SEQ ID NO: 35976 - DNA, 25 bp, Mus musculus
gattgtggcctgaggacaggaatac

SEQ ID NO: 35977 - DNA, 25 bp, Mus musculus
gattgtggtgctatccataactgga

SEQ ID NO: 35978 - DNA, 25 bp, Mus musculus
gattgtggttgctggagctctgctc

SEQ ID NO: 35979 - DNA, 25 bp, Mus musculus
gattgtggttgtaagccttgcatat

SEQ ID NO: 35980 - DNA, 25 bp, Mus musculus
gattgtgttatcgaggttcatgacg

SEQ ID NO: 35981 - DNA, 25 bp, Mus musculus
gattgttataacacagctcttcgtc

SEQ ID NO: 35982 - DNA, 25 bp, Mus musculus
gattgttcccgagcactgttattcc

SEQ ID NO: 35983 - DNA, 25 bp, Mus musculus
gattgttcgagttgtctttttccct

SEQ ID NO: 35984 - DNA, 25 bp, Mus musculus
gattgttgaccctgcatttgttgcc

SEQ ID NO: 35985 - DNA, 25 bp, Mus musculus
gattgttggttcacagggaagtcgc

SEQ ID NO: 35986 - DNA, 25 bp, Mus musculus
gatttaaagatctgaaaaactttca

SEQ ID NO: 35987 - DNA, 25 bp, Mus musculus
gatttaactgtctcacagtctctaa

SEQ ID NO: 35988 - DNA, 25 bp, Mus musculus
gatttaatttaaagcaagactgaga

SEQ ID NO: 35989 - DNA, 25 bp, Mus musculus
gatttacctacaacattccagggtg

SEQ ID NO: 35990 - DNA, 25 bp, Mus musculus
gatttacctgagttccaagtaccag

SEQ ID NO: 35991 - DNA, 25 bp, Mus musculus
gatttacttatgcaggatgctccag

SEQ ID NO: 35992 - DNA, 25 bp, Mus musculus
gatttacttatggaggatgctccag

SEQ ID NO: 35993 - DNA, 25 bp, Mus musculus
gatttagcagcagcagatgttaaga

SEQ ID NO: 35994 - DNA, 25 bp, Mus musculus
gatttagggcgcattcctcatccca

SEQ ID NO: 35995 - DNA, 25 bp, Mus musculus
gatttatcccacagccactggagaa

SEQ ID NO: 35996 - DNA, 25 bp, Mus musculus
gatttatccctgactccacttgagc

SEQ ID NO: 35997 - DNA, 25 bp, Mus musculus
gatttatccctgtctccacttgagc

SEQ ID NO: 35998 - DNA, 25 bp, Mus musculus
gatttatccgaagcagagactccaa

SEQ ID NO: 35999 - DNA, 25 bp, Mus musculus
gatttatgactgtgaaggactcggc

SEQ ID NO: 36000 - DNA, 25 bp, Mus musculus
gatttattaacagctgtcctctagg

SEQ ID NO: 36001 - DNA, 25 bp, Mus musculus
gatttcaaccttaaagtcgtcctgg

SEQ ID NO: 36002 - DNA, 25 bp, Mus musculus
gatttcaatggacatccgacccact

SEQ ID NO: 36003 - DNA, 25 bp, Mus musculus
gatttcacaaatcttcgaaggactc

SEQ ID NO: 36004 - DNA, 25 bp, Mus musculus
gatttcactagcagaccttcaggag

SEQ ID NO: 36005 - DNA, 25 bp, Mus musculus
gatttcagacgatgctggagccacc

SEQ ID NO: 36006 - DNA, 25 bp, Mus musculus
gatttcagcaggcaccattctccga

SEQ ID NO: 36007 - DNA, 25 bp, Mus musculus
gatttcaggcaggtgtcaccatacc

SEQ ID NO: 36008 - DNA, 25 bp, Mus musculus
gatttcaggtttaaagatcgcttca

SEQ ID NO: 36009 - DNA, 25 bp, Mus musculus
gatttcagtgaattatgccttttcg

SEQ ID NO: 36010 - DNA, 25 bp, Mus musculus
gatttcattgcactggatctcggcg

SEQ ID NO: 36011 - DNA, 25 bp, Mus musculus
gatttcattgtctacctctctggaa

SEQ ID NO: 36012 - DNA, 25 bp, Mus musculus
gatttccagagtagagattcagcac

SEQ ID NO: 36013 - DNA, 25 bp, Mus musculus
gatttccagggaaaggtgtcttaag

SEQ ID NO: 36014 - DNA, 25 bp, Mus musculus
gatttccccacgcaagaccaacttg

SEQ ID NO: 36015 - DNA, 25 bp, Mus musculus
gatttcctctcgtctcctaggcgtg

SEQ ID NO: 36016 - DNA, 25 bp, Mus musculus
gatttcctctgcatgcctgtcttcc

SEQ ID NO: 36017 - DNA, 25 bp, Mus musculus
gatttcctgaagatgtttacagcgc

SEQ ID NO: 36018 - DNA, 25 bp, Mus musculus
gatttcctgaagtaagtactctgag

SEQ ID NO: 36019 - DNA, 25 bp, Mus musculus
gatttcctgaagttgtttacagcgc

SEQ ID NO: 36020 - DNA, 25 bp, Mus musculus
gatttcgaaagatgacagaggctga

SEQ ID NO: 36021 - DNA, 25 bp, Mus musculus
gatttcggcctttgcaaggaatgtg

SEQ ID NO: 36022 - DNA, 25 bp, Mus musculus
gatttcgtacttgctcacagacaag

SEQ ID NO: 36023 - DNA, 25 bp, Mus musculus
gatttcgtggacatgtcaccacaca

SEQ ID NO: 36024 - DNA, 25 bp, Mus musculus
gatttctaccagagggctaccctat

SEQ ID NO: 36025 - DNA, 25 bp, Mus musculus
gatttctacgtggaaatgaaatggg

SEQ ID NO: 36026 - DNA, 25 bp, Mus musculus
gatttctatgttcatcacacccatg

SEQ ID NO: 36027 - DNA, 25 bp, Mus musculus
gatttctcagacttctcccttgcca

SEQ ID NO: 36028 - DNA, 25 bp, Mus musculus
gatttctcatcagccgaaagtccag

SEQ ID NO: 36029 - DNA, 25 bp, Mus musculus
gatttctccgaattcattaagtgca

SEQ ID NO: 36030 - DNA, 25 bp, Mus musculus
gatttctcctgcatgtcacagtgtc

SEQ ID NO: 36031 - DNA, 25 bp, Mus musculus
gatttctcgaataagtgggactcaa

SEQ ID NO: 36032 - DNA, 25 bp, Mus musculus
gatttctctgatcatgggcccgtgt

SEQ ID NO: 36033 - DNA, 25 bp, Mus musculus
gatttctctgggactggtgtttgag

SEQ ID NO: 36034 - DNA, 25 bp, Mus musculus
gatttctgaccaaacggttcatctg

SEQ ID NO: 36035 - DNA, 25 bp, Mus musculus
gatttctgcccttcggatgtctgtc

SEQ ID NO: 36036 - DNA, 25 bp, Mus musculus
gatttctggcagagtgatattttca

SEQ ID NO: 36037 - DNA, 25 bp, Mus musculus
gatttcttggatctccggcttggag

SEQ ID NO: 36038 - DNA, 25 bp, Mus musculus
gatttctttgaaccagcttgtccag

SEQ ID NO: 36039 - DNA, 25 bp, Mus musculus
gatttgaaaccactctatgctaacc

SEQ ID NO: 36040 - DNA, 25 bp, Mus musculus
gatttgaaaggaccactaacttctg

SEQ ID NO: 36041 - DNA, 25 bp, Mus musculus
gatttgaacagcctgtggccgtctt

SEQ ID NO: 36042 - DNA, 25 bp, Mus musculus
gatttgaagatgtagtaaaccagtc

SEQ ID NO: 36043 - DNA, 25 bp, Mus musculus
gatttgaaggcactacaaagtgttg

SEQ ID NO: 36044 - DNA, 25 bp, Mus musculus
gatttgaatctgaaattgagaggca

SEQ ID NO: 36045 - DNA, 25 bp, Mus musculus
gatttgaatctgtaattgagaggca

SEQ ID NO: 36046 - DNA, 25 bp, Mus musculus
gatttgagatcaattcttggagaac

SEQ ID NO: 36047 - DNA, 25 bp, Mus musculus
gatttgataatgcagataggatgtt

SEQ ID NO: 36048 - DNA, 25 bp, Mus musculus
gatttgatgaaaggaacctcagagg

SEQ ID NO: 36049 - DNA, 25 bp, Mus musculus
gatttgatggagaaggccaagacct

SEQ ID NO: 36050 - DNA, 25 bp, Mus musculus
gatttgatggagagcctggacctca

SEQ ID NO: 36051 - DNA, 25 bp, Mus musculus
gatttgattcaaatgttagtccaga

SEQ ID NO: 36052 - DNA, 25 bp, Mus musculus
gatttgattcacctcaggagcacgg

SEQ ID NO: 36053 - DNA, 25 bp, Mus musculus
gatttgcaaggattgtgggacccgt

SEQ ID NO: 36054 - DNA, 25 bp, Mus musculus
gatttgcaggagttagcagaccacg

SEQ ID NO: 36055 - DNA, 25 bp, Mus musculus
gatttgccagtccactcacagggat

SEQ ID NO: 36056 - DNA, 25 bp, Mus musculus
gatttgccatccaggacatctctgt

SEQ ID NO: 36057 - DNA, 25 bp, Mus musculus
gatttgccctgcagaacatcaacag

SEQ ID NO: 36058 - DNA, 25 bp, Mus musculus
gatttgccgatggaagtataagaac

SEQ ID NO: 36059 - DNA, 25 bp, Mus musculus
gatttgcctcggatggaacaccaac

SEQ ID NO: 36060 - DNA, 25 bp, Mus musculus
gatttgcggagttttatcagcttgt

SEQ ID NO: 36061 - DNA, 25 bp, Mus musculus
gatttgctaagcagtgtaagccgag

SEQ ID NO: 36062 - DNA, 25 bp, Mus musculus
gatttgctacgaagaaaacgtcaag

SEQ ID NO: 36063 - DNA, 25 bp, Mus musculus
gatttggaagcttatttcagaagtc

SEQ ID NO: 36064 - DNA, 25 bp, Mus musculus
gatttggaatgaacaggaatcaggc

SEQ ID NO: 36065 - DNA, 25 bp, Mus musculus
gatttggacaatagccaccagtctt

SEQ ID NO: 36066 - DNA, 25 bp, Mus musculus
gatttggaccttggaaactatgaaa

SEQ ID NO: 36067 - DNA, 25 bp, Mus musculus
gatttggccaacaccttccgtgggt

SEQ ID NO: 36068 - DNA, 25 bp, Mus musculus
gatttggcctctttgggatctacaa

SEQ ID NO: 36069 - DNA, 25 bp, Mus musculus
gatttggctacggaggcagagcttc

SEQ ID NO: 36070 - DNA, 25 bp, Mus musculus
gatttggctgccagaaacgtgttgg

SEQ ID NO: 36071 - DNA, 25 bp, Mus musculus
gatttgggcccgagagatcttggac

SEQ ID NO: 36072 - DNA, 25 bp, Mus musculus
gatttgggccctgaagttggtgata

SEQ ID NO: 36073 - DNA, 25 bp, Mus musculus
gatttgggtttagaagataaccagc

SEQ ID NO: 36074 - DNA, 25 bp, Mus musculus
gatttggtgtctccgtctgaccgtc

SEQ ID NO: 36075 - DNA, 25 bp, Mus musculus
gatttgtactgtgttcgcagtgacc

SEQ ID NO: 36076 - DNA, 25 bp, Mus musculus
gatttgtcggccacaccaaggatgt

SEQ ID NO: 36077 - DNA, 25 bp, Mus musculus
gatttgtgacagctttgcggtttgt

SEQ ID NO: 36078 - DNA, 25 bp, Mus musculus
gatttgttcatgagcgtgcagtcac

SEQ ID NO: 36079 - DNA, 25 bp, Mus musculus
gatttgttctcaccatatgtaccct

SEQ ID NO: 36080 - DNA, 25 bp, Mus musculus
gatttgttctgctcctggattcttc

SEQ ID NO: 36081 - DNA, 25 bp, Mus musculus
gattttaaagttggagatgcttcag

SEQ ID NO: 36082 - DNA, 25 bp, Mus musculus
gattttaaatattctactgagtacg

SEQ ID NO: 36083 - DNA, 25 bp, Mus musculus
gattttaatccaagtgcctgagaag

SEQ ID NO: 36084 - DNA, 25 bp, Mus musculus
gattttatcagcagctcctcccaag

SEQ ID NO: 36085 - DNA, 25 bp, Mus musculus
gattttatcagtcagttgttcatgc

SEQ ID NO: 36086 - DNA, 25 bp, Mus musculus
gattttcaagctattgcagatgtaa

SEQ ID NO: 36087 - DNA, 25 bp, Mus musculus
gattttccaagtcaagaccgactga

SEQ ID NO: 36088 - DNA, 25 bp, Mus musculus
gattttccacatcgacaccaatgcc

SEQ ID NO: 36089 - DNA, 25 bp, Mus musculus
gattttccgagaacagtcttctcac

SEQ ID NO: 36090 - DNA, 25 bp, Mus musculus
gattttccgagatcagtcttctcac

SEQ ID NO: 36091 - DNA, 25 bp, Mus musculus
gattttcctggttagaagaccaaga

SEQ ID NO: 36092 - DNA, 25 bp, Mus musculus
gattttcgagaaccgaatgcacaag

SEQ ID NO: 36093 - DNA, 25 bp, Mus musculus
gattttcgggatagagaaggaccac

SEQ ID NO: 36094 - DNA, 25 bp, Mus musculus
gattttctgactgatagattccagc

SEQ ID NO: 36095 - DNA, 25 bp, Mus musculus
gattttctgtcgttgcatccttcag

SEQ ID NO: 36096 - DNA, 25 bp, Mus musculus
gattttcttgagttatggtggctga

SEQ ID NO: 36097 - DNA, 25 bp, Mus musculus
gattttctttggtcttgctcctggc

SEQ ID NO: 36098 - DNA, 25 bp, Mus musculus
gattttgaaagcacgggcgctgaca

SEQ ID NO: 36099 - DNA, 25 bp, Mus musculus
gattttgaggaggtttcaggatcag

SEQ ID NO: 36100 - DNA, 25 bp, Mus musculus
gattttgaggcagctgagagacact

SEQ ID NO: 36101 - DNA, 25 bp, Mus musculus
gattttgagtggaacaatttcatag

SEQ ID NO: 36102 - DNA, 25 bp, Mus musculus
gattttgagtggtacaatttcatag

SEQ ID NO: 36103 - DNA, 25 bp, Mus musculus
gattttgatgaggactttagcccga

SEQ ID NO: 36104 - DNA, 25 bp, Mus musculus
gattttgatgagtacaccatgacca

SEQ ID NO: 36105 - DNA, 25 bp, Mus musculus
gattttgatgcatgcagggcaagca

SEQ ID NO: 36106 - DNA, 25 bp, Mus musculus
gattttgattggagtcctggtgtca

SEQ ID NO: 36107 - DNA, 25 bp, Mus musculus
gattttgcaacggaagtacgttctg

SEQ ID NO: 36108 - DNA, 25 bp, Mus musculus
gattttgcaggccaacaatagaagg

SEQ ID NO: 36109 - DNA, 25 bp, Mus musculus
gattttgcatggctggaagacagaa

SEQ ID NO: 36110 - DNA, 25 bp, Mus musculus
gattttgcatgggtggaagacagaa

SEQ ID NO: 36111 - DNA, 25 bp, Mus musculus
gattttgctcagctcaatttaaaga

SEQ ID NO: 36112 - DNA, 25 bp, Mus musculus
gattttgctcaggtcaatttaaaga

SEQ ID NO: 36113 - DNA, 25 bp, Mus musculus
gattttgctctggtgaaagcatgga

SEQ ID NO: 36114 - DNA, 25 bp, Mus musculus
gattttgctttccagtacattaagg

SEQ ID NO: 36115 - DNA, 25 bp, Mus musculus
gattttggaaattctgaagtcctga

SEQ ID NO: 36116 - DNA, 25 bp, Mus musculus
gattttggaccactcaatctggcca

SEQ ID NO: 36117 - DNA, 25 bp, Mus musculus
gattttggatgctgatctggactcc

SEQ ID NO: 36118 - DNA, 25 bp, Mus musculus
gattttggcttgtctgtgcagaagc

SEQ ID NO: 36119 - DNA, 25 bp, Mus musculus
gattttggtcctgatgtagtacaga

SEQ ID NO: 36120 - DNA, 25 bp, Mus musculus
gattttgtaagaaagtttatcctgg

SEQ ID NO: 36121 - DNA, 25 bp, Mus musculus
gattttgttgaggaccaggaagtgt

SEQ ID NO: 36122 - DNA, 25 bp, Mus musculus
gatttttaagaaatcggcaacacgg

SEQ ID NO: 36123 - DNA, 25 bp, Mus musculus
gatttttactaagtaccaatgtcct

SEQ ID NO: 36124 - DNA, 25 bp, Mus musculus
gatttttataagatgtcacagcccc

SEQ ID NO: 36125 - DNA, 25 bp, Mus musculus
gatttttatggcttagacagtgttg

SEQ ID NO: 36126 - DNA, 25 bp, Mus musculus
gatttttcagattctagatggaaca

SEQ ID NO: 36127 - DNA, 25 bp, Mus musculus
gatttttctggttgatgcctccagg

SEQ ID NO: 36128 - DNA, 25 bp, Mus musculus
gatttttgaacagaacgacatatta

SEQ ID NO: 36129 - DNA, 25 bp, Mus musculus
gatttttggtgaagatggcctgaca

SEQ ID NO: 36130 - DNA, 25 bp, Mus musculus
gcaaaaaagttagcatccccagaga

SEQ ID NO: 36131 - DNA, 25 bp, Mus musculus
gcaaaaaccttaagagacattaaag

SEQ ID NO: 36132 - DNA, 25 bp, Mus musculus
gcaaaaagtattacgtccttcctgg

SEQ ID NO: 36133 - DNA, 25 bp, Mus musculus
gcaaaaatcaaatgactctgccttt

SEQ ID NO: 36134 - DNA, 25 bp, Mus musculus
gcaaaacatgtctcaatccatagaa

SEQ ID NO: 36135 - DNA, 25 bp, Mus musculus
gcaaaaccaacagttgcgcgatcct

SEQ ID NO: 36136 - DNA, 25 bp, Mus musculus
gcaaaaccacctcttagctgaatgg

SEQ ID NO: 36137 - DNA, 25 bp, Mus musculus
gcaaaacctgtttcctgatccaatt

SEQ ID NO: 36138 - DNA, 25 bp, Mus musculus
gcaaaaccttatagacagcctcaca

SEQ ID NO: 36139 - DNA, 25 bp, Mus musculus
gcaaaacgtataacattgtgttggg

SEQ ID NO: 36140 - DNA, 25 bp, Mus musculus
gcaaaacgtctgcatggccttgatg

SEQ ID NO: 36141 - DNA, 25 bp, Mus musculus
gcaaaacgtggaatgaagattgtcc

SEQ ID NO: 36142 - DNA, 25 bp, Mus musculus
gcaaaactgattactcccttctggg

SEQ ID NO: 36143 - DNA, 25 bp, Mus musculus
gcaaaactgatttctcccttctggg

SEQ ID NO: 36144 - DNA, 25 bp, Mus musculus
gcaaaacttgaattctgttagacag

SEQ ID NO: 36145 - DNA, 25 bp, Mus musculus
gcaaaacttgactgtttcctcctag

SEQ ID NO: 36146 - DNA, 25 bp, Mus musculus
gcaaaactttccaagactaaataga

SEQ ID NO: 36147 - DNA, 25 bp, Mus musculus
gcaaaagcgactcagtagtctttca

SEQ ID NO: 36148 - DNA, 25 bp, Mus musculus
gcaaaagtctgacggtctgtccact

SEQ ID NO: 36149 - DNA, 25 bp, Mus musculus
gcaaaatcaaaatgtggcccgacct

SEQ ID NO: 36150 - DNA, 25 bp, Mus musculus
gcaaaatctactccctgaaggcaaa

SEQ ID NO: 36151 - DNA, 25 bp, Mus musculus
gcaaaatgtttttctgccgatttcc

SEQ ID NO: 36152 - DNA, 25 bp, Mus musculus
gcaaaattgggttcttccaaggaga

SEQ ID NO: 36153 - DNA, 25 bp, Mus musculus
gcaaacaaacgctcttccatgacag

SEQ ID NO: 36154 - DNA, 25 bp, Mus musculus
gcaaacaagcaattccccactgtgc

SEQ ID NO: 36155 - DNA, 25 bp, Mus musculus
gcaaacacccacagtgggaagccct

SEQ ID NO: 36156 - DNA, 25 bp, Mus musculus
gcaaacagtctatttcggcgaatct

SEQ ID NO: 36157 - DNA, 25 bp, Mus musculus
gcaaacagttgtggaaaccctcgac

SEQ ID NO: 36158 - DNA, 25 bp, Mus musculus
gcaaaccaacatgtcagagtgggag

SEQ ID NO: 36159 - DNA, 25 bp, Mus musculus
gcaaaccccaaagagaaaactccag

SEQ ID NO: 36160 - DNA, 25 bp, Mus musculus
gcaaacctgaagaggagctttgatg

SEQ ID NO: 36161 - DNA, 25 bp, Mus musculus
gcaaaccttctttgtcctcagtcag

SEQ ID NO: 36162 - DNA, 25 bp, Mus musculus
gcaaacgtcgccctgggtctttgta

SEQ ID NO: 36163 - DNA, 25 bp, Mus musculus
gcaaactacaggctcatcttgtagc

SEQ ID NO: 36164 - DNA, 25 bp, Mus musculus
gcaaactcagagtaattaattggag

SEQ ID NO: 36165 - DNA, 25 bp, Mus musculus
gcaaactccctagcagagtgaatga

SEQ ID NO: 36166 - DNA, 25 bp, Mus musculus
gcaaactgatgcacggccagcggga

SEQ ID NO: 36167 - DNA, 25 bp, Mus musculus
gcaaactggcactgagcaaggctat

SEQ ID NO: 36168 - DNA, 25 bp, Mus musculus
gcaaactggcccgtctgggtctggt

SEQ ID NO: 36169 - DNA, 25 bp, Mus musculus
gcaaactttcaccagaaacagatgg

SEQ ID NO: 36170 - DNA, 25 bp, Mus musculus
gcaaagaaatggtgacatagccaaa

SEQ ID NO: 36171 - DNA, 25 bp, Mus musculus
gcaaagaacttaattgaacagcttg

SEQ ID NO: 36172 - DNA, 25 bp, Mus musculus
gcaaagaagaaaagactcctggctg

SEQ ID NO: 36173 - DNA, 25 bp, Mus musculus
gcaaagaagattgcgaaagaagggc

SEQ ID NO: 36174 - DNA, 25 bp, Mus musculus
gcaaagaaggctaggattgaagaag

SEQ ID NO: 36175 - DNA, 25 bp, Mus musculus
gcaaagaattctgggatgtctgaca

SEQ ID NO: 36176 - DNA, 25 bp, Mus musculus
gcaaagacatcagggaaattctcca

SEQ ID NO: 36177 - DNA, 25 bp, Mus musculus
gcaaagaccttcttactgagatagg

SEQ ID NO: 36178 - DNA, 25 bp, Mus musculus
gcaaagagcacaacccaactcagta

SEQ ID NO: 36179 - DNA, 25 bp, Mus musculus
gcaaagagcctaaagctgaagcagc

SEQ ID NO: 36180 - DNA, 25 bp, Mus musculus
gcaaagaggcagctaccagagagaa

SEQ ID NO: 36181 - DNA, 25 bp, Mus musculus
gcaaagagtatatacctgctgacac

SEQ ID NO: 36182 - DNA, 25 bp, Mus musculus
gcaaagagtttgtgaagttctttca

SEQ ID NO: 36183 - DNA, 25 bp, Mus musculus
gcaaagatttgaggaaaagaggttc

SEQ ID NO: 36184 - DNA, 25 bp, Mus musculus
gcaaagcacaagaggactgcagcac

SEQ ID NO: 36185 - DNA, 25 bp, Mus musculus
gcaaagcagatatgcaaagtgctct

SEQ ID NO: 36186 - DNA, 25 bp, Mus musculus
gcaaagcaggccatagacagggccc

SEQ ID NO: 36187 - DNA, 25 bp, Mus musculus
gcaaagcattcttcagtgtacccaa

SEQ ID NO: 36188 - DNA, 25 bp, Mus musculus
gcaaagccaaagtgctatgaattct

SEQ ID NO: 36189 - DNA, 25 bp, Mus musculus
gcaaagccacttagtatctggactc

SEQ ID NO: 36190 - DNA, 25 bp, Mus musculus
gcaaagccactttgtatctggactc

SEQ ID NO: 36191 - DNA, 25 bp, Mus musculus
gcaaagcccagcatagaactcaaga

SEQ ID NO: 36192 - DNA, 25 bp, Mus musculus
gcaaagcccttgcttagaaccccag

SEQ ID NO: 36193 - DNA, 25 bp, Mus musculus
gcaaagcccttggttagaaccccag

SEQ ID NO: 36194 - DNA, 25 bp, Mus musculus
gcaaagccgtgattgtcgtccagga

SEQ ID NO: 36195 - DNA, 25 bp, Mus musculus
gcaaagcggaagtttgcagattcct

SEQ ID NO: 36196 - DNA, 25 bp, Mus musculus
gcaaagctggcctcaaagctgtgac

SEQ ID NO: 36197 - DNA, 25 bp, Mus musculus
gcaaagcttgcctcagtgaaaggag

SEQ ID NO: 36198 - DNA, 25 bp, Mus musculus
gcaaaggagacagcggcctaagcca

SEQ ID NO: 36199 - DNA, 25 bp, Mus musculus
gcaaaggcacagatcaattcctcaa

SEQ ID NO: 36200 - DNA, 25 bp, Mus musculus
gcaaaggcagagattgctccagcag

SEQ ID NO: 36201 - DNA, 25 bp, Mus musculus
gcaaaggccgaaaatacccgcccat

SEQ ID NO: 36202 - DNA, 25 bp, Mus musculus
gcaaagggccacaagttacattacc

SEQ ID NO: 36203 - DNA, 25 bp, Mus musculus
gcaaaggtccgaggcatcattcctg

SEQ ID NO: 36204 - DNA, 25 bp, Mus musculus
gcaaaggtgtcctagaaatggccag

SEQ ID NO: 36205 - DNA, 25 bp, Mus musculus
gcaaagtaaacagggtgccttgtgg

SEQ ID NO: 36206 - DNA, 25 bp, Mus musculus
gcaaagtacgattccatcatcaaag

SEQ ID NO: 36207 - DNA, 25 bp, Mus musculus
gcaaagtccctgatgacattccttc

SEQ ID NO: 36208 - DNA, 25 bp, Mus musculus
gcaaagtttgatccttcttcgaaaa

SEQ ID NO: 36209 - DNA, 25 bp, Mus musculus
gcaaataaggactccccttctgcta

SEQ ID NO: 36210 - DNA, 25 bp, Mus musculus
gcaaatacatgcagggactgaaaga

SEQ ID NO: 36211 - DNA, 25 bp, Mus musculus
gcaaatactgctatttcttaaagat

SEQ ID NO: 36212 - DNA, 25 bp, Mus musculus
gcaaatagaggaagaagatctaacc

SEQ ID NO: 36213 - DNA, 25 bp, Mus musculus
gcaaataggtgtgtgccaggacgca

SEQ ID NO: 36214 - DNA, 25 bp, Mus musculus
gcaaatatcatgtgtcctggcttaa

SEQ ID NO: 36215 - DNA, 25 bp, Mus musculus
gcaaatcacccattggattgtccta

SEQ ID NO: 36216 - DNA, 25 bp, Mus musculus
gcaaatcccatatcgaagtgttcaa

SEQ ID NO: 36217 - DNA, 25 bp, Mus musculus
gcaaatccgtagctctgctgcaatg

SEQ ID NO: 36218 - DNA, 25 bp, Mus musculus
gcaaatcctacatgtgtatagagcc

SEQ ID NO: 36219 - DNA, 25 bp, Mus musculus
gcaaatcctgttcttaaccatctct

SEQ ID NO: 36220 - DNA, 25 bp, Mus musculus
gcaaatctatctgcagaggcgggca

SEQ ID NO: 36221 - DNA, 25 bp, Mus musculus
gcaaatctcatgcataatcttggtg

SEQ ID NO: 36222 - DNA, 25 bp, Mus musculus
gcaaatgaccatggaaacagttgaa

SEQ ID NO: 36223 - DNA, 25 bp, Mus musculus
gcaaatgagcctttgatagaccctg

SEQ ID NO: 36224 - DNA, 25 bp, Mus musculus
gcaaatgaggaccagagcagtagtt

SEQ ID NO: 36225 - DNA, 25 bp, Mus musculus
gcaaatgcaataggccgaagtgcta

SEQ ID NO: 36226 - DNA, 25 bp, Mus musculus
gcaaatgccaccattgaagtgaaag

SEQ ID NO: 36227 - DNA, 25 bp, Mus musculus
gcaaatgctctcaaagagaagggca

SEQ ID NO: 36228 - DNA, 25 bp, Mus musculus
gcaaatggagtaatgtgaagccgat

SEQ ID NO: 36229 - DNA, 25 bp, Mus musculus
gcaaatgggagatggacacttctga

SEQ ID NO: 36230 - DNA, 25 bp, Mus musculus
gcaaatgggtggcaagtaccaccct

SEQ ID NO: 36231 - DNA, 25 bp, Mus musculus
gcaaatgtacagacacaagcgggcc

SEQ ID NO: 36232 - DNA, 25 bp, Mus musculus
gcaaatgtcagacaccagtccccag

SEQ ID NO: 36233 - DNA, 25 bp, Mus musculus
gcaaatgtgaacagcttccagagga

SEQ ID NO: 36234 - DNA, 25 bp, Mus musculus
gcaaattacaataatacagccttgt

SEQ ID NO: 36235 - DNA, 25 bp, Mus musculus
gcaaattcaactgccataaacgctg

SEQ ID NO: 36236 - DNA, 25 bp, Mus musculus
gcaaattcagaagaaaagctctatg

SEQ ID NO: 36237 - DNA, 25 bp, Mus musculus
gcaacaaaccccatttggcttataa

SEQ ID NO: 36238 - DNA, 25 bp, Mus musculus
gcaacaaacgggtttgttcgtggag

SEQ ID NO: 36239 - DNA, 25 bp, Mus musculus
gcaacaaatggaccaagatacgttg

SEQ ID NO: 36240 - DNA, 25 bp, Mus musculus
gcaacaacatctgccacaagtgttc

SEQ ID NO: 36241 - DNA, 25 bp, Mus musculus
gcaacaacggatcaatatattacat

SEQ ID NO: 36242 - DNA, 25 bp, Mus musculus
gcaacaacttgtcaggaaaattgga

SEQ ID NO: 36243 - DNA, 25 bp, Mus musculus
gcaacaagacttctgtgcagttcca

SEQ ID NO: 36244 - DNA, 25 bp, Mus musculus
gcaacaaggatgactagaatgggcc

SEQ ID NO: 36245 - DNA, 25 bp, Mus musculus
gcaacaagtgtccttggttataaac

SEQ ID NO: 36246 - DNA, 25 bp, Mus musculus
gcaacaatgctagtagaaaatgtgg

SEQ ID NO: 36247 - DNA, 25 bp, Mus musculus
gcaacaattcttaaggaggttttgg

SEQ ID NO: 36248 - DNA, 25 bp, Mus musculus
gcaacacagtcttttcattcttagg

SEQ ID NO: 36249 - DNA, 25 bp, Mus musculus
gcaacacatctcagtctgctgaagt

SEQ ID NO: 36250 - DNA, 25 bp, Mus musculus
gcaacacatctctgtctgctgaagt

SEQ ID NO: 36251 - DNA, 25 bp, Mus musculus
gcaacaccaccaaccttcggagtag

SEQ ID NO: 36252 - DNA, 25 bp, Mus musculus
gcaacacctacacactgctacagga

SEQ ID NO: 36253 - DNA, 25 bp, Mus musculus
gcaacacctgctacatgaacgccat

SEQ ID NO: 36254 - DNA, 25 bp, Mus musculus
gcaacacggaagctgattataaaat

SEQ ID NO: 36255 - DNA, 25 bp, Mus musculus
gcaacacgggcgagatcaaagcact

SEQ ID NO: 36256 - DNA, 25 bp, Mus musculus
gcaacacgtcgggaattgaatccca

SEQ ID NO: 36257 - DNA, 25 bp, Mus musculus
gcaacagaatgctgctcattttcta

SEQ ID NO: 36258 - DNA, 25 bp, Mus musculus
gcaacagaatgggatacgacacggg

SEQ ID NO: 36259 - DNA, 25 bp, Mus musculus
gcaacagaggccaggcagcagcccg

SEQ ID NO: 36260 - DNA, 25 bp, Mus musculus
gcaacagatctctcctttcagaagg

SEQ ID NO: 36261 - DNA, 25 bp, Mus musculus
gcaacagcacgcaggattgcattag

SEQ ID NO: 36262 - DNA, 25 bp, Mus musculus
gcaacagcagcctgggcgtgctgaa

SEQ ID NO: 36263 - DNA, 25 bp, Mus musculus
gcaacagccccgacttctacgggaa

SEQ ID NO: 36264 - DNA, 25 bp, Mus musculus
gcaacagcttctccacacatgatcg

SEQ ID NO: 36265 - DNA, 25 bp, Mus musculus
gcaacaggaagacgacctggatgat

SEQ ID NO: 36266 - DNA, 25 bp, Mus musculus
gcaacaggacctgtaccgaatcctg

SEQ ID NO: 36267 - DNA, 25 bp, Mus musculus
gcaacaggtgctgtagatctctccg

SEQ ID NO: 36268 - DNA, 25 bp, Mus musculus
gcaacaggtgtagcagatgaggccc

SEQ ID NO: 36269 - DNA, 25 bp, Mus musculus
gcaacatctgcaaagaatgcccgat

SEQ ID NO: 36270 - DNA, 25 bp, Mus musculus
gcaacatcttgaaaggcttaggcct

SEQ ID NO: 36271 - DNA, 25 bp, Mus musculus
gcaacatgccttgcccttaagtgga

SEQ ID NO: 36272 - DNA, 25 bp, Mus musculus
gcaacatggatgagacctgcataga

SEQ ID NO: 36273 - DNA, 25 bp, Mus musculus
gcaacatggcactgggcaagttccg

SEQ ID NO: 36274 - DNA, 25 bp, Mus musculus
gcaacattaaggctttcagggcttt

SEQ ID NO: 36275 - DNA, 25 bp, Mus musculus
gcaaccaagaagaaggtagctgagc

SEQ ID NO: 36276 - DNA, 25 bp, Mus musculus
gcaaccagagtgaggttatgctgcg

SEQ ID NO: 36277 - DNA, 25 bp, Mus musculus
gcaaccagattaaaaggaatagtcc

SEQ ID NO: 36278 - DNA, 25 bp, Mus musculus
gcaacccaaggataaagaaactgtg

SEQ ID NO: 36279 - DNA, 25 bp, Mus musculus
gcaacccgggaagagtccagtttgg

SEQ ID NO: 36280 - DNA, 25 bp, Mus musculus
gcaaccgcctgtgtgccactgaaaa

SEQ ID NO: 36281 - DNA, 25 bp, Mus musculus
gcaaccgctactaaatgaaaaccct

SEQ ID NO: 36282 - DNA, 25 bp, Mus musculus
gcaaccgctggaagctggccagcca

SEQ ID NO: 36283 - DNA, 25 bp, Mus musculus
gcaacctctaccagaccttcttgga

SEQ ID NO: 36284 - DNA, 25 bp, Mus musculus
gcaacctctacctgaccttcttgga

SEQ ID NO: 36285 - DNA, 25 bp, Mus musculus
gcaacctgctcaccagtacctggag

SEQ ID NO: 36286 - DNA, 25 bp, Mus musculus
gcaacctggctagcgaaaagcaaca

SEQ ID NO: 36287 - DNA, 25 bp, Mus musculus
gcaacctgggcaatgctcacatctt

SEQ ID NO: 36288 - DNA, 25 bp, Mus musculus
gcaaccttccgagatcttagtaagc

SEQ ID NO: 36289 - DNA, 25 bp, Mus musculus
gcaacctttcctgctaagaaacgga

SEQ ID NO: 36290 - DNA, 25 bp, Mus musculus
gcaacgaagttcagcctcgtcacct

SEQ ID NO: 36291 - DNA, 25 bp, Mus musculus
gcaacgaagtttgcaacagccccga

SEQ ID NO: 36292 - DNA, 25 bp, Mus musculus
gcaacgagcgacataagccagagca

SEQ ID NO: 36293 - DNA, 25 bp, Mus musculus
gcaacgagcgacttaagccagagca

SEQ ID NO: 36294 - DNA, 25 bp, Mus musculus
gcaacgatgacgcagtccgagtcct

SEQ ID NO: 36295 - DNA, 25 bp, Mus musculus
gcaacgcaatacaagtttggccaca

SEQ ID NO: 36296 - DNA, 25 bp, Mus musculus
gcaacgccaacgctgtactgcagat

SEQ ID NO: 36297 - DNA, 25 bp, Mus musculus
gcaacgccatggtgatgacacagta

SEQ ID NO: 36298 - DNA, 25 bp, Mus musculus
gcaacggaagtacgttctgtgataa

SEQ ID NO: 36299 - DNA, 25 bp, Mus musculus
gcaacgggaagaggtcaacaagttt

SEQ ID NO: 36300 - DNA, 25 bp, Mus musculus
gcaacgggcagcacggcttttccat

SEQ ID NO: 36301 - DNA, 25 bp, Mus musculus
gcaacgtcagtttgagagccctctg

SEQ ID NO: 36302 - DNA, 25 bp, Mus musculus
gcaacgtcttctaccatgggtccag

SEQ ID NO: 36303 - DNA, 25 bp, Mus musculus
gcaacgtgaacgtggagatgaacgc

SEQ ID NO: 36304 - DNA, 25 bp, Mus musculus
gcaacgtggttctgtggaagcccag

SEQ ID NO: 36305 - DNA, 25 bp, Mus musculus
gcaacgtttcatactccattcagcc

SEQ ID NO: 36306 - DNA, 25 bp, Mus musculus
gcaactaagttaaggccaaaggcag

SEQ ID NO: 36307 - DNA, 25 bp, Mus musculus
gcaactaccttttccgccagaatcg

SEQ ID NO: 36308 - DNA, 25 bp, Mus musculus
gcaactagaggtatttcaaagagag

SEQ ID NO: 36309 - DNA, 25 bp, Mus musculus
gcaactccccggagaagctgcagga

SEQ ID NO: 36310 - DNA, 25 bp, Mus musculus
gcaactcccgcctatggtgcctggt

SEQ ID NO: 36311 - DNA, 25 bp, Mus musculus
gcaactcctttatgggaatcacact

SEQ ID NO: 36312 - DNA, 25 bp, Mus musculus
gcaactcgacactctcgtgctgctg

SEQ ID NO: 36313 - DNA, 25 bp, Mus musculus
gcaactgaaggaggagctaagttcg

SEQ ID NO: 36314 - DNA, 25 bp, Mus musculus
gcaactgaggatacagtgcttttcc

SEQ ID NO: 36315 - DNA, 25 bp, Mus musculus
gcaactgcagcctacagattgataa

SEQ ID NO: 36316 - DNA, 25 bp, Mus musculus
gcaactgcagtaggtggtggtttcc

SEQ ID NO: 36317 - DNA, 25 bp, Mus musculus
gcaactgctgccatccaaatactgt

SEQ ID NO: 36318 - DNA, 25 bp, Mus musculus
gcaactggacgagacctgtgctgag

SEQ ID NO: 36319 - DNA, 25 bp, Mus musculus
gcaactggaggaaccttcatcgtga

SEQ ID NO: 36320 - DNA, 25 bp, Mus musculus
gcaactggctttccgtcacttatta

SEQ ID NO: 36321 - DNA, 25 bp, Mus musculus
gcaactggtggatggtttcctagcc

SEQ ID NO: 36322 - DNA, 25 bp, Mus musculus
gcaactgtgaaaagatgtcgctgtc

SEQ ID NO: 36323 - DNA, 25 bp, Mus musculus
gcaacttatgatggaccatatcaag

SEQ ID NO: 36324 - DNA, 25 bp, Mus musculus
gcaacttcacatagatgctttagag

SEQ ID NO: 36325 - DNA, 25 bp, Mus musculus
gcaacttgccactccctactgaata

SEQ ID NO: 36326 - DNA, 25 bp, Mus musculus
gcaacttgctagaagaatttagaag

SEQ ID NO: 36327 - DNA, 25 bp, Mus musculus
gcaacttgctgtcgttcacctataa

SEQ ID NO: 36328 - DNA, 25 bp, Mus musculus
gcaactttatgcacctacggcccat

SEQ ID NO: 36329 - DNA, 25 bp, Mus musculus
gcaactttgctaaactctccagata

SEQ ID NO: 36330 - DNA, 25 bp, Mus musculus
gcaagaaaaagtcatatttcccacg

SEQ ID NO: 36331 - DNA, 25 bp, Mus musculus
gcaagaaaccatgactgtaacgctc

SEQ ID NO: 36332 - DNA, 25 bp, Mus musculus
gcaagaaactggtcctctatttgga

SEQ ID NO: 36333 - DNA, 25 bp, Mus musculus
gcaagaaatgccctgggcagcctac

SEQ ID NO: 36334 - DNA, 25 bp, Mus musculus
gcaagaagaaatacctggccgcagc

SEQ ID NO: 36335 - DNA, 25 bp, Mus musculus
gcaagaagattgctcaggaacgcct

SEQ ID NO: 36336 - DNA, 25 bp, Mus musculus
gcaagaaggccagccctgagactac

SEQ ID NO: 36337 - DNA, 25 bp, Mus musculus
gcaagaaggcctccaggtttttctc

SEQ ID NO: 36338 - DNA, 25 bp, Mus musculus
gcaagacaagcggagaccagagttc

SEQ ID NO: 36339 - DNA, 25 bp, Mus musculus
gcaagacactgtaaagcgaactgac

SEQ ID NO: 36340 - DNA, 25 bp, Mus musculus
gcaagacagtcatcatcacccaaga

SEQ ID NO: 36341 - DNA, 25 bp, Mus musculus
gcaagacattgttatcggagctcca

SEQ ID NO: 36342 - DNA, 25 bp, Mus musculus
gcaagaccgtgatccaagcagagat

SEQ ID NO: 36343 - DNA, 25 bp, Mus musculus
gcaagacgcacctgcaaagaagaag

SEQ ID NO: 36344 - DNA, 25 bp, Mus musculus
gcaagacgtctctggtccagcgcta

SEQ ID NO: 36345 - DNA, 25 bp, Mus musculus
gcaagactccgccacattaagcgtc

SEQ ID NO: 36346 - DNA, 25 bp, Mus musculus
gcaagactctacacatcacatgtgg

SEQ ID NO: 36347 - DNA, 25 bp, Mus musculus
gcaagactgagaaatgcattctctc

SEQ ID NO: 36348 - DNA, 25 bp, Mus musculus
gcaagagaaaccagttggaagtcat

SEQ ID NO: 36349 - DNA, 25 bp, Mus musculus
gcaagagaagatttagaacgagtag

SEQ ID NO: 36350 - DNA, 25 bp, Mus musculus
gcaagagacaaaggccaacaaacac

SEQ ID NO: 36351 - DNA, 25 bp, Mus musculus
gcaagagatcttcaggtccagccct

SEQ ID NO: 36352 - DNA, 25 bp, Mus musculus
gcaagagatgaggaagacgcctatg

SEQ ID NO: 36353 - DNA, 25 bp, Mus musculus
gcaagagcaccgctgtgcacgcaaa

SEQ ID NO: 36354 - DNA, 25 bp, Mus musculus
gcaagaggccatcatcccctatatc

SEQ ID NO: 36355 - DNA, 25 bp, Mus musculus
gcaagaggcttactctgtcacctgt

SEQ ID NO: 36356 - DNA, 25 bp, Mus musculus
gcaagaggttgttctgagcctgttg

SEQ ID NO: 36357 - DNA, 25 bp, Mus musculus
gcaagagttgtgtgtacaaccacct

SEQ ID NO: 36358 - DNA, 25 bp, Mus musculus
gcaagataaggagtgacagctggct

SEQ ID NO: 36359 - DNA, 25 bp, Mus musculus
gcaagatatgttgcaatcaaatata

SEQ ID NO: 36360 - DNA, 25 bp, Mus musculus
gcaagatcaggatagactgtcacag

SEQ ID NO: 36361 - DNA, 25 bp, Mus musculus
gcaagatctggtgctttggccctga

SEQ ID NO: 36362 - DNA, 25 bp, Mus musculus
gcaagatgaatgcagttcagactga

SEQ ID NO: 36363 - DNA, 25 bp, Mus musculus
gcaagatgacaagcaaatcctagag

SEQ ID NO: 36364 - DNA, 25 bp, Mus musculus
gcaagatgtcagaactatccaccat

SEQ ID NO: 36365 - DNA, 25 bp, Mus musculus
gcaagcaactgctcattcttttgat

SEQ ID NO: 36366 - DNA, 25 bp, Mus musculus
gcaagcaagcacttttgtattgagt

SEQ ID NO: 36367 - DNA, 25 bp, Mus musculus
gcaagcaagggtccgtccctttgct

SEQ ID NO: 36368 - DNA, 25 bp, Mus musculus
gcaagcacacagtcgtggcatataa

SEQ ID NO: 36369 - DNA, 25 bp, Mus musculus
gcaagcacctttactctgtgtgatg

SEQ ID NO: 36370 - DNA, 25 bp, Mus musculus
gcaagcagcaatccaatgagcacct

SEQ ID NO: 36371 - DNA, 25 bp, Mus musculus
gcaagcagccacaagctaacttctg

SEQ ID NO: 36372 - DNA, 25 bp, Mus musculus
gcaagcagtattgcactgagcagaa

SEQ ID NO: 36373 - DNA, 25 bp, Mus musculus
gcaagcatcacctttgagcacatgt

SEQ ID NO: 36374 - DNA, 25 bp, Mus musculus
gcaagccaagatggagtgcccattg

SEQ ID NO: 36375 - DNA, 25 bp, Mus musculus
gcaagccagtaacctttgtggatgg

SEQ ID NO: 36376 - DNA, 25 bp, Mus musculus
gcaagccagtagctgacttgctggc

SEQ ID NO: 36377 - DNA, 25 bp, Mus musculus
gcaagccattaagggagtatactca

SEQ ID NO: 36378 - DNA, 25 bp, Mus musculus
gcaagccctcatgagagatttcttt

SEQ ID NO: 36379 - DNA, 25 bp, Mus musculus
gcaagcctgagatctctgctgtcag

SEQ ID NO: 36380 - DNA, 25 bp, Mus musculus
gcaagcgaatttatacctaaaggag

SEQ ID NO: 36381 - DNA, 25 bp, Mus musculus
gcaagcgccttggtcttatgcaggg

SEQ ID NO: 36382 - DNA, 25 bp, Mus musculus
gcaagctaaacaagaaggcacctgt

SEQ ID NO: 36383 - DNA, 25 bp, Mus musculus
gcaagctaagcagtgacgaggacct

SEQ ID NO: 36384 - DNA, 25 bp, Mus musculus
gcaagctccctattataactacaag

SEQ ID NO: 36385 - DNA, 25 bp, Mus musculus
gcaagctgacgaactgagtctcaca

SEQ ID NO: 36386 - DNA, 25 bp, Mus musculus
gcaagctgacgatctgagtctcaca

SEQ ID NO: 36387 - DNA, 25 bp, Mus musculus
gcaagctgagcctcttgctctgcac

SEQ ID NO: 36388 - DNA, 25 bp, Mus musculus
gcaagctgataagaaatgcctctga

SEQ ID NO: 36389 - DNA, 25 bp, Mus musculus
gcaagctggcaaacggactgttgct

SEQ ID NO: 36390 - DNA, 25 bp, Mus musculus
gcaagcttcaagaagtaagctttta

SEQ ID NO: 36391 - DNA, 25 bp, Mus musculus
gcaagcttccctgtttcaggtgaga

SEQ ID NO: 36392 - DNA, 25 bp, Mus musculus
gcaaggagaaatgccgaccggtgct

SEQ ID NO: 36393 - DNA, 25 bp, Mus musculus
gcaaggagacgtaagccccaatcct

SEQ ID NO: 36394 - DNA, 25 bp, Mus musculus
gcaaggaggccccttttacacactt

SEQ ID NO: 36395 - DNA, 25 bp, Mus musculus
gcaaggataaggtgccagctcaaag

SEQ ID NO: 36396 - DNA, 25 bp, Mus musculus
gcaaggattaatgtccagacttggt

SEQ ID NO: 36397 - DNA, 25 bp, Mus musculus
gcaaggcatacaccagaaaacgctg

SEQ ID NO: 36398 - DNA, 25 bp, Mus musculus
gcaaggccaaactcgagccagagag

SEQ ID NO: 36399 - DNA, 25 bp, Mus musculus
gcaaggccttgcttcaggagcagga

SEQ ID NO: 36400 - DNA, 25 bp, Mus musculus
gcaaggctattgagagtggagacac

SEQ ID NO: 36401 - DNA, 25 bp, Mus musculus
gcaaggctgggctgttgtctccata

SEQ ID NO: 36402 - DNA, 25 bp, Mus musculus
gcaaggctgtgtacttcatactgca

SEQ ID NO: 36403 - DNA, 25 bp, Mus musculus
gcaaggcttccccacagtcagattg

SEQ ID NO: 36404 - DNA, 25 bp, Mus musculus
gcaagggaatcctgctgatggaccc

SEQ ID NO: 36405 - DNA, 25 bp, Mus musculus
gcaagggagttgcagaaaagcctca

SEQ ID NO: 36406 - DNA, 25 bp, Mus musculus
gcaagggatgaagtaccactcctcc

SEQ ID NO: 36407 - DNA, 25 bp, Mus musculus
gcaagggcaagaaggcactgccaga

SEQ ID NO: 36408 - DNA, 25 bp, Mus musculus
gcaagggctggaggacaagaactac

SEQ ID NO: 36409 - DNA, 25 bp, Mus musculus
gcaagggtccgtccctttgctgcct

SEQ ID NO: 36410 - DNA, 25 bp, Mus musculus
gcaaggtatccatctgtccccaaaa

SEQ ID NO: 36411 - DNA, 25 bp, Mus musculus
gcaaggtctgctcctgtgtcgtcaa

SEQ ID NO: 36412 - DNA, 25 bp, Mus musculus
gcaaggtgaagcagtttgacttcct

SEQ ID NO: 36413 - DNA, 25 bp, Mus musculus
gcaagtaaggacaagtaacttgggt

SEQ ID NO: 36414 - DNA, 25 bp, Mus musculus
gcaagtacagaacttcacatcagat

SEQ ID NO: 36415 - DNA, 25 bp, Mus musculus
gcaagtaccaccctatggagtatat

SEQ ID NO: 36416 - DNA, 25 bp, Mus musculus
gcaagtaccgagagcagatgttcag

SEQ ID NO: 36417 - DNA, 25 bp, Mus musculus
gcaagtagtacaggcacaaaaggaa

SEQ ID NO: 36418 - DNA, 25 bp, Mus musculus
gcaagtagtcatggctgaagcagtg

SEQ ID NO: 36419 - DNA, 25 bp, Mus musculus
gcaagtatgctagcaacctgctgaa

SEQ ID NO: 36420 - DNA, 25 bp, Mus musculus
gcaagtcacagtcgtcgatgccagc

SEQ ID NO: 36421 - DNA, 25 bp, Mus musculus
gcaagtgaacaagccggtgctctcc

SEQ ID NO: 36422 - DNA, 25 bp, Mus musculus
gcaagtgaaggcaagaaatggctca

SEQ ID NO: 36423 - DNA, 25 bp, Mus musculus
gcaagtgacacgaccctccgaggat

SEQ ID NO: 36424 - DNA, 25 bp, Mus musculus
gcaagtgacgggactttatctgcag

SEQ ID NO: 36425 - DNA, 25 bp, Mus musculus
gcaagtggacgtgcctacgctgact

SEQ ID NO: 36426 - DNA, 25 bp, Mus musculus
gcaagtgggcttcaaggtttcaaaa

SEQ ID NO: 36427 - DNA, 25 bp, Mus musculus
gcaagttcacatctatccgtcggac

SEQ ID NO: 36428 - DNA, 25 bp, Mus musculus
gcaagttcagcaacatcgtggagaa

SEQ ID NO: 36429 - DNA, 25 bp, Mus musculus
gcaagttcatcagccacatcaagtg

SEQ ID NO: 36430 - DNA, 25 bp, Mus musculus
gcaagttggagcactgcacataatc

SEQ ID NO: 36431 - DNA, 25 bp, Mus musculus
gcaagttggagctctgcacataatc

SEQ ID NO: 36432 - DNA, 25 bp, Mus musculus
gcaagttggcacatacattgaaaaa

SEQ ID NO: 36433 - DNA, 25 bp, Mus musculus
gcaagtttgcagacttctttgagga

SEQ ID NO: 36434 - DNA, 25 bp, Mus musculus
gcaataaacccatccacagagcata

SEQ ID NO: 36435 - DNA, 25 bp, Mus musculus
gcaataactcccagcttccagtaga

SEQ ID NO: 36436 - DNA, 25 bp, Mus musculus
gcaataatccaagatcaacttggta

SEQ ID NO: 36437 - DNA, 25 bp, Mus musculus
gcaatacaaggctgacatcaatgca

SEQ ID NO: 36438 - DNA, 25 bp, Mus musculus
gcaatacataaggaatctggtcaag

SEQ ID NO: 36439 - DNA, 25 bp, Mus musculus
gcaataccgcatctgtctcaaaacc

SEQ ID NO: 36440 - DNA, 25 bp, Mus musculus
gcaataccgcatgtgtctcaaaacc

SEQ ID NO: 36441 - DNA, 25 bp, Mus musculus
gcaatacggaatatcaatcccagca

SEQ ID NO: 36442 - DNA, 25 bp, Mus musculus
gcaatagcctgccatgtctgctgct

SEQ ID NO: 36443 - DNA, 25 bp, Mus musculus
gcaataggagcttacaccttgatcc

SEQ ID NO: 36444 - DNA, 25 bp, Mus musculus
gcaatagtaattgtcgtcactgtgg

SEQ ID NO: 36445 - DNA, 25 bp, Mus musculus
gcaatatcgaatgggccagctgcac

SEQ ID NO: 36446 - DNA, 25 bp, Mus musculus
gcaatatgccatcctcttcaaccga

SEQ ID NO: 36447 - DNA, 25 bp, Mus musculus
gcaatatggagcagtgcgtacgcct

SEQ ID NO: 36448 - DNA, 25 bp, Mus musculus
gcaatcagcatttggatctcagaat

SEQ ID NO: 36449 - DNA, 25 bp, Mus musculus
gcaatcaggtcgtcaagccccaggt

SEQ ID NO: 36450 - DNA, 25 bp, Mus musculus
gcaatcctgtgtcgatataatgagg

SEQ ID NO: 36451 - DNA, 25 bp, Mus musculus
gcaatcgcttgctagctttacccga

SEQ ID NO: 36452 - DNA, 25 bp, Mus musculus
gcaatcgtgttgagcttgagccaaa

SEQ ID NO: 36453 - DNA, 25 bp, Mus musculus
gcaatctctgtggtaggaaggccct

SEQ ID NO: 36454 - DNA, 25 bp, Mus musculus
gcaatctgcagaagacccagagaaa

SEQ ID NO: 36455 - DNA, 25 bp, Mus musculus
gcaatctgctcccagttgtgctctg

SEQ ID NO: 36456 - DNA, 25 bp, Mus musculus
gcaatgaacatagtcaacttcccca

SEQ ID NO: 36457 - DNA, 25 bp, Mus musculus
gcaatgaattggtggcctagcaacc

SEQ ID NO: 36458 - DNA, 25 bp, Mus musculus
gcaatgacatcacagcttatctttt

SEQ ID NO: 36459 - DNA, 25 bp, Mus musculus
gcaatgacctgatgttactacgcct

SEQ ID NO: 36460 - DNA, 25 bp, Mus musculus
gcaatgacctgtcccagtaccctgt

SEQ ID NO: 36461 - DNA, 25 bp, Mus musculus
gcaatgacgccgactgggacttctg

SEQ ID NO: 36462 - DNA, 25 bp, Mus musculus
gcaatgagactgagcctgcgacgat

SEQ ID NO: 36463 - DNA, 25 bp, Mus musculus
gcaatgcacctgtagctagcgggcg

SEQ ID NO: 36464 - DNA, 25 bp, Mus musculus
gcaatgcacgcagactcctgcgaat

SEQ ID NO: 36465 - DNA, 25 bp, Mus musculus
gcaatgcagactatgtcttcactag

SEQ ID NO: 36466 - DNA, 25 bp, Mus musculus
gcaatgccgtggtcttagtacccag

SEQ ID NO: 36467 - DNA, 25 bp, Mus musculus
gcaatgcctcgagacatcctgatgg

SEQ ID NO: 36468 - DNA, 25 bp, Mus musculus
gcaatgcctctgcagcgtatctcca

SEQ ID NO: 36469 - DNA, 25 bp, Mus musculus
gcaatgctgtcatatgcctggacct

SEQ ID NO: 36470 - DNA, 25 bp, Mus musculus
gcaatgcttgttctccagccaaagg

SEQ ID NO: 36471 - DNA, 25 bp, Mus musculus
gcaatgcttgttgtccagccaaagg

SEQ ID NO: 36472 - DNA, 25 bp, Mus musculus
gcaatggactttggcatttctcttc

SEQ ID NO: 36473 - DNA, 25 bp, Mus musculus
gcaatggctgcagtggcttcttcaa

SEQ ID NO: 36474 - DNA, 25 bp, Mus musculus
gcaatggtgctccactcagttctgc

SEQ ID NO: 36475 - DNA, 25 bp, Mus musculus
gcaatgtcacagtaggaaaaatccc

SEQ ID NO: 36476 - DNA, 25 bp, Mus musculus
gcaatgtcattccaaaccctgctgc

SEQ ID NO: 36477 - DNA, 25 bp, Mus musculus
gcaatgtctgctaggtcttccagag

SEQ ID NO: 36478 - DNA, 25 bp, Mus musculus
gcaatgtgccacttcactatgcatg

SEQ ID NO: 36479 - DNA, 25 bp, Mus musculus
gcaatgttcctgcagtaaaatggga

SEQ ID NO: 36480 - DNA, 25 bp, Mus musculus
gcaattagaaattattaacaaaagg

SEQ ID NO: 36481 - DNA, 25 bp, Mus musculus
gcaattagcccagctacactaggcg

SEQ ID NO: 36482 - DNA, 25 bp, Mus musculus
gcaattagtgggaacctttctaact

SEQ ID NO: 36483 - DNA, 25 bp, Mus musculus
gcaattatgggacacagcaggtcaa

SEQ ID NO: 36484 - DNA, 25 bp, Mus musculus
gcaattcattgatagcaggaaaggg

SEQ ID NO: 36485 - DNA, 25 bp, Mus musculus
gcaattccaaggaaggctttccgtg

SEQ ID NO: 36486 - DNA, 25 bp, Mus musculus
gcaattccactaaccagatatgtac

SEQ ID NO: 36487 - DNA, 25 bp, Mus musculus
gcaattccactatccagatatgtac

SEQ ID NO: 36488 - DNA, 25 bp, Mus musculus
gcaattccagtaaacaaacagttgg

SEQ ID NO: 36489 - DNA, 25 bp, Mus musculus
gcaattccagtgtacagcatgttca

SEQ ID NO: 36490 - DNA, 25 bp, Mus musculus
gcaattctgccttgaactaaatgga

SEQ ID NO: 36491 - DNA, 25 bp, Mus musculus
gcaattcttacttcaaggcataccc

SEQ ID NO: 36492 - DNA, 25 bp, Mus musculus
gcaattgcagttgagtatttttgga

SEQ ID NO: 36493 - DNA, 25 bp, Mus musculus
gcaattgcttacttctacaaagagg

SEQ ID NO: 36494 - DNA, 25 bp, Mus musculus
gcaattgggctgacttttcttatgc

SEQ ID NO: 36495 - DNA, 25 bp, Mus musculus
gcaattgtagatcagtttggtcaaa

SEQ ID NO: 36496 - DNA, 25 bp, Mus musculus
gcaattgtgagcttcgctgtaggga

SEQ ID NO: 36497 - DNA, 25 bp, Mus musculus
gcaatttaacgagccacttccatga

SEQ ID NO: 36498 - DNA, 25 bp, Mus musculus
gcaatttgaccagctctctaaccgg

SEQ ID NO: 36499 - DNA, 25 bp, Mus musculus
gcaattttcattctttactctccag

SEQ ID NO: 36500 - DNA, 25 bp, Mus musculus
gcaattttcattgtttactctccag

SEQ ID NO: 36501 - DNA, 25 bp, Mus musculus
gcaattttctttgccatccatcgca

SEQ ID NO: 36502 - DNA, 25 bp, Mus musculus
gcaattttgagacacaatctgcatc

SEQ ID NO: 36503 - DNA, 25 bp, Mus musculus
gcacaaacaaagaccctcaagaaag

SEQ ID NO: 36504 - DNA, 25 bp, Mus musculus
gcacaaagtaccaggccatgctgag

SEQ ID NO: 36505 - DNA, 25 bp, Mus musculus
gcacaaagtgtggtccaggttactc

SEQ ID NO: 36506 - DNA, 25 bp, Mus musculus
gcacaaatatgccagctacctttgg

SEQ ID NO: 36507 - DNA, 25 bp, Mus musculus
gcacaaatgcagaaccactcgctgg

SEQ ID NO: 36508 - DNA, 25 bp, Mus musculus
gcacaacattgtggcaccgtataag

SEQ ID NO: 36509 - DNA, 25 bp, Mus musculus
gcacaaccaaagaacggttccacga

SEQ ID NO: 36510 - DNA, 25 bp, Mus musculus
gcacaaccaagtcaccgagactaga

SEQ ID NO: 36511 - DNA, 25 bp, Mus musculus
gcacaaccagcctaggcagcgactt

SEQ ID NO: 36512 - DNA, 25 bp, Mus musculus
gcacaaccctggctacctttagtgt

SEQ ID NO: 36513 - DNA, 25 bp, Mus musculus
gcacaactgtagcagttcgtggtga

SEQ ID NO: 36514 - DNA, 25 bp, Mus musculus
gcacaacttcccttttcagttcctg

SEQ ID NO: 36515 - DNA, 25 bp, Mus musculus
gcacaagaagtaccctaccaaagga

SEQ ID NO: 36516 - DNA, 25 bp, Mus musculus
gcacaagaatctcccttcccaaagg

SEQ ID NO: 36517 - DNA, 25 bp, Mus musculus
gcacaagacggtaagagggagacca

SEQ ID NO: 36518 - DNA, 25 bp, Mus musculus
gcacaagcacctgtagggaccagtt

SEQ ID NO: 36519 - DNA, 25 bp, Mus musculus
gcacaagcactgctgcaaagactcc

SEQ ID NO: 36520 - DNA, 25 bp, Mus musculus
gcacaagctggccaagagcatccct

SEQ ID NO: 36521 - DNA, 25 bp, Mus musculus
gcacaaggacttggtcaatgttcca

SEQ ID NO: 36522 - DNA, 25 bp, Mus musculus
gcacaaggagaatacattgccccag

SEQ ID NO: 36523 - DNA, 25 bp, Mus musculus
gcacaagggaactgctctgcacagc

SEQ ID NO: 36524 - DNA, 25 bp, Mus musculus
gcacaagtgtcaagacctattcccg

SEQ ID NO: 36525 - DNA, 25 bp, Mus musculus
gcacaatccagtcagggacccaaga

SEQ ID NO: 36526 - DNA, 25 bp, Mus musculus
gcacaatgccttacatatctttatg

SEQ ID NO: 36527 - DNA, 25 bp, Mus musculus
gcacaatggtgttagctgggcagaa

SEQ ID NO: 36528 - DNA, 25 bp, Mus musculus
gcacaattcagtaagagctgttcta

SEQ ID NO: 36529 - DNA, 25 bp, Mus musculus
gcacacagtcgtggcatataaggat

SEQ ID NO: 36530 - DNA, 25 bp, Mus musculus
gcacacatttggactggtgcagagc

SEQ ID NO: 36531 - DNA, 25 bp, Mus musculus
gcacaccatccaaagtacttgtcaa

SEQ ID NO: 36532 - DNA, 25 bp, Mus musculus
gcacaccatgtgtggactggtcact

SEQ ID NO: 36533 - DNA, 25 bp, Mus musculus
gcacaccgatgaagagttcctgaaa

SEQ ID NO: 36534 - DNA, 25 bp, Mus musculus
gcacaccggatcctagaaggcctgg

SEQ ID NO: 36535 - DNA, 25 bp, Mus musculus
gcacacctctatagttgtacacaag

SEQ ID NO: 36536 - DNA, 25 bp, Mus musculus
gcacacctggtggtcctgaagacag

SEQ ID NO: 36537 - DNA, 25 bp, Mus musculus
gcacacgaaacttccaggactttga

SEQ ID NO: 36538 - DNA, 25 bp, Mus musculus
gcacacgaaggccattcttctagct

SEQ ID NO: 36539 - DNA, 25 bp, Mus musculus
gcacacgtttgaggctcgggaccta

SEQ ID NO: 36540 - DNA, 25 bp, Mus musculus
gcacactctgtgtggctccagctgc

SEQ ID NO: 36541 - DNA, 25 bp, Mus musculus
gcacagaaagagcttcagaagttaa

SEQ ID NO: 36542 - DNA, 25 bp, Mus musculus
gcacagaaccgccaagaattcaatt

SEQ ID NO: 36543 - DNA, 25 bp, Mus musculus
gcacagaatagatcctgatgccatt

SEQ ID NO: 36544 - DNA, 25 bp, Mus musculus
gcacagacagaagcttgatgactct

SEQ ID NO: 36545 - DNA, 25 bp, Mus musculus
gcacagagatctaaagctggaaaac

SEQ ID NO: 36546 - DNA, 25 bp, Mus musculus
gcacagagccgggataagcagatag

SEQ ID NO: 36547 - DNA, 25 bp, Mus musculus
gcacagaggaagttgctgcttggct

SEQ ID NO: 36548 - DNA, 25 bp, Mus musculus
gcacagagtccttcagtatgtgggt

SEQ ID NO: 36549 - DNA, 25 bp, Mus musculus
gcacagatgctctcagctttttatg

SEQ ID NO: 36550 - DNA, 25 bp, Mus musculus
gcacagattgtaattgaccatttaa

SEQ ID NO: 36551 - DNA, 25 bp, Mus musculus
gcacagcaacatggcgagctttgtt

SEQ ID NO: 36552 - DNA, 25 bp, Mus musculus
gcacagcagcaagtaacttgattga

SEQ ID NO: 36553 - DNA, 25 bp, Mus musculus
gcacagcccaagcagtcggcattgc

SEQ ID NO: 36554 - DNA, 25 bp, Mus musculus
gcacagctctgaaacttaagcctga

SEQ ID NO: 36555 - DNA, 25 bp, Mus musculus
gcacagctctgtattatctttctca

SEQ ID NO: 36556 - DNA, 25 bp, Mus musculus
gcacaggaaagtaagccaggagtaa

SEQ ID NO: 36557 - DNA, 25 bp, Mus musculus
gcacaggaaagttagccaggagtaa

SEQ ID NO: 36558 - DNA, 25 bp, Mus musculus
gcacaggacctcagtgtcattgaag

SEQ ID NO: 36559 - DNA, 25 bp, Mus musculus
gcacaggaggtctgaacaccggaaa

SEQ ID NO: 36560 - DNA, 25 bp, Mus musculus
gcacaggattctcagatgacccctt

SEQ ID NO: 36561 - DNA, 25 bp, Mus musculus
gcacaggcacctggacgtcagaatt

SEQ ID NO: 36562 - DNA, 25 bp, Mus musculus
gcacaggcctgagctgattgagtat

SEQ ID NO: 36563 - DNA, 25 bp, Mus musculus
gcacaggctacacactggacactca

SEQ ID NO: 36564 - DNA, 25 bp, Mus musculus
gcacaggtgcagcaagtactcaaca

SEQ ID NO: 36565 - DNA, 25 bp, Mus musculus
gcacagtcttccagcagttcggcag

SEQ ID NO: 36566 - DNA, 25 bp, Mus musculus
gcacagttaccaaaaccgagcgcct

SEQ ID NO: 36567 - DNA, 25 bp, Mus musculus
gcacatagccaactgcaggttcagg

SEQ ID NO: 36568 - DNA, 25 bp, Mus musculus
gcacatatgtatgggtccagtacgt

SEQ ID NO: 36569 - DNA, 25 bp, Mus musculus
gcacatattttaccccatggatggc

SEQ ID NO: 36570 - DNA, 25 bp, Mus musculus
gcacatccaacagaaactggccaga

SEQ ID NO: 36571 - DNA, 25 bp, Mus musculus
gcacatcgaccttttgtaacactca

SEQ ID NO: 36572 - DNA, 25 bp, Mus musculus
gcacatcgccgttcacgagtgtcag

SEQ ID NO: 36573 - DNA, 25 bp, Mus musculus
gcacatcgtctgaatccttacacag

SEQ ID NO: 36574 - DNA, 25 bp, Mus musculus
gcacatcgtctgtatccttacacag

SEQ ID NO: 36575 - DNA, 25 bp, Mus musculus
gcacatgactcagggcttggacatg

SEQ ID NO: 36576 - DNA, 25 bp, Mus musculus
gcacatgagcgagcaattctcccag

SEQ ID NO: 36577 - DNA, 25 bp, Mus musculus
gcacatgatgacttctatctggtcg

SEQ ID NO: 36578 - DNA, 25 bp, Mus musculus
gcacatgattgacagacagagaatg

SEQ ID NO: 36579 - DNA, 25 bp, Mus musculus
gcacatgattgagagacagagaatg

SEQ ID NO: 36580 - DNA, 25 bp, Mus musculus
gcacatggccgtggcaggctagcct

SEQ ID NO: 36581 - DNA, 25 bp, Mus musculus
gcacatgggattaatctcagcaatt

SEQ ID NO: 36582 - DNA, 25 bp, Mus musculus
gcacatgggattccttctcaaggca

SEQ ID NO: 36583 - DNA, 25 bp, Mus musculus
gcacatgtcaatatttccatggaga

SEQ ID NO: 36584 - DNA, 25 bp, Mus musculus
gcacatgtctgtccgcagctcgcag

SEQ ID NO: 36585 - DNA, 25 bp, Mus musculus
gcacatgtgaaaccagacctcatcg

SEQ ID NO: 36586 - DNA, 25 bp, Mus musculus
gcacattactgttccactgaggtca

SEQ ID NO: 36587 - DNA, 25 bp, Mus musculus
gcacattatagtcaaacccatcacc

SEQ ID NO: 36588 - DNA, 25 bp, Mus musculus
gcacatttccctttcatgacaccag

SEQ ID NO: 36589 - DNA, 25 bp, Mus musculus
gcaccaaacaaataacgccaggttc

SEQ ID NO: 36590 - DNA, 25 bp, Mus musculus
gcaccaaacgcagccggtggatgga

SEQ ID NO: 36591 - DNA, 25 bp, Mus musculus
gcaccacatccacctcggaggaatg

SEQ ID NO: 36592 - DNA, 25 bp, Mus musculus
gcaccaccatagaacggcccttttg

SEQ ID NO: 36593 - DNA, 25 bp, Mus musculus
gcaccacccctgtgtgtgaagacat

SEQ ID NO: 36594 - DNA, 25 bp, Mus musculus
gcaccactaccacatgatgcatgga

SEQ ID NO: 36595 - DNA, 25 bp, Mus musculus
gcaccactctgtcatcctggtcggg

SEQ ID NO: 36596 - DNA, 25 bp, Mus musculus
gcaccacttcggattctctagcaca

SEQ ID NO: 36597 - DNA, 25 bp, Mus musculus
gcaccagaggtcatcttgaattgga

SEQ ID NO: 36598 - DNA, 25 bp, Mus musculus
gcaccagagtttttctcatatcaac

SEQ ID NO: 36599 - DNA, 25 bp, Mus musculus
gcaccagctgcgatgcaatggcgtg

SEQ ID NO: 36600 - DNA, 25 bp, Mus musculus
gcaccaggatcgtgggagctaagaa

SEQ ID NO: 36601 - DNA, 25 bp, Mus musculus
gcaccatcatccactgtgactgtcg

SEQ ID NO: 36602 - DNA, 25 bp, Mus musculus
gcaccatgaatgagatctaccgtaa

SEQ ID NO: 36603 - DNA, 25 bp, Mus musculus
gcaccatgacatggactcttgtttg

SEQ ID NO: 36604 - DNA, 25 bp, Mus musculus
gcaccattcattgcagagagaatct

SEQ ID NO: 36605 - DNA, 25 bp, Mus musculus
gcaccattcccgttttaagaacaga

SEQ ID NO: 36606 - DNA, 25 bp, Mus musculus
gcaccattgtttgagctgtatgaca

SEQ ID NO: 36607 - DNA, 25 bp, Mus musculus
gcacccaagcctagaaaagtggagc

SEQ ID NO: 36608 - DNA, 25 bp, Mus musculus
gcacccacaaggaacatgactttct

SEQ ID NO: 36609 - DNA, 25 bp, Mus musculus
gcacccagacaagaacccggataat

SEQ ID NO: 36610 - DNA, 25 bp, Mus musculus
gcacccagacatgtcagtgaccaaa

SEQ ID NO: 36611 - DNA, 25 bp, Mus musculus
gcacccagaggttgaagatgtcgag

SEQ ID NO: 36612 - DNA, 25 bp, Mus musculus
gcacccatttggagccatgaatatt

SEQ ID NO: 36613 - DNA, 25 bp, Mus musculus
gcaccccaagataagaagacagata

SEQ ID NO: 36614 - DNA, 25 bp, Mus musculus
gcaccccagaaggtgtcgtctttga

SEQ ID NO: 36615 - DNA, 25 bp, Mus musculus
gcaccccgataagaggaaaagagtc

SEQ ID NO: 36616 - DNA, 25 bp, Mus musculus
gcaccccggatcctgcagtgcatcg

SEQ ID NO: 36617 - DNA, 25 bp, Mus musculus
gcacccctgggaatttttggacaca

SEQ ID NO: 36618 - DNA, 25 bp, Mus musculus
gcacccgactcaaagcattggccga

SEQ ID NO: 36619 - DNA, 25 bp, Mus musculus
gcacccggaagatcctggagcagca

SEQ ID NO: 36620 - DNA, 25 bp, Mus musculus
gcacccggctttcctagtgctgagg

SEQ ID NO: 36621 - DNA, 25 bp, Mus musculus
gcacccggctttgctagtgctgagg

SEQ ID NO: 36622 - DNA, 25 bp, Mus musculus
gcacccggttctatcatccagagaa

SEQ ID NO: 36623 - DNA, 25 bp, Mus musculus
gcaccctaacaaccctggacagaaa

SEQ ID NO: 36624 - DNA, 25 bp, Mus musculus
gcaccctgagagttggtttcaaagg

SEQ ID NO: 36625 - DNA, 25 bp, Mus musculus
gcaccctgcgcccaggagttacaaa

SEQ ID NO: 36626 - DNA, 25 bp, Mus musculus
gcaccctgctcttcagggaggtcag

SEQ ID NO: 36627 - DNA, 25 bp, Mus musculus
gcacccttgggaaaggagagtctag

SEQ ID NO: 36628 - DNA, 25 bp, Mus musculus
gcaccgactacgtccctcgttagtg

SEQ ID NO: 36629 - DNA, 25 bp, Mus musculus
gcaccgcgcccaggtgaggaagaaa

SEQ ID NO: 36630 - DNA, 25 bp, Mus musculus
gcaccggaagctgagaactccacag

SEQ ID NO: 36631 - DNA, 25 bp, Mus musculus
gcaccggaaggaatattcccagagt

SEQ ID NO: 36632 - DNA, 25 bp, Mus musculus
gcaccggcttcagcaggatgagtga

SEQ ID NO: 36633 - DNA, 25 bp, Mus musculus
gcaccgtgaattcagtaaaaccaat

SEQ ID NO: 36634 - DNA, 25 bp, Mus musculus
gcacctcaacagaaagtgctccagc

SEQ ID NO: 36635 - DNA, 25 bp, Mus musculus
gcacctcagtgaagacaaatccaaa

SEQ ID NO: 36636 - DNA, 25 bp, Mus musculus
gcacctccagacatctgaatttcag

SEQ ID NO: 36637 - DNA, 25 bp, Mus musculus
gcacctcgggatgtgaccgaaggcc

SEQ ID NO: 36638 - DNA, 25 bp, Mus musculus
gcacctctcatgtgtctgtgttggg

SEQ ID NO: 36639 - DNA, 25 bp, Mus musculus
gcacctctgtggacatggaaccgga

SEQ ID NO: 36640 - DNA, 25 bp, Mus musculus
gcacctcttctcagtctcagacaag

SEQ ID NO: 36641 - DNA, 25 bp, Mus musculus
gcacctgaaatcaacaatataattg

SEQ ID NO: 36642 - DNA, 25 bp, Mus musculus
gcacctgatcctccaacagttaaaa

SEQ ID NO: 36643 - DNA, 25 bp, Mus musculus
gcacctgatgagtacattgagaaac

SEQ ID NO: 36644 - DNA, 25 bp, Mus musculus
gcacctgatgcagtagaggtgacac

SEQ ID NO: 36645 - DNA, 25 bp, Mus musculus
gcacctgcaggcttcaagtgtccca

SEQ ID NO: 36646 - DNA, 25 bp, Mus musculus
gcacctgcctatcggtgccactgat

SEQ ID NO: 36647 - DNA, 25 bp, Mus musculus
gcacctgctgattcggtaccgcctg

SEQ ID NO: 36648 - DNA, 25 bp, Mus musculus
gcacctggagaagagtgccgtactc

SEQ ID NO: 36649 - DNA, 25 bp, Mus musculus
gcacctggctagagaatcgatttgt

SEQ ID NO: 36650 - DNA, 25 bp, Mus musculus
gcacctgttcagagtcacacaaata

SEQ ID NO: 36651 - DNA, 25 bp, Mus musculus
gcaccttaaggatgtgatcctactg

SEQ ID NO: 36652 - DNA, 25 bp, Mus musculus
gcaccttccggatggctctgctgga

SEQ ID NO: 36653 - DNA, 25 bp, Mus musculus
gcaccttgcacgacattttactaag

SEQ ID NO: 36654 - DNA, 25 bp, Mus musculus
gcaccttggcaattaaacagaatcc

SEQ ID NO: 36655 - DNA, 25 bp, Mus musculus
gcacctttaagcatgaattagacta

SEQ ID NO: 36656 - DNA, 25 bp, Mus musculus
gcacctttaagcttgaattagacta

SEQ ID NO: 36657 - DNA, 25 bp, Mus musculus
gcacctttcctgctactgtttataa

SEQ ID NO: 36658 - DNA, 25 bp, Mus musculus
gcacctttgttgtcagcaggacaga

SEQ ID NO: 36659 - DNA, 25 bp, Mus musculus
gcacgaagtaaagagcgacccgact

SEQ ID NO: 36660 - DNA, 25 bp, Mus musculus
gcacgaccagttcaagcggcgcctt

SEQ ID NO: 36661 - DNA, 25 bp, Mus musculus
gcacgaccgggacaaacataacgag

SEQ ID NO: 36662 - DNA, 25 bp, Mus musculus
gcacgaccgggagaaacataacgag

SEQ ID NO: 36663 - DNA, 25 bp, Mus musculus
gcacgacctatgtatggcttggcag

SEQ ID NO: 36664 - DNA, 25 bp, Mus musculus
gcacgatttcgccatctttggaaaa

SEQ ID NO: 36665 - DNA, 25 bp, Mus musculus
gcacgcatgcatgttgcttagatat

SEQ ID NO: 36666 - DNA, 25 bp, Mus musculus
gcacgctcctgtcaggcgccaaagt

SEQ ID NO: 36667 - DNA, 25 bp, Mus musculus
gcacgctgaccctgagctagagctg

SEQ ID NO: 36668 - DNA, 25 bp, Mus musculus
gcacggataactcagtcataactgt

SEQ ID NO: 36669 - DNA, 25 bp, Mus musculus
gcacggcaatgtgccacttcactat

SEQ ID NO: 36670 - DNA, 25 bp, Mus musculus
gcacggcattgtgtttggaatacaa

SEQ ID NO: 36671 - DNA, 25 bp, Mus musculus
gcacggcgaaaaaatcttctcattc

SEQ ID NO: 36672 - DNA, 25 bp, Mus musculus
gcacggcttttccatggagatgaac

SEQ ID NO: 36673 - DNA, 25 bp, Mus musculus
gcacgggcttcaccttcaagtacag

SEQ ID NO: 36674 - DNA, 25 bp, Mus musculus
gcacgggtgtccagggatatcgcca

SEQ ID NO: 36675 - DNA, 25 bp, Mus musculus
gcacggtagtgggtgacctgttctc

SEQ ID NO: 36676 - DNA, 25 bp, Mus musculus
gcacggtcagaactattgctatgga

SEQ ID NO: 36677 - DNA, 25 bp, Mus musculus
gcacggtgtgtacaaccctaacaag

SEQ ID NO: 36678 - DNA, 25 bp, Mus musculus
gcacggttagacagtgcaccaagaa

SEQ ID NO: 36679 - DNA, 25 bp, Mus musculus
gcacgtcatggtagaaatccaagaa

SEQ ID NO: 36680 - DNA, 25 bp, Mus musculus
gcacgtctgtccgtagcctgctgag

SEQ ID NO: 36681 - DNA, 25 bp, Mus musculus
gcacgtgctgtctctagggctcctc

SEQ ID NO: 36682 - DNA, 25 bp, Mus musculus
gcacgttacaccagtgagatgcgga

SEQ ID NO: 36683 - DNA, 25 bp, Mus musculus
gcacgttcctgcctgagctgggcaa

SEQ ID NO: 36684 - DNA, 25 bp, Mus musculus
gcacgttgaggagtgaactgtccca

SEQ ID NO: 36685 - DNA, 25 bp, Mus musculus
gcacgttgccttgtggaggaactta

SEQ ID NO: 36686 - DNA, 25 bp, Mus musculus
gcactaactgcatatggtactccca

SEQ ID NO: 36687 - DNA, 25 bp, Mus musculus
gcactaaggagcttgaacagagcct

SEQ ID NO: 36688 - DNA, 25 bp, Mus musculus
gcactaataccgctcctggttggcg

SEQ ID NO: 36689 - DNA, 25 bp, Mus musculus
gcactacaatcgaaggacatgtggt

SEQ ID NO: 36690 - DNA, 25 bp, Mus musculus
gcactacagctaaccccaggtgatg

SEQ ID NO: 36691 - DNA, 25 bp, Mus musculus
gcactaccagccgtttgggaaatat

SEQ ID NO: 36692 - DNA, 25 bp, Mus musculus
gcactagacaactcggaaaaacacg

SEQ ID NO: 36693 - DNA, 25 bp, Mus musculus
gcactagcagtcttggcattatgga

SEQ ID NO: 36694 - DNA, 25 bp, Mus musculus
gcactaggtgtttttgctttagccg

SEQ ID NO: 36695 - DNA, 25 bp, Mus musculus
gcactataagactgacttcgacaag

SEQ ID NO: 36696 - DNA, 25 bp, Mus musculus
gcactcaaatctacaggattgcgaa

SEQ ID NO: 36697 - DNA, 25 bp, Mus musculus
gcactcagactacagggccaagctg

SEQ ID NO: 36698 - DNA, 25 bp, Mus musculus
gcactcagactatgtgcacctctgc

SEQ ID NO: 36699 - DNA, 25 bp, Mus musculus
gcactccacagcacagggcgtttta

SEQ ID NO: 36700 - DNA, 25 bp, Mus musculus
gcactccgagccagactctgacaat

SEQ ID NO: 36701 - DNA, 25 bp, Mus musculus
gcactcgctgaagctgctggcagct

SEQ ID NO: 36702 - DNA, 25 bp, Mus musculus
gcactcggagctggatgtgcgcact

SEQ ID NO: 36703 - DNA, 25 bp, Mus musculus
gcactctacaacattggaaatgtgt

SEQ ID NO: 36704 - DNA, 25 bp, Mus musculus
gcactctcccgggaatacaaactag

SEQ ID NO: 36705 - DNA, 25 bp, Mus musculus
gcactcttggcccacctgtatgtgg

SEQ ID NO: 36706 - DNA, 25 bp, Mus musculus
gcactgaagcaacacaaaaccctct

SEQ ID NO: 36707 - DNA, 25 bp, Mus musculus
gcactgaaggttggcaccattttat

SEQ ID NO: 36708 - DNA, 25 bp, Mus musculus
gcactgacttcaagatttccttcct

SEQ ID NO: 36709 - DNA, 25 bp, Mus musculus
gcactgaggcaaagtgtgcagcaca

SEQ ID NO: 36710 - DNA, 25 bp, Mus musculus
gcactgaggtaaattcattctgacg

SEQ ID NO: 36711 - DNA, 25 bp, Mus musculus
gcactgataacactgtcatggctgt

SEQ ID NO: 36712 - DNA, 25 bp, Mus musculus
gcactgatgcactataaagaagcca

SEQ ID NO: 36713 - DNA, 25 bp, Mus musculus
gcactgatggaattggaaaagcata

SEQ ID NO: 36714 - DNA, 25 bp, Mus musculus
gcactgattgaaaatgcagacgctg

SEQ ID NO: 36715 - DNA, 25 bp, Mus musculus
gcactgcatccttgatgtctcagcc

SEQ ID NO: 36716 - DNA, 25 bp, Mus musculus
gcactgccgtgtatggcctcttcag

SEQ ID NO: 36717 - DNA, 25 bp, Mus musculus
gcactgctatgaagactgaaaattg

SEQ ID NO: 36718 - DNA, 25 bp, Mus musculus
gcactgcttcctccagcatctgatg

SEQ ID NO: 36719 - DNA, 25 bp, Mus musculus
gcactggacacgcactactggactt

SEQ ID NO: 36720 - DNA, 25 bp, Mus musculus
gcactggcaggctcttcaaacggcg

SEQ ID NO: 36721 - DNA, 25 bp, Mus musculus
gcactggccgtgctaaacaccattc

SEQ ID NO: 36722 - DNA, 25 bp, Mus musculus
gcactggccttagctgagcgggcct

SEQ ID NO: 36723 - DNA, 25 bp, Mus musculus
gcactggctaatcaagagtgaaaaa

SEQ ID NO: 36724 - DNA, 25 bp, Mus musculus
gcactgggatccacagaacatcacc

SEQ ID NO: 36725 - DNA, 25 bp, Mus musculus
gcactgggcaagttccgggctgccc

SEQ ID NO: 36726 - DNA, 25 bp, Mus musculus
gcactgggccacacaaagccttgct

SEQ ID NO: 36727 - DNA, 25 bp, Mus musculus
gcactgggtttttcgagtgctgacc

SEQ ID NO: 36728 - DNA, 25 bp, Mus musculus
gcactgtccaaggacctgccaaaag

SEQ ID NO: 36729 - DNA, 25 bp, Mus musculus
gcactgtgacgtttctggctggcaa

SEQ ID NO: 36730 - DNA, 25 bp, Mus musculus
gcactgtgagtttcttctcctgaga

SEQ ID NO: 36731 - DNA, 25 bp, Mus musculus
gcactgtgtcaaccatgccaaacag

SEQ ID NO: 36732 - DNA, 25 bp, Mus musculus
gcactgttagggttgaaacaggctg

SEQ ID NO: 36733 - DNA, 25 bp, Mus musculus
gcacttaatgcagctggatatcacg

SEQ ID NO: 36734 - DNA, 25 bp, Mus musculus
gcacttactggtctacacaatagca

SEQ ID NO: 36735 - DNA, 25 bp, Mus musculus
gcacttactggtgtacacaatagca

SEQ ID NO: 36736 - DNA, 25 bp, Mus musculus
gcacttatcattgaatatagaggga

SEQ ID NO: 36737 - DNA, 25 bp, Mus musculus
gcacttcacggcttctttgtaccca

SEQ ID NO: 36738 - DNA, 25 bp, Mus musculus
gcacttcatggtggacacactaaga

SEQ ID NO: 36739 - DNA, 25 bp, Mus musculus
gcacttccgcttcctagtcattgaa

SEQ ID NO: 36740 - DNA, 25 bp, Mus musculus
gcacttctacaacaagtggttctac

SEQ ID NO: 36741 - DNA, 25 bp, Mus musculus
gcacttctactactttgtcaccgag

SEQ ID NO: 36742 - DNA, 25 bp, Mus musculus
gcacttctctatggaactgcagcag

SEQ ID NO: 36743 - DNA, 25 bp, Mus musculus
gcacttctggatccagctgtttggt

SEQ ID NO: 36744 - DNA, 25 bp, Mus musculus
gcacttgatgttccaaacacagcat

SEQ ID NO: 36745 - DNA, 25 bp, Mus musculus
gcacttgcagtacacggactggccc

SEQ ID NO: 36746 - DNA, 25 bp, Mus musculus
gcacttgcttggactatacgacact

SEQ ID NO: 36747 - DNA, 25 bp, Mus musculus
gcacttgctttggattcagaagcca

SEQ ID NO: 36748 - DNA, 25 bp, Mus musculus
gcacttgcttttccagagcagaaaa

SEQ ID NO: 36749 - DNA, 25 bp, Mus musculus
gcactttaataatgcgctccccaaa

SEQ ID NO: 36750 - DNA, 25 bp, Mus musculus
gcactttcagaaggttatgagacaa

SEQ ID NO: 36751 - DNA, 25 bp, Mus musculus
gcactttcatcaaggtgggccagca

SEQ ID NO: 36752 - DNA, 25 bp, Mus musculus
gcactttcttgccagatacaatttc

SEQ ID NO: 36753 - DNA, 25 bp, Mus musculus
gcagaaaaagtccagcaagcggact

SEQ ID NO: 36754 - DNA, 25 bp, Mus musculus
gcagaaaactgaaggcactaaatct

SEQ ID NO: 36755 - DNA, 25 bp, Mus musculus
gcagaaaacttcaccctcttggtaa

SEQ ID NO: 36756 - DNA, 25 bp, Mus musculus
gcagaaaagatagcatctcagatga

SEQ ID NO: 36757 - DNA, 25 bp, Mus musculus
gcagaaaagccggatgaaataacca

SEQ ID NO: 36758 - DNA, 25 bp, Mus musculus
gcagaaaagcctcatgttcatcgag

SEQ ID NO: 36759 - DNA, 25 bp, Mus musculus
gcagaaaatgaggttactagacctt

SEQ ID NO: 36760 - DNA, 25 bp, Mus musculus
gcagaaaatgtaactgtgacaaaga

SEQ ID NO: 36761 - DNA, 25 bp, Mus musculus
gcagaaacgtggaaaaactgtttgg

SEQ ID NO: 36762 - DNA, 25 bp, Mus musculus
gcagaaagcaagtcaaggagaaatg

SEQ ID NO: 36763 - DNA, 25 bp, Mus musculus
gcagaaagcctgtcctggtataaag

SEQ ID NO: 36764 - DNA, 25 bp, Mus musculus
gcagaaatcaatccaagccaactgg

SEQ ID NO: 36765 - DNA, 25 bp, Mus musculus
gcagaaatgatgttggttgattgcc

SEQ ID NO: 36766 - DNA, 25 bp, Mus musculus
gcagaaattcgccaaggatgactcg

SEQ ID NO: 36767 - DNA, 25 bp, Mus musculus
gcagaaattcgcgaaggatgactcg

SEQ ID NO: 36768 - DNA, 25 bp, Mus musculus
gcagaaatttcactacctcttcaaa

SEQ ID NO: 36769 - DNA, 25 bp, Mus musculus
gcagaacaaagtggtggtcatcaca

SEQ ID NO: 36770 - DNA, 25 bp, Mus musculus
gcagaacagtacacttatggccgag

SEQ ID NO: 36771 - DNA, 25 bp, Mus musculus
gcagaacagtgccaatacattgcac

SEQ ID NO: 36772 - DNA, 25 bp, Mus musculus
gcagaacagttcatgccgatcttag

SEQ ID NO: 36773 - DNA, 25 bp, Mus musculus
gcagaaccctgaattgtggccacaa

SEQ ID NO: 36774 - DNA, 25 bp, Mus musculus
gcagaacgccattgtagccaagatg

SEQ ID NO: 36775 - DNA, 25 bp, Mus musculus
gcagaagagaccatcactagcccca

SEQ ID NO: 36776 - DNA, 25 bp, Mus musculus
gcagaagagatatgtttgagatcct

SEQ ID NO: 36777 - DNA, 25 bp, Mus musculus
gcagaagagcccctatggacgacgc

SEQ ID NO: 36778 - DNA, 25 bp, Mus musculus
gcagaagaggcaattaccagtttca

SEQ ID NO: 36779 - DNA, 25 bp, Mus musculus
gcagaagatgacctgaacttcagat

SEQ ID NO: 36780 - DNA, 25 bp, Mus musculus
gcagaagcccatgctaaagtaagat

SEQ ID NO: 36781 - DNA, 25 bp, Mus musculus
gcagaagctagctggccctcgtcgc

SEQ ID NO: 36782 - DNA, 25 bp, Mus musculus
gcagaagctgatggctataactgag

SEQ ID NO: 36783 - DNA, 25 bp, Mus musculus
gcagaagctgctcgagaacattcca

SEQ ID NO: 36784 - DNA, 25 bp, Mus musculus
gcagaagcttcatcacagaagtgaa

SEQ ID NO: 36785 - DNA, 25 bp, Mus musculus
gcagaagcttcgagcctgtttggaa

SEQ ID NO: 36786 - DNA, 25 bp, Mus musculus
gcagaaggaaaagacccgctggctt

SEQ ID NO: 36787 - DNA, 25 bp, Mus musculus
gcagaaggcactttcatcatctcac

SEQ ID NO: 36788 - DNA, 25 bp, Mus musculus
gcagaaggcaggaaagtctctgttg

SEQ ID NO: 36789 - DNA, 25 bp, Mus musculus
gcagaaggtagaagctcagaaacag

SEQ ID NO: 36790 - DNA, 25 bp, Mus musculus
gcagaaggtcatttgccatcttggg

SEQ ID NO: 36791 - DNA, 25 bp, Mus musculus
gcagaagtcaaggagaactgaaagt

SEQ ID NO: 36792 - DNA, 25 bp, Mus musculus
gcagaagtctaaccgctggtcctgg

SEQ ID NO: 36793 - DNA, 25 bp, Mus musculus
gcagaagtgaggatgcaagcaactc

SEQ ID NO: 36794 - DNA, 25 bp, Mus musculus
gcagaataccagagtccttccgtgg

SEQ ID NO: 36795 - DNA, 25 bp, Mus musculus
gcagaatctacaaagcttaataatc

SEQ ID NO: 36796 - DNA, 25 bp, Mus musculus
gcagaatggcgcagaccgccatgtc

SEQ ID NO: 36797 - DNA, 25 bp, Mus musculus
gcagaatggcgctgaccgccatgtc

SEQ ID NO: 36798 - DNA, 25 bp, Mus musculus
gcagaatgtgaggaagaacctggat

SEQ ID NO: 36799 - DNA, 25 bp, Mus musculus
gcagaattccctgctgcatgtacca

SEQ ID NO: 36800 - DNA, 25 bp, Mus musculus
gcagaattgagcaggatctgttaga

SEQ ID NO: 36801 - DNA, 25 bp, Mus musculus
gcagacaacacctctgcctgcttgg

SEQ ID NO: 36802 - DNA, 25 bp, Mus musculus
gcagacaactttgccatgctgggac

SEQ ID NO: 36803 - DNA, 25 bp, Mus musculus
gcagacaagcatggctgtatcatta

SEQ ID NO: 36804 - DNA, 25 bp, Mus musculus
gcagacacacaagagattaatttga

SEQ ID NO: 36805 - DNA, 25 bp, Mus musculus
gcagacagccccattacacatgtaa

SEQ ID NO: 36806 - DNA, 25 bp, Mus musculus
gcagacaggagctctccagcttctt

SEQ ID NO: 36807 - DNA, 25 bp, Mus musculus
gcagacagtggctcggcttcctgag

SEQ ID NO: 36808 - DNA, 25 bp, Mus musculus
gcagacatccttgccgctgtggaaa

SEQ ID NO: 36809 - DNA, 25 bp, Mus musculus
gcagacattatgttacatcaccaga

SEQ ID NO: 36810 - DNA, 25 bp, Mus musculus
gcagaccaaaatcctccagtgttac

SEQ ID NO: 36811 - DNA, 25 bp, Mus musculus
gcagaccagtgtattctaaaaaggg

SEQ ID NO: 36812 - DNA, 25 bp, Mus musculus
gcagaccccgaaaacgcaaacgagg

SEQ ID NO: 36813 - DNA, 25 bp, Mus musculus
gcagacccggtggtcagtgccaaga

SEQ ID NO: 36814 - DNA, 25 bp, Mus musculus
gcagaccttcgtcattcttgccggg

SEQ ID NO: 36815 - DNA, 25 bp, Mus musculus
gcagactaactttttcctgctgcct

SEQ ID NO: 36816 - DNA, 25 bp, Mus musculus
gcagactacatgtgggactcctatc

SEQ ID NO: 36817 - DNA, 25 bp, Mus musculus
gcagactatgactccctgccggagt

SEQ ID NO: 36818 - DNA, 25 bp, Mus musculus
gcagactatgtcttcactagtatct

SEQ ID NO: 36819 - DNA, 25 bp, Mus musculus
gcagactctgctcatactgaattgg

SEQ ID NO: 36820 - DNA, 25 bp, Mus musculus
gcagactgccctcaggaactttcag

SEQ ID NO: 36821 - DNA, 25 bp, Mus musculus
gcagactgggctctactctctctct

SEQ ID NO: 36822 - DNA, 25 bp, Mus musculus
gcagacttctttgaggatgacacca

SEQ ID NO: 36823 - DNA, 25 bp, Mus musculus
gcagactttaatcccagtggttttt

SEQ ID NO: 36824 - DNA, 25 bp, Mus musculus
gcagagaaaagcctttcctggccct

SEQ ID NO: 36825 - DNA, 25 bp, Mus musculus
gcagagaaaatgttcaagggcaaac

SEQ ID NO: 36826 - DNA, 25 bp, Mus musculus
gcagagaaagaaatgcacaatctta

SEQ ID NO: 36827 - DNA, 25 bp, Mus musculus
gcagagaaagataatgctgaaatca

SEQ ID NO: 36828 - DNA, 25 bp, Mus musculus
gcagagaaatggaaagagagcaaag

SEQ ID NO: 36829 - DNA, 25 bp, Mus musculus
gcagagaaatggtaagagagcaaag

SEQ ID NO: 36830 - DNA, 25 bp, Mus musculus
gcagagaacatggatgatatgggca

SEQ ID NO: 36831 - DNA, 25 bp, Mus musculus
gcagagaactcggaagctgagcaga

SEQ ID NO: 36832 - DNA, 25 bp, Mus musculus
gcagagaagaattgatgagttcatt

SEQ ID NO: 36833 - DNA, 25 bp, Mus musculus
gcagagaagacaataccgacggcag

SEQ ID NO: 36834 - DNA, 25 bp, Mus musculus
gcagagaagagctcatacctctatt

SEQ ID NO: 36835 - DNA, 25 bp, Mus musculus
gcagagaaggactgagcacaatcag

SEQ ID NO: 36836 - DNA, 25 bp, Mus musculus
gcagagagatgctgaccagtgtcaa

SEQ ID NO: 36837 - DNA, 25 bp, Mus musculus
gcagagaggagcctggccacaccca

SEQ ID NO: 36838 - DNA, 25 bp, Mus musculus
gcagagagtacctgaacatgatgat

SEQ ID NO: 36839 - DNA, 25 bp, Mus musculus
gcagagatagacctttcccagggtg

SEQ ID NO: 36840 - DNA, 25 bp, Mus musculus
gcagagatgacctccatcttgcgaa

SEQ ID NO: 36841 - DNA, 25 bp, Mus musculus
gcagagatgtggactcgtagcccta

SEQ ID NO: 36842 - DNA, 25 bp, Mus musculus
gcagagatgttgtgagcagtgtacc

SEQ ID NO: 36843 - DNA, 25 bp, Mus musculus
gcagagcacatggaaaccaacatgc

SEQ ID NO: 36844 - DNA, 25 bp, Mus musculus
gcagagcaccgaaggacactggcag

SEQ ID NO: 36845 - DNA, 25 bp, Mus musculus
gcagagcatcctaaggtcaagtctt

SEQ ID NO: 36846 - DNA, 25 bp, Mus musculus
gcagagcatgcccagtgtcagatgt

SEQ ID NO: 36847 - DNA, 25 bp, Mus musculus
gcagagcattctgggtgatggaacc

SEQ ID NO: 36848 - DNA, 25 bp, Mus musculus
gcagagcccacttgcgaccaggaga

SEQ ID NO: 36849 - DNA, 25 bp, Mus musculus
gcagagcccagtcatgactcagcca

SEQ ID NO: 36850 - DNA, 25 bp, Mus musculus
gcagagccctctctccctttagtgg

SEQ ID NO: 36851 - DNA, 25 bp, Mus musculus
gcagagcctcactttgacaaatgta

SEQ ID NO: 36852 - DNA, 25 bp, Mus musculus
gcagagcgcacatttgcatggattt

SEQ ID NO: 36853 - DNA, 25 bp, Mus musculus
gcagagcgcagagagatgctgacca

SEQ ID NO: 36854 - DNA, 25 bp, Mus musculus
gcagagcgctgtccagtctgtttga

SEQ ID NO: 36855 - DNA, 25 bp, Mus musculus
gcagagctaaagatgcggaagcagt

SEQ ID NO: 36856 - DNA, 25 bp, Mus musculus
gcagagctatggaatcccaacatta

SEQ ID NO: 36857 - DNA, 25 bp, Mus musculus
gcagagctcggactgcacatcacac

SEQ ID NO: 36858 - DNA, 25 bp, Mus musculus
gcagagcttgagatgaaagacatcc

SEQ ID NO: 36859 - DNA, 25 bp, Mus musculus
gcagaggaattgtgcagtattggca

SEQ ID NO: 36860 - DNA, 25 bp, Mus musculus
gcagaggagttatgttatacctccg

SEQ ID NO: 36861 - DNA, 25 bp, Mus musculus
gcagaggcacggactagatacttct

SEQ ID NO: 36862 - DNA, 25 bp, Mus musculus
gcagaggcatctaagaagagtgcag

SEQ ID NO: 36863 - DNA, 25 bp, Mus musculus
gcagaggctaccctgaatctcctaa

SEQ ID NO: 36864 - DNA, 25 bp, Mus musculus
gcagaggctaccgtgaatctcctaa

SEQ ID NO: 36865 - DNA, 25 bp, Mus musculus
gcagaggctccagcttcagcagagg

SEQ ID NO: 36866 - DNA, 25 bp, Mus musculus
gcagagggaccttcgagagtatacc

SEQ ID NO: 36867 - DNA, 25 bp, Mus musculus
gcagagggagtgagagattttcacc

SEQ ID NO: 36868 - DNA, 25 bp, Mus musculus
gcagagggagtgtgagattttcacc

SEQ ID NO: 36869 - DNA, 25 bp, Mus musculus
gcagagggcctcagaatgttttcaa

SEQ ID NO: 36870 - DNA, 25 bp, Mus musculus
gcagaggtgtaccacaccctcaagg

SEQ ID NO: 36871 - DNA, 25 bp, Mus musculus
gcagagtatggatatacagtttctt

SEQ ID NO: 36872 - DNA, 25 bp, Mus musculus
gcagagtcacatcttcagcatttac

SEQ ID NO: 36873 - DNA, 25 bp, Mus musculus
gcagagtccagctcagatcctgaag

SEQ ID NO: 36874 - DNA, 25 bp, Mus musculus
gcagagtcccttgaaagcaagcttt

SEQ ID NO: 36875 - DNA, 25 bp, Mus musculus
gcagagtctgagagatgggaattac

SEQ ID NO: 36876 - DNA, 25 bp, Mus musculus
gcagagtgagtgtcccaatgtcgct

SEQ ID NO: 36877 - DNA, 25 bp, Mus musculus
gcagagtggcgatgacagcttcgat

SEQ ID NO: 36878 - DNA, 25 bp, Mus musculus
gcagagtgtcttttggcgctttctt

SEQ ID NO: 36879 - DNA, 25 bp, Mus musculus
gcagagttcctcaggttatctttgg

SEQ ID NO: 36880 - DNA, 25 bp, Mus musculus
gcagatacccctatgagtatgaagg

SEQ ID NO: 36881 - DNA, 25 bp, Mus musculus
gcagatagacaagatgaaggccatt

SEQ ID NO: 36882 - DNA, 25 bp, Mus musculus
gcagatcaacagcacgtttccctct

SEQ ID NO: 36883 - DNA, 25 bp, Mus musculus
gcagatcaatctgtagcaagaaagt

SEQ ID NO: 36884 - DNA, 25 bp, Mus musculus
gcagatcacttgctcacatgtcaag

SEQ ID NO: 36885 - DNA, 25 bp, Mus musculus
gcagatccaaactcggcagcttggg

SEQ ID NO: 36886 - DNA, 25 bp, Mus musculus
gcagatccacagtcaggacgagcct

SEQ ID NO: 36887 - DNA, 25 bp, Mus musculus
gcagatcccataggaaccaacgcag

SEQ ID NO: 36888 - DNA, 25 bp, Mus musculus
gcagatccttgcctgagacggttat

SEQ ID NO: 36889 - DNA, 25 bp, Mus musculus
gcagatcgagaaggaatacactcag

SEQ ID NO: 36890 - DNA, 25 bp, Mus musculus
gcagatcgtcatggcaagagccaag

SEQ ID NO: 36891 - DNA, 25 bp, Mus musculus
gcagatctcctcagtctgtcctcaa

SEQ ID NO: 36892 - DNA, 25 bp, Mus musculus
gcagatcttgacttgtccaggccac

SEQ ID NO: 36893 - DNA, 25 bp, Mus musculus
gcagatgaatcccaaaacatgcagt

SEQ ID NO: 36894 - DNA, 25 bp, Mus musculus
gcagatgactgggaggcaaacaccc

SEQ ID NO: 36895 - DNA, 25 bp, Mus musculus
gcagatgagctggagcggctagtga

SEQ ID NO: 36896 - DNA, 25 bp, Mus musculus
gcagatgaggcccttggcaatgttc

SEQ ID NO: 36897 - DNA, 25 bp, Mus musculus
gcagatgatatcatctccagcatgt

SEQ ID NO: 36898 - DNA, 25 bp, Mus musculus
gcagatgctgccaacatgacaccat

SEQ ID NO: 36899 - DNA, 25 bp, Mus musculus
gcagatggagaaactaaccctacag

SEQ ID NO: 36900 - DNA, 25 bp, Mus musculus
gcagatggccgtccataacctctat

SEQ ID NO: 36901 - DNA, 25 bp, Mus musculus
gcagatggtcctcaacaacctggtg

SEQ ID NO: 36902 - DNA, 25 bp, Mus musculus
gcagatgtggaatggcaacagcaaa

SEQ ID NO: 36903 - DNA, 25 bp, Mus musculus
gcagatgtgtgctaagatgagttcc

SEQ ID NO: 36904 - DNA, 25 bp, Mus musculus
gcagattacgtagaccattccaaga

SEQ ID NO: 36905 - DNA, 25 bp, Mus musculus
gcagattcccaaggcttgattgcat

SEQ ID NO: 36906 - DNA, 25 bp, Mus musculus
gcagattgacaatgccaggctcacg

SEQ ID NO: 36907 - DNA, 25 bp, Mus musculus
gcagattgtctctgggtcccgagac

SEQ ID NO: 36908 - DNA, 25 bp, Mus musculus
gcagatttggcctcaatgaaaagat

SEQ ID NO: 36909 - DNA, 25 bp, Mus musculus
gcagcaaaagcgactcagtagtctt

SEQ ID NO: 36910 - DNA, 25 bp, Mus musculus
gcagcaaaagctggaatccatagca

SEQ ID NO: 36911 - DNA, 25 bp, Mus musculus
gcagcaaacacagcctttgagagca

SEQ ID NO: 36912 - DNA, 25 bp, Mus musculus
gcagcaaagtttgatccttcttcga

SEQ ID NO: 36913 - DNA, 25 bp, Mus musculus
gcagcaaataaggactccccttctg

SEQ ID NO: 36914 - DNA, 25 bp, Mus musculus
gcagcaaatcctattgagtctcagt

SEQ ID NO: 36915 - DNA, 25 bp, Mus musculus
gcagcaaatctgctactctccagca

SEQ ID NO: 36916 - DNA, 25 bp, Mus musculus
gcagcaacaactcctgcaacaagtg

SEQ ID NO: 36917 - DNA, 25 bp, Mus musculus
gcagcaacaacttctgggtacaccc

SEQ ID NO: 36918 - DNA, 25 bp, Mus musculus
gcagcaacagcagatactgcagctc

SEQ ID NO: 36919 - DNA, 25 bp, Mus musculus
gcagcaacagcctgccaggactcat

SEQ ID NO: 36920 - DNA, 25 bp, Mus musculus
gcagcaacggtgacaagagggctcc

SEQ ID NO: 36921 - DNA, 25 bp, Mus musculus
gcagcaacttcacgagcatttgcaa

SEQ ID NO: 36922 - DNA, 25 bp, Mus musculus
gcagcaagacgctggctgttccacc

SEQ ID NO: 36923 - DNA, 25 bp, Mus musculus
gcagcaagcacacagtcgtggcata

SEQ ID NO: 36924 - DNA, 25 bp, Mus musculus
gcagcaagccacaactggcacgtta

SEQ ID NO: 36925 - DNA, 25 bp, Mus musculus
gcagcaataaggagtgccccttcct

SEQ ID NO: 36926 - DNA, 25 bp, Mus musculus
gcagcaattcatctacaggctctgc

SEQ ID NO: 36927 - DNA, 25 bp, Mus musculus
gcagcacaggttttctctccagctc

SEQ ID NO: 36928 - DNA, 25 bp, Mus musculus
gcagcacatccctgcattctgagcg

SEQ ID NO: 36929 - DNA, 25 bp, Mus musculus
gcagcacatcgctgcccagcagaag

SEQ ID NO: 36930 - DNA, 25 bp, Mus musculus
gcagcaccaacttccctgttgtgtg

SEQ ID NO: 36931 - DNA, 25 bp, Mus musculus
gcagcacctccagacatctgaattt

SEQ ID NO: 36932 - DNA, 25 bp, Mus musculus
gcagcacggcttttccatggagatg

SEQ ID NO: 36933 - DNA, 25 bp, Mus musculus
gcagcacgtcatggtagaaatccaa

SEQ ID NO: 36934 - DNA, 25 bp, Mus musculus
gcagcactatgagagacatctggag

SEQ ID NO: 36935 - DNA, 25 bp, Mus musculus
gcagcactcttgcaagatgtcagaa

SEQ ID NO: 36936 - DNA, 25 bp, Mus musculus
gcagcagaaatcctgggaatcaaat

SEQ ID NO: 36937 - DNA, 25 bp, Mus musculus
gcagcagaagcaaagacaagaacca

SEQ ID NO: 36938 - DNA, 25 bp, Mus musculus
gcagcagagaagacaataccgacgg

SEQ ID NO: 36939 - DNA, 25 bp, Mus musculus
gcagcagatcctcaggacaagcact

SEQ ID NO: 36940 - DNA, 25 bp, Mus musculus
gcagcagattgcctgaaacatccag

SEQ ID NO: 36941 - DNA, 25 bp, Mus musculus
gcagcagattgcgtgaaacatccag

SEQ ID NO: 36942 - DNA, 25 bp, Mus musculus
gcagcagatttactgtaaactccag

SEQ ID NO: 36943 - DNA, 25 bp, Mus musculus
gcagcagatttcagacgatgctgga

SEQ ID NO: 36944 - DNA, 25 bp, Mus musculus
gcagcagcaaatcctattgagtctc

SEQ ID NO: 36945 - DNA, 25 bp, Mus musculus
gcagcagcaagacgctggctgttcc

SEQ ID NO: 36946 - DNA, 25 bp, Mus musculus
gcagcagccatgcaattacctggaa

SEQ ID NO: 36947 - DNA, 25 bp, Mus musculus
gcagcagccatggaattacctggaa

SEQ ID NO: 36948 - DNA, 25 bp, Mus musculus
gcagcagcccggtcactgtggttga

SEQ ID NO: 36949 - DNA, 25 bp, Mus musculus
gcagcagccgtggtggatcgataca

SEQ ID NO: 36950 - DNA, 25 bp, Mus musculus
gcagcagctcaattcggcagccaag

SEQ ID NO: 36951 - DNA, 25 bp, Mus musculus
gcagcagctctaggcaaactatgga

SEQ ID NO: 36952 - DNA, 25 bp, Mus musculus
gcagcagctttgatagttctcacgg

SEQ ID NO: 36953 - DNA, 25 bp, Mus musculus
gcagcaggagcaattcgacctctgg

SEQ ID NO: 36954 - DNA, 25 bp, Mus musculus
gcagcaggcgcctttaggtcaacac

SEQ ID NO: 36955 - DNA, 25 bp, Mus musculus
gcagcaggtctcatccctggcgtca

SEQ ID NO: 36956 - DNA, 25 bp, Mus musculus
gcagcagtacgaagccagcagtgtc

SEQ ID NO: 36957 - DNA, 25 bp, Mus musculus
gcagcagtagtggagccccagaccg

SEQ ID NO: 36958 - DNA, 25 bp, Mus musculus
gcagcagtcagcgtcattcagaacc

SEQ ID NO: 36959 - DNA, 25 bp, Mus musculus
gcagcagtcctcttgaggtccccaa

SEQ ID NO: 36960 - DNA, 25 bp, Mus musculus
gcagcagtgatgttttctttaaaaa

SEQ ID NO: 36961 - DNA, 25 bp, Mus musculus
gcagcagttccactgaacccgttga

SEQ ID NO: 36962 - DNA, 25 bp, Mus musculus
gcagcatacaccttacaccttggga

SEQ ID NO: 36963 - DNA, 25 bp, Mus musculus
gcagcatcacatgcgggcaacaggc

SEQ ID NO: 36964 - DNA, 25 bp, Mus musculus
gcagcatcagagcttatcctagaag

SEQ ID NO: 36965 - DNA, 25 bp, Mus musculus
gcagcatcagctacagccagcctgg

SEQ ID NO: 36966 - DNA, 25 bp, Mus musculus
gcagcatcagtgagaaggaggacat

SEQ ID NO: 36967 - DNA, 25 bp, Mus musculus
gcagcatcgttttcctctgtgacct

SEQ ID NO: 36968 - DNA, 25 bp, Mus musculus
gcagcatctagccaggcagttcaag

SEQ ID NO: 36969 - DNA, 25 bp, Mus musculus
gcagcatcttgcaggatgagaagca

SEQ ID NO: 36970 - DNA, 25 bp, Mus musculus
gcagcatcttggtcaaacatttcgg

SEQ ID NO: 36971 - DNA, 25 bp, Mus musculus
gcagcattctgcaaaagttaatgcc

SEQ ID NO: 36972 - DNA, 25 bp, Mus musculus
gcagcattgccattactgtggcggc

SEQ ID NO: 36973 - DNA, 25 bp, Mus musculus
gcagcatttacagaaggcgtttgct

SEQ ID NO: 36974 - DNA, 25 bp, Mus musculus
gcagcatttgatgatgaatggagaa

SEQ ID NO: 36975 - DNA, 25 bp, Mus musculus
gcagcatttgggattggaacaagac

SEQ ID NO: 36976 - DNA, 25 bp, Mus musculus
gcagccaacttagaagacacaaaga

SEQ ID NO: 36977 - DNA, 25 bp, Mus musculus
gcagccagagcccagaccatgttta

SEQ ID NO: 36978 - DNA, 25 bp, Mus musculus
gcagccagatacttcctctccagtg

SEQ ID NO: 36979 - DNA, 25 bp, Mus musculus
gcagccagccagctgtgcacaagct

SEQ ID NO: 36980 - DNA, 25 bp, Mus musculus
gcagccagctcccttaggaatgaca

SEQ ID NO: 36981 - DNA, 25 bp, Mus musculus
gcagccagctccgttaggaatgaca

SEQ ID NO: 36982 - DNA, 25 bp, Mus musculus
gcagccagtggagcgtcatgctact

SEQ ID NO: 36983 - DNA, 25 bp, Mus musculus
gcagccatcccaacgtagtgactta

SEQ ID NO: 36984 - DNA, 25 bp, Mus musculus
gcagccatctacttcactagtggga

SEQ ID NO: 36985 - DNA, 25 bp, Mus musculus
gcagccatcttcctgacctgactgt

SEQ ID NO: 36986 - DNA, 25 bp, Mus musculus
gcagccatgagatctgaggccacag

SEQ ID NO: 36987 - DNA, 25 bp, Mus musculus
gcagcccacaggcagcacatgtgaa

SEQ ID NO: 36988 - DNA, 25 bp, Mus musculus
gcagcccacagggagcacatgtgaa

SEQ ID NO: 36989 - DNA, 25 bp, Mus musculus
gcagcccatccgcttcgtgaaggct

SEQ ID NO: 36990 - DNA, 25 bp, Mus musculus
gcagccccaacctgtttgtccagaa

SEQ ID NO: 36991 - DNA, 25 bp, Mus musculus
gcagccccggatacaggtgactggt

SEQ ID NO: 36992 - DNA, 25 bp, Mus musculus
gcagcccggcacagattgctaagag

SEQ ID NO: 36993 - DNA, 25 bp, Mus musculus
gcagccctacgatcagagctgagag

SEQ ID NO: 36994 - DNA, 25 bp, Mus musculus
gcagccctcaggagatgatgcggcc

SEQ ID NO: 36995 - DNA, 25 bp, Mus musculus
gcagccctgatctggtaactcggaa

SEQ ID NO: 36996 - DNA, 25 bp, Mus musculus
gcagccgataaagtcaactttgcta

SEQ ID NO: 36997 - DNA, 25 bp, Mus musculus
gcagccgcgccagtacttcataggt

SEQ ID NO: 36998 - DNA, 25 bp, Mus musculus
gcagccgctcttcgaaaacattcaa

SEQ ID NO: 36999 - DNA, 25 bp, Mus musculus
gcagccgtatatcttgcctcccatg

SEQ ID NO: 37000 - DNA, 25 bp, Mus musculus
gcagccgtggctgagtccagaacta

SEQ ID NO: 37001 - DNA, 25 bp, Mus musculus
gcagccgttgaatgtctcttctcca

SEQ ID NO: 37002 - DNA, 25 bp, Mus musculus
gcagccgtttggtttcgaacttatc

SEQ ID NO: 37003 - DNA, 25 bp, Mus musculus
gcagccgtttgtgtagcagccactg

SEQ ID NO: 37004 - DNA, 25 bp, Mus musculus
gcagcctacagattgataactgtcg

SEQ ID NO: 37005 - DNA, 25 bp, Mus musculus
gcagcctatgctcttaaacgctgag

SEQ ID NO: 37006 - DNA, 25 bp, Mus musculus
gcagcctatgtgcaaacccagagga

SEQ ID NO: 37007 - DNA, 25 bp, Mus musculus
gcagcctatgtggaaacccagagga

SEQ ID NO: 37008 - DNA, 25 bp, Mus musculus
gcagcctcaggaactaccttgtaaa

SEQ ID NO: 37009 - DNA, 25 bp, Mus musculus
gcagcctcctcactgacatgtatga

SEQ ID NO: 37010 - DNA, 25 bp, Mus musculus
gcagcctcgccacatacctgaagaa

SEQ ID NO: 37011 - DNA, 25 bp, Mus musculus
gcagcctctgaacttcagatcagta

SEQ ID NO: 37012 - DNA, 25 bp, Mus musculus
gcagcctgaacctgtggtacattct

SEQ ID NO: 37013 - DNA, 25 bp, Mus musculus
gcagcctgatcgcttttgccagcta

SEQ ID NO: 37014 - DNA, 25 bp, Mus musculus
gcagcctgatctctctgcacatcta

SEQ ID NO: 37015 - DNA, 25 bp, Mus musculus
gcagcctgggtctcatggactacta

SEQ ID NO: 37016 - DNA, 25 bp, Mus musculus
gcagccttgacattcatagcctgga

SEQ ID NO: 37017 - DNA, 25 bp, Mus musculus
gcagccttgagtgccatggtttctc

SEQ ID NO: 37018 - DNA, 25 bp, Mus musculus
gcagccttgatgtttctgccaagag

SEQ ID NO: 37019 - DNA, 25 bp, Mus musculus
gcagccttggtgaagaaagaaaccc

SEQ ID NO: 37020 - DNA, 25 bp, Mus musculus
gcagcctttggaggatcggctcttc

SEQ ID NO: 37021 - DNA, 25 bp, Mus musculus
gcagcgacagcagagtcatcctgtc

SEQ ID NO: 37022 - DNA, 25 bp, Mus musculus
gcagcgacttctccctggtcttgga

SEQ ID NO: 37023 - DNA, 25 bp, Mus musculus
gcagcgagccagcagatttcaaggt

SEQ ID NO: 37024 - DNA, 25 bp, Mus musculus
gcagcgagccaggagatttcaaggt

SEQ ID NO: 37025 - DNA, 25 bp, Mus musculus
gcagcgagctcacttcttcccagag

SEQ ID NO: 37026 - DNA, 25 bp, Mus musculus
gcagcgatgactgcctttccgtgca

SEQ ID NO: 37027 - DNA, 25 bp, Mus musculus
gcagcgcattacgataatcagaaag

SEQ ID NO: 37028 - DNA, 25 bp, Mus musculus
gcagcgccgtttccgactggaacgt

SEQ ID NO: 37029 - DNA, 25 bp, Mus musculus
gcagcgctgccgagatcatggctgt

SEQ ID NO: 37030 - DNA, 25 bp, Mus musculus
gcagcgctgtgtcaacagcaccagc

SEQ ID NO: 37031 - DNA, 25 bp, Mus musculus
gcagcgctgtgtgaacagcaccagc

SEQ ID NO: 37032 - DNA, 25 bp, Mus musculus
gcagcggaaactctcagcaagctat

SEQ ID NO: 37033 - DNA, 25 bp, Mus musculus
gcagcggctgcaggttctggactat

SEQ ID NO: 37034 - DNA, 25 bp, Mus musculus
gcagcgggttacaactcactcgagt

SEQ ID NO: 37035 - DNA, 25 bp, Mus musculus
gcagcggtgacaagatccgattctt

SEQ ID NO: 37036 - DNA, 25 bp, Mus musculus
gcagcgtccaccagaacacagttat

SEQ ID NO: 37037 - DNA, 25 bp, Mus musculus
gcagcgtgccattgatctctataag

SEQ ID NO: 37038 - DNA, 25 bp, Mus musculus
gcagcgtgtcagaccagttctatcg

SEQ ID NO: 37039 - DNA, 25 bp, Mus musculus
gcagcgtttgcaccatttggaagaa

SEQ ID NO: 37040 - DNA, 25 bp, Mus musculus
gcagctaagaacagaggtggagact

SEQ ID NO: 37041 - DNA, 25 bp, Mus musculus
gcagctaaggtgtgtgaaatcactc

SEQ ID NO: 37042 - DNA, 25 bp, Mus musculus
gcagctaatgaaggtgaataacaac

SEQ ID NO: 37043 - DNA, 25 bp, Mus musculus
gcagctacaaccctgtctgacactg

SEQ ID NO: 37044 - DNA, 25 bp, Mus musculus
gcagctacagtctaaagaagtagaa

SEQ ID NO: 37045 - DNA, 25 bp, Mus musculus
gcagctacatccacacgatgccttt

SEQ ID NO: 37046 - DNA, 25 bp, Mus musculus
gcagctacattttggaaaagaaaga

SEQ ID NO: 37047 - DNA, 25 bp, Mus musculus
gcagctaccgctaaaccacagaagt

SEQ ID NO: 37048 - DNA, 25 bp, Mus musculus
gcagctagtcaccagtgtttttgga

SEQ ID NO: 37049 - DNA, 25 bp, Mus musculus
gcagctatgagatgctcgtttccct

SEQ ID NO: 37050 - DNA, 25 bp, Mus musculus
gcagctatggagtctccaaccaagg

SEQ ID NO: 37051 - DNA, 25 bp, Mus musculus
gcagctcagccatctagtactggaa

SEQ ID NO: 37052 - DNA, 25 bp, Mus musculus
gcagctcagccgaatagaccagagg

SEQ ID NO: 37053 - DNA, 25 bp, Mus musculus
gcagctcagtcacctcagcagcgag

SEQ ID NO: 37054 - DNA, 25 bp, Mus musculus
gcagctcatcaccatttgccgtgaa

SEQ ID NO: 37055 - DNA, 25 bp, Mus musculus
gcagctcatctgaaaatctattgga

SEQ ID NO: 37056 - DNA, 25 bp, Mus musculus
gcagctcatctgtggatactgccgt

SEQ ID NO: 37057 - DNA, 25 bp, Mus musculus
gcagctcatgcgcattgagttcaag

SEQ ID NO: 37058 - DNA, 25 bp, Mus musculus
gcagctcatgtcctatattcaactc

SEQ ID NO: 37059 - DNA, 25 bp, Mus musculus
gcagctccaggccttatctgtaggg

SEQ ID NO: 37060 - DNA, 25 bp, Mus musculus
gcagctcccagaatcaaaaaatttg

SEQ ID NO: 37061 - DNA, 25 bp, Mus musculus
gcagctcgtccctcaactgcatgag

SEQ ID NO: 37062 - DNA, 25 bp, Mus musculus
gcagctctaccaagccatcttctat

SEQ ID NO: 37063 - DNA, 25 bp, Mus musculus
gcagctctaggcaaactatggacag

SEQ ID NO: 37064 - DNA, 25 bp, Mus musculus
gcagctctatgtgggaggccaagcc

SEQ ID NO: 37065 - DNA, 25 bp, Mus musculus
gcagctgaacggtctccagagcagc

SEQ ID NO: 37066 - DNA, 25 bp, Mus musculus
gcagctgaactcatggctggcagag

SEQ ID NO: 37067 - DNA, 25 bp, Mus musculus
gcagctgaattgttagaacactgta

SEQ ID NO: 37068 - DNA, 25 bp, Mus musculus
gcagctgacgaactggccttccacg

SEQ ID NO: 37069 - DNA, 25 bp, Mus musculus
gcagctgagaggagaccacaggata

SEQ ID NO: 37070 - DNA, 25 bp, Mus musculus
gcagctgagcctgaccatgatggcc

SEQ ID NO: 37071 - DNA, 25 bp, Mus musculus
gcagctgaggactcctccgcagtgc

SEQ ID NO: 37072 - DNA, 25 bp, Mus musculus
gcagctgatgcttacgctcccctta

SEQ ID NO: 37073 - DNA, 25 bp, Mus musculus
gcagctgattctgtgcagcagagaa

SEQ ID NO: 37074 - DNA, 25 bp, Mus musculus
gcagctgcaatgacctgtcccagta

SEQ ID NO: 37075 - DNA, 25 bp, Mus musculus
gcagctgcatacagaaagatccttt

SEQ ID NO: 37076 - DNA, 25 bp, Mus musculus
gcagctgcctcctcgtggaggacca

SEQ ID NO: 37077 - DNA, 25 bp, Mus musculus
gcagctgctgaatcacaggccgatg

SEQ ID NO: 37078 - DNA, 25 bp, Mus musculus
gcagctgctgaatgtcaaggcccac

SEQ ID NO: 37079 - DNA, 25 bp, Mus musculus
gcagctgctttggttgacttgggcc

SEQ ID NO: 37080 - DNA, 25 bp, Mus musculus
gcagctggacaacatgaagattgag

SEQ ID NO: 37081 - DNA, 25 bp, Mus musculus
gcagctggacacttgccactgtgag

SEQ ID NO: 37082 - DNA, 25 bp, Mus musculus
gcagctggagaaaggtgatgtcaac

SEQ ID NO: 37083 - DNA, 25 bp, Mus musculus
gcagctggcaatcatccagattcac

SEQ ID NO: 37084 - DNA, 25 bp, Mus musculus
gcagctggcactagtttggaccgac

SEQ ID NO: 37085 - DNA, 25 bp, Mus musculus
gcagctggcacttgtttggaccgac

SEQ ID NO: 37086 - DNA, 25 bp, Mus musculus
gcagctggccaatcttcaggaatcc

SEQ ID NO: 37087 - DNA, 25 bp, Mus musculus
gcagctggcttgcagctgatgctta

SEQ ID NO: 37088 - DNA, 25 bp, Mus musculus
gcagctggggtttgacatctcagaa

SEQ ID NO: 37089 - DNA, 25 bp, Mus musculus
gcagctgggtgatggctccttccac

SEQ ID NO: 37090 - DNA, 25 bp, Mus musculus
gcagctggtgccaaagagggaccat

SEQ ID NO: 37091 - DNA, 25 bp, Mus musculus
gcagctgtcaatgacactccgaggg

SEQ ID NO: 37092 - DNA, 25 bp, Mus musculus
gcagctgtcatcttttgaaacggaa

SEQ ID NO: 37093 - DNA, 25 bp, Mus musculus
gcagcttactttgaactgaatcacc

SEQ ID NO: 37094 - DNA, 25 bp, Mus musculus
gcagcttatcacaaggcactcagtt

SEQ ID NO: 37095 - DNA, 25 bp, Mus musculus
gcagcttatgatgccattcttgaaa

SEQ ID NO: 37096 - DNA, 25 bp, Mus musculus
gcagcttcatatgatcagttgttaa

SEQ ID NO: 37097 - DNA, 25 bp, Mus musculus
gcagcttctattgccaacattgtta

SEQ ID NO: 37098 - DNA, 25 bp, Mus musculus
gcagcttctgctagaatcgcagtct

SEQ ID NO: 37099 - DNA, 25 bp, Mus musculus
gcagcttgaagcctatgagcccgtg

SEQ ID NO: 37100 - DNA, 25 bp, Mus musculus
gcagcttgacggatagtggcatcca

SEQ ID NO: 37101 - DNA, 25 bp, Mus musculus
gcagcttgcaaactgacctctggga

SEQ ID NO: 37102 - DNA, 25 bp, Mus musculus
gcagcttgcaaagtgacctctggga

SEQ ID NO: 37103 - DNA, 25 bp, Mus musculus
gcagcttggtgtcccctgcagcttg

SEQ ID NO: 37104 - DNA, 25 bp, Mus musculus
gcagcttgtaagtctattctggaga

SEQ ID NO: 37105 - DNA, 25 bp, Mus musculus
gcagctttctgccatggtccagcat

SEQ ID NO: 37106 - DNA, 25 bp, Mus musculus
gcagctttgactcctggagctcttt

SEQ ID NO: 37107 - DNA, 25 bp, Mus musculus
gcagcttttctctatggagggcttt

SEQ ID NO: 37108 - DNA, 25 bp, Mus musculus
gcagctttttgtcaatccattatga

SEQ ID NO: 37109 - DNA, 25 bp, Mus musculus
gcaggaaagcattgcactggctaat

SEQ ID NO: 37110 - DNA, 25 bp, Mus musculus
gcaggaaaggatcaccaccaccaag

SEQ ID NO: 37111 - DNA, 25 bp, Mus musculus
gcaggaaatcctcactccgttgttc

SEQ ID NO: 37112 - DNA, 25 bp, Mus musculus
gcaggaacacagagggctccttcca

SEQ ID NO: 37113 - DNA, 25 bp, Mus musculus
gcaggaagacatacctgtacttctg

SEQ ID NO: 37114 - DNA, 25 bp, Mus musculus
gcaggaagagaaatgtggaacactg

SEQ ID NO: 37115 - DNA, 25 bp, Mus musculus
gcaggaagcactgatgcactataaa

SEQ ID NO: 37116 - DNA, 25 bp, Mus musculus
gcaggaattcttacctgtgcttcag

SEQ ID NO: 37117 - DNA, 25 bp, Mus musculus
gcaggacaccttatgatgagtcaca

SEQ ID NO: 37118 - DNA, 25 bp, Mus musculus
gcaggacagcttccggtgcttgtac

SEQ ID NO: 37119 - DNA, 25 bp, Mus musculus
gcaggacagcttcgaatacattaac

SEQ ID NO: 37120 - DNA, 25 bp, Mus musculus
gcaggaccagaaaaggacaggttcc

SEQ ID NO: 37121 - DNA, 25 bp, Mus musculus
gcaggaccagacagacatcatcttt

SEQ ID NO: 37122 - DNA, 25 bp, Mus musculus
gcaggaccgggaagcgttttatata

SEQ ID NO: 37123 - DNA, 25 bp, Mus musculus
gcaggacctgatctcacagaatctg

SEQ ID NO: 37124 - DNA, 25 bp, Mus musculus
gcaggacctgctgcgccagggcaat

SEQ ID NO: 37125 - DNA, 25 bp, Mus musculus
gcaggacggctccactatccatatc

SEQ ID NO: 37126 - DNA, 25 bp, Mus musculus
gcaggacgggctaagggcacttcta

SEQ ID NO: 37127 - DNA, 25 bp, Mus musculus
gcaggacgtacagggcatgtctgaa

SEQ ID NO: 37128 - DNA, 25 bp, Mus musculus
gcaggacttggaactggaagaatga

SEQ ID NO: 37129 - DNA, 25 bp, Mus musculus
gcaggagaaacttcagtcttggctg

SEQ ID NO: 37130 - DNA, 25 bp, Mus musculus
gcaggagaaatggatgcacccgtcc

SEQ ID NO: 37131 - DNA, 25 bp, Mus musculus
gcaggagacatttccctcgagagca

SEQ ID NO: 37132 - DNA, 25 bp, Mus musculus
gcaggagactgaacatgttggaaag

SEQ ID NO: 37133 - DNA, 25 bp, Mus musculus
gcaggagagttctcaggcagcctcg

SEQ ID NO: 37134 - DNA, 25 bp, Mus musculus
gcaggagatcacacaacattttgct

SEQ ID NO: 37135 - DNA, 25 bp, Mus musculus
gcaggagatccgctcactcttcgag

SEQ ID NO: 37136 - DNA, 25 bp, Mus musculus
gcaggagattcccatccacgtttct

SEQ ID NO: 37137 - DNA, 25 bp, Mus musculus
gcaggagcacatttccctttcatga

SEQ ID NO: 37138 - DNA, 25 bp, Mus musculus
gcaggagcagttccataggcagatc

SEQ ID NO: 37139 - DNA, 25 bp, Mus musculus
gcaggagcatcaaccacaggctggg

SEQ ID NO: 37140 - DNA, 25 bp, Mus musculus
gcaggagcgtttcttcatgccggcc

SEQ ID NO: 37141 - DNA, 25 bp, Mus musculus
gcaggagctgccaagtgtccaggct

SEQ ID NO: 37142 - DNA, 25 bp, Mus musculus
gcaggagcttgatgacctaatgcag

SEQ ID NO: 37143 - DNA, 25 bp, Mus musculus
gcaggaggacttcaagacgacagtt

SEQ ID NO: 37144 - DNA, 25 bp, Mus musculus
gcaggaggattgttaccagtgtaag

SEQ ID NO: 37145 - DNA, 25 bp, Mus musculus
gcaggaggcacagaaaatcttcaaa

SEQ ID NO: 37146 - DNA, 25 bp, Mus musculus
gcaggagtgcctacgacaggccagt

SEQ ID NO: 37147 - DNA, 25 bp, Mus musculus
gcaggagtgtatccagcagaccaca

SEQ ID NO: 37148 - DNA, 25 bp, Mus musculus
gcaggagtttaagcagaaaaaggca

SEQ ID NO: 37149 - DNA, 25 bp, Mus musculus
gcaggatattgagaccctacatggc

SEQ ID NO: 37150 - DNA, 25 bp, Mus musculus
gcaggatcctagcatgaatcttcag

SEQ ID NO: 37151 - DNA, 25 bp, Mus musculus
gcaggatcgatggtgtagaaactct

SEQ ID NO: 37152 - DNA, 25 bp, Mus musculus
gcaggatctctatcactgagctgta

SEQ ID NO: 37153 - DNA, 25 bp, Mus musculus
gcaggatggtggtgacgttcctcat

SEQ ID NO: 37154 - DNA, 25 bp, Mus musculus
gcaggattgctgaatggtctggcca

SEQ ID NO: 37155 - DNA, 25 bp, Mus musculus
gcaggatttcgtacttgctcacaga

SEQ ID NO: 37156 - DNA, 25 bp, Mus musculus
gcaggcactccgcaacatgatcaat

SEQ ID NO: 37157 - DNA, 25 bp, Mus musculus
gcaggcagaaggaccatgcacttat

SEQ ID NO: 37158 - DNA, 25 bp, Mus musculus
gcaggcagaattggtcttttgtctc

SEQ ID NO: 37159 - DNA, 25 bp, Mus musculus
gcaggcagcaatgaacatagtcaac

SEQ ID NO: 37160 - DNA, 25 bp, Mus musculus
gcaggcagcatcgtcttgaaggtgc

SEQ ID NO: 37161 - DNA, 25 bp, Mus musculus
gcaggcagctgaaaggactgtgcaa

SEQ ID NO: 37162 - DNA, 25 bp, Mus musculus
gcaggcaggcctctcaagatgctct

SEQ ID NO: 37163 - DNA, 25 bp, Mus musculus
gcaggcatcaaagtgcagatccaca

SEQ ID NO: 37164 - DNA, 25 bp, Mus musculus
gcaggcattgttagacttggccagg

SEQ ID NO: 37165 - DNA, 25 bp, Mus musculus
gcaggccaacaatagaaggttcaac

SEQ ID NO: 37166 - DNA, 25 bp, Mus musculus
gcaggccattgtggataaagtatcc

SEQ ID NO: 37167 - DNA, 25 bp, Mus musculus
gcaggcccaggcagaagacctggat

SEQ ID NO: 37168 - DNA, 25 bp, Mus musculus
gcaggcccttggagacccaatgact

SEQ ID NO: 37169 - DNA, 25 bp, Mus musculus
gcaggcccttggtgacccaatgact

SEQ ID NO: 37170 - DNA, 25 bp, Mus musculus
gcaggcctcctcagaaacaaactta

SEQ ID NO: 37171 - DNA, 25 bp, Mus musculus
gcaggcctgcattgaggccaagcac

SEQ ID NO: 37172 - DNA, 25 bp, Mus musculus
gcaggcgaagctacagctgcgctac

SEQ ID NO: 37173 - DNA, 25 bp, Mus musculus
gcaggcgctcaccattagggagctt

SEQ ID NO: 37174 - DNA, 25 bp, Mus musculus
gcaggctaccgccacattgattgtg

SEQ ID NO: 37175 - DNA, 25 bp, Mus musculus
gcaggctccgcctctataatagcct

SEQ ID NO: 37176 - DNA, 25 bp, Mus musculus
gcaggctcctctacaggcattatgg

SEQ ID NO: 37177 - DNA, 25 bp, Mus musculus
gcaggctgcaaggagcaacagcgat

SEQ ID NO: 37178 - DNA, 25 bp, Mus musculus
gcaggctggagcttgggcacctctc

SEQ ID NO: 37179 - DNA, 25 bp, Mus musculus
gcaggctgtcgcttcttccatcaac

SEQ ID NO: 37180 - DNA, 25 bp, Mus musculus
gcaggctgtgctgtatgccaaggct

SEQ ID NO: 37181 - DNA, 25 bp, Mus musculus
gcagggaagctgatgacattgtcaa

SEQ ID NO: 37182 - DNA, 25 bp, Mus musculus
gcagggaatccctccgagtgtaaga

SEQ ID NO: 37183 - DNA, 25 bp, Mus musculus
gcagggaatggaacaattatatacc

SEQ ID NO: 37184 - DNA, 25 bp, Mus musculus
gcagggactcgtgaaacagcaggat

SEQ ID NO: 37185 - DNA, 25 bp, Mus musculus
gcagggagaacagcgacaaacacct

SEQ ID NO: 37186 - DNA, 25 bp, Mus musculus
gcagggagcttgatttctatgttca

SEQ ID NO: 37187 - DNA, 25 bp, Mus musculus
gcagggaggttatgaggcttaataa

SEQ ID NO: 37188 - DNA, 25 bp, Mus musculus
gcagggcatcctctttggttaccga

SEQ ID NO: 37189 - DNA, 25 bp, Mus musculus
gcagggccagggttgccacagcttc

SEQ ID NO: 37190 - DNA, 25 bp, Mus musculus
gcagggccatgacaaagacctacag

SEQ ID NO: 37191 - DNA, 25 bp, Mus musculus
gcagggcctggcctacaatactgga

SEQ ID NO: 37192 - DNA, 25 bp, Mus musculus
gcagggcttcactcactcgactgcg

SEQ ID NO: 37193 - DNA, 25 bp, Mus musculus
gcagggtcaaggttcctagaatcca

SEQ ID NO: 37194 - DNA, 25 bp, Mus musculus
gcagggtcccatctggacgtttcct

SEQ ID NO: 37195 - DNA, 25 bp, Mus musculus
gcagggtcctatttgactaccaacc

SEQ ID NO: 37196 - DNA, 25 bp, Mus musculus
gcagggtgaagaaactcgcttgcac

SEQ ID NO: 37197 - DNA, 25 bp, Mus musculus
gcaggtagcctttctccagtcagct

SEQ ID NO: 37198 - DNA, 25 bp, Mus musculus
gcaggtagtgccaggacatttggat

SEQ ID NO: 37199 - DNA, 25 bp, Mus musculus
gcaggtcccaagataaactgaatca

SEQ ID NO: 37200 - DNA, 25 bp, Mus musculus
gcaggtctctgctgccgcctagtag

SEQ ID NO: 37201 - DNA, 25 bp, Mus musculus
gcaggtctgatatatgcatctataa

SEQ ID NO: 37202 - DNA, 25 bp, Mus musculus
gcaggtgatcctggagcagatcctc

SEQ ID NO: 37203 - DNA, 25 bp, Mus musculus
gcaggtgctccgtgtcggcagtaaa

SEQ ID NO: 37204 - DNA, 25 bp, Mus musculus
gcaggtgctgttatcaatcggatga

SEQ ID NO: 37205 - DNA, 25 bp, Mus musculus
gcaggtggaagccagcttacaacca

SEQ ID NO: 37206 - DNA, 25 bp, Mus musculus
gcaggtggataaacaggacacagag

SEQ ID NO: 37207 - DNA, 25 bp, Mus musculus
gcaggtggtgaatggctaccgccac

SEQ ID NO: 37208 - DNA, 25 bp, Mus musculus
gcaggtggtggcatttcatctctca

SEQ ID NO: 37209 - DNA, 25 bp, Mus musculus
gcaggtgtccttcttggaggaacat

SEQ ID NO: 37210 - DNA, 25 bp, Mus musculus
gcaggtgtgggtgacctttatctca

SEQ ID NO: 37211 - DNA, 25 bp, Mus musculus
gcaggtgttcttactgatggagcag

SEQ ID NO: 37212 - DNA, 25 bp, Mus musculus
gcaggtgttgtttgacaaatactca

SEQ ID NO: 37213 - DNA, 25 bp, Mus musculus
gcaggttaaccaggaaaagcaggaa

SEQ ID NO: 37214 - DNA, 25 bp, Mus musculus
gcaggttaagctggcactggccgtt

SEQ ID NO: 37215 - DNA, 25 bp, Mus musculus
gcagtaaatgagcttctaaataaat

SEQ ID NO: 37216 - DNA, 25 bp, Mus musculus
gcagtaatgtgtgataccgtgctca

SEQ ID NO: 37217 - DNA, 25 bp, Mus musculus
gcagtacatattggctggagtcagt

SEQ ID NO: 37218 - DNA, 25 bp, Mus musculus
gcagtaccaagcctgggatgctact

SEQ ID NO: 37219 - DNA, 25 bp, Mus musculus
gcagtacctcagagcgtttgtcacc

SEQ ID NO: 37220 - DNA, 25 bp, Mus musculus
gcagtaccttcaccaacctcaagta

SEQ ID NO: 37221 - DNA, 25 bp, Mus musculus
gcagtactacgtgcgagaccaggtg

SEQ ID NO: 37222 - DNA, 25 bp, Mus musculus
gcagtactgtagatggtctcaaagc

SEQ ID NO: 37223 - DNA, 25 bp, Mus musculus
gcagtagagagcgtagaaccggtct

SEQ ID NO: 37224 - DNA, 25 bp, Mus musculus
gcagtagattggcaaaatataggac

SEQ ID NO: 37225 - DNA, 25 bp, Mus musculus
gcagtagcagtgtcagttcagagaa

SEQ ID NO: 37226 - DNA, 25 bp, Mus musculus
gcagtagcattctagctgacagaat

SEQ ID NO: 37227 - DNA, 25 bp, Mus musculus
gcagtagcctcattcacctcatatt

SEQ ID NO: 37228 - DNA, 25 bp, Mus musculus
gcagtagctctgttgtcacacattc

SEQ ID NO: 37229 - DNA, 25 bp, Mus musculus
gcagtaggaattctaatgtctagtc

SEQ ID NO: 37230 - DNA, 25 bp, Mus musculus
gcagtaggtggtggtttccttcttc

SEQ ID NO: 37231 - DNA, 25 bp, Mus musculus
gcagtagtagtcatcccagggttca

SEQ ID NO: 37232 - DNA, 25 bp, Mus musculus
gcagtagtgtgtgtagaaagcgaaa

SEQ ID NO: 37233 - DNA, 25 bp, Mus musculus
gcagtataacaaagaagaccctacg

SEQ ID NO: 37234 - DNA, 25 bp, Mus musculus
gcagtatatggtgcgatccaggaca

SEQ ID NO: 37235 - DNA, 25 bp, Mus musculus
gcagtatattctttacacaagtcct

SEQ ID NO: 37236 - DNA, 25 bp, Mus musculus
gcagtatgaacacaccgtgcaggtc

SEQ ID NO: 37237 - DNA, 25 bp, Mus musculus
gcagtatgtgtcacacagcgactcc

SEQ ID NO: 37238 - DNA, 25 bp, Mus musculus
gcagtatgtgtgctttccgttggac

SEQ ID NO: 37239 - DNA, 25 bp, Mus musculus
gcagtattacctcgccagctgtgga

SEQ ID NO: 37240 - DNA, 25 bp, Mus musculus
gcagtcaacagcatcacctatgtcc

SEQ ID NO: 37241 - DNA, 25 bp, Mus musculus
gcagtcaacccaagaaagtggctgg

SEQ ID NO: 37242 - DNA, 25 bp, Mus musculus
gcagtcaactgcagcctgttttcag

SEQ ID NO: 37243 - DNA, 25 bp, Mus musculus
gcagtcacacaaagagcatctcatt

SEQ ID NO: 37244 - DNA, 25 bp, Mus musculus
gcagtcagcagtctgcggagctttt

SEQ ID NO: 37245 - DNA, 25 bp, Mus musculus
gcagtcagggacgtgcctacctctt

SEQ ID NO: 37246 - DNA, 25 bp, Mus musculus
gcagtcaggttcacaagaaaagcac

SEQ ID NO: 37247 - DNA, 25 bp, Mus musculus
gcagtcccaagaaatgttttgaagg

SEQ ID NO: 37248 - DNA, 25 bp, Mus musculus
gcagtcccagttgcctaaaggccta

SEQ ID NO: 37249 - DNA, 25 bp, Mus musculus
gcagtcccgcaaacaacttatcagt

SEQ ID NO: 37250 - DNA, 25 bp, Mus musculus
gcagtccctaaaaattacaagctgg

SEQ ID NO: 37251 - DNA, 25 bp, Mus musculus
gcagtcctcgtcctcaaagagcatc

SEQ ID NO: 37252 - DNA, 25 bp, Mus musculus
gcagtcctgattacagatggatcag

SEQ ID NO: 37253 - DNA, 25 bp, Mus musculus
gcagtcctggctattccagagcttg

SEQ ID NO: 37254 - DNA, 25 bp, Mus musculus
gcagtcgagcccgtatttcacacac

SEQ ID NO: 37255 - DNA, 25 bp, Mus musculus
gcagtcgctctgatgagctatccgt

SEQ ID NO: 37256 - DNA, 25 bp, Mus musculus
gcagtcgtgcgctttcccaggcttt

SEQ ID NO: 37257 - DNA, 25 bp, Mus musculus
gcagtctaaagtcatcctcgccatc

SEQ ID NO: 37258 - DNA, 25 bp, Mus musculus
gcagtctagggcacgttacaccagt

SEQ ID NO: 37259 - DNA, 25 bp, Mus musculus
gcagtctattccaggcatgcataat

SEQ ID NO: 37260 - DNA, 25 bp, Mus musculus
gcagtctccccttggtaattggtcc

SEQ ID NO: 37261 - DNA, 25 bp, Mus musculus
gcagtctcctgacttatggccgccg

SEQ ID NO: 37262 - DNA, 25 bp, Mus musculus
gcagtctgaggcttcagataccacg

SEQ ID NO: 37263 - DNA, 25 bp, Mus musculus
gcagtcttagaaaaggcccttcccg

SEQ ID NO: 37264 - DNA, 25 bp, Mus musculus
gcagtcttcagcctattatcaaaac

SEQ ID NO: 37265 - DNA, 25 bp, Mus musculus
gcagtgaaagaagacggacttttgt

SEQ ID NO: 37266 - DNA, 25 bp, Mus musculus
gcagtgaacaaacagtacatctctg

SEQ ID NO: 37267 - DNA, 25 bp, Mus musculus
gcagtgaagcaacccatagaacccg

SEQ ID NO: 37268 - DNA, 25 bp, Mus musculus
gcagtgaccattcctgtggctccaa

SEQ ID NO: 37269 - DNA, 25 bp, Mus musculus
gcagtgagcgctcctatcagcatat

SEQ ID NO: 37270 - DNA, 25 bp, Mus musculus
gcagtgagcttgtcagacaagaaag

SEQ ID NO: 37271 - DNA, 25 bp, Mus musculus
gcagtgaggcgtccccaatgtcttt

SEQ ID NO: 37272 - DNA, 25 bp, Mus musculus
gcagtgagtactggctctatgacct

SEQ ID NO: 37273 - DNA, 25 bp, Mus musculus
gcagtgatacacctgggagctccaa

SEQ ID NO: 37274 - DNA, 25 bp, Mus musculus
gcagtgatggcgactggtcattgca

SEQ ID NO: 37275 - DNA, 25 bp, Mus musculus
gcagtgatggctactacgtggccct

SEQ ID NO: 37276 - DNA, 25 bp, Mus musculus
gcagtgcaggcattactaaacgaac

SEQ ID NO: 37277 - DNA, 25 bp, Mus musculus
gcagtgcagttgcaacacctgccag

SEQ ID NO: 37278 - DNA, 25 bp, Mus musculus
gcagtgccagcataaagccgcacga

SEQ ID NO: 37279 - DNA, 25 bp, Mus musculus
gcagtgccctgaaaaccctctgaga

SEQ ID NO: 37280 - DNA, 25 bp, Mus musculus
gcagtgccgctcagggcctcagtgt

SEQ ID NO: 37281 - DNA, 25 bp, Mus musculus
gcagtgcctacctctacaagcaggg

SEQ ID NO: 37282 - DNA, 25 bp, Mus musculus
gcagtgctgaagagttggacctcat

SEQ ID NO: 37283 - DNA, 25 bp, Mus musculus
gcagtggaggattacttcatcgcca

SEQ ID NO: 37284 - DNA, 25 bp, Mus musculus
gcagtggccataaaaaccctgaaag

SEQ ID NO: 37285 - DNA, 25 bp, Mus musculus
gcagtggccttagccttgtgtgcct

SEQ ID NO: 37286 - DNA, 25 bp, Mus musculus
gcagtggctgcgacaggtcagctac

SEQ ID NO: 37287 - DNA, 25 bp, Mus musculus
gcagtggtagcagctacagtggctc

SEQ ID NO: 37288 - DNA, 25 bp, Mus musculus
gcagtggtccttcagcaccatcagc

SEQ ID NO: 37289 - DNA, 25 bp, Mus musculus
gcagtggtcgtttgaaacttccggg

SEQ ID NO: 37290 - DNA, 25 bp, Mus musculus
gcagtggtctcagctctcggacaaa

SEQ ID NO: 37291 - DNA, 25 bp, Mus musculus
gcagtggttctgcactcgcctctca

SEQ ID NO: 37292 - DNA, 25 bp, Mus musculus
gcagtgtcaccgaccttgccttcaa

SEQ ID NO: 37293 - DNA, 25 bp, Mus musculus
gcagtgtccgtagctattgtagacg

SEQ ID NO: 37294 - DNA, 25 bp, Mus musculus
gcagtgtctgccgttgtctatatta

SEQ ID NO: 37295 - DNA, 25 bp, Mus musculus
gcagtgtcttgcaatggctcttcag

SEQ ID NO: 37296 - DNA, 25 bp, Mus musculus
gcagtgtgacaaggagagggttcca

SEQ ID NO: 37297 - DNA, 25 bp, Mus musculus
gcagtgtgtgttcgaagcccatcat

SEQ ID NO: 37298 - DNA, 25 bp, Mus musculus
gcagtgttaaaactgaacgagcagg

SEQ ID NO: 37299 - DNA, 25 bp, Mus musculus
gcagtgtttgtgatcctctttgccc

SEQ ID NO: 37300 - DNA, 25 bp, Mus musculus
gcagtgtttgtgcaaccctgcccag

SEQ ID NO: 37301 - DNA, 25 bp, Mus musculus
gcagtgtttgtggaaccctgcccag

SEQ ID NO: 37302 - DNA, 25 bp, Mus musculus
gcagttaactgccagggacctgctc

SEQ ID NO: 37303 - DNA, 25 bp, Mus musculus
gcagttaatagctcgcctaacaaag

SEQ ID NO: 37304 - DNA, 25 bp, Mus musculus
gcagttacagcagcatacagcattt

SEQ ID NO: 37305 - DNA, 25 bp, Mus musculus
gcagttatacgacggctacgatgag

SEQ ID NO: 37306 - DNA, 25 bp, Mus musculus
gcagttatggatcaaagagggcact

SEQ ID NO: 37307 - DNA, 25 bp, Mus musculus
gcagttcagcatagagaacagcact

SEQ ID NO: 37308 - DNA, 25 bp, Mus musculus
gcagttcagcatgaggacactataa

SEQ ID NO: 37309 - DNA, 25 bp, Mus musculus
gcagttcaggcattgagatgctgga

SEQ ID NO: 37310 - DNA, 25 bp, Mus musculus
gcagttccactgaacccgttgatga

SEQ ID NO: 37311 - DNA, 25 bp, Mus musculus
gcagttccaggcacagctgttcgac

SEQ ID NO: 37312 - DNA, 25 bp, Mus musculus
gcagttccctgaccagttactagga

SEQ ID NO: 37313 - DNA, 25 bp, Mus musculus
gcagttccttttagtctagacagcg

SEQ ID NO: 37314 - DNA, 25 bp, Mus musculus
gcagttcggcagtatctgttttctc

SEQ ID NO: 37315 - DNA, 25 bp, Mus musculus
gcagttcgtggtgatcagccttcct

SEQ ID NO: 37316 - DNA, 25 bp, Mus musculus
gcagttctgcaagtagtagtgccac

SEQ ID NO: 37317 - DNA, 25 bp, Mus musculus
gcagttctgcctgggcttccatcag

SEQ ID NO: 37318 - DNA, 25 bp, Mus musculus
gcagttgaacactgctggaagaaat

SEQ ID NO: 37319 - DNA, 25 bp, Mus musculus
gcagttgaatatggcaccaaagaac

SEQ ID NO: 37320 - DNA, 25 bp, Mus musculus
gcagttgatgacgagatggcactca

SEQ ID NO: 37321 - DNA, 25 bp, Mus musculus
gcagttgcacctcctgatggtgaat

SEQ ID NO: 37322 - DNA, 25 bp, Mus musculus
gcagttggacactacactcaagttc

SEQ ID NO: 37323 - DNA, 25 bp, Mus musculus
gcagttgtgaactgcttgagtccag

SEQ ID NO: 37324 - DNA, 25 bp, Mus musculus
gcagttgttggctccaacacagatg

SEQ ID NO: 37325 - DNA, 25 bp, Mus musculus
gcagttgtttagactgccgtctgca

SEQ ID NO: 37326 - DNA, 25 bp, Mus musculus
gcagtttagatggactaagctgatt

SEQ ID NO: 37327 - DNA, 25 bp, Mus musculus
gcagtttaggacactgcatttactc

SEQ ID NO: 37328 - DNA, 25 bp, Mus musculus
gcagtttatataatctcaggagccc

SEQ ID NO: 37329 - DNA, 25 bp, Mus musculus
gcagtttcctggtcaccacgccatg

SEQ ID NO: 37330 - DNA, 25 bp, Mus musculus
gcagtttctctgttcggtgatcaat

SEQ ID NO: 37331 - DNA, 25 bp, Mus musculus
gcagtttctgcactacatctttccg

SEQ ID NO: 37332 - DNA, 25 bp, Mus musculus
gcagtttgaaggtggcccctgtgct

SEQ ID NO: 37333 - DNA, 25 bp, Mus musculus
gcagtttgcactcgactacgtggag

SEQ ID NO: 37334 - DNA, 25 bp, Mus musculus
gcagtttgccttttactccgtattt

SEQ ID NO: 37335 - DNA, 25 bp, Mus musculus
gcagtttggccctgaagcctgaaga

SEQ ID NO: 37336 - DNA, 25 bp, Mus musculus
gcagtttgttccagactatcaggct

SEQ ID NO: 37337 - DNA, 25 bp, Mus musculus
gcagttttggctggctagggaaccc

SEQ ID NO: 37338 - DNA, 25 bp, Mus musculus
gcataaaccaagagacagtatgtct

SEQ ID NO: 37339 - DNA, 25 bp, Mus musculus
gcataaaggtgctacaagaggctct

SEQ ID NO: 37340 - DNA, 25 bp, Mus musculus
gcataaatacggagaggcagaacat

SEQ ID NO: 37341 - DNA, 25 bp, Mus musculus
gcataagatccctgttgcttgatag

SEQ ID NO: 37342 - DNA, 25 bp, Mus musculus
gcataaggaagctcaagatataaaa

SEQ ID NO: 37343 - DNA, 25 bp, Mus musculus
gcataataatatagaaaactggtct

SEQ ID NO: 37344 - DNA, 25 bp, Mus musculus
gcataataatattgaaaactggtct

SEQ ID NO: 37345 - DNA, 25 bp, Mus musculus
gcataatcttctagataaaccacag

SEQ ID NO: 37346 - DNA, 25 bp, Mus musculus
gcatacacagactacagtgactcgg

SEQ ID NO: 37347 - DNA, 25 bp, Mus musculus
gcatacatcccagggacttgggcag

SEQ ID NO: 37348 - DNA, 25 bp, Mus musculus
gcataccgaaacacagatcccgagt

SEQ ID NO: 37349 - DNA, 25 bp, Mus musculus
gcataccgtcttctcccatgattaa

SEQ ID NO: 37350 - DNA, 25 bp, Mus musculus
gcatacggccacaaaaggaaggaaa

SEQ ID NO: 37351 - DNA, 25 bp, Mus musculus
gcatactggtcgaggactggtacgt

SEQ ID NO: 37352 - DNA, 25 bp, Mus musculus
gcatagaactcaagatgtctgccag

SEQ ID NO: 37353 - DNA, 25 bp, Mus musculus
gcatagaatctgaactgaagcagaa

SEQ ID NO: 37354 - DNA, 25 bp, Mus musculus
gcatagagaacactctgtgggcaag

SEQ ID NO: 37355 - DNA, 25 bp, Mus musculus
gcatagagaatagggcggtgaactt

SEQ ID NO: 37356 - DNA, 25 bp, Mus musculus
gcatagagctcttcataccttccaa

SEQ ID NO: 37357 - DNA, 25 bp, Mus musculus
gcatagcaagctgtctgtgatccac

SEQ ID NO: 37358 - DNA, 25 bp, Mus musculus
gcatagcagtgaggcgtccccaatg

SEQ ID NO: 37359 - DNA, 25 bp, Mus musculus
gcatagccaatcagatgctcttagt

SEQ ID NO: 37360 - DNA, 25 bp, Mus musculus
gcatagcctggtacctccgtgacct

SEQ ID NO: 37361 - DNA, 25 bp, Mus musculus
gcatagctctgctcatatgcagact

SEQ ID NO: 37362 - DNA, 25 bp, Mus musculus
gcatagttctgccacctacggcaag

SEQ ID NO: 37363 - DNA, 25 bp, Mus musculus
gcatataaggatgccatctatgtgt

SEQ ID NO: 37364 - DNA, 25 bp, Mus musculus
gcatatagatgtcttgccctagcac

SEQ ID NO: 37365 - DNA, 25 bp, Mus musculus
gcatatctagatgagttggtagagc

SEQ ID NO: 37366 - DNA, 25 bp, Mus musculus
gcatatctgctgttctttcaagcca

SEQ ID NO: 37367 - DNA, 25 bp, Mus musculus
gcatatcttactgtcggagcagcgg

SEQ ID NO: 37368 - DNA, 25 bp, Mus musculus
gcatatgcatctaatcagccagagt

SEQ ID NO: 37369 - DNA, 25 bp, Mus musculus
gcatatggatcaggctgtgatattg

SEQ ID NO: 37370 - DNA, 25 bp, Mus musculus
gcatatggcggctcggtccggacaa

SEQ ID NO: 37371 - DNA, 25 bp, Mus musculus
gcatatgtctactccaggtccaggg

SEQ ID NO: 37372 - DNA, 25 bp, Mus musculus
gcatattagtccttcaaacatgaca

SEQ ID NO: 37373 - DNA, 25 bp, Mus musculus
gcatattgtcaattgctcctgataa

SEQ ID NO: 37374 - DNA, 25 bp, Mus musculus
gcatatttaattaggctctctggtt

SEQ ID NO: 37375 - DNA, 25 bp, Mus musculus
gcatatttgtccatcttttgccaaa

SEQ ID NO: 37376 - DNA, 25 bp, Mus musculus
gcatcaaagagatcaagactaggtt

SEQ ID NO: 37377 - DNA, 25 bp, Mus musculus
gcatcaagaaaaccgtccttccttg

SEQ ID NO: 37378 - DNA, 25 bp, Mus musculus
gcatcaagaaaagcgtccttccttg

SEQ ID NO: 37379 - DNA, 25 bp, Mus musculus
gcatcaagctgtcaggagctcagta

SEQ ID NO: 37380 - DNA, 25 bp, Mus musculus
gcatcaagttcactaccgtggttga

SEQ ID NO: 37381 - DNA, 25 bp, Mus musculus
gcatcaatacttgtgcaaaggttac

SEQ ID NO: 37382 - DNA, 25 bp, Mus musculus
gcatcaatatgatccacatcagccc

SEQ ID NO: 37383 - DNA, 25 bp, Mus musculus
gcatcaattttacaggcagtgtccc

SEQ ID NO: 37384 - DNA, 25 bp, Mus musculus
gcatcacaagccaaagcgttccggt

SEQ ID NO: 37385 - DNA, 25 bp, Mus musculus
gcatcacaagcctaagcgttccggt

SEQ ID NO: 37386 - DNA, 25 bp, Mus musculus
gcatcacagaagctggaagttctga

SEQ ID NO: 37387 - DNA, 25 bp, Mus musculus
gcatcacagactccactatgtctct

SEQ ID NO: 37388 - DNA, 25 bp, Mus musculus
gcatcactattgttgctaacaggat

SEQ ID NO: 37389 - DNA, 25 bp, Mus musculus
gcatcactggcatagttggagacaa

SEQ ID NO: 37390 - DNA, 25 bp, Mus musculus
gcatcactgggctgaagtttaacca

SEQ ID NO: 37391 - DNA, 25 bp, Mus musculus
gcatcagacaaacggatagcttgcg

SEQ ID NO: 37392 - DNA, 25 bp, Mus musculus
gcatcaggattgagcaagggtgaaa

SEQ ID NO: 37393 - DNA, 25 bp, Mus musculus
gcatcagtgagaaggaggacattaa

SEQ ID NO: 37394 - DNA, 25 bp, Mus musculus
gcatcagttgaacccatttttatgg

SEQ ID NO: 37395 - DNA, 25 bp, Mus musculus
gcatcataaaccaggtgattggctg

SEQ ID NO: 37396 - DNA, 25 bp, Mus musculus
gcatcatagagaacttagctggcca

SEQ ID NO: 37397 - DNA, 25 bp, Mus musculus
gcatcatcgccaccgtcattgtcag

SEQ ID NO: 37398 - DNA, 25 bp, Mus musculus
gcatcatcggtaccctctgcggtag

SEQ ID NO: 37399 - DNA, 25 bp, Mus musculus
gcatcatgaactagaacgatccctg

SEQ ID NO: 37400 - DNA, 25 bp, Mus musculus
gcatcatgacagtgattctttctca

SEQ ID NO: 37401 - DNA, 25 bp, Mus musculus
gcatcatgggagaaatgatcaaagg

SEQ ID NO: 37402 - DNA, 25 bp, Mus musculus
gcatcatgtccatcctcgaggagga

SEQ ID NO: 37403 - DNA, 25 bp, Mus musculus
gcatcattcccaacgagcgaaaggc

SEQ ID NO: 37404 - DNA, 25 bp, Mus musculus
gcatcattcctgaagaaatttgtaa

SEQ ID NO: 37405 - DNA, 25 bp, Mus musculus
gcatccaaccccagtataagcttct

SEQ ID NO: 37406 - DNA, 25 bp, Mus musculus
gcatccaatttttcaactttaccaa

SEQ ID NO: 37407 - DNA, 25 bp, Mus musculus
gcatccacgcttaaacaggtgaagc

SEQ ID NO: 37408 - DNA, 25 bp, Mus musculus
gcatccactgtatcatcggccgctt

SEQ ID NO: 37409 - DNA, 25 bp, Mus musculus
gcatccagagaatgaaagaaagtct

SEQ ID NO: 37410 - DNA, 25 bp, Mus musculus
gcatccagtgtacccggtgcatcag

SEQ ID NO: 37411 - DNA, 25 bp, Mus musculus
gcatccagttcacctgtgacactga

SEQ ID NO: 37412 - DNA, 25 bp, Mus musculus
gcatccagtttagggcagatgaaag

SEQ ID NO: 37413 - DNA, 25 bp, Mus musculus
gcatccatccacctaagctgtaata

SEQ ID NO: 37414 - DNA, 25 bp, Mus musculus
gcatccatttgcaacatatcccagg

SEQ ID NO: 37415 - DNA, 25 bp, Mus musculus
gcatccatttgctacatatcccagg

SEQ ID NO: 37416 - DNA, 25 bp, Mus musculus
gcatcccacggacacaagtagaaaa

SEQ ID NO: 37417 - DNA, 25 bp, Mus musculus
gcatcccctcagcaattgtgagctt

SEQ ID NO: 37418 - DNA, 25 bp, Mus musculus
gcatccctaagaggacagatgtgaa

SEQ ID NO: 37419 - DNA, 25 bp, Mus musculus
gcatccctgggagtgacatcatgag

SEQ ID NO: 37420 - DNA, 25 bp, Mus musculus
gcatccgaaaagagcagagaccaag

SEQ ID NO: 37421 - DNA, 25 bp, Mus musculus
gcatccgatccccacgaactttgta

SEQ ID NO: 37422 - DNA, 25 bp, Mus musculus
gcatcctaaggtcaagtcttgcctg

SEQ ID NO: 37423 - DNA, 25 bp, Mus musculus
gcatcctactacgagattctagacg

SEQ ID NO: 37424 - DNA, 25 bp, Mus musculus
gcatcctcaaatccatcatgaagaa

SEQ ID NO: 37425 - DNA, 25 bp, Mus musculus
gcatcctgagctctacgtggacaag

SEQ ID NO: 37426 - DNA, 25 bp, Mus musculus
gcatcctgccttgataaacttggtg

SEQ ID NO: 37427 - DNA, 25 bp, Mus musculus
gcatcctgcttttgaacatcctccg

SEQ ID NO: 37428 - DNA, 25 bp, Mus musculus
gcatccttcagagggccattccgga

SEQ ID NO: 37429 - DNA, 25 bp, Mus musculus
gcatccttgattggcatgtggcaaa

SEQ ID NO: 37430 - DNA, 25 bp, Mus musculus
gcatccttgctgagcactaccggga

SEQ ID NO: 37431 - DNA, 25 bp, Mus musculus
gcatccttggagcaggcaaccttag

SEQ ID NO: 37432 - DNA, 25 bp, Mus musculus
gcatcgatggaaaccggcagaagat

SEQ ID NO: 37433 - DNA, 25 bp, Mus musculus
gcatcgatttgactacaatgatcag

SEQ ID NO: 37434 - DNA, 25 bp, Mus musculus
gcatcgcaccttgttaaaaggaaat

SEQ ID NO: 37435 - DNA, 25 bp, Mus musculus
gcatcgcctggagtgacacagtcct

SEQ ID NO: 37436 - DNA, 25 bp, Mus musculus
gcatcgctgtggtctggcaagcacg

SEQ ID NO: 37437 - DNA, 25 bp, Mus musculus
gcatcggagaatgcctttgacagct

SEQ ID NO: 37438 - DNA, 25 bp, Mus musculus
gcatcggagacaccccgaaccagga

SEQ ID NO: 37439 - DNA, 25 bp, Mus musculus
gcatcgtcaacattttctctctagg

SEQ ID NO: 37440 - DNA, 25 bp, Mus musculus
gcatcgtcaggtctgcagatgaagt

SEQ ID NO: 37441 - DNA, 25 bp, Mus musculus
gcatcgtcttcagcaatggagaaac

SEQ ID NO: 37442 - DNA, 25 bp, Mus musculus
gcatcgtgctggtactgagcctgca

SEQ ID NO: 37443 - DNA, 25 bp, Mus musculus
gcatcgtggcagtgggactagggct

SEQ ID NO: 37444 - DNA, 25 bp, Mus musculus
gcatcgttaggaacacacacattgt

SEQ ID NO: 37445 - DNA, 25 bp, Mus musculus
gcatctacataacaaccgcatccag

SEQ ID NO: 37446 - DNA, 25 bp, Mus musculus
gcatctactatgaacccaactgtag

SEQ ID NO: 37447 - DNA, 25 bp, Mus musculus
gcatctataaatgtgcgtcttgcca

SEQ ID NO: 37448 - DNA, 25 bp, Mus musculus
gcatctatagaccagaagcttgaga

SEQ ID NO: 37449 - DNA, 25 bp, Mus musculus
gcatctatcagttttgttccatgaa

SEQ ID NO: 37450 - DNA, 25 bp, Mus musculus
gcatctatgagtatgccagcaggat

SEQ ID NO: 37451 - DNA, 25 bp, Mus musculus
gcatctcagcactgcgaggctgtgg

SEQ ID NO: 37452 - DNA, 25 bp, Mus musculus
gcatctccagaggaggacagattgc

SEQ ID NO: 37453 - DNA, 25 bp, Mus musculus
gcatctcccaatttcagagaccgaa

SEQ ID NO: 37454 - DNA, 25 bp, Mus musculus
gcatctcccgggtgcaaggccctgg

SEQ ID NO: 37455 - DNA, 25 bp, Mus musculus
gcatctctggcatatttaaatctca

SEQ ID NO: 37456 - DNA, 25 bp, Mus musculus
gcatctgacaatgacctttgacagt

SEQ ID NO: 37457 - DNA, 25 bp, Mus musculus
gcatctgactcattatccgccagac

SEQ ID NO: 37458 - DNA, 25 bp, Mus musculus
gcatctgcatcctgcttttgaacat

SEQ ID NO: 37459 - DNA, 25 bp, Mus musculus
gcatctgccttcagaaagcctctct

SEQ ID NO: 37460 - DNA, 25 bp, Mus musculus
gcatctgctcgaggcattggcattc

SEQ ID NO: 37461 - DNA, 25 bp, Mus musculus
gcatctgctttattgggtgtcctgc

SEQ ID NO: 37462 - DNA, 25 bp, Mus musculus
gcatctggaaagacgagatcttaag

SEQ ID NO: 37463 - DNA, 25 bp, Mus musculus
gcatctggcatctatttatgagaag

SEQ ID NO: 37464 - DNA, 25 bp, Mus musculus
gcatctggctcatttgtaaacaaaa

SEQ ID NO: 37465 - DNA, 25 bp, Mus musculus
gcatctgggaaactctcgaaggaca

SEQ ID NO: 37466 - DNA, 25 bp, Mus musculus
gcatctgtaagcactgtgcagctgt

SEQ ID NO: 37467 - DNA, 25 bp, Mus musculus
gcatctgtgaagctcgttaactttc

SEQ ID NO: 37468 - DNA, 25 bp, Mus musculus
gcatctgtgatagccaagtacccac

SEQ ID NO: 37469 - DNA, 25 bp, Mus musculus
gcatctgtggcaaggcatccctcta

SEQ ID NO: 37470 - DNA, 25 bp, Mus musculus
gcatcttaacagaaatacagaggaa

SEQ ID NO: 37471 - DNA, 25 bp, Mus musculus
gcatcttaagtaactggttcagcct

SEQ ID NO: 37472 - DNA, 25 bp, Mus musculus
gcatcttaccatcgtgagcttggca

SEQ ID NO: 37473 - DNA, 25 bp, Mus musculus
gcatcttactttcttacctggaagc

SEQ ID NO: 37474 - DNA, 25 bp, Mus musculus
gcatcttagcagtgtattccaaaga

SEQ ID NO: 37475 - DNA, 25 bp, Mus musculus
gcatcttatggaagagtctgttggg

SEQ ID NO: 37476 - DNA, 25 bp, Mus musculus
gcatcttctctatttccagctggct

SEQ ID NO: 37477 - DNA, 25 bp, Mus musculus
gcatcttgatttgactgagcgagac

SEQ ID NO: 37478 - DNA, 25 bp, Mus musculus
gcatcttggcctctgtgaaagaaca

SEQ ID NO: 37479 - DNA, 25 bp, Mus musculus
gcatgaattcaaatgtaacagatgg

SEQ ID NO: 37480 - DNA, 25 bp, Mus musculus
gcatgacaatctctcactaatcttc

SEQ ID NO: 37481 - DNA, 25 bp, Mus musculus
gcatgacaccaacagtcattgcggt

SEQ ID NO: 37482 - DNA, 25 bp, Mus musculus
gcatgacgaccgagaccttcgtgaa

SEQ ID NO: 37483 - DNA, 25 bp, Mus musculus
gcatgactactcactttctgtgctg

SEQ ID NO: 37484 - DNA, 25 bp, Mus musculus
gcatgactccagagtggtgatcagt

SEQ ID NO: 37485 - DNA, 25 bp, Mus musculus
gcatgagaaggagggttacaccatc

SEQ ID NO: 37486 - DNA, 25 bp, Mus musculus
gcatgagccagcgagagctaggcct

SEQ ID NO: 37487 - DNA, 25 bp, Mus musculus
gcatgagccattggatgttccatca

SEQ ID NO: 37488 - DNA, 25 bp, Mus musculus
gcatgagcgggcacattgactaccg

SEQ ID NO: 37489 - DNA, 25 bp, Mus musculus
gcatgaggacactataaaaaccgaa

SEQ ID NO: 37490 - DNA, 25 bp, Mus musculus
gcatgatcagaagaaagggaagttt

SEQ ID NO: 37491 - DNA, 25 bp, Mus musculus
gcatgatcaggcagctagttaggcc

SEQ ID NO: 37492 - DNA, 25 bp, Mus musculus
gcatgatggacacagacgatttccg

SEQ ID NO: 37493 - DNA, 25 bp, Mus musculus
gcatgcaagaggtccggcaggtcat

SEQ ID NO: 37494 - DNA, 25 bp, Mus musculus
gcatgcaccattgtgcttcgtggtg

SEQ ID NO: 37495 - DNA, 25 bp, Mus musculus
gcatgcacgaatccctgaagctctt

SEQ ID NO: 37496 - DNA, 25 bp, Mus musculus
gcatgcaggcttcggtcctctggaa

SEQ ID NO: 37497 - DNA, 25 bp, Mus musculus
gcatgcaggtgtgggtgacctttat

SEQ ID NO: 37498 - DNA, 25 bp, Mus musculus
gcatgcatgcttcctactaccacaa

SEQ ID NO: 37499 - DNA, 25 bp, Mus musculus
gcatgcattatgcaccaatgggcat

SEQ ID NO: 37500 - DNA, 25 bp, Mus musculus
gcatgccatatcgacagatagtcca

SEQ ID NO: 37501 - DNA, 25 bp, Mus musculus
gcatgccatgaagatacttccaaga

SEQ ID NO: 37502 - DNA, 25 bp, Mus musculus
gcatgcccgcactaaggagcttgaa

SEQ ID NO: 37503 - DNA, 25 bp, Mus musculus
gcatgctacgtgaccagacaggagg

SEQ ID NO: 37504 - DNA, 25 bp, Mus musculus
gcatgctagtgattcaagttcatcc

SEQ ID NO: 37505 - DNA, 25 bp, Mus musculus
gcatgctcaacgtgttcctcaagtc

SEQ ID NO: 37506 - DNA, 25 bp, Mus musculus
gcatgctcctcttacacgtttccga

SEQ ID NO: 37507 - DNA, 25 bp, Mus musculus
gcatgctggatcacctcaccaagaa

SEQ ID NO: 37508 - DNA, 25 bp, Mus musculus
gcatgctgtatgagaagatccccag

SEQ ID NO: 37509 - DNA, 25 bp, Mus musculus
gcatgctgtcatgggactgggccac

SEQ ID NO: 37510 - DNA, 25 bp, Mus musculus
gcatgcttgtagtgtccagaatcct

SEQ ID NO: 37511 - DNA, 25 bp, Mus musculus
gcatggaagagcctaatcaccttga

SEQ ID NO: 37512 - DNA, 25 bp, Mus musculus
gcatggaatatctcgtgaaatggaa

SEQ ID NO: 37513 - DNA, 25 bp, Mus musculus
gcatggaccagtcaataatcatttc

SEQ ID NO: 37514 - DNA, 25 bp, Mus musculus
gcatggagaacctcattagtgcccc

SEQ ID NO: 37515 - DNA, 25 bp, Mus musculus
gcatggagctacacacctgtaaacc

SEQ ID NO: 37516 - DNA, 25 bp, Mus musculus
gcatggagggcttgtccaagaataa

SEQ ID NO: 37517 - DNA, 25 bp, Mus musculus
gcatggcaggcctgccccttactga

SEQ ID NO: 37518 - DNA, 25 bp, Mus musculus
gcatggctcccacaaacaagatcag

SEQ ID NO: 37519 - DNA, 25 bp, Mus musculus
gcatggctcccagaaacaagatcag

SEQ ID NO: 37520 - DNA, 25 bp, Mus musculus
gcatggctgccatctgggttctgga

SEQ ID NO: 37521 - DNA, 25 bp, Mus musculus
gcatggctggaaagaacacctggtt

SEQ ID NO: 37522 - DNA, 25 bp, Mus musculus
gcatgggaagggtcctactatctcc

SEQ ID NO: 37523 - DNA, 25 bp, Mus musculus
gcatgggaatctctgcttggataag

SEQ ID NO: 37524 - DNA, 25 bp, Mus musculus
gcatgggacctgctggcaaaggagg

SEQ ID NO: 37525 - DNA, 25 bp, Mus musculus
gcatgggcacatcaactcctaccta

SEQ ID NO: 37526 - DNA, 25 bp, Mus musculus
gcatgggccacgaagttcaggttga

SEQ ID NO: 37527 - DNA, 25 bp, Mus musculus
gcatgggtaacttgcacacctggga

SEQ ID NO: 37528 - DNA, 25 bp, Mus musculus
gcatgggtgtgtggagctccatcca

SEQ ID NO: 37529 - DNA, 25 bp, Mus musculus
gcatggtcatccactcacatcttaa

SEQ ID NO: 37530 - DNA, 25 bp, Mus musculus
gcatggtcgacaccctggcctgtcg

SEQ ID NO: 37531 - DNA, 25 bp, Mus musculus
gcatggtcgccctgggtgacaccgt

SEQ ID NO: 37532 - DNA, 25 bp, Mus musculus
gcatggtcgtttccggagttactcc

SEQ ID NO: 37533 - DNA, 25 bp, Mus musculus
gcatgtaccacgcactgaaggaggc

SEQ ID NO: 37534 - DNA, 25 bp, Mus musculus
gcatgtatctcttctatggcaacaa

SEQ ID NO: 37535 - DNA, 25 bp, Mus musculus
gcatgtatgaccgactctaccagga

SEQ ID NO: 37536 - DNA, 25 bp, Mus musculus
gcatgtcaacgaccagaaggaccag

SEQ ID NO: 37537 - DNA, 25 bp, Mus musculus
gcatgtcatccacaaatacttcctg

SEQ ID NO: 37538 - DNA, 25 bp, Mus musculus
gcatgtcgatgagggagtctcctgt

SEQ ID NO: 37539 - DNA, 25 bp, Mus musculus
gcatgtctcagaccacagtggattt

SEQ ID NO: 37540 - DNA, 25 bp, Mus musculus
gcatgtctcctctgccacatgacag

SEQ ID NO: 37541 - DNA, 25 bp, Mus musculus
gcatgtctgctggtaggacatcatg

SEQ ID NO: 37542 - DNA, 25 bp, Mus musculus
gcatgtcttctaaaacagcaagaga

SEQ ID NO: 37543 - DNA, 25 bp, Mus musculus
gcatgtgcggcctctctagcttgta

SEQ ID NO: 37544 - DNA, 25 bp, Mus musculus
gcatgtgctagacaaaccaccctgt

SEQ ID NO: 37545 - DNA, 25 bp, Mus musculus
gcatgttagccaggcagtttggtca

SEQ ID NO: 37546 - DNA, 25 bp, Mus musculus
gcatgttcacatccagctcatttga

SEQ ID NO: 37547 - DNA, 25 bp, Mus musculus
gcatgttccccaaggcctcagacat

SEQ ID NO: 37548 - DNA, 25 bp, Mus musculus
gcatgttcctgctcttttcaaagct

SEQ ID NO: 37549 - DNA, 25 bp, Mus musculus
gcatgttctcgaagatgttaccacg

SEQ ID NO: 37550 - DNA, 25 bp, Mus musculus
gcatgttgggccgtatcatctttgc

SEQ ID NO: 37551 - DNA, 25 bp, Mus musculus
gcatgtttggtgcttcaagaaagaa

SEQ ID NO: 37552 - DNA, 25 bp, Mus musculus
gcattaatagtcaagtctgagaaag

SEQ ID NO: 37553 - DNA, 25 bp, Mus musculus
gcattaccttctatgtcgtgatcgg

SEQ ID NO: 37554 - DNA, 25 bp, Mus musculus
gcattactcatcagtctcaagtact

SEQ ID NO: 37555 - DNA, 25 bp, Mus musculus
gcattacttcagacgggttgttgcc

SEQ ID NO: 37556 - DNA, 25 bp, Mus musculus
gcattagatgccctgaaatggagtt

SEQ ID NO: 37557 - DNA, 25 bp, Mus musculus
gcattagatgccgtgaaatggagtt

SEQ ID NO: 37558 - DNA, 25 bp, Mus musculus
gcattagattgactgtctcgtaatc

SEQ ID NO: 37559 - DNA, 25 bp, Mus musculus
gcattagattgcttggagccagagt

SEQ ID NO: 37560 - DNA, 25 bp, Mus musculus
gcattatgcaagactggatttcctg

SEQ ID NO: 37561 - DNA, 25 bp, Mus musculus
gcattatgcaagtctggatttcctg

SEQ ID NO: 37562 - DNA, 25 bp, Mus musculus
gcattcaaaactgcgtatgagcttt

SEQ ID NO: 37563 - DNA, 25 bp, Mus musculus
gcattcaaggttcccgaggaattcc

SEQ ID NO: 37564 - DNA, 25 bp, Mus musculus
gcattcagtttgacgagcaaaccta

SEQ ID NO: 37565 - DNA, 25 bp, Mus musculus
gcattccacatcaacaagggtcttg

SEQ ID NO: 37566 - DNA, 25 bp, Mus musculus
gcattccctgtgtacagcctttcca

SEQ ID NO: 37567 - DNA, 25 bp, Mus musculus
gcattcctggcttctcaagaattag

SEQ ID NO: 37568 - DNA, 25 bp, Mus musculus
gcattcctttcgaacaccacggcaa

SEQ ID NO: 37569 - DNA, 25 bp, Mus musculus
gcattcgattagcatgcctgctatg

SEQ ID NO: 37570 - DNA, 25 bp, Mus musculus
gcattcggtggatttactaaaacaa

SEQ ID NO: 37571 - DNA, 25 bp, Mus musculus
gcattcgtactggaaggagagaacc

SEQ ID NO: 37572 - DNA, 25 bp, Mus musculus
gcattctgcaatccttataggacag

SEQ ID NO: 37573 - DNA, 25 bp, Mus musculus
gcattctgcaatgcttataggacag

SEQ ID NO: 37574 - DNA, 25 bp, Mus musculus
gcattctgcatttggctttacttac

SEQ ID NO: 37575 - DNA, 25 bp, Mus musculus
gcattctgccctctgtacccaaaga

SEQ ID NO: 37576 - DNA, 25 bp, Mus musculus
gcattctgccctgtgtacccaaaga

SEQ ID NO: 37577 - DNA, 25 bp, Mus musculus
gcattgaaaattggctacctctaca

SEQ ID NO: 37578 - DNA, 25 bp, Mus musculus
gcattgaaagtctgtatactctgtg

SEQ ID NO: 37579 - DNA, 25 bp, Mus musculus
gcattgaagacaagaccctccaaaa

SEQ ID NO: 37580 - DNA, 25 bp, Mus musculus
gcattgaagcaagaaggccacagca

SEQ ID NO: 37581 - DNA, 25 bp, Mus musculus
gcattgaatcccatgtgagccatca

SEQ ID NO: 37582 - DNA, 25 bp, Mus musculus
gcattgacatcagccctgccatgtt

SEQ ID NO: 37583 - DNA, 25 bp, Mus musculus
gcattgaccagcaacgcaatacaag

SEQ ID NO: 37584 - DNA, 25 bp, Mus musculus
gcattgaggatttcacagcatacgg

SEQ ID NO: 37585 - DNA, 25 bp, Mus musculus
gcattgaggcaaaggtgtgagtcct

SEQ ID NO: 37586 - DNA, 25 bp, Mus musculus
gcattgagttcaagaagatagtgga

SEQ ID NO: 37587 - DNA, 25 bp, Mus musculus
gcattgagttgggagtttatcgact

SEQ ID NO: 37588 - DNA, 25 bp, Mus musculus
gcattgcccatttttaagcaagaag

SEQ ID NO: 37589 - DNA, 25 bp, Mus musculus
gcattgcccggttcttcactgacta

SEQ ID NO: 37590 - DNA, 25 bp, Mus musculus
gcattgctagcttggtggtctcgtt

SEQ ID NO: 37591 - DNA, 25 bp, Mus musculus
gcattgctattgagtgctacaaaca

SEQ ID NO: 37592 - DNA, 25 bp, Mus musculus
gcattgctgaaactggcccgaaact

SEQ ID NO: 37593 - DNA, 25 bp, Mus musculus
gcattgctggcaacctcagaacaca

SEQ ID NO: 37594 - DNA, 25 bp, Mus musculus
gcattggagattactccggaccgaa

SEQ ID NO: 37595 - DNA, 25 bp, Mus musculus
gcattggagcatgatactgttcttc

SEQ ID NO: 37596 - DNA, 25 bp, Mus musculus
gcattggctgctgacattgacatcg

SEQ ID NO: 37597 - DNA, 25 bp, Mus musculus
gcattgggaagtgcattgctattga

SEQ ID NO: 37598 - DNA, 25 bp, Mus musculus
gcattggtctcatctgtccgtcaga

SEQ ID NO: 37599 - DNA, 25 bp, Mus musculus
gcattgtatcatcatcacttcatca

SEQ ID NO: 37600 - DNA, 25 bp, Mus musculus
gcattgtgcagtactacggctgcct

SEQ ID NO: 37601 - DNA, 25 bp, Mus musculus
gcattgtgctccacacggcgagtgc

SEQ ID NO: 37602 - DNA, 25 bp, Mus musculus
gcattgtgctcctcacggcgagtgc

SEQ ID NO: 37603 - DNA, 25 bp, Mus musculus
gcattgtggtaacagatgtgacctt

SEQ ID NO: 37604 - DNA, 25 bp, Mus musculus
gcattgttcatctgcttcatcaacc

SEQ ID NO: 37605 - DNA, 25 bp, Mus musculus
gcattgttcatgcactgaccgacct

SEQ ID NO: 37606 - DNA, 25 bp, Mus musculus
gcatttaccggaacacaggcactga

SEQ ID NO: 37607 - DNA, 25 bp, Mus musculus
gcatttatacgagggcagcttgaaa

SEQ ID NO: 37608 - DNA, 25 bp, Mus musculus
gcatttcacctgtgcaagccatata

SEQ ID NO: 37609 - DNA, 25 bp, Mus musculus
gcatttcagatctggaaacctctag

SEQ ID NO: 37610 - DNA, 25 bp, Mus musculus
gcatttccagaagaggagctctcag

SEQ ID NO: 37611 - DNA, 25 bp, Mus musculus
gcatttccagcgtcccatgagaatt

SEQ ID NO: 37612 - DNA, 25 bp, Mus musculus
gcatttgagggtcagacgaacacag

SEQ ID NO: 37613 - DNA, 25 bp, Mus musculus
gcatttgagggtgagacgaacacag

SEQ ID NO: 37614 - DNA, 25 bp, Mus musculus
gcatttgcaacatgtggtggctatt

SEQ ID NO: 37615 - DNA, 25 bp, Mus musculus
gcatttgcaagatgcaatgtccttc

SEQ ID NO: 37616 - DNA, 25 bp, Mus musculus
gcatttggcacaatagccattcagt

SEQ ID NO: 37617 - DNA, 25 bp, Mus musculus
gcatttgggattggaacaagacatg

SEQ ID NO: 37618 - DNA, 25 bp, Mus musculus
gcatttgtccctgagatcagcgtga

SEQ ID NO: 37619 - DNA, 25 bp, Mus musculus
gcatttgtctcacctgctggttgag

SEQ ID NO: 37620 - DNA, 25 bp, Mus musculus
gcatttgtctcagctgctggttgag

SEQ ID NO: 37621 - DNA, 25 bp, Mus musculus
gcatttgttgcacccaggaccttcg

SEQ ID NO: 37622 - DNA, 25 bp, Mus musculus
gcatttgttgcagccaggaccttcg

SEQ ID NO: 37623 - DNA, 25 bp, Mus musculus
gcattttaattatgatgtctgccag

SEQ ID NO: 37624 - DNA, 25 bp, Mus musculus
gcattttcctagtatctattacgga

SEQ ID NO: 37625 - DNA, 25 bp, Mus musculus
gcattttgcagaggcatcagaaaac

SEQ ID NO: 37626 - DNA, 25 bp, Mus musculus
gcattttggcactccagtcatagga

SEQ ID NO: 37627 - DNA, 25 bp, Mus musculus
gcattttggcctcggtgaaggaaca

SEQ ID NO: 37628 - DNA, 25 bp, Mus musculus
gcattttgttgacggagtatcgagt

SEQ ID NO: 37629 - DNA, 25 bp, Mus musculus
gcattttgttgagggagtatcgagt

SEQ ID NO: 37630 - DNA, 25 bp, Mus musculus
gcatttttgcggcagcttcctttta

SEQ ID NO: 37631 - DNA, 25 bp, Mus musculus
gccaaaaaactctccaggtttgtca

SEQ ID NO: 37632 - DNA, 25 bp, Mus musculus
gccaaaaaagtggatgcagctgcca

SEQ ID NO: 37633 - DNA, 25 bp, Mus musculus
gccaaaaaatcagtgtcggtccccg

SEQ ID NO: 37634 - DNA, 25 bp, Mus musculus
gccaaaaatacgctgacgcaggaag

SEQ ID NO: 37635 - DNA, 25 bp, Mus musculus
gccaaaacaccgtcacctcaagatt

SEQ ID NO: 37636 - DNA, 25 bp, Mus musculus
gccaaaactgttctggctatcagat

SEQ ID NO: 37637 - DNA, 25 bp, Mus musculus
gccaaaagatacaacataatggctt

SEQ ID NO: 37638 - DNA, 25 bp, Mus musculus
gccaaaagcctattgaacaagaagt

SEQ ID NO: 37639 - DNA, 25 bp, Mus musculus
gccaaaaggaagaggcgctctagca

SEQ ID NO: 37640 - DNA, 25 bp, Mus musculus
gccaaaagttagcaaaagagaagtt

SEQ ID NO: 37641 - DNA, 25 bp, Mus musculus
gccaaaatggttccagcaccgcaag

SEQ ID NO: 37642 - DNA, 25 bp, Mus musculus
gccaaaattagagatcggagcaaga

SEQ ID NO: 37643 - DNA, 25 bp, Mus musculus
gccaaacagttatttggacgcttac

SEQ ID NO: 37644 - DNA, 25 bp, Mus musculus
gccaaagaagaaacgctgcagtaat

SEQ ID NO: 37645 - DNA, 25 bp, Mus musculus
gccaaagaccttgaaatgtttgcca

SEQ ID NO: 37646 - DNA, 25 bp, Mus musculus
gccaaagagatgtcatgattttgag

SEQ ID NO: 37647 - DNA, 25 bp, Mus musculus
gccaaagagggcaagagacttgact

SEQ ID NO: 37648 - DNA, 25 bp, Mus musculus
gccaaagcaagcctgagatctctgc

SEQ ID NO: 37649 - DNA, 25 bp, Mus musculus
gccaaagcaaggtatccatctgtcc

SEQ ID NO: 37650 - DNA, 25 bp, Mus musculus
gccaaagcacatgcgggttatggct

SEQ ID NO: 37651 - DNA, 25 bp, Mus musculus
gccaaagcctacatacataaagtca

SEQ ID NO: 37652 - DNA, 25 bp, Mus musculus
gccaaaggaaaaggccgaggcacat

SEQ ID NO: 37653 - DNA, 25 bp, Mus musculus
gccaaagggtcagaatgttaccaaa

SEQ ID NO: 37654 - DNA, 25 bp, Mus musculus
gccaaagtcaataggacccttaacg

SEQ ID NO: 37655 - DNA, 25 bp, Mus musculus
gccaaagtttgagcagatagtcgga

SEQ ID NO: 37656 - DNA, 25 bp, Mus musculus
gccaaatcagttttgaaggagaggg

SEQ ID NO: 37657 - DNA, 25 bp, Mus musculus
gccaaatgcaacctgctggcagaga

SEQ ID NO: 37658 - DNA, 25 bp, Mus musculus
gccaaatgggataacattgccggtg

SEQ ID NO: 37659 - DNA, 25 bp, Mus musculus
gccaaattgggacagaaaaactagc

SEQ ID NO: 37660 - DNA, 25 bp, Mus musculus
gccaacaactgggttctgacagctg

SEQ ID NO: 37661 - DNA, 25 bp, Mus musculus
gccaacaatcctagtaagaaatacc

SEQ ID NO: 37662 - DNA, 25 bp, Mus musculus
gccaacaatgtggaggccgctcaga

SEQ ID NO: 37663 - DNA, 25 bp, Mus musculus
gccaacacattcagctcccagatgt

SEQ ID NO: 37664 - DNA, 25 bp, Mus musculus
gccaacagctttagttgtacacccc

SEQ ID NO: 37665 - DNA, 25 bp, Mus musculus
gccaacaggctatggtgctccaaga

SEQ ID NO: 37666 - DNA, 25 bp, Mus musculus
gccaaccacccgatggatgctgaag

SEQ ID NO: 37667 - DNA, 25 bp, Mus musculus
gccaaccagagccaccaggctttga

SEQ ID NO: 37668 - DNA, 25 bp, Mus musculus
gccaaccccacgaggactctgaaga

SEQ ID NO: 37669 - DNA, 25 bp, Mus musculus
gccaaccctgacagaggagcctatg

SEQ ID NO: 37670 - DNA, 25 bp, Mus musculus
gccaaccctgactgaggagcctatg

SEQ ID NO: 37671 - DNA, 25 bp, Mus musculus
gccaaccgccggttactgcaggaag

SEQ ID NO: 37672 - DNA, 25 bp, Mus musculus
gccaaccgctgctactgacactatg

SEQ ID NO: 37673 - DNA, 25 bp, Mus musculus
gccaacgaggtcttccactacggct

SEQ ID NO: 37674 - DNA, 25 bp, Mus musculus
gccaacgctcatgaaacaaaccaga

SEQ ID NO: 37675 - DNA, 25 bp, Mus musculus
gccaacggcacatcgggcttctttt

SEQ ID NO: 37676 - DNA, 25 bp, Mus musculus
gccaacgtggtaaccagccccaaag

SEQ ID NO: 37677 - DNA, 25 bp, Mus musculus
gccaactcgggatgcaggcttcact

SEQ ID NO: 37678 - DNA, 25 bp, Mus musculus
gccaactctgtgaggaatttttggg

SEQ ID NO: 37679 - DNA, 25 bp, Mus musculus
gccaactggaatagagaagaagatg

SEQ ID NO: 37680 - DNA, 25 bp, Mus musculus
gccaagaaattctgccaagagttga

SEQ ID NO: 37681 - DNA, 25 bp, Mus musculus
gccaagaagaaaggtttgctcccgg

SEQ ID NO: 37682 - DNA, 25 bp, Mus musculus
gccaagaattcataagatcccagag

SEQ ID NO: 37683 - DNA, 25 bp, Mus musculus
gccaagacgttctcctaccttcggg

SEQ ID NO: 37684 - DNA, 25 bp, Mus musculus
gccaagagaggtggatccattggtt

SEQ ID NO: 37685 - DNA, 25 bp, Mus musculus
gccaagagcaaccactgcctggatg

SEQ ID NO: 37686 - DNA, 25 bp, Mus musculus
gccaagagtcagctatttgacgttg

SEQ ID NO: 37687 - DNA, 25 bp, Mus musculus
gccaagatgatagattcatgtcaga

SEQ ID NO: 37688 - DNA, 25 bp, Mus musculus
gccaagatgggccaatcaaagtcct

SEQ ID NO: 37689 - DNA, 25 bp, Mus musculus
gccaagatgtcctgctgtttattga

SEQ ID NO: 37690 - DNA, 25 bp, Mus musculus
gccaagattatcaacaccaagaagc

SEQ ID NO: 37691 - DNA, 25 bp, Mus musculus
gccaagattcatgtatgggagtcac

SEQ ID NO: 37692 - DNA, 25 bp, Mus musculus
gccaagcacatctgaaagagagcag

SEQ ID NO: 37693 - DNA, 25 bp, Mus musculus
gccaagcacattgctgaagatgctg

SEQ ID NO: 37694 - DNA, 25 bp, Mus musculus
gccaagccagctgaagaagctcaaa

SEQ ID NO: 37695 - DNA, 25 bp, Mus musculus
gccaagcctattcactgagggcaaa

SEQ ID NO: 37696 - DNA, 25 bp, Mus musculus
gccaagcctgactaaggagtatgat

SEQ ID NO: 37697 - DNA, 25 bp, Mus musculus
gccaagcgtgtgaaaggccgtactt

SEQ ID NO: 37698 - DNA, 25 bp, Mus musculus
gccaagctacaagggcatgtggaac

SEQ ID NO: 37699 - DNA, 25 bp, Mus musculus
gccaagctccatgtgatgcaagagg

SEQ ID NO: 37700 - DNA, 25 bp, Mus musculus
gccaagctgcaaaatccctgattat

SEQ ID NO: 37701 - DNA, 25 bp, Mus musculus
gccaagctgcaatatccctgattat

SEQ ID NO: 37702 - DNA, 25 bp, Mus musculus
gccaagctgtcccagatccgacaga

SEQ ID NO: 37703 - DNA, 25 bp, Mus musculus
gccaagctttatggatctaccaaag

SEQ ID NO: 37704 - DNA, 25 bp, Mus musculus
gccaaggaatatgtacatgtcattg

SEQ ID NO: 37705 - DNA, 25 bp, Mus musculus
gccaaggactacatgaaaacagcat

SEQ ID NO: 37706 - DNA, 25 bp, Mus musculus
gccaaggcagtagccacggaggctc

SEQ ID NO: 37707 - DNA, 25 bp, Mus musculus
gccaagggactcagcaagcctagtc

SEQ ID NO: 37708 - DNA, 25 bp, Mus musculus
gccaagggcacagccggagttgcca

SEQ ID NO: 37709 - DNA, 25 bp, Mus musculus
gccaaggtgctgaccaagttgcagg

SEQ ID NO: 37710 - DNA, 25 bp, Mus musculus
gccaagtacatctgcaatcgtatca

SEQ ID NO: 37711 - DNA, 25 bp, Mus musculus
gccaagtacatttctcggttgttta

SEQ ID NO: 37712 - DNA, 25 bp, Mus musculus
gccaagtacccaagaggaaccacaa

SEQ ID NO: 37713 - DNA, 25 bp, Mus musculus
gccaagtattttcaaggagatctga

SEQ ID NO: 37714 - DNA, 25 bp, Mus musculus
gccaagtattttgaaggagatctga

SEQ ID NO: 37715 - DNA, 25 bp, Mus musculus
gccaagtccttcagcataaagagaa

SEQ ID NO: 37716 - DNA, 25 bp, Mus musculus
gccaagtctcggagcctgtcagcct

SEQ ID NO: 37717 - DNA, 25 bp, Mus musculus
gccaagtgagttcacctctgcaaag

SEQ ID NO: 37718 - DNA, 25 bp, Mus musculus
gccaagtgcaacgtgagcagtttgc

SEQ ID NO: 37719 - DNA, 25 bp, Mus musculus
gccaagtgtgcacctgcagccagat

SEQ ID NO: 37720 - DNA, 25 bp, Mus musculus
gccaagttgaagtgaagccgctcct

SEQ ID NO: 37721 - DNA, 25 bp, Mus musculus
gccaagtttgggttacgcttcgaca

SEQ ID NO: 37722 - DNA, 25 bp, Mus musculus
gccaatacaaagacatctaaccagt

SEQ ID NO: 37723 - DNA, 25 bp, Mus musculus
gccaatacaagctgtttcccacaag

SEQ ID NO: 37724 - DNA, 25 bp, Mus musculus
gccaatacatatgaaaagtactggc

SEQ ID NO: 37725 - DNA, 25 bp, Mus musculus
gccaatacattgcacagacacccgg

SEQ ID NO: 37726 - DNA, 25 bp, Mus musculus
gccaatactgctctagcacacgtag

SEQ ID NO: 37727 - DNA, 25 bp, Mus musculus
gccaatagaagcattcaccagttga

SEQ ID NO: 37728 - DNA, 25 bp, Mus musculus
gccaataggctgaagttctacttta

SEQ ID NO: 37729 - DNA, 25 bp, Mus musculus
gccaataggttgactggaaatttca

SEQ ID NO: 37730 - DNA, 25 bp, Mus musculus
gccaatctcaagtcggacaaagcca

SEQ ID NO: 37731 - DNA, 25 bp, Mus musculus
gccaatctctaatcaacctggatgg

SEQ ID NO: 37732 - DNA, 25 bp, Mus musculus
gccaatctctgcgtgacagagctcg

SEQ ID NO: 37733 - DNA, 25 bp, Mus musculus
gccaatcttgtcttacatcatatga

SEQ ID NO: 37734 - DNA, 25 bp, Mus musculus
gccaatgaagcctggcatggctcct

SEQ ID NO: 37735 - DNA, 25 bp, Mus musculus
gccaatgccatcataggccactatg

SEQ ID NO: 37736 - DNA, 25 bp, Mus musculus
gccaatgctctgtggtctgctggag

SEQ ID NO: 37737 - DNA, 25 bp, Mus musculus
gccaatggaagcacagcgtggccac

SEQ ID NO: 37738 - DNA, 25 bp, Mus musculus
gccaatggaataaggagaaccgatt

SEQ ID NO: 37739 - DNA, 25 bp, Mus musculus
gccaatgtcaccgtacagattgaga

SEQ ID NO: 37740 - DNA, 25 bp, Mus musculus
gccaattcccaggtgagggtcgtgt

SEQ ID NO: 37741 - DNA, 25 bp, Mus musculus
gccaatttctcgactctacgccaag

SEQ ID NO: 37742 - DNA, 25 bp, Mus musculus
gccaatttctcgtctctacgccaag

SEQ ID NO: 37743 - DNA, 25 bp, Mus musculus
gccacaaacggatatgtcagaggag

SEQ ID NO: 37744 - DNA, 25 bp, Mus musculus
gccacaaagactgtaaagtgcttca

SEQ ID NO: 37745 - DNA, 25 bp, Mus musculus
gccacaaagatgtgggttctccagg

SEQ ID NO: 37746 - DNA, 25 bp, Mus musculus
gccacaaagcttcttctcatttaaa

SEQ ID NO: 37747 - DNA, 25 bp, Mus musculus
gccacaaataacaataacgctgctg

SEQ ID NO: 37748 - DNA, 25 bp, Mus musculus
gccacaaataactataacgctgctg

SEQ ID NO: 37749 - DNA, 25 bp, Mus musculus
gccacaacacacataaagaagccag

SEQ ID NO: 37750 - DNA, 25 bp, Mus musculus
gccacaacacacttaaagaagccag

SEQ ID NO: 37751 - DNA, 25 bp, Mus musculus
gccacaacagatctggtgcccatgc

SEQ ID NO: 37752 - DNA, 25 bp, Mus musculus
gccacaactacaacagcatcaactg

SEQ ID NO: 37753 - DNA, 25 bp, Mus musculus
gccacaagaagagaaatatcctgtt

SEQ ID NO: 37754 - DNA, 25 bp, Mus musculus
gccacaagtgttcccttcgctgcaa

SEQ ID NO: 37755 - DNA, 25 bp, Mus musculus
gccacacactaaagagcaacagagg

SEQ ID NO: 37756 - DNA, 25 bp, Mus musculus
gccacacagggagcttttaattctt

SEQ ID NO: 37757 - DNA, 25 bp, Mus musculus
gccacacgcgggtctgctgttaaaa

SEQ ID NO: 37758 - DNA, 25 bp, Mus musculus
gccacacgtgcaattcctgagctga

SEQ ID NO: 37759 - DNA, 25 bp, Mus musculus
gccacactcaataccctctttaaga

SEQ ID NO: 37760 - DNA, 25 bp, Mus musculus
gccacacttccagggcgtgacggga

SEQ ID NO: 37761 - DNA, 25 bp, Mus musculus
gccacagaagtgctctactgcacct

SEQ ID NO: 37762 - DNA, 25 bp, Mus musculus
gccacagaatgaagatccatattcc

SEQ ID NO: 37763 - DNA, 25 bp, Mus musculus
gccacagaatgaagctggtttccat

SEQ ID NO: 37764 - DNA, 25 bp, Mus musculus
gccacagaatgatgctggtttccat

SEQ ID NO: 37765 - DNA, 25 bp, Mus musculus
gccacagatgaggacgatgctgtca

SEQ ID NO: 37766 - DNA, 25 bp, Mus musculus
gccacagattctgttgttaagacat

SEQ ID NO: 37767 - DNA, 25 bp, Mus musculus
gccacagattgccacattagcccag

SEQ ID NO: 37768 - DNA, 25 bp, Mus musculus
gccacagcagtgaagttcctacaga

SEQ ID NO: 37769 - DNA, 25 bp, Mus musculus
gccacagcctgaatgagaatgttct

SEQ ID NO: 37770 - DNA, 25 bp, Mus musculus
gccacaggaagcaacccaaggataa

SEQ ID NO: 37771 - DNA, 25 bp, Mus musculus
gccacaggccagtcacaagctgctt

SEQ ID NO: 37772 - DNA, 25 bp, Mus musculus
gccacagggcttgatgccatatggt

SEQ ID NO: 37773 - DNA, 25 bp, Mus musculus
gccacagtcagctgctatttcaaag

SEQ ID NO: 37774 - DNA, 25 bp, Mus musculus
gccacagtcagtcggaactacaaga

SEQ ID NO: 37775 - DNA, 25 bp, Mus musculus
gccacagtcagtgggaactacaaga

SEQ ID NO: 37776 - DNA, 25 bp, Mus musculus
gccacagtggtagagatgagcccta

SEQ ID NO: 37777 - DNA, 25 bp, Mus musculus
gccacagtgtgagcgctggaaatca

SEQ ID NO: 37778 - DNA, 25 bp, Mus musculus
gccacatactggaatccgagtctgg

SEQ ID NO: 37779 - DNA, 25 bp, Mus musculus
gccacatcaggttcccaggtggtga

SEQ ID NO: 37780 - DNA, 25 bp, Mus musculus
gccacatgacagtcctttaatagag

SEQ ID NO: 37781 - DNA, 25 bp, Mus musculus
gccacattgctcagctagctgggaa

SEQ ID NO: 37782 - DNA, 25 bp, Mus musculus
gccacattggaactatcgacccaaa

SEQ ID NO: 37783 - DNA, 25 bp, Mus musculus
gccacattggaagtatcgacccaaa

SEQ ID NO: 37784 - DNA, 25 bp, Mus musculus
gccacatttaaaaggaaggatacat

SEQ ID NO: 37785 - DNA, 25 bp, Mus musculus
gccaccaaaagtaactacctccgag

SEQ ID NO: 37786 - DNA, 25 bp, Mus musculus
gccaccaaatgtagcggaactgaag

SEQ ID NO: 37787 - DNA, 25 bp, Mus musculus
gccaccaatggcctgatgtacatgt

SEQ ID NO: 37788 - DNA, 25 bp, Mus musculus
gccaccaccaccagtcatgggaatg

SEQ ID NO: 37789 - DNA, 25 bp, Mus musculus
gccaccaggcccagtttaaggattt

SEQ ID NO: 37790 - DNA, 25 bp, Mus musculus
gccaccagtgcgctagatgcagaat

SEQ ID NO: 37791 - DNA, 25 bp, Mus musculus
gccaccatcatgacgtcgtctgtac

SEQ ID NO: 37792 - DNA, 25 bp, Mus musculus
gccaccatgaatgaggtatctgtca

SEQ ID NO: 37793 - DNA, 25 bp, Mus musculus
gccaccatggataagcacgctgatg

SEQ ID NO: 37794 - DNA, 25 bp, Mus musculus
gccaccatgtacacagggaaagcat

SEQ ID NO: 37795 - DNA, 25 bp, Mus musculus
gccaccatttcaaacccagtaacag

SEQ ID NO: 37796 - DNA, 25 bp, Mus musculus
gccacccgatgatgtcattgctcag

SEQ ID NO: 37797 - DNA, 25 bp, Mus musculus
gccacctaccatagagccatcaaaa

SEQ ID NO: 37798 - DNA, 25 bp, Mus musculus
gccacctagtggagttaacctgcca

SEQ ID NO: 37799 - DNA, 25 bp, Mus musculus
gccacctatgaagaggctctgacag

SEQ ID NO: 37800 - DNA, 25 bp, Mus musculus
gccacctattttgactatgcagcct

SEQ ID NO: 37801 - DNA, 25 bp, Mus musculus
gccacctctcaacagcatcttgatg

SEQ ID NO: 37802 - DNA, 25 bp, Mus musculus
gccacctggcatggagtactcctat

SEQ ID NO: 37803 - DNA, 25 bp, Mus musculus
gccacctggccgcagggaagctcaa

SEQ ID NO: 37804 - DNA, 25 bp, Mus musculus
gccaccttgggaacctagctgatga

SEQ ID NO: 37805 - DNA, 25 bp, Mus musculus
gccacgatccacactagttatggga

SEQ ID NO: 37806 - DNA, 25 bp, Mus musculus
gccacgcaggtgttgcagttctact

SEQ ID NO: 37807 - DNA, 25 bp, Mus musculus
gccacggctcgggaagcatgacgac

SEQ ID NO: 37808 - DNA, 25 bp, Mus musculus
gccacggtcgcggtgctgagtttca

SEQ ID NO: 37809 - DNA, 25 bp, Mus musculus
gccacggtgaagtacggttcaagga

SEQ ID NO: 37810 - DNA, 25 bp, Mus musculus
gccacggtgagcatctatagaccag

SEQ ID NO: 37811 - DNA, 25 bp, Mus musculus
gccacgtcacgccaacaacaggggt

SEQ ID NO: 37812 - DNA, 25 bp, Mus musculus
gccacgtccatcctggaaacttgat

SEQ ID NO: 37813 - DNA, 25 bp, Mus musculus
gccacgtgggatgcaagaaatgccc

SEQ ID NO: 37814 - DNA, 25 bp, Mus musculus
gccacgttacttttgttggaaatga

SEQ ID NO: 37815 - DNA, 25 bp, Mus musculus
gccacgttcagaaagcttgaaggat

SEQ ID NO: 37816 - DNA, 25 bp, Mus musculus
gccacgttggtctttgccatagcaa

SEQ ID NO: 37817 - DNA, 25 bp, Mus musculus
gccactatgaccagcttgatgccaa

SEQ ID NO: 37818 - DNA, 25 bp, Mus musculus
gccactatgacctgcttgatgccaa

SEQ ID NO: 37819 - DNA, 25 bp, Mus musculus
gccactcagatgacttatttcaatg

SEQ ID NO: 37820 - DNA, 25 bp, Mus musculus
gccactcaggagacctctccatatg

SEQ ID NO: 37821 - DNA, 25 bp, Mus musculus
gccactcgataagtatgcctgtcat

SEQ ID NO: 37822 - DNA, 25 bp, Mus musculus
gccactcgatatgaacccgtggctg

SEQ ID NO: 37823 - DNA, 25 bp, Mus musculus
gccactcttcgactccagtgacatg

SEQ ID NO: 37824 - DNA, 25 bp, Mus musculus
gccactgaacaaccaaggcattcca

SEQ ID NO: 37825 - DNA, 25 bp, Mus musculus
gccactgagatttctgctaagtgat

SEQ ID NO: 37826 - DNA, 25 bp, Mus musculus
gccactgagtacgaaattgaactct

SEQ ID NO: 37827 - DNA, 25 bp, Mus musculus
gccactgcagcgttagaaacagatt

SEQ ID NO: 37828 - DNA, 25 bp, Mus musculus
gccactgctgtacattgagcttcgt

SEQ ID NO: 37829 - DNA, 25 bp, Mus musculus
gccactgcttcatgttgtgctgatg

SEQ ID NO: 37830 - DNA, 25 bp, Mus musculus
gccactggcgagtcatgcacttcca

SEQ ID NO: 37831 - DNA, 25 bp, Mus musculus
gccactgtagatattgttcagaaaa

SEQ ID NO: 37832 - DNA, 25 bp, Mus musculus
gccactgtgtttggtctttggcctc

SEQ ID NO: 37833 - DNA, 25 bp, Mus musculus
gccactgttgccctgacgacttcgt

SEQ ID NO: 37834 - DNA, 25 bp, Mus musculus
gccacttcggtgtccccaagggtgt

SEQ ID NO: 37835 - DNA, 25 bp, Mus musculus
gccacttctaatcctcatcatgaca

SEQ ID NO: 37836 - DNA, 25 bp, Mus musculus
gccacttctcgtaaacggaaagaag

SEQ ID NO: 37837 - DNA, 25 bp, Mus musculus
gccacttctgtatctggtttcctgt

SEQ ID NO: 37838 - DNA, 25 bp, Mus musculus
gccacttgcaaatctctggaagaga

SEQ ID NO: 37839 - DNA, 25 bp, Mus musculus
gccactttaactgcgcctatttggg

SEQ ID NO: 37840 - DNA, 25 bp, Mus musculus
gccactttgccaacgccatggacaa

SEQ ID NO: 37841 - DNA, 25 bp, Mus musculus
gccactttgccatcgccatggacaa

SEQ ID NO: 37842 - DNA, 25 bp, Mus musculus
gccacttttcacaggctttcttgtg

SEQ ID NO: 37843 - DNA, 25 bp, Mus musculus
gccagaaacgggaaatacagacttc

SEQ ID NO: 37844 - DNA, 25 bp, Mus musculus
gccagaaacgtgttggtaacagaaa

SEQ ID NO: 37845 - DNA, 25 bp, Mus musculus
gccagaaactttccctcagctgggc

SEQ ID NO: 37846 - DNA, 25 bp, Mus musculus
gccagaaagaggcaaattcgacttc

SEQ ID NO: 37847 - DNA, 25 bp, Mus musculus
gccagaacactgctagtaagccagc

SEQ ID NO: 37848 - DNA, 25 bp, Mus musculus
gccagaacactggtagtaagccagc

SEQ ID NO: 37849 - DNA, 25 bp, Mus musculus
gccagaacggctagtgtaactgcaa

SEQ ID NO: 37850 - DNA, 25 bp, Mus musculus
gccagaacggcttgtgtaactgcaa

SEQ ID NO: 37851 - DNA, 25 bp, Mus musculus
gccagaagagtgttgatgccctgga

SEQ ID NO: 37852 - DNA, 25 bp, Mus musculus
gccagaagcccacaaagaaagtcag

SEQ ID NO: 37853 - DNA, 25 bp, Mus musculus
gccagaaggcatatcccaaggctct

SEQ ID NO: 37854 - DNA, 25 bp, Mus musculus
gccagaaggcgaaggtctccttctc

SEQ ID NO: 37855 - DNA, 25 bp, Mus musculus
gccagaaggctgtcgaacccttgta

SEQ ID NO: 37856 - DNA, 25 bp, Mus musculus
gccagaatctccacggtggcttctg

SEQ ID NO: 37857 - DNA, 25 bp, Mus musculus
gccagaatggcccatgcctcaacat

SEQ ID NO: 37858 - DNA, 25 bp, Mus musculus
gccagaatggccgatgcctcaacat

SEQ ID NO: 37859 - DNA, 25 bp, Mus musculus
gccagaatgtcaccgagtacgtcgt

SEQ ID NO: 37860 - DNA, 25 bp, Mus musculus
gccagaatttgtcttatacaaggac

SEQ ID NO: 37861 - DNA, 25 bp, Mus musculus
gccagaatttgtgttatacaaggac

SEQ ID NO: 37862 - DNA, 25 bp, Mus musculus
gccagacaagagcactgaatctcct

SEQ ID NO: 37863 - DNA, 25 bp, Mus musculus
gccagacacagactctgagaccaga

SEQ ID NO: 37864 - DNA, 25 bp, Mus musculus
gccagacacgagtatacattcagca

SEQ ID NO: 37865 - DNA, 25 bp, Mus musculus
gccagacatcagaacaccctagaag

SEQ ID NO: 37866 - DNA, 25 bp, Mus musculus
gccagaccgttgctgcgacagatag

SEQ ID NO: 37867 - DNA, 25 bp, Mus musculus
gccagacgggtcacactgctggaag

SEQ ID NO: 37868 - DNA, 25 bp, Mus musculus
gccagactgggcactgcccctttgg

SEQ ID NO: 37869 - DNA, 25 bp, Mus musculus
gccagagacttgtcacctgtattat

SEQ ID NO: 37870 - DNA, 25 bp, Mus musculus
gccagagcaactttgatcaccatca

SEQ ID NO: 37871 - DNA, 25 bp, Mus musculus
gccagaggaagccattacccactgc

SEQ ID NO: 37872 - DNA, 25 bp, Mus musculus
gccagaggatctgagcgtcatctgt

SEQ ID NO: 37873 - DNA, 25 bp, Mus musculus
gccagaggctctataggactgccaa

SEQ ID NO: 37874 - DNA, 25 bp, Mus musculus
gccagagtggttgcctttgaaagtg

SEQ ID NO: 37875 - DNA, 25 bp, Mus musculus
gccagagtttgagagtgctgctgaa

SEQ ID NO: 37876 - DNA, 25 bp, Mus musculus
gccagatcctacagcggagtggaaa

SEQ ID NO: 37877 - DNA, 25 bp, Mus musculus
gccagatgagaaggccatcatgact

SEQ ID NO: 37878 - DNA, 25 bp, Mus musculus
gccagatgcggcagctgtgcattgc

SEQ ID NO: 37879 - DNA, 25 bp, Mus musculus
gccagatgggtccagcttcaacatg

SEQ ID NO: 37880 - DNA, 25 bp, Mus musculus
gccagattttgagctgcccctgact

SEQ ID NO: 37881 - DNA, 25 bp, Mus musculus
gccagcaaatttttcaagccattaa

SEQ ID NO: 37882 - DNA, 25 bp, Mus musculus
gccagcaactctgggaaagagtctg

SEQ ID NO: 37883 - DNA, 25 bp, Mus musculus
gccagcacccatttggagccatgaa

SEQ ID NO: 37884 - DNA, 25 bp, Mus musculus
gccagcacggataactcagtcataa

SEQ ID NO: 37885 - DNA, 25 bp, Mus musculus
gccagcagagtctctgaactgtttg

SEQ ID NO: 37886 - DNA, 25 bp, Mus musculus
gccagcagcaatccatactttaaag

SEQ ID NO: 37887 - DNA, 25 bp, Mus musculus
gccagcagctaaaaagccgccagca

SEQ ID NO: 37888 - DNA, 25 bp, Mus musculus
gccagcaggcactcagttcttacca

SEQ ID NO: 37889 - DNA, 25 bp, Mus musculus
gccagcatcagtgaactgaaaaaga

SEQ ID NO: 37890 - DNA, 25 bp, Mus musculus
gccagcatctttgcctggacacggg

SEQ ID NO: 37891 - DNA, 25 bp, Mus musculus
gccagcatgccaccaggaagtgatg

SEQ ID NO: 37892 - DNA, 25 bp, Mus musculus
gccagcatgtcatccacaaatactt

SEQ ID NO: 37893 - DNA, 25 bp, Mus musculus
gccagccacattctagaagtggtag

SEQ ID NO: 37894 - DNA, 25 bp, Mus musculus
gccagccacattgtagaagtggtag

SEQ ID NO: 37895 - DNA, 25 bp, Mus musculus
gccagccagcatcatgatgtaacaa

SEQ ID NO: 37896 - DNA, 25 bp, Mus musculus
gccagcccaagaaccaggaaagttc

SEQ ID NO: 37897 - DNA, 25 bp, Mus musculus
gccagcccacagtggatgtcagcca

SEQ ID NO: 37898 - DNA, 25 bp, Mus musculus
gccagccccatgtgttggaggcact

SEQ ID NO: 37899 - DNA, 25 bp, Mus musculus
gccagccctgaccagaggatcatct

SEQ ID NO: 37900 - DNA, 25 bp, Mus musculus
gccagccgttggcattgcacatcca

SEQ ID NO: 37901 - DNA, 25 bp, Mus musculus
gccagccgttgggattgcacatcca

SEQ ID NO: 37902 - DNA, 25 bp, Mus musculus
gccagcctgagggtgccgaggagga

SEQ ID NO: 37903 - DNA, 25 bp, Mus musculus
gccagcctgggcatggtagtcagca

SEQ ID NO: 37904 - DNA, 25 bp, Mus musculus
gccagcgagtggattcttgttccta

SEQ ID NO: 37905 - DNA, 25 bp, Mus musculus
gccagcgcaaaaatctccggtgttt

SEQ ID NO: 37906 - DNA, 25 bp, Mus musculus
gccagcgcaaaattctccggtgttt

SEQ ID NO: 37907 - DNA, 25 bp, Mus musculus
gccagcgcagctgctgagaattact

SEQ ID NO: 37908 - DNA, 25 bp, Mus musculus
gccagcgcgggcagatttcattgag

SEQ ID NO: 37909 - DNA, 25 bp, Mus musculus
gccagcgggccatgctgcagctgaa

SEQ ID NO: 37910 - DNA, 25 bp, Mus musculus
gccagcgtccacttcatctgtgtgg

SEQ ID NO: 37911 - DNA, 25 bp, Mus musculus
gccagcgtttctgaaccaagttaac

SEQ ID NO: 37912 - DNA, 25 bp, Mus musculus
gccagcgttttcatcttttctcagc

SEQ ID NO: 37913 - DNA, 25 bp, Mus musculus
gccagctaatgtatctaagactctg

SEQ ID NO: 37914 - DNA, 25 bp, Mus musculus
gccagctaatgtttctaagactctg

SEQ ID NO: 37915 - DNA, 25 bp, Mus musculus
gccagctactggatgccattcagca

SEQ ID NO: 37916 - DNA, 25 bp, Mus musculus
gccagctatgatgtctgcagtattc

SEQ ID NO: 37917 - DNA, 25 bp, Mus musculus
gccagctcccttaggaatgacagca

SEQ ID NO: 37918 - DNA, 25 bp, Mus musculus
gccagctccctttggaatgacagca

SEQ ID NO: 37919 - DNA, 25 bp, Mus musculus
gccagctccgaaagcaaaagaggga

SEQ ID NO: 37920 - DNA, 25 bp, Mus musculus
gccagctctgcaagggccagtcctg

SEQ ID NO: 37921 - DNA, 25 bp, Mus musculus
gccagctgctcgatgtggtcctcac

SEQ ID NO: 37922 - DNA, 25 bp, Mus musculus
gccagctggaaaggaacggaaacgt

SEQ ID NO: 37923 - DNA, 25 bp, Mus musculus
gccagctgtcaacattcagtatgaa

SEQ ID NO: 37924 - DNA, 25 bp, Mus musculus
gccagcttacaaccagagaccctga

SEQ ID NO: 37925 - DNA, 25 bp, Mus musculus
gccagcttagactacacagttatca

SEQ ID NO: 37926 - DNA, 25 bp, Mus musculus
gccagcttgaaggagtctacagaga

SEQ ID NO: 37927 - DNA, 25 bp, Mus musculus
gccagcttgatgtttaaaattcagc

SEQ ID NO: 37928 - DNA, 25 bp, Mus musculus
gccagcttggcacagttaacaacat

SEQ ID NO: 37929 - DNA, 25 bp, Mus musculus
gccagcttgtgcaccggtgctgagt

SEQ ID NO: 37930 - DNA, 25 bp, Mus musculus
gccaggaaaggctcaatgagagcag

SEQ ID NO: 37931 - DNA, 25 bp, Mus musculus
gccaggaaccagagttgctttggat

SEQ ID NO: 37932 - DNA, 25 bp, Mus musculus
gccaggaagtagcatagaactgcca

SEQ ID NO: 37933 - DNA, 25 bp, Mus musculus
gccaggaatgagctcaccgaaatga

SEQ ID NO: 37934 - DNA, 25 bp, Mus musculus
gccaggacatttggatgtaaaccca

SEQ ID NO: 37935 - DNA, 25 bp, Mus musculus
gccaggagcaagaccgtgtttacga

SEQ ID NO: 37936 - DNA, 25 bp, Mus musculus
gccaggagggccagccccatgtgtt

SEQ ID NO: 37937 - DNA, 25 bp, Mus musculus
gccaggatcatctgttgaacacccc

SEQ ID NO: 37938 - DNA, 25 bp, Mus musculus
gccaggatccaaacagtctctcaaa

SEQ ID NO: 37939 - DNA, 25 bp, Mus musculus
gccaggcaatgcatggtccagcatc

SEQ ID NO: 37940 - DNA, 25 bp, Mus musculus
gccaggcaggcttctcatgccagaa

SEQ ID NO: 37941 - DNA, 25 bp, Mus musculus
gccaggccagagaaacccaagttgg

SEQ ID NO: 37942 - DNA, 25 bp, Mus musculus
gccaggcgctaaagcttcggtgtca

SEQ ID NO: 37943 - DNA, 25 bp, Mus musculus
gccaggctaggacagcagcattaaa

SEQ ID NO: 37944 - DNA, 25 bp, Mus musculus
gccaggctcagagaaggacaatgag

SEQ ID NO: 37945 - DNA, 25 bp, Mus musculus
gccaggctcagctggaaagagagaa

SEQ ID NO: 37946 - DNA, 25 bp, Mus musculus
gccaggctgaagctgttccgacatt

SEQ ID NO: 37947 - DNA, 25 bp, Mus musculus
gccaggctggcatcagacccacaga

SEQ ID NO: 37948 - DNA, 25 bp, Mus musculus
gccaggctttgcataaaccaagaga

SEQ ID NO: 37949 - DNA, 25 bp, Mus musculus
gccagggcatccctatggagaacct

SEQ ID NO: 37950 - DNA, 25 bp, Mus musculus
gccaggtacggctgaaacaccggaa

SEQ ID NO: 37951 - DNA, 25 bp, Mus musculus
gccaggtcctgaattctctgggtct

SEQ ID NO: 37952 - DNA, 25 bp, Mus musculus
gccaggtgcttactattcctcagtc

SEQ ID NO: 37953 - DNA, 25 bp, Mus musculus
gccaggtgctttgcggatggaaccc

SEQ ID NO: 37954 - DNA, 25 bp, Mus musculus
gccaggttcccagggtgcatgaaag

SEQ ID NO: 37955 - DNA, 25 bp, Mus musculus
gccaggttccttccaatgctacaag

SEQ ID NO: 37956 - DNA, 25 bp, Mus musculus
gccagtaacatcgtcatgctgagga

SEQ ID NO: 37957 - DNA, 25 bp, Mus musculus
gccagtacctactgcaacatctttt

SEQ ID NO: 37958 - DNA, 25 bp, Mus musculus
gccagtagatgcacaggtgcgcctt

SEQ ID NO: 37959 - DNA, 25 bp, Mus musculus
gccagtagtctgagtttctgaccaa

SEQ ID NO: 37960 - DNA, 25 bp, Mus musculus
gccagtcaatggctagattgctcag

SEQ ID NO: 37961 - DNA, 25 bp, Mus musculus
gccagtcactcttaaaagcaggtct

SEQ ID NO: 37962 - DNA, 25 bp, Mus musculus
gccagtcattatatactgatgaacc

SEQ ID NO: 37963 - DNA, 25 bp, Mus musculus
gccagtccactcacagggatagcag

SEQ ID NO: 37964 - DNA, 25 bp, Mus musculus
gccagtcgccaatggaatgtacccc

SEQ ID NO: 37965 - DNA, 25 bp, Mus musculus
gccagtctgcaaatactgttatgag

SEQ ID NO: 37966 - DNA, 25 bp, Mus musculus
gccagtcttggcatcttcgaagtaa

SEQ ID NO: 37967 - DNA, 25 bp, Mus musculus
gccagtgaaatccaagccaagtgca

SEQ ID NO: 37968 - DNA, 25 bp, Mus musculus
gccagtgaagatggcatacaatgaa

SEQ ID NO: 37969 - DNA, 25 bp, Mus musculus
gccagtgaatgtcctgcagaaaatg

SEQ ID NO: 37970 - DNA, 25 bp, Mus musculus
gccagtgagaagctcatgactgtct

SEQ ID NO: 37971 - DNA, 25 bp, Mus musculus
gccagtgatattcctaagtcattac

SEQ ID NO: 37972 - DNA, 25 bp, Mus musculus
gccagtgatattgctaagtcattac

SEQ ID NO: 37973 - DNA, 25 bp, Mus musculus
gccagtgcacctttgacccaatggg

SEQ ID NO: 37974 - DNA, 25 bp, Mus musculus
gccagtgcattcagtttcccagtaa

SEQ ID NO: 37975 - DNA, 25 bp, Mus musculus
gccagtgccctacttaactggtatg

SEQ ID NO: 37976 - DNA, 25 bp, Mus musculus
gccagtgctggtgctggatgtcact

SEQ ID NO: 37977 - DNA, 25 bp, Mus musculus
gccagtggagccaagtgtatggaaa

SEQ ID NO: 37978 - DNA, 25 bp, Mus musculus
gccagtggccgtgcaatccagaaaa

SEQ ID NO: 37979 - DNA, 25 bp, Mus musculus
gccagtgtatggcaataaattgcta

SEQ ID NO: 37980 - DNA, 25 bp, Mus musculus
gccagtgtgtctatgtgcattgtaa

SEQ ID NO: 37981 - DNA, 25 bp, Mus musculus
gccagtgtgtctgtaaacgttctgt

SEQ ID NO: 37982 - DNA, 25 bp, Mus musculus
gccagtgttgtggtctccttcttcc

SEQ ID NO: 37983 - DNA, 25 bp, Mus musculus
gccagttaacaagactatagcagca

SEQ ID NO: 37984 - DNA, 25 bp, Mus musculus
gccagttacaagaacctcacactga

SEQ ID NO: 37985 - DNA, 25 bp, Mus musculus
gccagttcacttcatactgtccatg

SEQ ID NO: 37986 - DNA, 25 bp, Mus musculus
gccagttcagggtgatgcacaccca

SEQ ID NO: 37987 - DNA, 25 bp, Mus musculus
gccagttccataagcagattgctgt

SEQ ID NO: 37988 - DNA, 25 bp, Mus musculus
gccagttgctgagccagaaacatgt

SEQ ID NO: 37989 - DNA, 25 bp, Mus musculus
gccagtttgcttttattgcccggaa

SEQ ID NO: 37990 - DNA, 25 bp, Mus musculus
gccataaacgctgtgcatccaaagt

SEQ ID NO: 37991 - DNA, 25 bp, Mus musculus
gccataaagcggatcaacttggaaa

SEQ ID NO: 37992 - DNA, 25 bp, Mus musculus
gccataaagttggagcggatgctca

SEQ ID NO: 37993 - DNA, 25 bp, Mus musculus
gccataattagtcacagccatgact

SEQ ID NO: 37994 - DNA, 25 bp, Mus musculus
gccataattagtgacagccatgact

SEQ ID NO: 37995 - DNA, 25 bp, Mus musculus
gccatacctgagctcttaagagtca

SEQ ID NO: 37996 - DNA, 25 bp, Mus musculus
gccatactggggcttggcttaccca

SEQ ID NO: 37997 - DNA, 25 bp, Mus musculus
gccatagaggcattgagtctaccat

SEQ ID NO: 37998 - DNA, 25 bp, Mus musculus
gccatagatcttgtgtacattgact

SEQ ID NO: 37999 - DNA, 25 bp, Mus musculus
gccatataaaaattacggattttgg

SEQ ID NO: 38000 - DNA, 25 bp, Mus musculus
gccatatatgtcctgaaggacaggt

SEQ ID NO: 38001 - DNA, 25 bp, Mus musculus
gccatatcgacagatagtccagacc

SEQ ID NO: 38002 - DNA, 25 bp, Mus musculus
gccatatctgcaggtttccttgcct

SEQ ID NO: 38003 - DNA, 25 bp, Mus musculus
gccatatgattggtacaggacctgg

SEQ ID NO: 38004 - DNA, 25 bp, Mus musculus
gccatatgttgtagtgagacgagac

SEQ ID NO: 38005 - DNA, 25 bp, Mus musculus
gccatatgttgttgtgagacgagac

SEQ ID NO: 38006 - DNA, 25 bp, Mus musculus
gccatatttgctgagtccacacggg

SEQ ID NO: 38007 - DNA, 25 bp, Mus musculus
gccatattttccagtattgtcacct

SEQ ID NO: 38008 - DNA, 25 bp, Mus musculus
gccatcaaccagagtgcagtttcga

SEQ ID NO: 38009 - DNA, 25 bp, Mus musculus
gccatcaagtgttgcaggagaaact

SEQ ID NO: 38010 - DNA, 25 bp, Mus musculus
gccatcacaggtttgtccacctctg

SEQ ID NO: 38011 - DNA, 25 bp, Mus musculus
gccatcacgggagattttgctctgg

SEQ ID NO: 38012 - DNA, 25 bp, Mus musculus
gccatcaggactggcctggatgact

SEQ ID NO: 38013 - DNA, 25 bp, Mus musculus
gccatcatctttgtcatcaacaggg

SEQ ID NO: 38014 - DNA, 25 bp, Mus musculus
gccatcatgattggcgatgacatcg

SEQ ID NO: 38015 - DNA, 25 bp, Mus musculus
gccatcatgattgtgaggagggcca

SEQ ID NO: 38016 - DNA, 25 bp, Mus musculus
gccatccacaaatgcagagctgagg

SEQ ID NO: 38017 - DNA, 25 bp, Mus musculus
gccatccagaaagccagggagtgtg

SEQ ID NO: 38018 - DNA, 25 bp, Mus musculus
gccatccaggacatctctgtggaag

SEQ ID NO: 38019 - DNA, 25 bp, Mus musculus
gccatccataattctgtatgcattg

SEQ ID NO: 38020 - DNA, 25 bp, Mus musculus
gccatcccgatgttcacaaatacag

SEQ ID NO: 38021 - DNA, 25 bp, Mus musculus
gccatccgtctctccagttctatag

SEQ ID NO: 38022 - DNA, 25 bp, Mus musculus
gccatcctcgccttcctggtgtgat

SEQ ID NO: 38023 - DNA, 25 bp, Mus musculus
gccatcgatactggcccaaactggg

SEQ ID NO: 38024 - DNA, 25 bp, Mus musculus
gccatcgccaatgctttccggagaa

SEQ ID NO: 38025 - DNA, 25 bp, Mus musculus
gccatcgtgaaaaaacagcttgtaa

SEQ ID NO: 38026 - DNA, 25 bp, Mus musculus
gccatctccagccactagaaggacg

SEQ ID NO: 38027 - DNA, 25 bp, Mus musculus
gccatctcgactgtccaaggaggag

SEQ ID NO: 38028 - DNA, 25 bp, Mus musculus
gccatcttggagaacacaagccgtg

SEQ ID NO: 38029 - DNA, 25 bp, Mus musculus
gccatgaagtgccaaggataaggcc

SEQ ID NO: 38030 - DNA, 25 bp, Mus musculus
gccatgacagagacccgtgaaccca

SEQ ID NO: 38031 - DNA, 25 bp, Mus musculus
gccatgacatttgctgaggacaaga

SEQ ID NO: 38032 - DNA, 25 bp, Mus musculus
gccatgacgttgatggagtacctca

SEQ ID NO: 38033 - DNA, 25 bp, Mus musculus
gccatgacttctggcagatggtgtg

SEQ ID NO: 38034 - DNA, 25 bp, Mus musculus
gccatgagtctgttgctaacaccac

SEQ ID NO: 38035 - DNA, 25 bp, Mus musculus
gccatgatgagccaccacgagatga

SEQ ID NO: 38036 - DNA, 25 bp, Mus musculus
gccatgcaggtttctaagtatggtg

SEQ ID NO: 38037 - DNA, 25 bp, Mus musculus
gccatgcccaatatgtaaagaagaa

SEQ ID NO: 38038 - DNA, 25 bp, Mus musculus
gccatgccccacattcctgaggatg

SEQ ID NO: 38039 - DNA, 25 bp, Mus musculus
gccatgcgtggtttagttgattatc

SEQ ID NO: 38040 - DNA, 25 bp, Mus musculus
gccatgctctcatcgaaatgtggaa

SEQ ID NO: 38041 - DNA, 25 bp, Mus musculus
gccatgctgaccatgcacagttgaa

SEQ ID NO: 38042 - DNA, 25 bp, Mus musculus
gccatgctgagtgtggacgactgct

SEQ ID NO: 38043 - DNA, 25 bp, Mus musculus
gccatggaattcttacaagaactaa

SEQ ID NO: 38044 - DNA, 25 bp, Mus musculus
gccatggagaacagcgagtgctccc

SEQ ID NO: 38045 - DNA, 25 bp, Mus musculus
gccatggagcccagctatgctacac

SEQ ID NO: 38046 - DNA, 25 bp, Mus musculus
gccatggcacctcccctgtgggaga

SEQ ID NO: 38047 - DNA, 25 bp, Mus musculus
gccatggctgcagatccaaatttcc

SEQ ID NO: 38048 - DNA, 25 bp, Mus musculus
gccatggctgctggccctgtttgtt

SEQ ID NO: 38049 - DNA, 25 bp, Mus musculus
gccatgggcatgaccccaagtctgg

SEQ ID NO: 38050 - DNA, 25 bp, Mus musculus
gccatgggcatgtccccaagtctgg

SEQ ID NO: 38051 - DNA, 25 bp, Mus musculus
gccatggtccatgaactactgggca

SEQ ID NO: 38052 - DNA, 25 bp, Mus musculus
gccatggtgcactctgaaagtttga

SEQ ID NO: 38053 - DNA, 25 bp, Mus musculus
gccatgtattctcatactagactcc

SEQ ID NO: 38054 - DNA, 25 bp, Mus musculus
gccatgtgcgtccagagccctctgg

SEQ ID NO: 38055 - DNA, 25 bp, Mus musculus
gccatgtgctatcagagctggtctc

SEQ ID NO: 38056 - DNA, 25 bp, Mus musculus
gccatgtggaagtggtctctgagct

SEQ ID NO: 38057 - DNA, 25 bp, Mus musculus
gccatgtggacccagccaatgatac

SEQ ID NO: 38058 - DNA, 25 bp, Mus musculus
gccatgttgacaaaggcacagcaga

SEQ ID NO: 38059 - DNA, 25 bp, Mus musculus
gccatgttgatgcaagctgctgtca

SEQ ID NO: 38060 - DNA, 25 bp, Mus musculus
gccatgtttgccagctacgtccctg

SEQ ID NO: 38061 - DNA, 25 bp, Mus musculus
gccattaaacatgcccttagcgcag

SEQ ID NO: 38062 - DNA, 25 bp, Mus musculus
gccattaacaattctgaaatacgat

SEQ ID NO: 38063 - DNA, 25 bp, Mus musculus
gccattaagtcattgtggacacaaa

SEQ ID NO: 38064 - DNA, 25 bp, Mus musculus
gccattatctggcagaggttcagaa

SEQ ID NO: 38065 - DNA, 25 bp, Mus musculus
gccattatgtttgtctgcctgtgct

SEQ ID NO: 38066 - DNA, 25 bp, Mus musculus
gccattcacggaggctgcattggcg

SEQ ID NO: 38067 - DNA, 25 bp, Mus musculus
gccattcaggccagaaagcggaggc

SEQ ID NO: 38068 - DNA, 25 bp, Mus musculus
gccattccaaggacttatcccaaag

SEQ ID NO: 38069 - DNA, 25 bp, Mus musculus
gccattccataagtatgcctgccat

SEQ ID NO: 38070 - DNA, 25 bp, Mus musculus
gccattcctgccaaatatgagtatg

SEQ ID NO: 38071 - DNA, 25 bp, Mus musculus
gccattgaatgttgaaaaacaagtg

SEQ ID NO: 38072 - DNA, 25 bp, Mus musculus
gccattgaattagcaaccggagcag

SEQ ID NO: 38073 - DNA, 25 bp, Mus musculus
gccattgatctctataagcagctaa

SEQ ID NO: 38074 - DNA, 25 bp, Mus musculus
gccattgatggaatactttctatag

SEQ ID NO: 38075 - DNA, 25 bp, Mus musculus
gccattgcactctgccacaacgtga

SEQ ID NO: 38076 - DNA, 25 bp, Mus musculus
gccattgccagaaagagcgatttat

SEQ ID NO: 38077 - DNA, 25 bp, Mus musculus
gccattgccatacagagacctcagc

SEQ ID NO: 38078 - DNA, 25 bp, Mus musculus
gccattgccatagagagacctcagc

SEQ ID NO: 38079 - DNA, 25 bp, Mus musculus
gccattgcctcgaaaaccaaagaga

SEQ ID NO: 38080 - DNA, 25 bp, Mus musculus
gccattgctggaattctctccatta

SEQ ID NO: 38081 - DNA, 25 bp, Mus musculus
gccattggctctctgatggacgact

SEQ ID NO: 38082 - DNA, 25 bp, Mus musculus
gccattgggtaacaacagaagaaaa

SEQ ID NO: 38083 - DNA, 25 bp, Mus musculus
gccattgggtgcagaggagcagcct

SEQ ID NO: 38084 - DNA, 25 bp, Mus musculus
gccattggtcttcaggctccttatg

SEQ ID NO: 38085 - DNA, 25 bp, Mus musculus
gccattgtcactatcgaggctatgt

SEQ ID NO: 38086 - DNA, 25 bp, Mus musculus
gccattgtccatctagaagggaagt

SEQ ID NO: 38087 - DNA, 25 bp, Mus musculus
gccattgtgaaaccccaaatcctga

SEQ ID NO: 38088 - DNA, 25 bp, Mus musculus
gccattgttttgaagaacacctggc

SEQ ID NO: 38089 - DNA, 25 bp, Mus musculus
gccatttaccgatgggacccagaca

SEQ ID NO: 38090 - DNA, 25 bp, Mus musculus
gccatttattgaaactcgccaggat

SEQ ID NO: 38091 - DNA, 25 bp, Mus musculus
gcccaaaaaagctaaaatgagagaa

SEQ ID NO: 38092 - DNA, 25 bp, Mus musculus
gcccaaagatttacagttggaggag

SEQ ID NO: 38093 - DNA, 25 bp, Mus musculus
gcccaaaggaagaagctcaggacag

SEQ ID NO: 38094 - DNA, 25 bp, Mus musculus
gcccaaagggaaagcggcggcacct

SEQ ID NO: 38095 - DNA, 25 bp, Mus musculus
gcccaaatcgactgctttgaaagca

SEQ ID NO: 38096 - DNA, 25 bp, Mus musculus
gcccaacaataacggataaggaccg

SEQ ID NO: 38097 - DNA, 25 bp, Mus musculus
gcccaacaccggcttgtcagcaaag

SEQ ID NO: 38098 - DNA, 25 bp, Mus musculus
gcccaacacgtacattctctgtagt

SEQ ID NO: 38099 - DNA, 25 bp, Mus musculus
gcccaagaactcagggagtgtctga

SEQ ID NO: 38100 - DNA, 25 bp, Mus musculus
gcccaagacgtttcaggcctacttg

SEQ ID NO: 38101 - DNA, 25 bp, Mus musculus
gcccaagagatggaagtcggacttc

SEQ ID NO: 38102 - DNA, 25 bp, Mus musculus
gcccaagagggaagaagtccttcga

SEQ ID NO: 38103 - DNA, 25 bp, Mus musculus
gcccaagatggagggcctggacaac

SEQ ID NO: 38104 - DNA, 25 bp, Mus musculus
gcccaagcctgaagtagctcagcag

SEQ ID NO: 38105 - DNA, 25 bp, Mus musculus
gcccaagccttccatagaaatcaat

SEQ ID NO: 38106 - DNA, 25 bp, Mus musculus
gcccaagcttcgtgtctgacaagag

SEQ ID NO: 38107 - DNA, 25 bp, Mus musculus
gcccaaggaaaacatactcctgggc

SEQ ID NO: 38108 - DNA, 25 bp, Mus musculus
gcccaaggcctgagtggccagagca

SEQ ID NO: 38109 - DNA, 25 bp, Mus musculus
gcccaaggtggttactacaacaggg

SEQ ID NO: 38110 - DNA, 25 bp, Mus musculus
gcccaaggtttaccaggagacgtcg

SEQ ID NO: 38111 - DNA, 25 bp, Mus musculus
gcccaatgatccacttgtgccgact

SEQ ID NO: 38112 - DNA, 25 bp, Mus musculus
gcccacaatgacatatttaaaagca

SEQ ID NO: 38113 - DNA, 25 bp, Mus musculus
gcccacaatgaccttgttgacaagg

SEQ ID NO: 38114 - DNA, 25 bp, Mus musculus
gcccacaatggctgacgaactgtat

SEQ ID NO: 38115 - DNA, 25 bp, Mus musculus
gcccacaatggtggaaaccagtaag

SEQ ID NO: 38116 - DNA, 25 bp, Mus musculus
gcccacacaggtacatctggtccat

SEQ ID NO: 38117 - DNA, 25 bp, Mus musculus
gcccacagcatccaatatcagtgag

SEQ ID NO: 38118 - DNA, 25 bp, Mus musculus
gcccacagcttcttcgaagtcgtca

SEQ ID NO: 38119 - DNA, 25 bp, Mus musculus
gcccacagggtaattttagcagcga

SEQ ID NO: 38120 - DNA, 25 bp, Mus musculus
gcccacatagagaaggtgacagatg

SEQ ID NO: 38121 - DNA, 25 bp, Mus musculus
gcccacatggagtcgctttacagca

SEQ ID NO: 38122 - DNA, 25 bp, Mus musculus
gcccacccagtacaagggtctgtat

SEQ ID NO: 38123 - DNA, 25 bp, Mus musculus
gcccacgggccaaagtggccaagct

SEQ ID NO: 38124 - DNA, 25 bp, Mus musculus
gcccacgttctcctgttgtgaatag

SEQ ID NO: 38125 - DNA, 25 bp, Mus musculus
gcccactatgacttggccatcagtg

SEQ ID NO: 38126 - DNA, 25 bp, Mus musculus
gcccactgaatagtaatcacacagg

SEQ ID NO: 38127 - DNA, 25 bp, Mus musculus
gcccagaaatatggaggagctgaga

SEQ ID NO: 38128 - DNA, 25 bp, Mus musculus
gcccagaaattcacgtgagtacgcc

SEQ ID NO: 38129 - DNA, 25 bp, Mus musculus
gcccagaacataatgcagtcctttg

SEQ ID NO: 38130 - DNA, 25 bp, Mus musculus
gcccagaaccaaatgtacaccctgg

SEQ ID NO: 38131 - DNA, 25 bp, Mus musculus
gcccagaactgtgcggtcatgcaca

SEQ ID NO: 38132 - DNA, 25 bp, Mus musculus
gcccagaagaccagaaagccctgtc

SEQ ID NO: 38133 - DNA, 25 bp, Mus musculus
gcccagaagacctgaaagccctgtc

SEQ ID NO: 38134 - DNA, 25 bp, Mus musculus
gcccagaccacagatgaccaaaagg

SEQ ID NO: 38135 - DNA, 25 bp, Mus musculus
gcccagactgatcttgcttccttgg

SEQ ID NO: 38136 - DNA, 25 bp, Mus musculus
gcccagagatcagaacaatggccta

SEQ ID NO: 38137 - DNA, 25 bp, Mus musculus
gcccagagcatagtgactctctgga

SEQ ID NO: 38138 - DNA, 25 bp, Mus musculus
gcccagagcgtttccttcagctcgg

SEQ ID NO: 38139 - DNA, 25 bp, Mus musculus
gcccagagtgcccataacacagaac

SEQ ID NO: 38140 - DNA, 25 bp, Mus musculus
gcccagcaccaaaatacacgaaagt

SEQ ID NO: 38141 - DNA, 25 bp, Mus musculus
gcccagcagagttgtgttttcctga

SEQ ID NO: 38142 - DNA, 25 bp, Mus musculus
gcccagcagcaaaaagttgtcaaca

SEQ ID NO: 38143 - DNA, 25 bp, Mus musculus
gcccagcagtgtggaatgagagctc

SEQ ID NO: 38144 - DNA, 25 bp, Mus musculus
gcccagcatagaactcaagatgtct

SEQ ID NO: 38145 - DNA, 25 bp, Mus musculus
gcccagcatcgaaggataactttga

SEQ ID NO: 38146 - DNA, 25 bp, Mus musculus
gcccagccacagattgccacattag

SEQ ID NO: 38147 - DNA, 25 bp, Mus musculus
gcccagccctgacaaaatgcttcag

SEQ ID NO: 38148 - DNA, 25 bp, Mus musculus
gcccagcgaggacatctggaagaaa

SEQ ID NO: 38149 - DNA, 25 bp, Mus musculus
gcccagctaaccttgtaagatgaat

SEQ ID NO: 38150 - DNA, 25 bp, Mus musculus
gcccagctcagaatggtggacgacg

SEQ ID NO: 38151 - DNA, 25 bp, Mus musculus
gcccagctggctactctgctggaga

SEQ ID NO: 38152 - DNA, 25 bp, Mus musculus
gcccagctgtgggaatctctgtcac

SEQ ID NO: 38153 - DNA, 25 bp, Mus musculus
gcccagctgttcctatgaggacaaa

SEQ ID NO: 38154 - DNA, 25 bp, Mus musculus
gcccagcttgggacattcttcactt

SEQ ID NO: 38155 - DNA, 25 bp, Mus musculus
gcccaggaaactgggctcacctgga

SEQ ID NO: 38156 - DNA, 25 bp, Mus musculus
gcccaggaactgattgaaaacatca

SEQ ID NO: 38157 - DNA, 25 bp, Mus musculus
gcccaggaagtctttaatgagctac

SEQ ID NO: 38158 - DNA, 25 bp, Mus musculus
gcccaggaccaagttagaggcttcc

SEQ ID NO: 38159 - DNA, 25 bp, Mus musculus
gcccaggagggcaagcataaaagaa

SEQ ID NO: 38160 - DNA, 25 bp, Mus musculus
gcccaggagtgaatacccagcccta

SEQ ID NO: 38161 - DNA, 25 bp, Mus musculus
gcccaggctttactgctactattac

SEQ ID NO: 38162 - DNA, 25 bp, Mus musculus
gcccagggattgtggttgtaagcct

SEQ ID NO: 38163 - DNA, 25 bp, Mus musculus
gcccagggccagagatgatcagagc

SEQ ID NO: 38164 - DNA, 25 bp, Mus musculus
gcccagggcttgcaagagtccttct

SEQ ID NO: 38165 - DNA, 25 bp, Mus musculus
gcccagggcttggaagagtccttct

SEQ ID NO: 38166 - DNA, 25 bp, Mus musculus
gcccagggtttgtgagcacaagaca

SEQ ID NO: 38167 - DNA, 25 bp, Mus musculus
gcccaggtgcattgccaagcttgcc

SEQ ID NO: 38168 - DNA, 25 bp, Mus musculus
gcccagtactatggcgatatcggca

SEQ ID NO: 38169 - DNA, 25 bp, Mus musculus
gcccagtagaagactatatgaactt

SEQ ID NO: 38170 - DNA, 25 bp, Mus musculus
gcccagtcgttatgggccctcttca

SEQ ID NO: 38171 - DNA, 25 bp, Mus musculus
gcccagtcttctgatgaactgcctg

SEQ ID NO: 38172 - DNA, 25 bp, Mus musculus
gcccagtgacaacatttggaccaaa

SEQ ID NO: 38173 - DNA, 25 bp, Mus musculus
gcccagtgagtacatggaggttcct

SEQ ID NO: 38174 - DNA, 25 bp, Mus musculus
gcccagtgatggagcacgcgctgct

SEQ ID NO: 38175 - DNA, 25 bp, Mus musculus
gcccagtgcaaacagtgtaacatca

SEQ ID NO: 38176 - DNA, 25 bp, Mus musculus
gcccagtggaggtgctgttccaacc

SEQ ID NO: 38177 - DNA, 25 bp, Mus musculus
gcccagtggtttatcgtggtttata

SEQ ID NO: 38178 - DNA, 25 bp, Mus musculus
gcccagttcccactggataaagccg

SEQ ID NO: 38179 - DNA, 25 bp, Mus musculus
gcccagttcccagtggataaagccg

SEQ ID NO: 38180 - DNA, 25 bp, Mus musculus
gcccagttcctgaggtccttaccat

SEQ ID NO: 38181 - DNA, 25 bp, Mus musculus
gcccagttgcagaagcggccaatgg

SEQ ID NO: 38182 - DNA, 25 bp, Mus musculus
gcccagttggaagctcgggaccgtt

SEQ ID NO: 38183 - DNA, 25 bp, Mus musculus
gcccagttgttacaacaccctctgg

SEQ ID NO: 38184 - DNA, 25 bp, Mus musculus
gcccagtttcagttcatcctgctgc

SEQ ID NO: 38185 - DNA, 25 bp, Mus musculus
gcccagtttgctgcccttgtgttga

SEQ ID NO: 38186 - DNA, 25 bp, Mus musculus
gcccagtttggcgacattagcagat

SEQ ID NO: 38187 - DNA, 25 bp, Mus musculus
gcccataagaaagatggcggcttcg

SEQ ID NO: 38188 - DNA, 25 bp, Mus musculus
gcccatccagggagctcaaagccag

SEQ ID NO: 38189 - DNA, 25 bp, Mus musculus
gcccatcgactttccagaagaaaag

SEQ ID NO: 38190 - DNA, 25 bp, Mus musculus
gcccatctacctaaactctgatttg

SEQ ID NO: 38191 - DNA, 25 bp, Mus musculus
gcccatcttgatagacaaggtcatg

SEQ ID NO: 38192 - DNA, 25 bp, Mus musculus
gcccatgaagctcccacagatacgt

SEQ ID NO: 38193 - DNA, 25 bp, Mus musculus
gcccatgagaggaactactagatct

SEQ ID NO: 38194 - DNA, 25 bp, Mus musculus
gcccatgagaggtactactagatct

SEQ ID NO: 38195 - DNA, 25 bp, Mus musculus
gcccatgatcacaggtgcctgcaga

SEQ ID NO: 38196 - DNA, 25 bp, Mus musculus
gcccatgctaaagtaagattttcaa

SEQ ID NO: 38197 - DNA, 25 bp, Mus musculus
gcccatggaatgctgtgatcaacat

SEQ ID NO: 38198 - DNA, 25 bp, Mus musculus
gcccatggatattgacagtagtgat

SEQ ID NO: 38199 - DNA, 25 bp, Mus musculus
gcccatggcaggaacagcctcctgg

SEQ ID NO: 38200 - DNA, 25 bp, Mus musculus
gcccatgtggagcttggctactcta

SEQ ID NO: 38201 - DNA, 25 bp, Mus musculus
gcccattactgtcagcagcgagcag

SEQ ID NO: 38202 - DNA, 25 bp, Mus musculus
gcccattcctttggttgctacatga

SEQ ID NO: 38203 - DNA, 25 bp, Mus musculus
gcccattgctacaagcctggagttc

SEQ ID NO: 38204 - DNA, 25 bp, Mus musculus
gcccattgcttcagatgtatccact

SEQ ID NO: 38205 - DNA, 25 bp, Mus musculus
gcccattgggattccgccggctctt

SEQ ID NO: 38206 - DNA, 25 bp, Mus musculus
gcccatttggaggccagtgctgaga

SEQ ID NO: 38207 - DNA, 25 bp, Mus musculus
gccccaaactacagcactgtcatgg

SEQ ID NO: 38208 - DNA, 25 bp, Mus musculus
gccccaaactactgcactgtcatgg

SEQ ID NO: 38209 - DNA, 25 bp, Mus musculus
gccccaagccagtgattgctgccat

SEQ ID NO: 38210 - DNA, 25 bp, Mus musculus
gccccacattcctgaggatgaggag

SEQ ID NO: 38211 - DNA, 25 bp, Mus musculus
gccccactggtcaaaaagctggata

SEQ ID NO: 38212 - DNA, 25 bp, Mus musculus
gccccacttctacagtttcaggaca

SEQ ID NO: 38213 - DNA, 25 bp, Mus musculus
gccccagaagggaaagcctcttaag

SEQ ID NO: 38214 - DNA, 25 bp, Mus musculus
gccccagcagttagagcgtcctcag

SEQ ID NO: 38215 - DNA, 25 bp, Mus musculus
gccccaggaagagtcaacataatag

SEQ ID NO: 38216 - DNA, 25 bp, Mus musculus
gccccaggtgtcctccagtgcagaa

SEQ ID NO: 38217 - DNA, 25 bp, Mus musculus
gccccagtcaaaactggaaccaggg

SEQ ID NO: 38218 - DNA, 25 bp, Mus musculus
gccccagtggaaagctaaccctgag

SEQ ID NO: 38219 - DNA, 25 bp, Mus musculus
gccccatgctgcaaagagctttgct

SEQ ID NO: 38220 - DNA, 25 bp, Mus musculus
gccccattaagggaagagtttacat

SEQ ID NO: 38221 - DNA, 25 bp, Mus musculus
gccccattggtagcagctgtagcag

SEQ ID NO: 38222 - DNA, 25 bp, Mus musculus
gccccgaaggttaaaacttcagcag

SEQ ID NO: 38223 - DNA, 25 bp, Mus musculus
gccccgactgttcgagtgctccagt

SEQ ID NO: 38224 - DNA, 25 bp, Mus musculus
gccccgagagtacagtgacttctca

SEQ ID NO: 38225 - DNA, 25 bp, Mus musculus
gccccgcccttggagagtagtttag

SEQ ID NO: 38226 - DNA, 25 bp, Mus musculus
gccccgcgcctgagaattaacaagc

SEQ ID NO: 38227 - DNA, 25 bp, Mus musculus
gccccggacgttggtgagcaccaag

SEQ ID NO: 38228 - DNA, 25 bp, Mus musculus
gccccgtattcgagccccgtgggat

SEQ ID NO: 38229 - DNA, 25 bp, Mus musculus
gccccgtcaccaagtctgttattta

SEQ ID NO: 38230 - DNA, 25 bp, Mus musculus
gcccctaattacctagatgtctata

SEQ ID NO: 38231 - DNA, 25 bp, Mus musculus
gcccctacctatggttttacatgct

SEQ ID NO: 38232 - DNA, 25 bp, Mus musculus
gcccctactgtcactacctggagta

SEQ ID NO: 38233 - DNA, 25 bp, Mus musculus
gcccctacttcttgtacctcaaaag

SEQ ID NO: 38234 - DNA, 25 bp, Mus musculus
gcccctagtggacctgcagtttctt

SEQ ID NO: 38235 - DNA, 25 bp, Mus musculus
gcccctagtggatgagagagctccc

SEQ ID NO: 38236 - DNA, 25 bp, Mus musculus
gcccctcctatgaagagatgctgcg

SEQ ID NO: 38237 - DNA, 25 bp, Mus musculus
gcccctcgcaggatagcgaggttgc

SEQ ID NO: 38238 - DNA, 25 bp, Mus musculus
gcccctctggagaatatgagtacag

SEQ ID NO: 38239 - DNA, 25 bp, Mus musculus
gcccctgaagacacgggcctacaat

SEQ ID NO: 38240 - DNA, 25 bp, Mus musculus
gcccctgaagactcgggcctacaat

SEQ ID NO: 38241 - DNA, 25 bp, Mus musculus
gcccctgagtgatgcctacctcagt

SEQ ID NO: 38242 - DNA, 25 bp, Mus musculus
gcccctgatgattgtcactcagaag

SEQ ID NO: 38243 - DNA, 25 bp, Mus musculus
gcccctgatttctacgtggaaatga

SEQ ID NO: 38244 - DNA, 25 bp, Mus musculus
gcccctgctgttgagtgcacaagaa

SEQ ID NO: 38245 - DNA, 25 bp, Mus musculus
gcccctgctttgtgcgagttccggc

SEQ ID NO: 38246 - DNA, 25 bp, Mus musculus
gcccctggcctccaagcaggaaaag

SEQ ID NO: 38247 - DNA, 25 bp, Mus musculus
gcccctgggtcccttcacgaagtat

SEQ ID NO: 38248 - DNA, 25 bp, Mus musculus
gcccctgtgagcagacagataggac

SEQ ID NO: 38249 - DNA, 25 bp, Mus musculus
gcccctgtggagctcacagtctcag

SEQ ID NO: 38250 - DNA, 25 bp, Mus musculus
gccccttaagggagcagacagagca

SEQ ID NO: 38251 - DNA, 25 bp, Mus musculus
gccccttaagggtgcagacagagca

SEQ ID NO: 38252 - DNA, 25 bp, Mus musculus
gccccttactcagcacatgaaataa

SEQ ID NO: 38253 - DNA, 25 bp, Mus musculus
gccccttctcaaaggtagtacctta

SEQ ID NO: 38254 - DNA, 25 bp, Mus musculus
gccccttctcaatggtagtacctta

SEQ ID NO: 38255 - DNA, 25 bp, Mus musculus
gccccttgcaccagcgatcggaaag

SEQ ID NO: 38256 - DNA, 25 bp, Mus musculus
gccccttgcacctgcgatcggaaag

SEQ ID NO: 38257 - DNA, 25 bp, Mus musculus
gcccgaagtgtaagtccaactacag

SEQ ID NO: 38258 - DNA, 25 bp, Mus musculus
gcccgaccaaaacaggagaaagctt

SEQ ID NO: 38259 - DNA, 25 bp, Mus musculus
gcccgacgagaaggccataatgaca

SEQ ID NO: 38260 - DNA, 25 bp, Mus musculus
gcccgacttgggaaagctgacatag

SEQ ID NO: 38261 - DNA, 25 bp, Mus musculus
gcccgatttctgaagatcccgagaa

SEQ ID NO: 38262 - DNA, 25 bp, Mus musculus
gcccgcactaaggagcttgaacaga

SEQ ID NO: 38263 - DNA, 25 bp, Mus musculus
gcccgctcaacctggcttacttgta

SEQ ID NO: 38264 - DNA, 25 bp, Mus musculus
gcccgctcagcagacgggatgcatg

SEQ ID NO: 38265 - DNA, 25 bp, Mus musculus
gcccgctgtggtgactgctgaccta

SEQ ID NO: 38266 - DNA, 25 bp, Mus musculus
gcccggaagctattctgctcggcag

SEQ ID NO: 38267 - DNA, 25 bp, Mus musculus
gcccggagtttgctggatactctga

SEQ ID NO: 38268 - DNA, 25 bp, Mus musculus
gcccggatcctaacccatgaggctg

SEQ ID NO: 38269 - DNA, 25 bp, Mus musculus
gcccggatgatggtacaaactttcg

SEQ ID NO: 38270 - DNA, 25 bp, Mus musculus
gcccggcaacgctgcatggatggct

SEQ ID NO: 38271 - DNA, 25 bp, Mus musculus
gcccggcacccatgagttgtgacaa

SEQ ID NO: 38272 - DNA, 25 bp, Mus musculus
gcccggcagcactatgagagacatc

SEQ ID NO: 38273 - DNA, 25 bp, Mus musculus
gcccggcatgtggtaagcgagatcc

SEQ ID NO: 38274 - DNA, 25 bp, Mus musculus
gcccggccaaggagccaaggtagta

SEQ ID NO: 38275 - DNA, 25 bp, Mus musculus
gcccggcctgtgcaactgaggatac

SEQ ID NO: 38276 - DNA, 25 bp, Mus musculus
gcccggctctactctgatcactatg

SEQ ID NO: 38277 - DNA, 25 bp, Mus musculus
gcccggctggagtgtgagatcaaca

SEQ ID NO: 38278 - DNA, 25 bp, Mus musculus
gcccgggagtactttgaggacaaca

SEQ ID NO: 38279 - DNA, 25 bp, Mus musculus
gcccgggccagaataagtaacttag

SEQ ID NO: 38280 - DNA, 25 bp, Mus musculus
gcccgggccagattaagtaacttag

SEQ ID NO: 38281 - DNA, 25 bp, Mus musculus
gcccgggcgcgcagtgctgctctaa

SEQ ID NO: 38282 - DNA, 25 bp, Mus musculus
gcccgggtagttaaagacatggcaa

SEQ ID NO: 38283 - DNA, 25 bp, Mus musculus
gcccgtaagctggtcatcatcgaga

SEQ ID NO: 38284 - DNA, 25 bp, Mus musculus
gcccgtctttaatactgtgaaggaa

SEQ ID NO: 38285 - DNA, 25 bp, Mus musculus
gcccgtgaggcatcttcaaatagaa

SEQ ID NO: 38286 - DNA, 25 bp, Mus musculus
gcccgtgattcaccaagaaatgatt

SEQ ID NO: 38287 - DNA, 25 bp, Mus musculus
gcccgtgatttgatgtcaggttcaa

SEQ ID NO: 38288 - DNA, 25 bp, Mus musculus
gcccgtgcaagtcctgctcctttgg

SEQ ID NO: 38289 - DNA, 25 bp, Mus musculus
gcccgtgcatgtgctagacaaacca

SEQ ID NO: 38290 - DNA, 25 bp, Mus musculus
gcccgtgcttccaatctcctgtaat

SEQ ID NO: 38291 - DNA, 25 bp, Mus musculus
gcccgtggttgatttgttctgctcc

SEQ ID NO: 38292 - DNA, 25 bp, Mus musculus
gcccgtgtcagagtgtgaagaccag

SEQ ID NO: 38293 - DNA, 25 bp, Mus musculus
gcccgtgtgcagacgccggctcaga

SEQ ID NO: 38294 - DNA, 25 bp, Mus musculus
gcccgttcctgatgggaactgatct

SEQ ID NO: 38295 - DNA, 25 bp, Mus musculus
gccctaaatgcggagcgactggaga

SEQ ID NO: 38296 - DNA, 25 bp, Mus musculus
gccctaacgggagagaagttaccat

SEQ ID NO: 38297 - DNA, 25 bp, Mus musculus
gccctaagtttattcatctgatgta

SEQ ID NO: 38298 - DNA, 25 bp, Mus musculus
gccctaatcccactggcacaagaat

SEQ ID NO: 38299 - DNA, 25 bp, Mus musculus
gccctacaaggtgatcatgaagcag

SEQ ID NO: 38300 - DNA, 25 bp, Mus musculus
gccctacccacaggtggcagagatt

SEQ ID NO: 38301 - DNA, 25 bp, Mus musculus
gccctaccgtggacccagatgcagg

SEQ ID NO: 38302 - DNA, 25 bp, Mus musculus
gccctactaaaggaggacgctggga

SEQ ID NO: 38303 - DNA, 25 bp, Mus musculus
gccctagaggaggagaccaacgaga

SEQ ID NO: 38304 - DNA, 25 bp, Mus musculus
gccctagcacaaaacacagatctta

SEQ ID NO: 38305 - DNA, 25 bp, Mus musculus
gccctagtctgaagactctgtgcaa

SEQ ID NO: 38306 - DNA, 25 bp, Mus musculus
gccctagtggcttctgaggccaaga

SEQ ID NO: 38307 - DNA, 25 bp, Mus musculus
gccctatgaatacttatggaggtca

SEQ ID NO: 38308 - DNA, 25 bp, Mus musculus
gccctatgcactggtgagaagggct

SEQ ID NO: 38309 - DNA, 25 bp, Mus musculus
gccctatgctagctactttggaggt

SEQ ID NO: 38310 - DNA, 25 bp, Mus musculus
gccctatgctaggtactttggaggt

SEQ ID NO: 38311 - DNA, 25 bp, Mus musculus
gccctatgtggctaaactgattgaa

SEQ ID NO: 38312 - DNA, 25 bp, Mus musculus
gccctatttctagagacagctgctg

SEQ ID NO: 38313 - DNA, 25 bp, Mus musculus
gccctcaacaagaccggacttagca

SEQ ID NO: 38314 - DNA, 25 bp, Mus musculus
gccctcaagagtgtgagagttccta

SEQ ID NO: 38315 - DNA, 25 bp, Mus musculus
gccctcagcagggaacagtttctca

SEQ ID NO: 38316 - DNA, 25 bp, Mus musculus
gccctcagtacaattcgtctctcat

SEQ ID NO: 38317 - DNA, 25 bp, Mus musculus
gccctcatgaggatgctggacaatt

SEQ ID NO: 38318 - DNA, 25 bp, Mus musculus
gccctcattacagtgatcacttgaa

SEQ ID NO: 38319 - DNA, 25 bp, Mus musculus
gccctcccattccagaagcagatga

SEQ ID NO: 38320 - DNA, 25 bp, Mus musculus
gccctcggatggagagcctgagaca

SEQ ID NO: 38321 - DNA, 25 bp, Mus musculus
gccctctattttgcctgctacgaaa

SEQ ID NO: 38322 - DNA, 25 bp, Mus musculus
gccctctctgcaattgatgcctgta

SEQ ID NO: 38323 - DNA, 25 bp, Mus musculus
gccctctgccagaacctgggtgctg

SEQ ID NO: 38324 - DNA, 25 bp, Mus musculus
gccctctggatcagcagttaacatg

SEQ ID NO: 38325 - DNA, 25 bp, Mus musculus
gccctgaaaaccctctgagaggagt

SEQ ID NO: 38326 - DNA, 25 bp, Mus musculus
gccctgaacaacctggaggtgaagc

SEQ ID NO: 38327 - DNA, 25 bp, Mus musculus
gccctgaagcctgaagattcaactg

SEQ ID NO: 38328 - DNA, 25 bp, Mus musculus
gccctgaatgctgactttaatatca

SEQ ID NO: 38329 - DNA, 25 bp, Mus musculus
gccctgacattagagtcaattgaga

SEQ ID NO: 38330 - DNA, 25 bp, Mus musculus
gccctgacgacttcgtgggacaatg

SEQ ID NO: 38331 - DNA, 25 bp, Mus musculus
gccctgagccccaagatagcaaaga

SEQ ID NO: 38332 - DNA, 25 bp, Mus musculus
gccctgccttctttgctgaacgact

SEQ ID NO: 38333 - DNA, 25 bp, Mus musculus
gccctgccttgtctcaaagagaaga

SEQ ID NO: 38334 - DNA, 25 bp, Mus musculus
gccctgcgcaactgtttgtctccag

SEQ ID NO: 38335 - DNA, 25 bp, Mus musculus
gccctgcggtggtcatgaatcggtt

SEQ ID NO: 38336 - DNA, 25 bp, Mus musculus
gccctgctctatgcttactggacta

SEQ ID NO: 38337 - DNA, 25 bp, Mus musculus
gccctgctggaagataacactgttt

SEQ ID NO: 38338 - DNA, 25 bp, Mus musculus
gccctgctggactggatgctatgag

SEQ ID NO: 38339 - DNA, 25 bp, Mus musculus
gccctgctgggagttacaggcccta

SEQ ID NO: 38340 - DNA, 25 bp, Mus musculus
gccctgctgggctatgacatctcgg

SEQ ID NO: 38341 - DNA, 25 bp, Mus musculus
gccctgcttctctaaagaagtcagg

SEQ ID NO: 38342 - DNA, 25 bp, Mus musculus
gccctgcttgccctccatgtatagt

SEQ ID NO: 38343 - DNA, 25 bp, Mus musculus
gccctgctttccctgtacaagtgaa

SEQ ID NO: 38344 - DNA, 25 bp, Mus musculus
gccctggaactgataatgagcaagt

SEQ ID NO: 38345 - DNA, 25 bp, Mus musculus
gccctggagcacctgcatagcaagc

SEQ ID NO: 38346 - DNA, 25 bp, Mus musculus
gccctggagtccatggtgagacgct

SEQ ID NO: 38347 - DNA, 25 bp, Mus musculus
gccctggagtcctagtgagtgcttc

SEQ ID NO: 38348 - DNA, 25 bp, Mus musculus
gccctggcgctgaacttggaccctg

SEQ ID NO: 38349 - DNA, 25 bp, Mus musculus
gccctggctacccagcaatctcagg

SEQ ID NO: 38350 - DNA, 25 bp, Mus musculus
gccctgggaagttgctctgacctat

SEQ ID NO: 38351 - DNA, 25 bp, Mus musculus
gccctggtagtgttttcattcaaga

SEQ ID NO: 38352 - DNA, 25 bp, Mus musculus
gccctggtttgtggtagtgctgaca

SEQ ID NO: 38353 - DNA, 25 bp, Mus musculus
gccctgtaattctcagttggaaata

SEQ ID NO: 38354 - DNA, 25 bp, Mus musculus
gccctgtattggaaaccacccagca

SEQ ID NO: 38355 - DNA, 25 bp, Mus musculus
gccctgtcatgatttgccgtgaacc

SEQ ID NO: 38356 - DNA, 25 bp, Mus musculus
gccctgtcctggtggaagatacctg

SEQ ID NO: 38357 - DNA, 25 bp, Mus musculus
gccctgtctgcctactggatcgctt

SEQ ID NO: 38358 - DNA, 25 bp, Mus musculus
gccctgtgttccaaatatcttagta

SEQ ID NO: 38359 - DNA, 25 bp, Mus musculus
gccctgttggagtcaaggctctgag

SEQ ID NO: 38360 - DNA, 25 bp, Mus musculus
gccctgttttctattactcttccgg

SEQ ID NO: 38361 - DNA, 25 bp, Mus musculus
gccctgttttcttgtacgagttcca

SEQ ID NO: 38362 - DNA, 25 bp, Mus musculus
gcccttagctgatgggcaggtgtct

SEQ ID NO: 38363 - DNA, 25 bp, Mus musculus
gcccttagtttgagccgagaggagc

SEQ ID NO: 38364 - DNA, 25 bp, Mus musculus
gcccttatctgatggtagatcctgc

SEQ ID NO: 38365 - DNA, 25 bp, Mus musculus
gcccttcaaagctgcacactctaga

SEQ ID NO: 38366 - DNA, 25 bp, Mus musculus
gcccttccaagcattaaggcaaagg

SEQ ID NO: 38367 - DNA, 25 bp, Mus musculus
gcccttcccgttgagtggctttctg

SEQ ID NO: 38368 - DNA, 25 bp, Mus musculus
gcccttctacattggttactttatc

SEQ ID NO: 38369 - DNA, 25 bp, Mus musculus
gcccttctgaaactgatggtgttga

SEQ ID NO: 38370 - DNA, 25 bp, Mus musculus
gcccttctggaaagacagctaaaga

SEQ ID NO: 38371 - DNA, 25 bp, Mus musculus
gcccttctttccaagtggagactcg

SEQ ID NO: 38372 - DNA, 25 bp, Mus musculus
gcccttctttccaccattactggga

SEQ ID NO: 38373 - DNA, 25 bp, Mus musculus
gcccttgaagggtacacagactagc

SEQ ID NO: 38374 - DNA, 25 bp, Mus musculus
gcccttgagggctgagaccattaca

SEQ ID NO: 38375 - DNA, 25 bp, Mus musculus
gcccttgctacagttataggacaga

SEQ ID NO: 38376 - DNA, 25 bp, Mus musculus
gcccttggaagcacctgagaagtct

SEQ ID NO: 38377 - DNA, 25 bp, Mus musculus
gcccttggacttaacatttatgaga

SEQ ID NO: 38378 - DNA, 25 bp, Mus musculus
gcccttggagtgttaaataccttgt

SEQ ID NO: 38379 - DNA, 25 bp, Mus musculus
gcccttgtaattgtctactcatttg

SEQ ID NO: 38380 - DNA, 25 bp, Mus musculus
gccctttacttggtgcattactgcg

SEQ ID NO: 38381 - DNA, 25 bp, Mus musculus
gccctttcataaaggcatcggacag

SEQ ID NO: 38382 - DNA, 25 bp, Mus musculus
gccctttcatttcaagtacgactga

SEQ ID NO: 38383 - DNA, 25 bp, Mus musculus
gccctttccagttatgaagctccag

SEQ ID NO: 38384 - DNA, 25 bp, Mus musculus
gccctttgaacggacagttactatg

SEQ ID NO: 38385 - DNA, 25 bp, Mus musculus
gccctttggagacggctgttttcca

SEQ ID NO: 38386 - DNA, 25 bp, Mus musculus
gcccttttgcggctctggaccagca

SEQ ID NO: 38387 - DNA, 25 bp, Mus musculus
gccctttttgatagagtttacactc

SEQ ID NO: 38388 - DNA, 25 bp, Mus musculus
gccgaaaagagagaaacatccgaaa

SEQ ID NO: 38389 - DNA, 25 bp, Mus musculus
gccgaaagcgtgtttgcaaatgtcc

SEQ ID NO: 38390 - DNA, 25 bp, Mus musculus
gccgaaattgtttgcgcatttcaag

SEQ ID NO: 38391 - DNA, 25 bp, Mus musculus
gccgaactcatcgacttcttcaggt

SEQ ID NO: 38392 - DNA, 25 bp, Mus musculus
gccgaagactgtactatggaagtta

SEQ ID NO: 38393 - DNA, 25 bp, Mus musculus
gccgaagtgctaaaactgtccggga

SEQ ID NO: 38394 - DNA, 25 bp, Mus musculus
gccgaagttcgaggacacagagctg

SEQ ID NO: 38395 - DNA, 25 bp, Mus musculus
gccgaatagaccagaggcatcgcgc

SEQ ID NO: 38396 - DNA, 25 bp, Mus musculus
gccgacagagcgaagtatgcgccct

SEQ ID NO: 38397 - DNA, 25 bp, Mus musculus
gccgacatcaactctacagatgaaa

SEQ ID NO: 38398 - DNA, 25 bp, Mus musculus
gccgaccaagaaccagatacaaatg

SEQ ID NO: 38399 - DNA, 25 bp, Mus musculus
gccgaccgcagctgcaatgacctgt

SEQ ID NO: 38400 - DNA, 25 bp, Mus musculus
gccgaccgcatccaccaagatggaa

SEQ ID NO: 38401 - DNA, 25 bp, Mus musculus
gccgactcgcttatgctggctgagc

SEQ ID NO: 38402 - DNA, 25 bp, Mus musculus
gccgagaaggctgaagcataagcta

SEQ ID NO: 38403 - DNA, 25 bp, Mus musculus
gccgagaatcagcagccatctactt

SEQ ID NO: 38404 - DNA, 25 bp, Mus musculus
gccgagaccaacacctggaatgata

SEQ ID NO: 38405 - DNA, 25 bp, Mus musculus
gccgagaccttagccacattggaga

SEQ ID NO: 38406 - DNA, 25 bp, Mus musculus
gccgagagatggatgaacagatcag

SEQ ID NO: 38407 - DNA, 25 bp, Mus musculus
gccgagaggaacgagaaaaacagct

SEQ ID NO: 38408 - DNA, 25 bp, Mus musculus
gccgagatggaataccaggaatgcc

SEQ ID NO: 38409 - DNA, 25 bp, Mus musculus
gccgagctacagtacatgaccctga

SEQ ID NO: 38410 - DNA, 25 bp, Mus musculus
gccgagctctggagcacctgcttct

SEQ ID NO: 38411 - DNA, 25 bp, Mus musculus
gccgagctgagctgcagttacaaaa

SEQ ID NO: 38412 - DNA, 25 bp, Mus musculus
gccgaggaggctttctttaacacca

SEQ ID NO: 38413 - DNA, 25 bp, Mus musculus
gccgagggagttctctctagctctt

SEQ ID NO: 38414 - DNA, 25 bp, Mus musculus
gccgagtgtctgtgcgtttatcata

SEQ ID NO: 38415 - DNA, 25 bp, Mus musculus
gccgagtgtttcatcatggactaga

SEQ ID NO: 38416 - DNA, 25 bp, Mus musculus
gccgagttgcaatcaactgtgaaaa

SEQ ID NO: 38417 - DNA, 25 bp, Mus musculus
gccgataaaccagtgtgaaggagga

SEQ ID NO: 38418 - DNA, 25 bp, Mus musculus
gccgatagcatagacagtgatcaag

SEQ ID NO: 38419 - DNA, 25 bp, Mus musculus
gccgatcaacagtgctaatcgagat

SEQ ID NO: 38420 - DNA, 25 bp, Mus musculus
gccgatcgccaatggtgagctttgg

SEQ ID NO: 38421 - DNA, 25 bp, Mus musculus
gccgatgagcaacttccgcttcggg

SEQ ID NO: 38422 - DNA, 25 bp, Mus musculus
gccgatgcccattcttatcccgagt

SEQ ID NO: 38423 - DNA, 25 bp, Mus musculus
gccgatggattcctctcataaatga

SEQ ID NO: 38424 - DNA, 25 bp, Mus musculus
gccgcacattgcactgttttgtcaa

SEQ ID NO: 38425 - DNA, 25 bp, Mus musculus
gccgcactgaactggccattaaggt

SEQ ID NO: 38426 - DNA, 25 bp, Mus musculus
gccgcagacaggagctctccagctt

SEQ ID NO: 38427 - DNA, 25 bp, Mus musculus
gccgcagacatcttctgggtgtccg

SEQ ID NO: 38428 - DNA, 25 bp, Mus musculus
gccgcagagaagagtgaatgcagat

SEQ ID NO: 38429 - DNA, 25 bp, Mus musculus
gccgcagttggacaagacttcgctt

SEQ ID NO: 38430 - DNA, 25 bp, Mus musculus
gccgcagttggagaagacttcgctt

SEQ ID NO: 38431 - DNA, 25 bp, Mus musculus
gccgcatccctctggctgagtggga

SEQ ID NO: 38432 - DNA, 25 bp, Mus musculus
gccgcatgtatctcttctatggcaa

SEQ ID NO: 38433 - DNA, 25 bp, Mus musculus
gccgcattgaccaagcccagaagca

SEQ ID NO: 38434 - DNA, 25 bp, Mus musculus
gccgccactccctggagaacaaggt

SEQ ID NO: 38435 - DNA, 25 bp, Mus musculus
gccgccagcaccagcgaaatgtcaa

SEQ ID NO: 38436 - DNA, 25 bp, Mus musculus
gccgccatttttgctgttatgtcga

SEQ ID NO: 38437 - DNA, 25 bp, Mus musculus
gccgcccacggactggacattgatg

SEQ ID NO: 38438 - DNA, 25 bp, Mus musculus
gccgcccagcagagttgtgttttcc

SEQ ID NO: 38439 - DNA, 25 bp, Mus musculus
gccgccggcattttctgggcctctg

SEQ ID NO: 38440 - DNA, 25 bp, Mus musculus
gccgccggtgttaacaccacggaca

SEQ ID NO: 38441 - DNA, 25 bp, Mus musculus
gccgccgtcgctcagtacagttgat

SEQ ID NO: 38442 - DNA, 25 bp, Mus musculus
gccgcctggtggtgtacgtctctca

SEQ ID NO: 38443 - DNA, 25 bp, Mus musculus
gccgccttccttgtcgggtgttata

SEQ ID NO: 38444 - DNA, 25 bp, Mus musculus
gccgcgaggaatagctgtgcatcca

SEQ ID NO: 38445 - DNA, 25 bp, Mus musculus
gccgcgcctctgatggattctgcat

SEQ ID NO: 38446 - DNA, 25 bp, Mus musculus
gccgcgctccttcctggtcaggaag

SEQ ID NO: 38447 - DNA, 25 bp, Mus musculus
gccgcgctccttgctggtcaggaag

SEQ ID NO: 38448 - DNA, 25 bp, Mus musculus
gccgcgtgatgcttggagagaccaa

SEQ ID NO: 38449 - DNA, 25 bp, Mus musculus
gccgctaaagcagaggacgattctt

SEQ ID NO: 38450 - DNA, 25 bp, Mus musculus
gccgctaccgcaagatcaagcacga

SEQ ID NO: 38451 - DNA, 25 bp, Mus musculus
gccgctaccgcatgatcaagcacga

SEQ ID NO: 38452 - DNA, 25 bp, Mus musculus
gccgctatgccgcagtgttccagga

SEQ ID NO: 38453 - DNA, 25 bp, Mus musculus
gccgctcacaaatagaggtgtggat

SEQ ID NO: 38454 - DNA, 25 bp, Mus musculus
gccgctcaccgtctccaagaagata

SEQ ID NO: 38455 - DNA, 25 bp, Mus musculus
gccgctgatcgtagctatcctgaaa

SEQ ID NO: 38456 - DNA, 25 bp, Mus musculus
gccgctgcagcctggaatctcttca

SEQ ID NO: 38457 - DNA, 25 bp, Mus musculus
gccgctgcttcataggcactgtgat

SEQ ID NO: 38458 - DNA, 25 bp, Mus musculus
gccgctggtgcaaagaattctggga

SEQ ID NO: 38459 - DNA, 25 bp, Mus musculus
gccgctgtgatgacggtggtttcac

SEQ ID NO: 38460 - DNA, 25 bp, Mus musculus
gccgctgtgatgtcggtggtttcac

SEQ ID NO: 38461 - DNA, 25 bp, Mus musculus
gccgcttaccttttgaccactgcag

SEQ ID NO: 38462 - DNA, 25 bp, Mus musculus
gccgcttcgccaaggaagtgctgcc

SEQ ID NO: 38463 - DNA, 25 bp, Mus musculus
gccgcttcggtctctgtgagcgaga

SEQ ID NO: 38464 - DNA, 25 bp, Mus musculus
gccggaaagacatcaacagaaaaaa

SEQ ID NO: 38465 - DNA, 25 bp, Mus musculus
gccggaaagataccttcttgtgcta

SEQ ID NO: 38466 - DNA, 25 bp, Mus musculus
gccggaagacgccagaggaactact

SEQ ID NO: 38467 - DNA, 25 bp, Mus musculus
gccggaagaggcattagatgccctg

SEQ ID NO: 38468 - DNA, 25 bp, Mus musculus
gccggaagaggctttagatgccctg

SEQ ID NO: 38469 - DNA, 25 bp, Mus musculus
gccggaagcccaactatagcgagct

SEQ ID NO: 38470 - DNA, 25 bp, Mus musculus
gccggaagcccatctatagcgagct

SEQ ID NO: 38471 - DNA, 25 bp, Mus musculus
gccggaagctgatctggtagccagt

SEQ ID NO: 38472 - DNA, 25 bp, Mus musculus
gccggactgactcagaactttggaa

SEQ ID NO: 38473 - DNA, 25 bp, Mus musculus
gccggactggccacccaggaaaact

SEQ ID NO: 38474 - DNA, 25 bp, Mus musculus
gccggagaatctactggacagacag

SEQ ID NO: 38475 - DNA, 25 bp, Mus musculus
gccggaggagctgacactcagacat

SEQ ID NO: 38476 - DNA, 25 bp, Mus musculus
gccggagttgtaccacccaatgaaa

SEQ ID NO: 38477 - DNA, 25 bp, Mus musculus
gccggatcacgattgccatcaacaa

SEQ ID NO: 38478 - DNA, 25 bp, Mus musculus
gccggatctcgatgacaatgaggag

SEQ ID NO: 38479 - DNA, 25 bp, Mus musculus
gccggatgaaataaccaaagatgaa

SEQ ID NO: 38480 - DNA, 25 bp, Mus musculus
gccggattcatcactgcatgaggtt

SEQ ID NO: 38481 - DNA, 25 bp, Mus musculus
gccggcaagagtcagtatcttctgg

SEQ ID NO: 38482 - DNA, 25 bp, Mus musculus
gccggccccatggatctgtacttga

SEQ ID NO: 38483 - DNA, 25 bp, Mus musculus
gccggcctcgtgctttccaggagct

SEQ ID NO: 38484 - DNA, 25 bp, Mus musculus
gccggcctcgtggtttccaggagct

SEQ ID NO: 38485 - DNA, 25 bp, Mus musculus
gccggctccattgcgagtgcacaga

SEQ ID NO: 38486 - DNA, 25 bp, Mus musculus
gccgggaatatgtcgacttagagag

SEQ ID NO: 38487 - DNA, 25 bp, Mus musculus
gccgggacctgaacatggactgtgt

SEQ ID NO: 38488 - DNA, 25 bp, Mus musculus
gccgggagacaccactgtcataagt

SEQ ID NO: 38489 - DNA, 25 bp, Mus musculus
gccgggatcacaagttgcatgttga

SEQ ID NO: 38490 - DNA, 25 bp, Mus musculus
gccgggcaagttgcctttggtatca

SEQ ID NO: 38491 - DNA, 25 bp, Mus musculus
gccgggcagttgtatctgtgagcca

SEQ ID NO: 38492 - DNA, 25 bp, Mus musculus
gccgggcctgcatcaattgagcgag

SEQ ID NO: 38493 - DNA, 25 bp, Mus musculus
gccgggctcatcaggagtcgactca

SEQ ID NO: 38494 - DNA, 25 bp, Mus musculus
gccgggtagtgctggcctccttcct

SEQ ID NO: 38495 - DNA, 25 bp, Mus musculus
gccgggttcttgtttgctgttccta

SEQ ID NO: 38496 - DNA, 25 bp, Mus musculus
gccggtcctggagtagaagtcaccc

SEQ ID NO: 38497 - DNA, 25 bp, Mus musculus
gccggtgcaagcaaaaaccaggagg

SEQ ID NO: 38498 - DNA, 25 bp, Mus musculus
gccggtggcagagctcagctacaat

SEQ ID NO: 38499 - DNA, 25 bp, Mus musculus
gccggtggcagccagaactgataca

SEQ ID NO: 38500 - DNA, 25 bp, Mus musculus
gccggttcttgcgaaagactcgttg

SEQ ID NO: 38501 - DNA, 25 bp, Mus musculus
gccgtaatcaaccttatatcgatga

SEQ ID NO: 38502 - DNA, 25 bp, Mus musculus
gccgtacagagtatactgtgacatg

SEQ ID NO: 38503 - DNA, 25 bp, Mus musculus
gccgtagtagtttacgatatcacaa

SEQ ID NO: 38504 - DNA, 25 bp, Mus musculus
gccgtagtcacgtatcagctcctgg

SEQ ID NO: 38505 - DNA, 25 bp, Mus musculus
gccgtccgttagtcctggagtcaag

SEQ ID NO: 38506 - DNA, 25 bp, Mus musculus
gccgtcctagtgtttgacatcgaac

SEQ ID NO: 38507 - DNA, 25 bp, Mus musculus
gccgtcgggtttgccctaaggtcag

SEQ ID NO: 38508 - DNA, 25 bp, Mus musculus
gccgtctgataaagagaggcttact

SEQ ID NO: 38509 - DNA, 25 bp, Mus musculus
gccgtctgctgaccttggatagctc

SEQ ID NO: 38510 - DNA, 25 bp, Mus musculus
gccgtctggaacaggaaaagcaggt

SEQ ID NO: 38511 - DNA, 25 bp, Mus musculus
gccgtgacctcatgattgttttgcc

SEQ ID NO: 38512 - DNA, 25 bp, Mus musculus
gccgtgactcgaaatccccagactg

SEQ ID NO: 38513 - DNA, 25 bp, Mus musculus
gccgtgatgccgtcaccaggaacat

SEQ ID NO: 38514 - DNA, 25 bp, Mus musculus
gccgtgcaatccagaaaaaaccctg

SEQ ID NO: 38515 - DNA, 25 bp, Mus musculus
gccgtgcagaacaaagtggtggtca

SEQ ID NO: 38516 - DNA, 25 bp, Mus musculus
gccgtggaatagcaattgcagttga

SEQ ID NO: 38517 - DNA, 25 bp, Mus musculus
gccgtggactgctgtctctgtccct

SEQ ID NO: 38518 - DNA, 25 bp, Mus musculus
gccgtggcagagatccatttcacat

SEQ ID NO: 38519 - DNA, 25 bp, Mus musculus
gccgtggctgacactaaagactttg

SEQ ID NO: 38520 - DNA, 25 bp, Mus musculus
gccgtgtggcgctacttccgagact

SEQ ID NO: 38521 - DNA, 25 bp, Mus musculus
gccgtgtggttgacgccctcggtaa

SEQ ID NO: 38522 - DNA, 25 bp, Mus musculus
gccgttacgattgcacgtgaagcga

SEQ ID NO: 38523 - DNA, 25 bp, Mus musculus
gccgttcctcagttaccagaggatg

SEQ ID NO: 38524 - DNA, 25 bp, Mus musculus
gccgttcgcgttagatcttccctta

SEQ ID NO: 38525 - DNA, 25 bp, Mus musculus
gccgttcgcgtttgatcttccctta

SEQ ID NO: 38526 - DNA, 25 bp, Mus musculus
gccgttggtcataatcagcagagtt

SEQ ID NO: 38527 - DNA, 25 bp, Mus musculus
gccgttgtgcctgttccactatcta

SEQ ID NO: 38528 - DNA, 25 bp, Mus musculus
gccgtttgatgatggagctccaccc

SEQ ID NO: 38529 - DNA, 25 bp, Mus musculus
gccgtttgggaaatatgttagtgga

SEQ ID NO: 38530 - DNA, 25 bp, Mus musculus
gccgttttggatttcgttgacgatt

SEQ ID NO: 38531 - DNA, 25 bp, Mus musculus
gcctaaagaggttaaaagcagaaag

SEQ ID NO: 38532 - DNA, 25 bp, Mus musculus
gcctaaaggaaccattgaatatact

SEQ ID NO: 38533 - DNA, 25 bp, Mus musculus
gcctaaagtacaagacaacacagag

SEQ ID NO: 38534 - DNA, 25 bp, Mus musculus
gcctaaatgtgatgagtgtctgcca

SEQ ID NO: 38535 - DNA, 25 bp, Mus musculus
gcctaagtcacactgtcattcgaaa

SEQ ID NO: 38536 - DNA, 25 bp, Mus musculus
gcctaatagcaaacagtctatttcg

SEQ ID NO: 38537 - DNA, 25 bp, Mus musculus
gcctaattcctgatcccaagcgctt

SEQ ID NO: 38538 - DNA, 25 bp, Mus musculus
gcctacaaggatggcctcagttcat

SEQ ID NO: 38539 - DNA, 25 bp, Mus musculus
gcctacccaacagaacttgtgattt

SEQ ID NO: 38540 - DNA, 25 bp, Mus musculus
gcctaccctgaagctgtcacaatta

SEQ ID NO: 38541 - DNA, 25 bp, Mus musculus
gcctaccgcaaatgtactttttcag

SEQ ID NO: 38542 - DNA, 25 bp, Mus musculus
gcctacctcccgtggctggagagaa

SEQ ID NO: 38543 - DNA, 25 bp, Mus musculus
gcctacctgctgagggggacccctg

SEQ ID NO: 38544 - DNA, 25 bp, Mus musculus
gcctaccttttccaatgccttgaat

SEQ ID NO: 38545 - DNA, 25 bp, Mus musculus
gcctacggaccaagtgatgctcaaa

SEQ ID NO: 38546 - DNA, 25 bp, Mus musculus
gcctacgtggtgactcggacagtga

SEQ ID NO: 38547 - DNA, 25 bp, Mus musculus
gcctactctgtatgttgggaagtat

SEQ ID NO: 38548 - DNA, 25 bp, Mus musculus
gcctactggacatctgtgagcatgc

SEQ ID NO: 38549 - DNA, 25 bp, Mus musculus
gcctactggttctggaagggccaaa

SEQ ID NO: 38550 - DNA, 25 bp, Mus musculus
gcctacttttatcttcgaacacatt

SEQ ID NO: 38551 - DNA, 25 bp, Mus musculus
gcctagaagaggagataacatccat

SEQ ID NO: 38552 - DNA, 25 bp, Mus musculus
gcctagactgtctgcccttctgtgc

SEQ ID NO: 38553 - DNA, 25 bp, Mus musculus
gcctagcacccatagggcaaccatt

SEQ ID NO: 38554 - DNA, 25 bp, Mus musculus
gcctaggacaatgcttcagttacag

SEQ ID NO: 38555 - DNA, 25 bp, Mus musculus
gcctaggcacggtcactggctctgt

SEQ ID NO: 38556 - DNA, 25 bp, Mus musculus
gcctagtgggcagggaccttcttcc

SEQ ID NO: 38557 - DNA, 25 bp, Mus musculus
gcctatacgtcgagccgtgaattct

SEQ ID NO: 38558 - DNA, 25 bp, Mus musculus
gcctatagagatcacatatcgagcg

SEQ ID NO: 38559 - DNA, 25 bp, Mus musculus
gcctatcacgtaattgaccgcgcta

SEQ ID NO: 38560 - DNA, 25 bp, Mus musculus
gcctatgactgcatcatcttcagtg

SEQ ID NO: 38561 - DNA, 25 bp, Mus musculus
gcctatgactgcttcatcttcagtg

SEQ ID NO: 38562 - DNA, 25 bp, Mus musculus
gcctatgagcccgtgtgtagacacg

SEQ ID NO: 38563 - DNA, 25 bp, Mus musculus
gcctatgatgcctacggaccaagtg

SEQ ID NO: 38564 - DNA, 25 bp, Mus musculus
gcctatgcacttcatggtggacaca

SEQ ID NO: 38565 - DNA, 25 bp, Mus musculus
gcctatgcagactatcatgacctca

SEQ ID NO: 38566 - DNA, 25 bp, Mus musculus
gcctatgccagacacagggctgcga

SEQ ID NO: 38567 - DNA, 25 bp, Mus musculus
gcctatgcctggctggtccctctgg

SEQ ID NO: 38568 - DNA, 25 bp, Mus musculus
gcctatggatttgtcaactataaag

SEQ ID NO: 38569 - DNA, 25 bp, Mus musculus
gcctatggcatgagcccctccttaa

SEQ ID NO: 38570 - DNA, 25 bp, Mus musculus
gcctatgtctctgctcttcagtaca

SEQ ID NO: 38571 - DNA, 25 bp, Mus musculus
gcctattcactgagggcaaagaaga

SEQ ID NO: 38572 - DNA, 25 bp, Mus musculus
gcctatttcccctgtattggttgtg

SEQ ID NO: 38573 - DNA, 25 bp, Mus musculus
gcctatttgccgcatgagctgctgg

SEQ ID NO: 38574 - DNA, 25 bp, Mus musculus
gcctcaaaacggagggcaataggtt

SEQ ID NO: 38575 - DNA, 25 bp, Mus musculus
gcctcaaacttctatgttcagagtg

SEQ ID NO: 38576 - DNA, 25 bp, Mus musculus
gcctcaaagctgtgaccctctttct

SEQ ID NO: 38577 - DNA, 25 bp, Mus musculus
gcctcaacagaggagccaagtgtga

SEQ ID NO: 38578 - DNA, 25 bp, Mus musculus
gcctcaacatagagcctggctacat

SEQ ID NO: 38579 - DNA, 25 bp, Mus musculus
gcctcaacatagtgcctggctacat

SEQ ID NO: 38580 - DNA, 25 bp, Mus musculus
gcctcaagacagagatgatctctat

SEQ ID NO: 38581 - DNA, 25 bp, Mus musculus
gcctcaaggcattacgtcaccaagt

SEQ ID NO: 38582 - DNA, 25 bp, Mus musculus
gcctcaatgagctctccatggctgg

SEQ ID NO: 38583 - DNA, 25 bp, Mus musculus
gcctcacagacatcttgactagagt

SEQ ID NO: 38584 - DNA, 25 bp, Mus musculus
gcctcacatcaagacgagctgtaag

SEQ ID NO: 38585 - DNA, 25 bp, Mus musculus
gcctcacattttacttctggacgaa

SEQ ID NO: 38586 - DNA, 25 bp, Mus musculus
gcctcaccattgcagacctgagtga

SEQ ID NO: 38587 - DNA, 25 bp, Mus musculus
gcctcaccgattttctggcacagaa

SEQ ID NO: 38588 - DNA, 25 bp, Mus musculus
gcctcaccgcctatgtgatgaaaga

SEQ ID NO: 38589 - DNA, 25 bp, Mus musculus
gcctcacgctgattggctctcctaa

SEQ ID NO: 38590 - DNA, 25 bp, Mus musculus
gcctcactatcgctgggatcctctt

SEQ ID NO: 38591 - DNA, 25 bp, Mus musculus
gcctcagaatgtgggaggataccag

SEQ ID NO: 38592 - DNA, 25 bp, Mus musculus
gcctcagacctcctcaagagagatg

SEQ ID NO: 38593 - DNA, 25 bp, Mus musculus
gcctcagatctgacgtggaccttcc

SEQ ID NO: 38594 - DNA, 25 bp, Mus musculus
gcctcagcatttatctggactggaa

SEQ ID NO: 38595 - DNA, 25 bp, Mus musculus
gcctcagccagctgggccgctggat

SEQ ID NO: 38596 - DNA, 25 bp, Mus musculus
gcctcagctctgttcaaatctggct

SEQ ID NO: 38597 - DNA, 25 bp, Mus musculus
gcctcaggatatcatcgtgtttatt

SEQ ID NO: 38598 - DNA, 25 bp, Mus musculus
gcctcaggccaccatttctgaaatc

SEQ ID NO: 38599 - DNA, 25 bp, Mus musculus
gcctcagtgatacagtgcaacgcct

SEQ ID NO: 38600 - DNA, 25 bp, Mus musculus
gcctcagtgtccaaggctgcttcca

SEQ ID NO: 38601 - DNA, 25 bp, Mus musculus
gcctcatcttaatagtcattttcat

SEQ ID NO: 38602 - DNA, 25 bp, Mus musculus
gcctcatgagaagacacaagcggcg

SEQ ID NO: 38603 - DNA, 25 bp, Mus musculus
gcctcatgcttagtatgtgacaaag

SEQ ID NO: 38604 - DNA, 25 bp, Mus musculus
gcctcatggccgtcgcctggttcat

SEQ ID NO: 38605 - DNA, 25 bp, Mus musculus
gcctcatgggcattggacgtcgtcc

SEQ ID NO: 38606 - DNA, 25 bp, Mus musculus
gcctcatttgagcaagagcctggga

SEQ ID NO: 38607 - DNA, 25 bp, Mus musculus
gcctccaaaaccattatatctgcag

SEQ ID NO: 38608 - DNA, 25 bp, Mus musculus
gcctccaaattggaaatatctgcaa

SEQ ID NO: 38609 - DNA, 25 bp, Mus musculus
gcctccaagacacaaaggaaaacaa

SEQ ID NO: 38610 - DNA, 25 bp, Mus musculus
gcctccagaggaaaaactgatgtcc

SEQ ID NO: 38611 - DNA, 25 bp, Mus musculus
gcctccagcagaaagtagacaccat

SEQ ID NO: 38612 - DNA, 25 bp, Mus musculus
gcctccagtttgatgaattccagat

SEQ ID NO: 38613 - DNA, 25 bp, Mus musculus
gcctccatagtgatagcctccaaga

SEQ ID NO: 38614 - DNA, 25 bp, Mus musculus
gcctccatttgaccaaaaacttgac

SEQ ID NO: 38615 - DNA, 25 bp, Mus musculus
gcctcccaggagtatggacaagcct

SEQ ID NO: 38616 - DNA, 25 bp, Mus musculus
gcctcccatgcatgtccagtgcagt

SEQ ID NO: 38617 - DNA, 25 bp, Mus musculus
gcctccccagagtgacaagtgcgag

SEQ ID NO: 38618 - DNA, 25 bp, Mus musculus
gcctccgaaagctgtctcgccagtg

SEQ ID NO: 38619 - DNA, 25 bp, Mus musculus
gcctccgtagcggtgtcatcctttg

SEQ ID NO: 38620 - DNA, 25 bp, Mus musculus
gcctccgtgtgttcatccgacagca

SEQ ID NO: 38621 - DNA, 25 bp, Mus musculus
gcctccgtttgcttgttgctgataa

SEQ ID NO: 38622 - DNA, 25 bp, Mus musculus
gcctcctagtggtactgtttcttcc

SEQ ID NO: 38623 - DNA, 25 bp, Mus musculus
gcctcctcactgacatgtatgatgc

SEQ ID NO: 38624 - DNA, 25 bp, Mus musculus
gcctcctctgccacgatgacataga

SEQ ID NO: 38625 - DNA, 25 bp, Mus musculus
gcctcctctttcaggtgctgagcat

SEQ ID NO: 38626 - DNA, 25 bp, Mus musculus
gcctcctgagtgaaaatggagcatt

SEQ ID NO: 38627 - DNA, 25 bp, Mus musculus
gcctcctgatgcacttatcattgaa

SEQ ID NO: 38628 - DNA, 25 bp, Mus musculus
gcctcctgcgtcatcaacttaggcg

SEQ ID NO: 38629 - DNA, 25 bp, Mus musculus
gcctcctgctagactcatcagtgga

SEQ ID NO: 38630 - DNA, 25 bp, Mus musculus
gcctcctggagttccgggcatagat

SEQ ID NO: 38631 - DNA, 25 bp, Mus musculus
gcctccttccctattagattcttag

SEQ ID NO: 38632 - DNA, 25 bp, Mus musculus
gcctccttctgcagcggaagatgga

SEQ ID NO: 38633 - DNA, 25 bp, Mus musculus
gcctccttgctggaacgcttctatg

SEQ ID NO: 38634 - DNA, 25 bp, Mus musculus
gcctccttggattgtagacacacca

SEQ ID NO: 38635 - DNA, 25 bp, Mus musculus
gcctcgagactgagaaaatggaaca

SEQ ID NO: 38636 - DNA, 25 bp, Mus musculus
gcctcgattcagttttggtgaaatg

SEQ ID NO: 38637 - DNA, 25 bp, Mus musculus
gcctcgccctggatgagaattgtct

SEQ ID NO: 38638 - DNA, 25 bp, Mus musculus
gcctcgccctgtgttggacattctt

SEQ ID NO: 38639 - DNA, 25 bp, Mus musculus
gcctcgcgagcgcagttgactaccg

SEQ ID NO: 38640 - DNA, 25 bp, Mus musculus
gcctcgcgagcggagttgactaccg

SEQ ID NO: 38641 - DNA, 25 bp, Mus musculus
gcctcgcgctgtgagtatacaactg

SEQ ID NO: 38642 - DNA, 25 bp, Mus musculus
gcctcggagaaccatcaggagattt

SEQ ID NO: 38643 - DNA, 25 bp, Mus musculus
gcctcggagacaatgcggcctcctg

SEQ ID NO: 38644 - DNA, 25 bp, Mus musculus
gcctcggattgtgagccagctctga

SEQ ID NO: 38645 - DNA, 25 bp, Mus musculus
gcctcggtcctgaagcatggcagcc

SEQ ID NO: 38646 - DNA, 25 bp, Mus musculus
gcctcggtgtcccagaaaactaaga

SEQ ID NO: 38647 - DNA, 25 bp, Mus musculus
gcctcgtaataagtcatcatgcatc

SEQ ID NO: 38648 - DNA, 25 bp, Mus musculus
gcctcgtcatgtatgtcatcctcag

SEQ ID NO: 38649 - DNA, 25 bp, Mus musculus
gcctcgtcgtggatatgctgatcaa

SEQ ID NO: 38650 - DNA, 25 bp, Mus musculus
gcctcgtctcccatgatcgtgtggg

SEQ ID NO: 38651 - DNA, 25 bp, Mus musculus
gcctcgttccatgagaggatttttt

SEQ ID NO: 38652 - DNA, 25 bp, Mus musculus
gcctctaacttcagcaagcgccttg

SEQ ID NO: 38653 - DNA, 25 bp, Mus musculus
gcctctaccctgtgctcttggtcaa

SEQ ID NO: 38654 - DNA, 25 bp, Mus musculus
gcctctacgccaagtacttccaggg

SEQ ID NO: 38655 - DNA, 25 bp, Mus musculus
gcctctactggcaggtgacatggag

SEQ ID NO: 38656 - DNA, 25 bp, Mus musculus
gcctctcaatgggacggacagctga

SEQ ID NO: 38657 - DNA, 25 bp, Mus musculus
gcctctcagaaggtacttgacttta

SEQ ID NO: 38658 - DNA, 25 bp, Mus musculus
gcctctccatttatgcagaagcttg

SEQ ID NO: 38659 - DNA, 25 bp, Mus musculus
gcctctcgaaatgaactgcataatc

SEQ ID NO: 38660 - DNA, 25 bp, Mus musculus
gcctctcgcccatatgtttgagacc

SEQ ID NO: 38661 - DNA, 25 bp, Mus musculus
gcctctcggaaacatatctatattg

SEQ ID NO: 38662 - DNA, 25 bp, Mus musculus
gcctctctatgacctggacgactct

SEQ ID NO: 38663 - DNA, 25 bp, Mus musculus
gcctctgacgatgttcacagattca

SEQ ID NO: 38664 - DNA, 25 bp, Mus musculus
gcctctgcaaggactcggagtgcgt

SEQ ID NO: 38665 - DNA, 25 bp, Mus musculus
gcctctgcaaggtctcggagtgcgt

SEQ ID NO: 38666 - DNA, 25 bp, Mus musculus
gcctctgcatccactgagaattcca

SEQ ID NO: 38667 - DNA, 25 bp, Mus musculus
gcctctggagtagatagatacatct

SEQ ID NO: 38668 - DNA, 25 bp, Mus musculus
gcctctggccttgaaaatcgctggg

SEQ ID NO: 38669 - DNA, 25 bp, Mus musculus
gcctctgtcagtgtttggtttggag

SEQ ID NO: 38670 - DNA, 25 bp, Mus musculus
gcctctgtgcccacaaggtcagatt

SEQ ID NO: 38671 - DNA, 25 bp, Mus musculus
gcctctgtgtattgctttctgactg

SEQ ID NO: 38672 - DNA, 25 bp, Mus musculus
gcctcttaagaagcttccggtttga

SEQ ID NO: 38673 - DNA, 25 bp, Mus musculus
gcctcttctacgagtccatgctcaa

SEQ ID NO: 38674 - DNA, 25 bp, Mus musculus
gcctctttccggaatacaaggacaa

SEQ ID NO: 38675 - DNA, 25 bp, Mus musculus
gcctctttcttctccagcgatgagt

SEQ ID NO: 38676 - DNA, 25 bp, Mus musculus
gcctctttgcagcatcagtttttga

SEQ ID NO: 38677 - DNA, 25 bp, Mus musculus
gcctctttgcaggatcagtttttga

SEQ ID NO: 38678 - DNA, 25 bp, Mus musculus
gcctctttgggatctacaaatcaga

SEQ ID NO: 38679 - DNA, 25 bp, Mus musculus
gcctctttgttcttgggatcgccag

SEQ ID NO: 38680 - DNA, 25 bp, Mus musculus
gcctgaaactcacacggtctggaag

SEQ ID NO: 38681 - DNA, 25 bp, Mus musculus
gcctgaaagcccctggaattatccc

SEQ ID NO: 38682 - DNA, 25 bp, Mus musculus
gcctgaaccaaaatggaagttattc

SEQ ID NO: 38683 - DNA, 25 bp, Mus musculus
gcctgaagacttggatgaaaatatg

SEQ ID NO: 38684 - DNA, 25 bp, Mus musculus
gcctgaagccaagagcttctgctct

SEQ ID NO: 38685 - DNA, 25 bp, Mus musculus
gcctgaaggttctgctctggtcacc

SEQ ID NO: 38686 - DNA, 25 bp, Mus musculus
gcctgaatgagaatgttctcaagcc

SEQ ID NO: 38687 - DNA, 25 bp, Mus musculus
gcctgaattagagagcagctcatct

SEQ ID NO: 38688 - DNA, 25 bp, Mus musculus
gcctgacagagttagatatgactcc

SEQ ID NO: 38689 - DNA, 25 bp, Mus musculus
gcctgaccatgatggcccaatggag

SEQ ID NO: 38690 - DNA, 25 bp, Mus musculus
gcctgacgtctgtcctctccaagtg

SEQ ID NO: 38691 - DNA, 25 bp, Mus musculus
gcctgactctccatgaagggcttcc

SEQ ID NO: 38692 - DNA, 25 bp, Mus musculus
gcctgactctggctgttgcgtgcct

SEQ ID NO: 38693 - DNA, 25 bp, Mus musculus
gcctgactgcttacaggttgtcaga

SEQ ID NO: 38694 - DNA, 25 bp, Mus musculus
gcctgactgcttcgacaagagtgac

SEQ ID NO: 38695 - DNA, 25 bp, Mus musculus
gcctgactgttgatgacatcaagaa

SEQ ID NO: 38696 - DNA, 25 bp, Mus musculus
gcctgactttcctgatgcttattgt

SEQ ID NO: 38697 - DNA, 25 bp, Mus musculus
gcctgagagccgtggtccggaacct

SEQ ID NO: 38698 - DNA, 25 bp, Mus musculus
gcctgagcaagcctgagacctagtt

SEQ ID NO: 38699 - DNA, 25 bp, Mus musculus
gcctgagcaagcgtgagacctagtt

SEQ ID NO: 38700 - DNA, 25 bp, Mus musculus
gcctgagcctgtccttgggccgatt

SEQ ID NO: 38701 - DNA, 25 bp, Mus musculus
gcctgaggaaggcacaaatgcagaa

SEQ ID NO: 38702 - DNA, 25 bp, Mus musculus
gcctgagtctcccttgggtgaaaga

SEQ ID NO: 38703 - DNA, 25 bp, Mus musculus
gcctgatatcagacgctgccagctg

SEQ ID NO: 38704 - DNA, 25 bp, Mus musculus
gcctgatcacgtggacgcaaggacg

SEQ ID NO: 38705 - DNA, 25 bp, Mus musculus
gcctgatgggaccacagtagagcca

SEQ ID NO: 38706 - DNA, 25 bp, Mus musculus
gcctgattcgcccaggagtgcgcct

SEQ ID NO: 38707 - DNA, 25 bp, Mus musculus
gcctgattcgccgaggagtgcgcct

SEQ ID NO: 38708 - DNA, 25 bp, Mus musculus
gcctgcaagcaacagctttctttgt

SEQ ID NO: 38709 - DNA, 25 bp, Mus musculus
gcctgcacacagaagtccctgaaaa

SEQ ID NO: 38710 - DNA, 25 bp, Mus musculus
gcctgcacatatggcagctgaggag

SEQ ID NO: 38711 - DNA, 25 bp, Mus musculus
gcctgcacccgcttataaatgcctt

SEQ ID NO: 38712 - DNA, 25 bp, Mus musculus
gcctgcactgtatactatttttcaa

SEQ ID NO: 38713 - DNA, 25 bp, Mus musculus
gcctgcactttctgcctgagagcgt

SEQ ID NO: 38714 - DNA, 25 bp, Mus musculus
gcctgcagaaagagtgccagcagtg

SEQ ID NO: 38715 - DNA, 25 bp, Mus musculus
gcctgcagaagaacagcctaaaaaa

SEQ ID NO: 38716 - DNA, 25 bp, Mus musculus
gcctgcagctggacacttgccactg

SEQ ID NO: 38717 - DNA, 25 bp, Mus musculus
gcctgcaggaaagcaaaaccaacag

SEQ ID NO: 38718 - DNA, 25 bp, Mus musculus
gcctgcatggtggtgacagtcatct

SEQ ID NO: 38719 - DNA, 25 bp, Mus musculus
gcctgcattcccaaagaagttggct

SEQ ID NO: 38720 - DNA, 25 bp, Mus musculus
gcctgccagaactgagtgtggctca

SEQ ID NO: 38721 - DNA, 25 bp, Mus musculus
gcctgccgctgcttcataggcactg

SEQ ID NO: 38722 - DNA, 25 bp, Mus musculus
gcctgcctctaatgtgcaaactgag

SEQ ID NO: 38723 - DNA, 25 bp, Mus musculus
gcctgcctggctgggtatcatactg

SEQ ID NO: 38724 - DNA, 25 bp, Mus musculus
gcctgccttatctccatgggttaca

SEQ ID NO: 38725 - DNA, 25 bp, Mus musculus
gcctgccttcctggtggctgaagga

SEQ ID NO: 38726 - DNA, 25 bp, Mus musculus
gcctgcgtgagatcacactgctctt

SEQ ID NO: 38727 - DNA, 25 bp, Mus musculus
gcctgcgtgcgggaccctgtacata

SEQ ID NO: 38728 - DNA, 25 bp, Mus musculus
gcctgcgtgctgcagaacccgcaga

SEQ ID NO: 38729 - DNA, 25 bp, Mus musculus
gcctgcgtggcggtacacaatgaga

SEQ ID NO: 38730 - DNA, 25 bp, Mus musculus
gcctgctcagcgtcacctgggtgga

SEQ ID NO: 38731 - DNA, 25 bp, Mus musculus
gcctgctctgactccttggaatcta

SEQ ID NO: 38732 - DNA, 25 bp, Mus musculus
gcctgctcttgaaggataaagtccg

SEQ ID NO: 38733 - DNA, 25 bp, Mus musculus
gcctgctgctgccttgaactgtgtg

SEQ ID NO: 38734 - DNA, 25 bp, Mus musculus
gcctgctggagactctcttcgtgca

SEQ ID NO: 38735 - DNA, 25 bp, Mus musculus
gcctgctggagagcgaggactgcaa

SEQ ID NO: 38736 - DNA, 25 bp, Mus musculus
gcctgctgtcgtttagttgatctat

SEQ ID NO: 38737 - DNA, 25 bp, Mus musculus
gcctgctgtctgaaggcacagatgt

SEQ ID NO: 38738 - DNA, 25 bp, Mus musculus
gcctgctgtgaagtccgaggttctg

SEQ ID NO: 38739 - DNA, 25 bp, Mus musculus
gcctgcttttgcctgtacactggct

SEQ ID NO: 38740 - DNA, 25 bp, Mus musculus
gcctggaacgaagccaccaatgttt

SEQ ID NO: 38741 - DNA, 25 bp, Mus musculus
gcctggaactggaaattctgagctg

SEQ ID NO: 38742 - DNA, 25 bp, Mus musculus
gcctggacagccagcaactatgata

SEQ ID NO: 38743 - DNA, 25 bp, Mus musculus
gcctggacatttcgacaaaccatgt

SEQ ID NO: 38744 - DNA, 25 bp, Mus musculus
gcctggacatttggacaaaccatgt

SEQ ID NO: 38745 - DNA, 25 bp, Mus musculus
gcctggacctcagggcattccaggt

SEQ ID NO: 38746 - DNA, 25 bp, Mus musculus
gcctggacgatcagcctgaaaacct

SEQ ID NO: 38747 - DNA, 25 bp, Mus musculus
gcctggacgatctgcctgaaaacct

SEQ ID NO: 38748 - DNA, 25 bp, Mus musculus
gcctggactgcgatgtgattgtagc

SEQ ID NO: 38749 - DNA, 25 bp, Mus musculus
gcctggacttgttcagtaacgtgcc

SEQ ID NO: 38750 - DNA, 25 bp, Mus musculus
gcctggagactgtgagctgaccttc

SEQ ID NO: 38751 - DNA, 25 bp, Mus musculus
gcctggagatgcctgacaacctcta

SEQ ID NO: 38752 - DNA, 25 bp, Mus musculus
gcctggagccatcaagaacttcgtg

SEQ ID NO: 38753 - DNA, 25 bp, Mus musculus
gcctggaggctcagagcattccctg

SEQ ID NO: 38754 - DNA, 25 bp, Mus musculus
gcctggagtcaatgggtcagaaact

SEQ ID NO: 38755 - DNA, 25 bp, Mus musculus
gcctggatccctcatctactcttgg

SEQ ID NO: 38756 - DNA, 25 bp, Mus musculus
gcctggatctatgccttctatgaca

SEQ ID NO: 38757 - DNA, 25 bp, Mus musculus
gcctggatctgattacaaaagaaga

SEQ ID NO: 38758 - DNA, 25 bp, Mus musculus
gcctggatgaagtttgatgcccaag

SEQ ID NO: 38759 - DNA, 25 bp, Mus musculus
gcctggatgaggcacccgtctctct

SEQ ID NO: 38760 - DNA, 25 bp, Mus musculus
gcctggatgagggacccgtctctct

SEQ ID NO: 38761 - DNA, 25 bp, Mus musculus
gcctggcaagactggccactgactc

SEQ ID NO: 38762 - DNA, 25 bp, Mus musculus
gcctggcacctctgagctgcgagta

SEQ ID NO: 38763 - DNA, 25 bp, Mus musculus
gcctggcagcatggaaaatctgtcc

SEQ ID NO: 38764 - DNA, 25 bp, Mus musculus
gcctggcagtatgggccttgtacag

SEQ ID NO: 38765 - DNA, 25 bp, Mus musculus
gcctggcctacaatactggagttaa

SEQ ID NO: 38766 - DNA, 25 bp, Mus musculus
gcctggccttgatgatgcagctggc

SEQ ID NO: 38767 - DNA, 25 bp, Mus musculus
gcctggcgactgaggcagctgctca

SEQ ID NO: 38768 - DNA, 25 bp, Mus musculus
gcctggctagggtttttaggccctg

SEQ ID NO: 38769 - DNA, 25 bp, Mus musculus
gcctggctgatggtctatctgtgca

SEQ ID NO: 38770 - DNA, 25 bp, Mus musculus
gcctgggacccaactatctgcagat

SEQ ID NO: 38771 - DNA, 25 bp, Mus musculus
gcctgggatctggacgtcaagcaga

SEQ ID NO: 38772 - DNA, 25 bp, Mus musculus
gcctgggcatggtagtcagcacctt

SEQ ID NO: 38773 - DNA, 25 bp, Mus musculus
gcctgggcattggtaccactgacaa

SEQ ID NO: 38774 - DNA, 25 bp, Mus musculus
gcctgggcttccatcagcatattcc

SEQ ID NO: 38775 - DNA, 25 bp, Mus musculus
gcctgggtccagttccgtcctttca

SEQ ID NO: 38776 - DNA, 25 bp, Mus musculus
gcctgggtcgcctgcggttatgtaa

SEQ ID NO: 38777 - DNA, 25 bp, Mus musculus
gcctgggtgcatggtctccctagta

SEQ ID NO: 38778 - DNA, 25 bp, Mus musculus
gcctgggtgccattgcccgatggct

SEQ ID NO: 38779 - DNA, 25 bp, Mus musculus
gcctgggtgtgttcgaaaacttagt

SEQ ID NO: 38780 - DNA, 25 bp, Mus musculus
gcctgggtttaaatcagcgaaacca

SEQ ID NO: 38781 - DNA, 25 bp, Mus musculus
gcctggtacagatctgcgacaagta

SEQ ID NO: 38782 - DNA, 25 bp, Mus musculus
gcctggtagattgccagaggactcc

SEQ ID NO: 38783 - DNA, 25 bp, Mus musculus
gcctggtcaccttttaccatccaag

SEQ ID NO: 38784 - DNA, 25 bp, Mus musculus
gcctggtccagatcatctacgatga

SEQ ID NO: 38785 - DNA, 25 bp, Mus musculus
gcctggtcccagatttgtcctccga

SEQ ID NO: 38786 - DNA, 25 bp, Mus musculus
gcctggtctcgggaattcctcaaat

SEQ ID NO: 38787 - DNA, 25 bp, Mus musculus
gcctggtctgcccagaatggtccct

SEQ ID NO: 38788 - DNA, 25 bp, Mus musculus
gcctggtgactgagaagccctgtta

SEQ ID NO: 38789 - DNA, 25 bp, Mus musculus
gcctggtgactgtgaagccctgtta

SEQ ID NO: 38790 - DNA, 25 bp, Mus musculus
gcctggtggtattaccagtatcaga

SEQ ID NO: 38791 - DNA, 25 bp, Mus musculus
gcctggtggtgtacgtctctcagga

SEQ ID NO: 38792 - DNA, 25 bp, Mus musculus
gcctggtgtccctgtctatgctgtc

SEQ ID NO: 38793 - DNA, 25 bp, Mus musculus
gcctggtgtggatcctgattgcctc

SEQ ID NO: 38794 - DNA, 25 bp, Mus musculus
gcctggtgtgtttaactttgtcaac

SEQ ID NO: 38795 - DNA, 25 bp, Mus musculus
gcctggtttccacctgccatcatgg

SEQ ID NO: 38796 - DNA, 25 bp, Mus musculus
gcctgtaaaaactattggcattacg

SEQ ID NO: 38797 - DNA, 25 bp, Mus musculus
gcctgtaactcaacaaatgacagaa

SEQ ID NO: 38798 - DNA, 25 bp, Mus musculus
gcctgtaagagaataaagcgtgaag

SEQ ID NO: 38799 - DNA, 25 bp, Mus musculus
gcctgtaccagctataaggtctagg

SEQ ID NO: 38800 - DNA, 25 bp, Mus musculus
gcctgtagaagcagacattttagca

SEQ ID NO: 38801 - DNA, 25 bp, Mus musculus
gcctgtagacagaggtgctcctcac

SEQ ID NO: 38802 - DNA, 25 bp, Mus musculus
gcctgtagacagtggtgctcctcac

SEQ ID NO: 38803 - DNA, 25 bp, Mus musculus
gcctgtagctttcctgatgaagaaa

SEQ ID NO: 38804 - DNA, 25 bp, Mus musculus
gcctgtagctttgctgatgaagaaa

SEQ ID NO: 38805 - DNA, 25 bp, Mus musculus
gcctgtatcttctcactactttgca

SEQ ID NO: 38806 - DNA, 25 bp, Mus musculus
gcctgtcagaagactcgtgtccctc

SEQ ID NO: 38807 - DNA, 25 bp, Mus musculus
gcctgtcagctttttctcctcgaga

SEQ ID NO: 38808 - DNA, 25 bp, Mus musculus
gcctgtcatgattgtgatagagttc

SEQ ID NO: 38809 - DNA, 25 bp, Mus musculus
gcctgtccctcagcagatttagctg

SEQ ID NO: 38810 - DNA, 25 bp, Mus musculus
gcctgtcgccgggtagaaatgcttt

SEQ ID NO: 38811 - DNA, 25 bp, Mus musculus
gcctgtcgtgagttcaccacacatg

SEQ ID NO: 38812 - DNA, 25 bp, Mus musculus
gcctgtcgtttctgctcggtctgac

SEQ ID NO: 38813 - DNA, 25 bp, Mus musculus
gcctgtctgcagttttcacaaattt

SEQ ID NO: 38814 - DNA, 25 bp, Mus musculus
gcctgtgaaagcagtatagctcccc

SEQ ID NO: 38815 - DNA, 25 bp, Mus musculus
gcctgtgaagccacgttcccttcta

SEQ ID NO: 38816 - DNA, 25 bp, Mus musculus
gcctgtgaattaccacgtgcaggag

SEQ ID NO: 38817 - DNA, 25 bp, Mus musculus
gcctgtgagctttaccgcccttcag

SEQ ID NO: 38818 - DNA, 25 bp, Mus musculus
gcctgtgaggagaagctgcgttccc

SEQ ID NO: 38819 - DNA, 25 bp, Mus musculus
gcctgtgccctgagcattgcagaat

SEQ ID NO: 38820 - DNA, 25 bp, Mus musculus
gcctgtgcctcctgaacgctgagat

SEQ ID NO: 38821 - DNA, 25 bp, Mus musculus
gcctgtgcctgaacggtggcacctg

SEQ ID NO: 38822 - DNA, 25 bp, Mus musculus
gcctgtgctgtggacaagacagcat

SEQ ID NO: 38823 - DNA, 25 bp, Mus musculus
gcctgtgcttgctggagtcagacca

SEQ ID NO: 38824 - DNA, 25 bp, Mus musculus
gcctgtggaatcctggctacactgg

SEQ ID NO: 38825 - DNA, 25 bp, Mus musculus
gcctgtgggctttcgttttcagtct

SEQ ID NO: 38826 - DNA, 25 bp, Mus musculus
gcctgtgtacgaggtgccagctaca

SEQ ID NO: 38827 - DNA, 25 bp, Mus musculus
gcctgtgtattctggccctgtccct

SEQ ID NO: 38828 - DNA, 25 bp, Mus musculus
gcctgtgtgcctccaggataataat

SEQ ID NO: 38829 - DNA, 25 bp, Mus musculus
gcctgtgtgtctacccagcggcgcg

SEQ ID NO: 38830 - DNA, 25 bp, Mus musculus
gcctgttagattggcaaatataatg

SEQ ID NO: 38831 - DNA, 25 bp, Mus musculus
gcctgttccaaacagtgatgctgtt

SEQ ID NO: 38832 - DNA, 25 bp, Mus musculus
gcctgtttatcccatcacgggtgga

SEQ ID NO: 38833 - DNA, 25 bp, Mus musculus
gcctgtttctgctacttctaggaag

SEQ ID NO: 38834 - DNA, 25 bp, Mus musculus
gcctgttttgcctaaagtgtctata

SEQ ID NO: 38835 - DNA, 25 bp, Mus musculus
gccttaaacgcaccatgctctcaga

SEQ ID NO: 38836 - DNA, 25 bp, Mus musculus
gccttaagcctcagcaaagagcaca

SEQ ID NO: 38837 - DNA, 25 bp, Mus musculus
gccttacagaataatgtgctcagca

SEQ ID NO: 38838 - DNA, 25 bp, Mus musculus
gccttacaggaccacctattacatg

SEQ ID NO: 38839 - DNA, 25 bp, Mus musculus
gccttaccacgtgggacagaccttt

SEQ ID NO: 38840 - DNA, 25 bp, Mus musculus
gccttacctacaatatgggagccat

SEQ ID NO: 38841 - DNA, 25 bp, Mus musculus
gccttacgattccatagaaacttga

SEQ ID NO: 38842 - DNA, 25 bp, Mus musculus
gccttagatcttcgtcttagtgaca

SEQ ID NO: 38843 - DNA, 25 bp, Mus musculus
gccttagctacatggccctgctcag

SEQ ID NO: 38844 - DNA, 25 bp, Mus musculus
gccttattgtcaagtgtacagcaga

SEQ ID NO: 38845 - DNA, 25 bp, Mus musculus
gccttcaaggccatcaagacggaga

SEQ ID NO: 38846 - DNA, 25 bp, Mus musculus
gccttcactgatggacatataggga

SEQ ID NO: 38847 - DNA, 25 bp, Mus musculus
gccttcactgcctgataatcagttt

SEQ ID NO: 38848 - DNA, 25 bp, Mus musculus
gccttcagcggctcggccgtgcatg

SEQ ID NO: 38849 - DNA, 25 bp, Mus musculus
gccttcagcttgtatgccaacattg

SEQ ID NO: 38850 - DNA, 25 bp, Mus musculus
gccttcataccaaaggatctacaga

SEQ ID NO: 38851 - DNA, 25 bp, Mus musculus
gccttcatcattgccgtcatttata

SEQ ID NO: 38852 - DNA, 25 bp, Mus musculus
gccttcatcgttttcacagaagctg

SEQ ID NO: 38853 - DNA, 25 bp, Mus musculus
gccttcatctgtgtacgaagctccg

SEQ ID NO: 38854 - DNA, 25 bp, Mus musculus
gccttcatgggatgcttcgtgtatt

SEQ ID NO: 38855 - DNA, 25 bp, Mus musculus
gccttccacagtaaaatggctcttg

SEQ ID NO: 38856 - DNA, 25 bp, Mus musculus
gccttcccagtaccgccatggttgg

SEQ ID NO: 38857 - DNA, 25 bp, Mus musculus
gccttccctggaaaatctcactgtg

SEQ ID NO: 38858 - DNA, 25 bp, Mus musculus
gccttccgacatctcttcctgctgg

SEQ ID NO: 38859 - DNA, 25 bp, Mus musculus
gccttcctacagatgtgacagcata

SEQ ID NO: 38860 - DNA, 25 bp, Mus musculus
gccttcctatttccccaagaggtct

SEQ ID NO: 38861 - DNA, 25 bp, Mus musculus
gccttcctcctgcagaccgtggatg

SEQ ID NO: 38862 - DNA, 25 bp, Mus musculus
gccttcctggtgtgattcgcagaag

SEQ ID NO: 38863 - DNA, 25 bp, Mus musculus
gccttcctgtggtttgccattcact

SEQ ID NO: 38864 - DNA, 25 bp, Mus musculus
gccttcggcagaagcatgcccagca

SEQ ID NO: 38865 - DNA, 25 bp, Mus musculus
gccttctcctgtcaggccgggataa

SEQ ID NO: 38866 - DNA, 25 bp, Mus musculus
gccttctgaccaccagcaaatagtg

SEQ ID NO: 38867 - DNA, 25 bp, Mus musculus
gccttctgatagctccgtgcagcgc

SEQ ID NO: 38868 - DNA, 25 bp, Mus musculus
gccttctggattctatcactaatat

SEQ ID NO: 38869 - DNA, 25 bp, Mus musculus
gccttctgtctgtcccatgtggtca

SEQ ID NO: 38870 - DNA, 25 bp, Mus musculus
gccttgaacaaagtggacggacccg

SEQ ID NO: 38871 - DNA, 25 bp, Mus musculus
gccttgaagtcttcctgaatgatcc

SEQ ID NO: 38872 - DNA, 25 bp, Mus musculus
gccttgaatcgcaggacttggaaag

SEQ ID NO: 38873 - DNA, 25 bp, Mus musculus
gccttgaatctacagaaaattgcca

SEQ ID NO: 38874 - DNA, 25 bp, Mus musculus
gccttgagaagaagacccaggtcct

SEQ ID NO: 38875 - DNA, 25 bp, Mus musculus
gccttgagcccggatgatggtacaa

SEQ ID NO: 38876 - DNA, 25 bp, Mus musculus
gccttgataaacttggtgaccaaat

SEQ ID NO: 38877 - DNA, 25 bp, Mus musculus
gccttgatagatcaagaagtgaaga

SEQ ID NO: 38878 - DNA, 25 bp, Mus musculus
gccttgattcctggcttgtctcgag

SEQ ID NO: 38879 - DNA, 25 bp, Mus musculus
gccttgattgcttcgtcctgaaccc

SEQ ID NO: 38880 - DNA, 25 bp, Mus musculus
gccttgatttctgccgttggtcata

SEQ ID NO: 38881 - DNA, 25 bp, Mus musculus
gccttgcagataaccgtgccacaaa

SEQ ID NO: 38882 - DNA, 25 bp, Mus musculus
gccttgcagccaggaaagcaactgg

SEQ ID NO: 38883 - DNA, 25 bp, Mus musculus
gccttgccaggacttagaatttgtt

SEQ ID NO: 38884 - DNA, 25 bp, Mus musculus
gccttgcccgctcataaactggttt

SEQ ID NO: 38885 - DNA, 25 bp, Mus musculus
gccttgcccgctgataaactggttt

SEQ ID NO: 38886 - DNA, 25 bp, Mus musculus
gccttgcctgtaactcaacaaatga

SEQ ID NO: 38887 - DNA, 25 bp, Mus musculus
gccttgctcaacagagccatcgatg

SEQ ID NO: 38888 - DNA, 25 bp, Mus musculus
gccttgctttacaaacgggacctct

SEQ ID NO: 38889 - DNA, 25 bp, Mus musculus
gccttggaaaagcttcgagatgtca

SEQ ID NO: 38890 - DNA, 25 bp, Mus musculus
gccttggattatgaccctgtggaaa

SEQ ID NO: 38891 - DNA, 25 bp, Mus musculus
gccttggcattcaagcattccctag

SEQ ID NO: 38892 - DNA, 25 bp, Mus musculus
gccttggcccaatatcaaacagatg

SEQ ID NO: 38893 - DNA, 25 bp, Mus musculus
gccttgggatctttggcttcctcag

SEQ ID NO: 38894 - DNA, 25 bp, Mus musculus
gccttgggcggcatggcaaatgcaa

SEQ ID NO: 38895 - DNA, 25 bp, Mus musculus
gccttggtgctgagtccaaagcaga

SEQ ID NO: 38896 - DNA, 25 bp, Mus musculus
gccttgtggttaaccaatctattag

SEQ ID NO: 38897 - DNA, 25 bp, Mus musculus
gccttgtgtttggtggaaaaacaca

SEQ ID NO: 38898 - DNA, 25 bp, Mus musculus
gccttgttagcatgggcagcatgca

SEQ ID NO: 38899 - DNA, 25 bp, Mus musculus
gccttgttggacagcaaaatgcccg

SEQ ID NO: 38900 - DNA, 25 bp, Mus musculus
gccttgttttcatgcctgggaccat

SEQ ID NO: 38901 - DNA, 25 bp, Mus musculus
gcctttaaaacatccctggatgaaa

SEQ ID NO: 38902 - DNA, 25 bp, Mus musculus
gcctttaagaccattcgaagcttcc

SEQ ID NO: 38903 - DNA, 25 bp, Mus musculus
gcctttaagttatagaacatcattc

SEQ ID NO: 38904 - DNA, 25 bp, Mus musculus
gcctttatacccttggctttcctag

SEQ ID NO: 38905 - DNA, 25 bp, Mus musculus
gcctttatccagctggctgcaaaga

SEQ ID NO: 38906 - DNA, 25 bp, Mus musculus
gcctttattagtccttgttgacaga

SEQ ID NO: 38907 - DNA, 25 bp, Mus musculus
gcctttcatgcgcacaaggtggtct

SEQ ID NO: 38908 - DNA, 25 bp, Mus musculus
gcctttcctgagtgcggtactgaag

SEQ ID NO: 38909 - DNA, 25 bp, Mus musculus
gcctttcctttcaaaaatgtctgcc

SEQ ID NO: 38910 - DNA, 25 bp, Mus musculus
gcctttccttttacaatgcctcaga

SEQ ID NO: 38911 - DNA, 25 bp, Mus musculus
gcctttcgaagccacaccttttcag

SEQ ID NO: 38912 - DNA, 25 bp, Mus musculus
gcctttcggaagcttcttatatgaa

SEQ ID NO: 38913 - DNA, 25 bp, Mus musculus
gcctttcggagatgtcctgtgtgac

SEQ ID NO: 38914 - DNA, 25 bp, Mus musculus
gcctttcgggtcaatgtcattcatg

SEQ ID NO: 38915 - DNA, 25 bp, Mus musculus
gcctttctcatcagttaagtacaag

SEQ ID NO: 38916 - DNA, 25 bp, Mus musculus
gcctttgaaaccattgtgaaaaagc

SEQ ID NO: 38917 - DNA, 25 bp, Mus musculus
gcctttgatagaccctgtgtacggg

SEQ ID NO: 38918 - DNA, 25 bp, Mus musculus
gcctttgccaagatggaccccagct

SEQ ID NO: 38919 - DNA, 25 bp, Mus musculus
gcctttgccaatggattgctgggat

SEQ ID NO: 38920 - DNA, 25 bp, Mus musculus
gcctttgctgatagtctctgcccat

SEQ ID NO: 38921 - DNA, 25 bp, Mus musculus
gcctttggactataaagagggaaat

SEQ ID NO: 38922 - DNA, 25 bp, Mus musculus
gcctttggaggatcggctcttccca

SEQ ID NO: 38923 - DNA, 25 bp, Mus musculus
gcctttggatgcacgatttcgccat

SEQ ID NO: 38924 - DNA, 25 bp, Mus musculus
gcctttggattatactgaaactcat

SEQ ID NO: 38925 - DNA, 25 bp, Mus musculus
gcctttggccgcttctctcctggaa

SEQ ID NO: 38926 - DNA, 25 bp, Mus musculus
gcctttggtagagtgttcctctggg

SEQ ID NO: 38927 - DNA, 25 bp, Mus musculus
gcctttggtgatcctccaggaccta

SEQ ID NO: 38928 - DNA, 25 bp, Mus musculus
gcctttgtatattgatcttcgtatc

SEQ ID NO: 38929 - DNA, 25 bp, Mus musculus
gcctttgtatggagaagatcctata

SEQ ID NO: 38930 - DNA, 25 bp, Mus musculus
gcctttgttgaaaattatccacagt

SEQ ID NO: 38931 - DNA, 25 bp, Mus musculus
gccttttaaagacgcgctcactcag

SEQ ID NO: 38932 - DNA, 25 bp, Mus musculus
gccttttccccaatgcagactcatg

SEQ ID NO: 38933 - DNA, 25 bp, Mus musculus
gccttttctcgtccattgagtcgga

SEQ ID NO: 38934 - DNA, 25 bp, Mus musculus
gcctttttctggctggtctccctgc

SEQ ID NO: 38935 - DNA, 25 bp, Mus musculus
gcctttttgatgacgcatttgtccc

SEQ ID NO: 38936 - DNA, 25 bp, Mus musculus
gcctttttgcctacccggacactca

SEQ ID NO: 38937 - DNA, 25 bp, Mus musculus
gcgaaaaatatctatgcgaaaacca

SEQ ID NO: 38938 - DNA, 25 bp, Mus musculus
gcgaaaagccattcaggaacttcag

SEQ ID NO: 38939 - DNA, 25 bp, Mus musculus
gcgaaataggacagtcgacattggg

SEQ ID NO: 38940 - DNA, 25 bp, Mus musculus
gcgaagaaagtaagaaaggtgcctc

SEQ ID NO: 38941 - DNA, 25 bp, Mus musculus
gcgaagaaggtgaaggcgactatct

SEQ ID NO: 38942 - DNA, 25 bp, Mus musculus
gcgaagacgaaagttgtccccttcg

SEQ ID NO: 38943 - DNA, 25 bp, Mus musculus
gcgaagcacagttcccatgccagta

SEQ ID NO: 38944 - DNA, 25 bp, Mus musculus
gcgaagctacagctgcgctaccagg

SEQ ID NO: 38945 - DNA, 25 bp, Mus musculus
gcgaaggagattaaatagaagccac

SEQ ID NO: 38946 - DNA, 25 bp, Mus musculus
gcgaagtgcaccaccattgaacctc

SEQ ID NO: 38947 - DNA, 25 bp, Mus musculus
gcgaagtggttaaaagtgcctgaat

SEQ ID NO: 38948 - DNA, 25 bp, Mus musculus
gcgaatctcttctcgggccttatga

SEQ ID NO: 38949 - DNA, 25 bp, Mus musculus
gcgaatcttgtcatcctgttgtaaa

SEQ ID NO: 38950 - DNA, 25 bp, Mus musculus
gcgaattatgagaccaactgatgta

SEQ ID NO: 38951 - DNA, 25 bp, Mus musculus
gcgacaagtacctcccaggttacta

SEQ ID NO: 38952 - DNA, 25 bp, Mus musculus
gcgacagctacctgacgcactgctt

SEQ ID NO: 38953 - DNA, 25 bp, Mus musculus
gcgacagtgacagcgaccaggaaga

SEQ ID NO: 38954 - DNA, 25 bp, Mus musculus
gcgacataagccagagcatcgttct

SEQ ID NO: 38955 - DNA, 25 bp, Mus musculus
gcgacataagcctgagcatcgttct

SEQ ID NO: 38956 - DNA, 25 bp, Mus musculus
gcgacatgataactgatctgggaga

SEQ ID NO: 38957 - DNA, 25 bp, Mus musculus
gcgaccacccgaagaagttgcagct

SEQ ID NO: 38958 - DNA, 25 bp, Mus musculus
gcgaccacttcctccagattatgtc

SEQ ID NO: 38959 - DNA, 25 bp, Mus musculus
gcgaccagggccctacatctgtagt

SEQ ID NO: 38960 - DNA, 25 bp, Mus musculus
gcgacccagtggaatcccagagaaa

SEQ ID NO: 38961 - DNA, 25 bp, Mus musculus
gcgaccccagccagggcctggtttg

SEQ ID NO: 38962 - DNA, 25 bp, Mus musculus
gcgaccccagcctgggcctggtttg

SEQ ID NO: 38963 - DNA, 25 bp, Mus musculus
gcgaccctgcctttgccaatggatt

SEQ ID NO: 38964 - DNA, 25 bp, Mus musculus
gcgacctcctggaagaaccaaccag

SEQ ID NO: 38965 - DNA, 25 bp, Mus musculus
gcgacgggacccatttccagaagaa

SEQ ID NO: 38966 - DNA, 25 bp, Mus musculus
gcgacgggccctgaaactaatgtag

SEQ ID NO: 38967 - DNA, 25 bp, Mus musculus
gcgacgtcttcatgaagccttagag

SEQ ID NO: 38968 - DNA, 25 bp, Mus musculus
gcgactaccatgatgagaacatgta

SEQ ID NO: 38969 - DNA, 25 bp, Mus musculus
gcgactatctggatgactggacagt

SEQ ID NO: 38970 - DNA, 25 bp, Mus musculus
gcgactccaacgcatgatgagaaag

SEQ ID NO: 38971 - DNA, 25 bp, Mus musculus
gcgactgcagtacactgagcaccag

SEQ ID NO: 38972 - DNA, 25 bp, Mus musculus
gcgactgtcatctatgcctatgcct

SEQ ID NO: 38973 - DNA, 25 bp, Mus musculus
gcgacttcagtgttcacatcagcag

SEQ ID NO: 38974 - DNA, 25 bp, Mus musculus
gcgacttgccaaacgggagagagaa

SEQ ID NO: 38975 - DNA, 25 bp, Mus musculus
gcgactttgtcaagttgaggacgat

SEQ ID NO: 38976 - DNA, 25 bp, Mus musculus
gcgagaaagagaacacgttcccttc

SEQ ID NO: 38977 - DNA, 25 bp, Mus musculus
gcgagacaaggaaatgaattcacag

SEQ ID NO: 38978 - DNA, 25 bp, Mus musculus
gcgagatctttaacccagcacacag

SEQ ID NO: 38979 - DNA, 25 bp, Mus musculus
gcgagatgtgctgtgactgtcgaat

SEQ ID NO: 38980 - DNA, 25 bp, Mus musculus
gcgagcagatcttgacttgtccagg

SEQ ID NO: 38981 - DNA, 25 bp, Mus musculus
gcgagcagatgctggtctactacat

SEQ ID NO: 38982 - DNA, 25 bp, Mus musculus
gcgagcagcaaaagagaccctgcct

SEQ ID NO: 38983 - DNA, 25 bp, Mus musculus
gcgagccaccatttcaaacccagta

SEQ ID NO: 38984 - DNA, 25 bp, Mus musculus
gcgagcccttgctgtggccaggctt

SEQ ID NO: 38985 - DNA, 25 bp, Mus musculus
gcgagccgagcactgggctcctcat

SEQ ID NO: 38986 - DNA, 25 bp, Mus musculus
gcgagcctgcagttcccaatgcaga

SEQ ID NO: 38987 - DNA, 25 bp, Mus musculus
gcgagcgccttgtaaagagtccaca

SEQ ID NO: 38988 - DNA, 25 bp, Mus musculus
gcgagcgctactctcgtagattccg

SEQ ID NO: 38989 - DNA, 25 bp, Mus musculus
gcgagcggagttcactaccgacctt

SEQ ID NO: 38990 - DNA, 25 bp, Mus musculus
gcgagcggagttgactaccgacctt

SEQ ID NO: 38991 - DNA, 25 bp, Mus musculus
gcgagctcctcaagtattgggcctt

SEQ ID NO: 38992 - DNA, 25 bp, Mus musculus
gcgagctggagactaccagtttctt

SEQ ID NO: 38993 - DNA, 25 bp, Mus musculus
gcgagctgtgtgttcagtcaagtaa

SEQ ID NO: 38994 - DNA, 25 bp, Mus musculus
gcgagctttgttcgccaactcaaca

SEQ ID NO: 38995 - DNA, 25 bp, Mus musculus
gcgaggacatctggaagaaattcga

SEQ ID NO: 38996 - DNA, 25 bp, Mus musculus
gcgaggactctcctgcctattcaag

SEQ ID NO: 38997 - DNA, 25 bp, Mus musculus
gcgaggactgggaacttcttgacag

SEQ ID NO: 38998 - DNA, 25 bp, Mus musculus
gcgaggagaacatcaagaacaattt

SEQ ID NO: 38999 - DNA, 25 bp, Mus musculus
gcgaggatgatgacatcttcaaccg

SEQ ID NO: 39000 - DNA, 25 bp, Mus musculus
gcgaggatgatgtcatcttcaaccg

SEQ ID NO: 39001 - DNA, 25 bp, Mus musculus
gcgaggcagttgagatggacattca

SEQ ID NO: 39002 - DNA, 25 bp, Mus musculus
gcgaggctgtggtatccagtctcct

SEQ ID NO: 39003 - DNA, 25 bp, Mus musculus
gcgaggtccttccacagaagcgtcc

SEQ ID NO: 39004 - DNA, 25 bp, Mus musculus
gcgaggtcgtccctgtcgtacacaa

SEQ ID NO: 39005 - DNA, 25 bp, Mus musculus
gcgaggtggacatcaaaatagctac

SEQ ID NO: 39006 - DNA, 25 bp, Mus musculus
gcgaggttaaacactcgggaatgca

SEQ ID NO: 39007 - DNA, 25 bp, Mus musculus
gcgagtcttgaacaggctccatcag

SEQ ID NO: 39008 - DNA, 25 bp, Mus musculus
gcgagtttgtctatgcggtatgcag

SEQ ID NO: 39009 - DNA, 25 bp, Mus musculus
gcgagtttgtctttgcggtatgcag

SEQ ID NO: 39010 - DNA, 25 bp, Mus musculus
gcgatacttggctgatatgggatac

SEQ ID NO: 39011 - DNA, 25 bp, Mus musculus
gcgatagtattttcctcaagtccca

SEQ ID NO: 39012 - DNA, 25 bp, Mus musculus
gcgatcaccgcgtcagggtccttat

SEQ ID NO: 39013 - DNA, 25 bp, Mus musculus
gcgatcgccgtgtaaaatgagatat

SEQ ID NO: 39014 - DNA, 25 bp, Mus musculus
gcgatcgtgcctggagcactctggt

SEQ ID NO: 39015 - DNA, 25 bp, Mus musculus
gcgatctccgaggtgacttttcgac

SEQ ID NO: 39016 - DNA, 25 bp, Mus musculus
gcgatgcaactaagttaaggccaaa

SEQ ID NO: 39017 - DNA, 25 bp, Mus musculus
gcgatgctgggcctcatgtatatct

SEQ ID NO: 39018 - DNA, 25 bp, Mus musculus
gcgatgctgtgctccccagccgggt

SEQ ID NO: 39019 - DNA, 25 bp, Mus musculus
gcgatggcagtcaccagtgactaaa

SEQ ID NO: 39020 - DNA, 25 bp, Mus musculus
gcgatgtgagggaacggatcatcaa

SEQ ID NO: 39021 - DNA, 25 bp, Mus musculus
gcgatgtggactacaggaactacct

SEQ ID NO: 39022 - DNA, 25 bp, Mus musculus
gcgattcaaatggaaaccatggcag

SEQ ID NO: 39023 - DNA, 25 bp, Mus musculus
gcgattgcaattatgggacacagca

SEQ ID NO: 39024 - DNA, 25 bp, Mus musculus
gcgattggcagaagacttgtctctg

SEQ ID NO: 39025 - DNA, 25 bp, Mus musculus
gcgattgtacatgccagatcctaag

SEQ ID NO: 39026 - DNA, 25 bp, Mus musculus
gcgatttgaaggagctgcagacact

SEQ ID NO: 39027 - DNA, 25 bp, Mus musculus
gcgcaaaaatctccggtgtttctct

SEQ ID NO: 39028 - DNA, 25 bp, Mus musculus
gcgcaaaaatctgcggtgtttctct

SEQ ID NO: 39029 - DNA, 25 bp, Mus musculus
gcgcaacatccttgtcaacagcaat

SEQ ID NO: 39030 - DNA, 25 bp, Mus musculus
gcgcaagcggcggaatttcagcaag

SEQ ID NO: 39031 - DNA, 25 bp, Mus musculus
gcgcaagctgaagcgggtccgaatc

SEQ ID NO: 39032 - DNA, 25 bp, Mus musculus
gcgcaaggctgctgtggaggaggac

SEQ ID NO: 39033 - DNA, 25 bp, Mus musculus
gcgcaatgctcatgtgaagccaggg

SEQ ID NO: 39034 - DNA, 25 bp, Mus musculus
gcgcacaggatatagcttggtccag

SEQ ID NO: 39035 - DNA, 25 bp, Mus musculus
gcgcacgttgaagggctccattgaa

SEQ ID NO: 39036 - DNA, 25 bp, Mus musculus
gcgcactgagtgctatggctatgca

SEQ ID NO: 39037 - DNA, 25 bp, Mus musculus
gcgcactggtccagcgcacaggata

SEQ ID NO: 39038 - DNA, 25 bp, Mus musculus
gcgcagagagatgctgaccagtgtc

SEQ ID NO: 39039 - DNA, 25 bp, Mus musculus
gcgcagatccttatcattgttgtgg

SEQ ID NO: 39040 - DNA, 25 bp, Mus musculus
gcgcagcaagcacacagtcgtggca

SEQ ID NO: 39041 - DNA, 25 bp, Mus musculus
gcgcaggacctgatctcacagaatc

SEQ ID NO: 39042 - DNA, 25 bp, Mus musculus
gcgcaggagggtttctgcgtcttca

SEQ ID NO: 39043 - DNA, 25 bp, Mus musculus
gcgcatatttgaacgcctagttggt

SEQ ID NO: 39044 - DNA, 25 bp, Mus musculus
gcgcatccttgattggcatgtggca

SEQ ID NO: 39045 - DNA, 25 bp, Mus musculus
gcgcatcgggttgcctagaaggaca

SEQ ID NO: 39046 - DNA, 25 bp, Mus musculus
gcgcatctcccaatttcagagaccg

SEQ ID NO: 39047 - DNA, 25 bp, Mus musculus
gcgcatgaggatacagaaagctgga

SEQ ID NO: 39048 - DNA, 25 bp, Mus musculus
gcgcattcttgcacatttatctggg

SEQ ID NO: 39049 - DNA, 25 bp, Mus musculus
gcgcattgcgtcaactggaggtgca

SEQ ID NO: 39050 - DNA, 25 bp, Mus musculus
gcgccaagtagcctcacggctctga

SEQ ID NO: 39051 - DNA, 25 bp, Mus musculus
gcgccaagtagcgtcacggctctga

SEQ ID NO: 39052 - DNA, 25 bp, Mus musculus
gcgccaatgatgctaatgacgacac

SEQ ID NO: 39053 - DNA, 25 bp, Mus musculus
gcgccagccagctccgaaagcaaaa

SEQ ID NO: 39054 - DNA, 25 bp, Mus musculus
gcgccaggtgccatgcgcacagtat

SEQ ID NO: 39055 - DNA, 25 bp, Mus musculus
gcgccagtgaccatgaggagtacga

SEQ ID NO: 39056 - DNA, 25 bp, Mus musculus
gcgccagtgaccttgaggagtacga

SEQ ID NO: 39057 - DNA, 25 bp, Mus musculus
gcgccagtgcctgcagtttgccatg

SEQ ID NO: 39058 - DNA, 25 bp, Mus musculus
gcgccagttccggaacgaagggatt

SEQ ID NO: 39059 - DNA, 25 bp, Mus musculus
gcgcccagcgaggacatctggaaga

SEQ ID NO: 39060 - DNA, 25 bp, Mus musculus
gcgcccaggagttacaaatgaacag

SEQ ID NO: 39061 - DNA, 25 bp, Mus musculus
gcgccccttgtctcagctttgacat

SEQ ID NO: 39062 - DNA, 25 bp, Mus musculus
gcgcccgactctgtgaacatttaca

SEQ ID NO: 39063 - DNA, 25 bp, Mus musculus
gcgccgctgctgtgggaacgcactt

SEQ ID NO: 39064 - DNA, 25 bp, Mus musculus
gcgcgccctgcattgccttcggatg

SEQ ID NO: 39065 - DNA, 25 bp, Mus musculus
gcgcggcccaacaccatagactttg

SEQ ID NO: 39066 - DNA, 25 bp, Mus musculus
gcgctactctcgtagattccggaga

SEQ ID NO: 39067 - DNA, 25 bp, Mus musculus
gcgctactggcctttgtatggagaa

SEQ ID NO: 39068 - DNA, 25 bp, Mus musculus
gcgctatgacaatctggtagcccag

SEQ ID NO: 39069 - DNA, 25 bp, Mus musculus
gcgctcaatggaggccactgtctgg

SEQ ID NO: 39070 - DNA, 25 bp, Mus musculus
gcgctgcaagagacaaaggccaaca

SEQ ID NO: 39071 - DNA, 25 bp, Mus musculus
gcgctgcacaagaagcacagggagt

SEQ ID NO: 39072 - DNA, 25 bp, Mus musculus
gcgctggactggcttcctggaaaca

SEQ ID NO: 39073 - DNA, 25 bp, Mus musculus
gcgctgggcagcagacatagagtta

SEQ ID NO: 39074 - DNA, 25 bp, Mus musculus
gcgctgtgtgaacagcaccagcagc

SEQ ID NO: 39075 - DNA, 25 bp, Mus musculus
gcgctgtgtgaagagcaccagcagc

SEQ ID NO: 39076 - DNA, 25 bp, Mus musculus
gcgcttagttaggactggagtgctt

SEQ ID NO: 39077 - DNA, 25 bp, Mus musculus
gcgcttatatgcctcggagaaccat

SEQ ID NO: 39078 - DNA, 25 bp, Mus musculus
gcgcttctgggaaagctatacgtac

SEQ ID NO: 39079 - DNA, 25 bp, Mus musculus
gcgcttgcataccacttgaaggaag

SEQ ID NO: 39080 - DNA, 25 bp, Mus musculus
gcgctttcagttcattcggtccatg

SEQ ID NO: 39081 - DNA, 25 bp, Mus musculus
gcgctttgcagcaaatgcccatgct

SEQ ID NO: 39082 - DNA, 25 bp, Mus musculus
gcgctttgcccactttactgagctg

SEQ ID NO: 39083 - DNA, 25 bp, Mus musculus
gcgctttgcgtgcactgcacacaca

SEQ ID NO: 39084 - DNA, 25 bp, Mus musculus
gcgctttgcgtggactgcacacaca

SEQ ID NO: 39085 - DNA, 25 bp, Mus musculus
gcgctttggattcctgcttcccatc

SEQ ID NO: 39086 - DNA, 25 bp, Mus musculus
gcgcttttggcaggctcacagtgga

SEQ ID NO: 39087 - DNA, 25 bp, Mus musculus
gcggaacacactgtgggaactgcca

SEQ ID NO: 39088 - DNA, 25 bp, Mus musculus
gcggaaccacgagggtcatgaagat

SEQ ID NO: 39089 - DNA, 25 bp, Mus musculus
gcggaactcaataaccgctggttca

SEQ ID NO: 39090 - DNA, 25 bp, Mus musculus
gcggaacttgccaagtacatgtgtg

SEQ ID NO: 39091 - DNA, 25 bp, Mus musculus
gcggaagacgcacttaactatggat

SEQ ID NO: 39092 - DNA, 25 bp, Mus musculus
gcggaagcagaaggtctcccggatt

SEQ ID NO: 39093 - DNA, 25 bp, Mus musculus
gcggaagcgggagcgcaaggctgct

SEQ ID NO: 39094 - DNA, 25 bp, Mus musculus
gcggaagcggtgatctgtagcaccc

SEQ ID NO: 39095 - DNA, 25 bp, Mus musculus
gcggaagtctgcaatgaccccaagg

SEQ ID NO: 39096 - DNA, 25 bp, Mus musculus
gcggacaatcggttcagtttactga

SEQ ID NO: 39097 - DNA, 25 bp, Mus musculus
gcggacagagctactgatgccaatg

SEQ ID NO: 39098 - DNA, 25 bp, Mus musculus
gcggacatggacttcgactcgtatc

SEQ ID NO: 39099 - DNA, 25 bp, Mus musculus
gcggaccgtggctagcgacccttct

SEQ ID NO: 39100 - DNA, 25 bp, Mus musculus
gcggacctggcctgtctgatatgca

SEQ ID NO: 39101 - DNA, 25 bp, Mus musculus
gcggactgcccgcagctcctggata

SEQ ID NO: 39102 - DNA, 25 bp, Mus musculus
gcggagaacaattatgaagccctta

SEQ ID NO: 39103 - DNA, 25 bp, Mus musculus
gcggagaagtccattactatcctct

SEQ ID NO: 39104 - DNA, 25 bp, Mus musculus
gcggagtgtccttttacctggatag

SEQ ID NO: 39105 - DNA, 25 bp, Mus musculus
gcggatacttggaccagcgagtgcc

SEQ ID NO: 39106 - DNA, 25 bp, Mus musculus
gcggatatttgtgggccaggataat

SEQ ID NO: 39107 - DNA, 25 bp, Mus musculus
gcggatcacagtcgctctggctgcc

SEQ ID NO: 39108 - DNA, 25 bp, Mus musculus
gcggatcctccgtgccaccgggaag

SEQ ID NO: 39109 - DNA, 25 bp, Mus musculus
gcggatgaccctgagattggagaaa

SEQ ID NO: 39110 - DNA, 25 bp, Mus musculus
gcggatgactccatgaagatggcga

SEQ ID NO: 39111 - DNA, 25 bp, Mus musculus
gcggattacggtcacgatggcacaa

SEQ ID NO: 39112 - DNA, 25 bp, Mus musculus
gcggattcgaatcaacgggaaacca

SEQ ID NO: 39113 - DNA, 25 bp, Mus musculus
gcggattctactcgagcgccgtgac

SEQ ID NO: 39114 - DNA, 25 bp, Mus musculus
gcggattctactggagcgccgtgac

SEQ ID NO: 39115 - DNA, 25 bp, Mus musculus
gcggcaagttccacagagcgtgaga

SEQ ID NO: 39116 - DNA, 25 bp, Mus musculus
gcggcaattcttccccactgatgag

SEQ ID NO: 39117 - DNA, 25 bp, Mus musculus
gcggcacaaagacacccgggtgctc

SEQ ID NO: 39118 - DNA, 25 bp, Mus musculus
gcggcacaaagagacccgggtgctc

SEQ ID NO: 39119 - DNA, 25 bp, Mus musculus
gcggcacctgcagactcatgggata

SEQ ID NO: 39120 - DNA, 25 bp, Mus musculus
gcggcagcagctctggacccattct

SEQ ID NO: 39121 - DNA, 25 bp, Mus musculus
gcggcaggactacatcaacctggat

SEQ ID NO: 39122 - DNA, 25 bp, Mus musculus
gcggcatctgggaaactctcgaagg

SEQ ID NO: 39123 - DNA, 25 bp, Mus musculus
gcggcatctgtgatagccaagtacc

SEQ ID NO: 39124 - DNA, 25 bp, Mus musculus
gcggcatgcccatacggattgaaaa

SEQ ID NO: 39125 - DNA, 25 bp, Mus musculus
gcggcatggcaaatgcaaacatgaa

SEQ ID NO: 39126 - DNA, 25 bp, Mus musculus
gcggcattgctgaaactggcccgaa

SEQ ID NO: 39127 - DNA, 25 bp, Mus musculus
gcggccacgttcatagacgcaataa

SEQ ID NO: 39128 - DNA, 25 bp, Mus musculus
gcggccaggctgagacttgtgcaca

SEQ ID NO: 39129 - DNA, 25 bp, Mus musculus
gcggcccaagagatcccatgtaaag

SEQ ID NO: 39130 - DNA, 25 bp, Mus musculus
gcggcccacgccattgtctctgtga

SEQ ID NO: 39131 - DNA, 25 bp, Mus musculus
gcggcccatgaaaagccaaattaga

SEQ ID NO: 39132 - DNA, 25 bp, Mus musculus
gcggcctcactatcgctgggatcct

SEQ ID NO: 39133 - DNA, 25 bp, Mus musculus
gcggcctcctcttcatttaccagga

SEQ ID NO: 39134 - DNA, 25 bp, Mus musculus
gcggcctctctagcttgtattctga

SEQ ID NO: 39135 - DNA, 25 bp, Mus musculus
gcggcctgagccgagttctgcgtaa

SEQ ID NO: 39136 - DNA, 25 bp, Mus musculus
gcggcgatctccgaggtgacttttc

SEQ ID NO: 39137 - DNA, 25 bp, Mus musculus
gcggcgcacggccatgagggtcagc

SEQ ID NO: 39138 - DNA, 25 bp, Mus musculus
gcggcggctccgttaactttgcact

SEQ ID NO: 39139 - DNA, 25 bp, Mus musculus
gcggcgttaaattctcggactggag

SEQ ID NO: 39140 - DNA, 25 bp, Mus musculus
gcggctccgtttatctgcaaggtgc

SEQ ID NO: 39141 - DNA, 25 bp, Mus musculus
gcggctcgctcgtggctacccatga

SEQ ID NO: 39142 - DNA, 25 bp, Mus musculus
gcggctctctgatgaaattctgata

SEQ ID NO: 39143 - DNA, 25 bp, Mus musculus
gcggctgagagatcctgacataaac

SEQ ID NO: 39144 - DNA, 25 bp, Mus musculus
gcggctgctcagagaattagcggat

SEQ ID NO: 39145 - DNA, 25 bp, Mus musculus
gcggctggctctggtttaaagcaag

SEQ ID NO: 39146 - DNA, 25 bp, Mus musculus
gcggctgtagtccatttccagtgtg

SEQ ID NO: 39147 - DNA, 25 bp, Mus musculus
gcggcttccaccgtgtagctgtgaa

SEQ ID NO: 39148 - DNA, 25 bp, Mus musculus
gcggcttcgggccagtttctccaag

SEQ ID NO: 39149 - DNA, 25 bp, Mus musculus
gcggcttgtactctgccagcctggc

SEQ ID NO: 39150 - DNA, 25 bp, Mus musculus
gcggcttgtactgtgccagcctggc

SEQ ID NO: 39151 - DNA, 25 bp, Mus musculus
gcggctttgtggcacagacctctaa

SEQ ID NO: 39152 - DNA, 25 bp, Mus musculus
gcgggaacctcctggtggatgtctt

SEQ ID NO: 39153 - DNA, 25 bp, Mus musculus
gcgggaagaaattccctgtgaggca

SEQ ID NO: 39154 - DNA, 25 bp, Mus musculus
gcgggaagacggtcaccatgatgcc

SEQ ID NO: 39155 - DNA, 25 bp, Mus musculus
gcgggaagaggtgactttcatctat

SEQ ID NO: 39156 - DNA, 25 bp, Mus musculus
gcgggacctcggatcactcagagga

SEQ ID NO: 39157 - DNA, 25 bp, Mus musculus
gcgggacgacatgctgcgcatgtac

SEQ ID NO: 39158 - DNA, 25 bp, Mus musculus
gcgggacttgtatccatgattgacc

SEQ ID NO: 39159 - DNA, 25 bp, Mus musculus
gcgggactttatcactgctttacca

SEQ ID NO: 39160 - DNA, 25 bp, Mus musculus
gcgggagatgataaacatatgttca

SEQ ID NO: 39161 - DNA, 25 bp, Mus musculus
gcgggcatattgtgagagctgctat

SEQ ID NO: 39162 - DNA, 25 bp, Mus musculus
gcgggccctcggtgacctcaggcat

SEQ ID NO: 39163 - DNA, 25 bp, Mus musculus
gcgggctcacaaacactcgggagag

SEQ ID NO: 39164 - DNA, 25 bp, Mus musculus
gcgggcttctggaggcctctcagcc

SEQ ID NO: 39165 - DNA, 25 bp, Mus musculus
gcgggcttctggtggcctctcagcc

SEQ ID NO: 39166 - DNA, 25 bp, Mus musculus
gcgggtaattctatcgggatatcct

SEQ ID NO: 39167 - DNA, 25 bp, Mus musculus
gcgggtagtgctgtctctgtcgtat

SEQ ID NO: 39168 - DNA, 25 bp, Mus musculus
gcgggtcggacgagcaagactaaaa

SEQ ID NO: 39169 - DNA, 25 bp, Mus musculus
gcgggtctagctgggaagcacctta

SEQ ID NO: 39170 - DNA, 25 bp, Mus musculus
gcgggtctggaggaaaacttccata

SEQ ID NO: 39171 - DNA, 25 bp, Mus musculus
gcgggttatcctgcattagcttcaa

SEQ ID NO: 39172 - DNA, 25 bp, Mus musculus
gcggtacacaatgagagcgtcttcg

SEQ ID NO: 39173 - DNA, 25 bp, Mus musculus
gcggtacacactaaaccacaatctg

SEQ ID NO: 39174 - DNA, 25 bp, Mus musculus
gcggtacatgcagggccttaaggaa

SEQ ID NO: 39175 - DNA, 25 bp, Mus musculus
gcggtactgccgaggagtcaatgca

SEQ ID NO: 39176 - DNA, 25 bp, Mus musculus
gcggtactgtgacagaagccatcag

SEQ ID NO: 39177 - DNA, 25 bp, Mus musculus
gcggtgaatctgaggagcagatcca

SEQ ID NO: 39178 - DNA, 25 bp, Mus musculus
gcggtgatgagagaaaccatcagga

SEQ ID NO: 39179 - DNA, 25 bp, Mus musculus
gcggtgctgagtttcatcctgtcca

SEQ ID NO: 39180 - DNA, 25 bp, Mus musculus
gcggtgctgttttccttatcatcct

SEQ ID NO: 39181 - DNA, 25 bp, Mus musculus
gcggtggcaattttggaccaggacc

SEQ ID NO: 39182 - DNA, 25 bp, Mus musculus
gcggtggtacatcctcatgcaacag

SEQ ID NO: 39183 - DNA, 25 bp, Mus musculus
gcggtggtcatgaatcggttcagcc

SEQ ID NO: 39184 - DNA, 25 bp, Mus musculus
gcggtgttgttactacagccttcta

SEQ ID NO: 39185 - DNA, 25 bp, Mus musculus
gcggttacagggatagcagtgtctt

SEQ ID NO: 39186 - DNA, 25 bp, Mus musculus
gcggttctcaggtggctacccggcc

SEQ ID NO: 39187 - DNA, 25 bp, Mus musculus
gcggtttaccctgcagccaggcgag

SEQ ID NO: 39188 - DNA, 25 bp, Mus musculus
gcggtttcatatccagatcaccaga

SEQ ID NO: 39189 - DNA, 25 bp, Mus musculus
gcggtttcatggacatgtttgggat

SEQ ID NO: 39190 - DNA, 25 bp, Mus musculus
gcggtttcctctgagtagcgctggc

SEQ ID NO: 39191 - DNA, 25 bp, Mus musculus
gcggtttcttactgtttgtgcaagt

SEQ ID NO: 39192 - DNA, 25 bp, Mus musculus
gcggtttttgaatgtggcttttgat

SEQ ID NO: 39193 - DNA, 25 bp, Mus musculus
gcgtaagctgaagcctcaggcacag

SEQ ID NO: 39194 - DNA, 25 bp, Mus musculus
gcgtagccataaagcggatcaactt

SEQ ID NO: 39195 - DNA, 25 bp, Mus musculus
gcgtagctcttcaaagaattgtatt

SEQ ID NO: 39196 - DNA, 25 bp, Mus musculus
gcgtagtgttccacgacaggcgact

SEQ ID NO: 39197 - DNA, 25 bp, Mus musculus
gcgtataactgtgcccagctaacct

SEQ ID NO: 39198 - DNA, 25 bp, Mus musculus
gcgtcaaccccgacttggaggagcc

SEQ ID NO: 39199 - DNA, 25 bp, Mus musculus
gcgtcaaggaaaggctccggcctga

SEQ ID NO: 39200 - DNA, 25 bp, Mus musculus
gcgtcagaaccaggagtaccaggtg

SEQ ID NO: 39201 - DNA, 25 bp, Mus musculus
gcgtcagacttaacaggaagcttca

SEQ ID NO: 39202 - DNA, 25 bp, Mus musculus
gcgtcagcacagtctcgggatgtca

SEQ ID NO: 39203 - DNA, 25 bp, Mus musculus
gcgtcagggtccttatttccaacca

SEQ ID NO: 39204 - DNA, 25 bp, Mus musculus
gcgtcatctgtttcaccagtggaac

SEQ ID NO: 39205 - DNA, 25 bp, Mus musculus
gcgtcattcagaacctgcctaagaa

SEQ ID NO: 39206 - DNA, 25 bp, Mus musculus
gcgtcattgttagaacgacaaacaa

SEQ ID NO: 39207 - DNA, 25 bp, Mus musculus
gcgtccaaagaagctatatcagcag

SEQ ID NO: 39208 - DNA, 25 bp, Mus musculus
gcgtccagagatcaccatcgtggca

SEQ ID NO: 39209 - DNA, 25 bp, Mus musculus
gcgtccagagatgaccatcgtggca

SEQ ID NO: 39210 - DNA, 25 bp, Mus musculus
gcgtccagattagatgtcaccaatg

SEQ ID NO: 39211 - DNA, 25 bp, Mus musculus
gcgtccatgctggatgagagcagcc

SEQ ID NO: 39212 - DNA, 25 bp, Mus musculus
gcgtccgatccccaggattggaatt

SEQ ID NO: 39213 - DNA, 25 bp, Mus musculus
gcgtccgtgttgatgcgctacccac

SEQ ID NO: 39214 - DNA, 25 bp, Mus musculus
gcgtccgtgttgttgcgctacccac

SEQ ID NO: 39215 - DNA, 25 bp, Mus musculus
gcgtcctgctgtctcggacacacag

SEQ ID NO: 39216 - DNA, 25 bp, Mus musculus
gcgtccttagataaagacttagaag

SEQ ID NO: 39217 - DNA, 25 bp, Mus musculus
gcgtcgcctgatcctgttcaagttg

SEQ ID NO: 39218 - DNA, 25 bp, Mus musculus
gcgtcgggccaaacaagtgcaaatg

SEQ ID NO: 39219 - DNA, 25 bp, Mus musculus
gcgtcggtgtgattctctttgagat

SEQ ID NO: 39220 - DNA, 25 bp, Mus musculus
gcgtctaatgagcaggacagtgaca

SEQ ID NO: 39221 - DNA, 25 bp, Mus musculus
gcgtctaggtctcctgcaggagcct

SEQ ID NO: 39222 - DNA, 25 bp, Mus musculus
gcgtctatgggagactcgtgtgcac

SEQ ID NO: 39223 - DNA, 25 bp, Mus musculus
gcgtctcaaagacaacttgaaggta

SEQ ID NO: 39224 - DNA, 25 bp, Mus musculus
gcgtctcatggtggaaaaagtcact

SEQ ID NO: 39225 - DNA, 25 bp, Mus musculus
gcgtctccgaaattacttcaagaaa

SEQ ID NO: 39226 - DNA, 25 bp, Mus musculus
gcgtctgaagtatagcaccatcacc

SEQ ID NO: 39227 - DNA, 25 bp, Mus musculus
gcgtctgaccgagttgctaaagcaa

SEQ ID NO: 39228 - DNA, 25 bp, Mus musculus
gcgtctggagtcatcccgcagattt

SEQ ID NO: 39229 - DNA, 25 bp, Mus musculus
gcgtctgtacttgtgcccatggatg

SEQ ID NO: 39230 - DNA, 25 bp, Mus musculus
gcgtcttcgtgatgggcaccgagaa

SEQ ID NO: 39231 - DNA, 25 bp, Mus musculus
gcgtcttgcactaccagcaggctct

SEQ ID NO: 39232 - DNA, 25 bp, Mus musculus
gcgtctttgcttttgtgatcatggc

SEQ ID NO: 39233 - DNA, 25 bp, Mus musculus
gcgtctttgggttttctgtccgctc

SEQ ID NO: 39234 - DNA, 25 bp, Mus musculus
gcgtgaagccatttttagaaccccg

SEQ ID NO: 39235 - DNA, 25 bp, Mus musculus
gcgtgacccgcccacttggtgtaaa

SEQ ID NO: 39236 - DNA, 25 bp, Mus musculus
gcgtgacgcctcaggccgcctaatt

SEQ ID NO: 39237 - DNA, 25 bp, Mus musculus
gcgtgatctgctccgacaagtgtct

SEQ ID NO: 39238 - DNA, 25 bp, Mus musculus
gcgtgatgacattttctcttcttta

SEQ ID NO: 39239 - DNA, 25 bp, Mus musculus
gcgtgcaaggctctgaccgaccacg

SEQ ID NO: 39240 - DNA, 25 bp, Mus musculus
gcgtgcaggtgtacaagcacacagg

SEQ ID NO: 39241 - DNA, 25 bp, Mus musculus
gcgtgccagccatcatgagagcaat

SEQ ID NO: 39242 - DNA, 25 bp, Mus musculus
gcgtgccagtgataaacctgggaca

SEQ ID NO: 39243 - DNA, 25 bp, Mus musculus
gcgtgccattgatctctataagcag

SEQ ID NO: 39244 - DNA, 25 bp, Mus musculus
gcgtgctggaggtatcgcgttccat

SEQ ID NO: 39245 - DNA, 25 bp, Mus musculus
gcgtggaccgtgagatcaccatggt

SEQ ID NO: 39246 - DNA, 25 bp, Mus musculus
gcgtggacctcaccgtcctgctgaa

SEQ ID NO: 39247 - DNA, 25 bp, Mus musculus
gcgtggcagagctgggactcacttt

SEQ ID NO: 39248 - DNA, 25 bp, Mus musculus
gcgtgggactcatcacacgcagtga

SEQ ID NO: 39249 - DNA, 25 bp, Mus musculus
gcgtgggcctacacctgtaacatca

SEQ ID NO: 39250 - DNA, 25 bp, Mus musculus
gcgtgggcgtcctatgatcagacag

SEQ ID NO: 39251 - DNA, 25 bp, Mus musculus
gcgtgggtgactgatttttaagaaa

SEQ ID NO: 39252 - DNA, 25 bp, Mus musculus
gcgtgtaggctatgtgagttctgac

SEQ ID NO: 39253 - DNA, 25 bp, Mus musculus
gcgtgtcctgtccaaggccaactca

SEQ ID NO: 39254 - DNA, 25 bp, Mus musculus
gcgtgtcggtgcttcctacaaacga

SEQ ID NO: 39255 - DNA, 25 bp, Mus musculus
gcgtgtgatggctttagttctgctg

SEQ ID NO: 39256 - DNA, 25 bp, Mus musculus
gcgtgtgttatcatgcttggctcaa

SEQ ID NO: 39257 - DNA, 25 bp, Mus musculus
gcgtgtgttccgagtctgctcagga

SEQ ID NO: 39258 - DNA, 25 bp, Mus musculus
gcgttacaatgaagccatgctctat

SEQ ID NO: 39259 - DNA, 25 bp, Mus musculus
gcgttaccccaactatgttgcagaa

SEQ ID NO: 39260 - DNA, 25 bp, Mus musculus
gcgttatcactctcattaatggcgg

SEQ ID NO: 39261 - DNA, 25 bp, Mus musculus
gcgttattacccaaagacaataaag

SEQ ID NO: 39262 - DNA, 25 bp, Mus musculus
gcgttcacctctggtgctccgagga

SEQ ID NO: 39263 - DNA, 25 bp, Mus musculus
gcgttcatcatcagaaagttcaaag

SEQ ID NO: 39264 - DNA, 25 bp, Mus musculus
gcgttcatcatctgaaagttcaaag

SEQ ID NO: 39265 - DNA, 25 bp, Mus musculus
gcgttcctgggagaccaacatcggg

SEQ ID NO: 39266 - DNA, 25 bp, Mus musculus
gcgttccttactgaatatagaagtc

SEQ ID NO: 39267 - DNA, 25 bp, Mus musculus
gcgttgacgtaatttaggacgtgga

SEQ ID NO: 39268 - DNA, 25 bp, Mus musculus
gcgttgcaaattccattcactcctt

SEQ ID NO: 39269 - DNA, 25 bp, Mus musculus
gcgttgcagattccagtccagatca

SEQ ID NO: 39270 - DNA, 25 bp, Mus musculus
gcgttggagaagatgttcctcaaca

SEQ ID NO: 39271 - DNA, 25 bp, Mus musculus
gcgttgggaagtggcaggatcgata

SEQ ID NO: 39272 - DNA, 25 bp, Mus musculus
gcgttgtgcgtctgctgcttctgcc

SEQ ID NO: 39273 - DNA, 25 bp, Mus musculus
gcgtttagagaagaaattgcaccaa

SEQ ID NO: 39274 - DNA, 25 bp, Mus musculus
gcgtttccaagaaaatgagaatgaa

SEQ ID NO: 39275 - DNA, 25 bp, Mus musculus
gcgtttccttcagctcggtgccaag

SEQ ID NO: 39276 - DNA, 25 bp, Mus musculus
gcgtttctcactcatgacgctgcgg

SEQ ID NO: 39277 - DNA, 25 bp, Mus musculus
gcgtttctcggcctcagagctgatg

SEQ ID NO: 39278 - DNA, 25 bp, Mus musculus
gcgtttttccgagtggaccatggcc

SEQ ID NO: 39279 - DNA, 25 bp, Mus musculus
gcgttttttctatcagcggctggtg

SEQ ID NO: 39280 - DNA, 25 bp, Mus musculus
gctaaaacatggacttggcaacagg

SEQ ID NO: 39281 - DNA, 25 bp, Mus musculus
gctaaaaccagattacactgcccct

SEQ ID NO: 39282 - DNA, 25 bp, Mus musculus
gctaaaaccgactctgaagaaaaag

SEQ ID NO: 39283 - DNA, 25 bp, Mus musculus
gctaaaactgagagcttcaaacagc

SEQ ID NO: 39284 - DNA, 25 bp, Mus musculus
gctaaaagatactgcaatgcacatg

SEQ ID NO: 39285 - DNA, 25 bp, Mus musculus
gctaaaaggagaacttgaaagctca

SEQ ID NO: 39286 - DNA, 25 bp, Mus musculus
gctaaaagtatggaaaggactgttt

SEQ ID NO: 39287 - DNA, 25 bp, Mus musculus
gctaaacctctgcttgaggtccaaa

SEQ ID NO: 39288 - DNA, 25 bp, Mus musculus
gctaaacgaaataagaaatgttggg

SEQ ID NO: 39289 - DNA, 25 bp, Mus musculus
gctaaactcttccaccattatcggg

SEQ ID NO: 39290 - DNA, 25 bp, Mus musculus
gctaaactgaaatatcctgatgcgc

SEQ ID NO: 39291 - DNA, 25 bp, Mus musculus
gctaaactgtgacaatgcagtcctc

SEQ ID NO: 39292 - DNA, 25 bp, Mus musculus
gctaaagatgcttgggaagttgcac

SEQ ID NO: 39293 - DNA, 25 bp, Mus musculus
gctaaagcaattatcaaccttgctg

SEQ ID NO: 39294 - DNA, 25 bp, Mus musculus
gctaaagcttccaaatctgaaaagg

SEQ ID NO: 39295 - DNA, 25 bp, Mus musculus
gctaaagggccctcttgtaccagag

SEQ ID NO: 39296 - DNA, 25 bp, Mus musculus
gctaaatctgagaacctgggccagg

SEQ ID NO: 39297 - DNA, 25 bp, Mus musculus
gctaaatctgctgcaaggacaagtg

SEQ ID NO: 39298 - DNA, 25 bp, Mus musculus
gctaacaagggactactgcactcct

SEQ ID NO: 39299 - DNA, 25 bp, Mus musculus
gctaaccaacatagagctgttggat

SEQ ID NO: 39300 - DNA, 25 bp, Mus musculus
gctaaccatggcgtctggagatgac

SEQ ID NO: 39301 - DNA, 25 bp, Mus musculus
gctaacccagaaggtggcccaggaa

SEQ ID NO: 39302 - DNA, 25 bp, Mus musculus
gctaacgaagagaaggaccatgcag

SEQ ID NO: 39303 - DNA, 25 bp, Mus musculus
gctaactaccgcaaagagaacttgt

SEQ ID NO: 39304 - DNA, 25 bp, Mus musculus
gctaagaacagaggtggagactcag

SEQ ID NO: 39305 - DNA, 25 bp, Mus musculus
gctaagaatagccagcccaaccgat

SEQ ID NO: 39306 - DNA, 25 bp, Mus musculus
gctaagagcactccaactgctgaag

SEQ ID NO: 39307 - DNA, 25 bp, Mus musculus
gctaagccgagtaagaagacataca

SEQ ID NO: 39308 - DNA, 25 bp, Mus musculus
gctaagcttcatcttcacctaccag

SEQ ID NO: 39309 - DNA, 25 bp, Mus musculus
gctaaggacgctacactgcacactt

SEQ ID NO: 39310 - DNA, 25 bp, Mus musculus
gctaagtataatggttctctgcaca

SEQ ID NO: 39311 - DNA, 25 bp, Mus musculus
gctaagtcttcaatacagaagggta

SEQ ID NO: 39312 - DNA, 25 bp, Mus musculus
gctaagtcttcattacagaagggta

SEQ ID NO: 39313 - DNA, 25 bp, Mus musculus
gctaagtgggaacgtgtcagaacaa

SEQ ID NO: 39314 - DNA, 25 bp, Mus musculus
gctaagtgggaaggtgtcagaacaa

SEQ ID NO: 39315 - DNA, 25 bp, Mus musculus
gctaagtgggcaattaaaaaagtga

SEQ ID NO: 39316 - DNA, 25 bp, Mus musculus
gctaagtgtctgagactgacatcgg

SEQ ID NO: 39317 - DNA, 25 bp, Mus musculus
gctaagtgtgctacacatccatggg

SEQ ID NO: 39318 - DNA, 25 bp, Mus musculus
gctaagttcgaaagatgctcaaggg

SEQ ID NO: 39319 - DNA, 25 bp, Mus musculus
gctaagttgacatggatccgctcag

SEQ ID NO: 39320 - DNA, 25 bp, Mus musculus
gctaatcaagagtgaaaaacctgaa

SEQ ID NO: 39321 - DNA, 25 bp, Mus musculus
gctaatcagctgaagcgtcacatga

SEQ ID NO: 39322 - DNA, 25 bp, Mus musculus
gctaatcgaactgctacaaatggcc

SEQ ID NO: 39323 - DNA, 25 bp, Mus musculus
gctaatcgcgatttgctaagcagtg

SEQ ID NO: 39324 - DNA, 25 bp, Mus musculus
gctaatctgctaatgtaatttggaa

SEQ ID NO: 39325 - DNA, 25 bp, Mus musculus
gctaatgcacccagagagccgcttt

SEQ ID NO: 39326 - DNA, 25 bp, Mus musculus
gctaatgcatcatggagcctcccca

SEQ ID NO: 39327 - DNA, 25 bp, Mus musculus
gctaatgggaacagagcagtgctcc

SEQ ID NO: 39328 - DNA, 25 bp, Mus musculus
gctaatgtgtatgtggatgcggtca

SEQ ID NO: 39329 - DNA, 25 bp, Mus musculus
gctaattaaagaaggagacgttgtg

SEQ ID NO: 39330 - DNA, 25 bp, Mus musculus
gctaattatcttttgggttcgacac

SEQ ID NO: 39331 - DNA, 25 bp, Mus musculus
gctaattggactttaacaccattga

SEQ ID NO: 39332 - DNA, 25 bp, Mus musculus
gctacaaatggccactgcattgata

SEQ ID NO: 39333 - DNA, 25 bp, Mus musculus
gctacaacccaaacgaacggacaag

SEQ ID NO: 39334 - DNA, 25 bp, Mus musculus
gctacaaccccttcgaggacgagga

SEQ ID NO: 39335 - DNA, 25 bp, Mus musculus
gctacaacgcttctctgacagactc

SEQ ID NO: 39336 - DNA, 25 bp, Mus musculus
gctacaagaattccttggagacggt

SEQ ID NO: 39337 - DNA, 25 bp, Mus musculus
gctacaagaggagatggcgctgatt

SEQ ID NO: 39338 - DNA, 25 bp, Mus musculus
gctacaagatcctggcagcctgctg

SEQ ID NO: 39339 - DNA, 25 bp, Mus musculus
gctacaaggagatgaactgactgca

SEQ ID NO: 39340 - DNA, 25 bp, Mus musculus
gctacaaggagttcttcccacagca

SEQ ID NO: 39341 - DNA, 25 bp, Mus musculus
gctacaagggcatgtggaaccactt

SEQ ID NO: 39342 - DNA, 25 bp, Mus musculus
gctacaatgggaatcaaccagtgtc

SEQ ID NO: 39343 - DNA, 25 bp, Mus musculus
gctacacaaggagttcgggccctat

SEQ ID NO: 39344 - DNA, 25 bp, Mus musculus
gctacacaagtcgttttaatacaga

SEQ ID NO: 39345 - DNA, 25 bp, Mus musculus
gctacacactggacactcaaagcca

SEQ ID NO: 39346 - DNA, 25 bp, Mus musculus
gctacacccagaaagcacctcaggt

SEQ ID NO: 39347 - DNA, 25 bp, Mus musculus
gctacaccgtggtggactttaggaa

SEQ ID NO: 39348 - DNA, 25 bp, Mus musculus
gctacacgttaagccgagaccggaa

SEQ ID NO: 39349 - DNA, 25 bp, Mus musculus
gctacactcctgatgattgtataca

SEQ ID NO: 39350 - DNA, 25 bp, Mus musculus
gctacactctgtggttctgcatggg

SEQ ID NO: 39351 - DNA, 25 bp, Mus musculus
gctacacttgaacaaccaccaagtc

SEQ ID NO: 39352 - DNA, 25 bp, Mus musculus
gctacactttcctggtctctgaagg

SEQ ID NO: 39353 - DNA, 25 bp, Mus musculus
gctacagaccgttcccactatgcaa

SEQ ID NO: 39354 - DNA, 25 bp, Mus musculus
gctacagagatgagtctgatttaaa

SEQ ID NO: 39355 - DNA, 25 bp, Mus musculus
gctacagagatgtgtctgatttaaa

SEQ ID NO: 39356 - DNA, 25 bp, Mus musculus
gctacagccatattcaatccaagtg

SEQ ID NO: 39357 - DNA, 25 bp, Mus musculus
gctacagcgctgctgtcacactctt

SEQ ID NO: 39358 - DNA, 25 bp, Mus musculus
gctacagctgcgctaccaggagatc

SEQ ID NO: 39359 - DNA, 25 bp, Mus musculus
gctacagctgtacctgtcaaccagg

SEQ ID NO: 39360 - DNA, 25 bp, Mus musculus
gctacagctttgactatgattacta

SEQ ID NO: 39361 - DNA, 25 bp, Mus musculus
gctacaggaattcaaagagaagggc

SEQ ID NO: 39362 - DNA, 25 bp, Mus musculus
gctacaggtgatcacgtatgtcctt

SEQ ID NO: 39363 - DNA, 25 bp, Mus musculus
gctacagtgccagggatgaagaaga

SEQ ID NO: 39364 - DNA, 25 bp, Mus musculus
gctacagtttctctagatccttgaa

SEQ ID NO: 39365 - DNA, 25 bp, Mus musculus
gctacagtttctgtagatccttgaa

SEQ ID NO: 39366 - DNA, 25 bp, Mus musculus
gctacagtttgaaggccaaaattag

SEQ ID NO: 39367 - DNA, 25 bp, Mus musculus
gctacagtttttcatgcctactatc

SEQ ID NO: 39368 - DNA, 25 bp, Mus musculus
gctacatagtcagcacgaagactgg

SEQ ID NO: 39369 - DNA, 25 bp, Mus musculus
gctacatccacacgatgcctttaat

SEQ ID NO: 39370 - DNA, 25 bp, Mus musculus
gctacatctggtgtctgtactcgga

SEQ ID NO: 39371 - DNA, 25 bp, Mus musculus
gctacatgaagtcagccagctacag

SEQ ID NO: 39372 - DNA, 25 bp, Mus musculus
gctacatgctgcagtggcagcgagg

SEQ ID NO: 39373 - DNA, 25 bp, Mus musculus
gctacatgtgtgctttcagagcagt

SEQ ID NO: 39374 - DNA, 25 bp, Mus musculus
gctacattcgctgggaaggtgtttt

SEQ ID NO: 39375 - DNA, 25 bp, Mus musculus
gctaccaaattccagtccatcggga

SEQ ID NO: 39376 - DNA, 25 bp, Mus musculus
gctaccaactccagggatgagcgct

SEQ ID NO: 39377 - DNA, 25 bp, Mus musculus
gctaccacagctgggaagcctgaac

SEQ ID NO: 39378 - DNA, 25 bp, Mus musculus
gctaccatttttcaaagtcctggcg

SEQ ID NO: 39379 - DNA, 25 bp, Mus musculus
gctacccacagacggaaggcttgct

SEQ ID NO: 39380 - DNA, 25 bp, Mus musculus
gctacccacattccagatgttcaag

SEQ ID NO: 39381 - DNA, 25 bp, Mus musculus
gctacccatatacagccccgtggag

SEQ ID NO: 39382 - DNA, 25 bp, Mus musculus
gctacccatatagagccccgtggag

SEQ ID NO: 39383 - DNA, 25 bp, Mus musculus
gctacccatggcttagatgaagaag

SEQ ID NO: 39384 - DNA, 25 bp, Mus musculus
gctaccctcgggtcgcttgtcagag

SEQ ID NO: 39385 - DNA, 25 bp, Mus musculus
gctaccctgggactagtggtgcact

SEQ ID NO: 39386 - DNA, 25 bp, Mus musculus
gctaccgcagagaacagcaaacttt

SEQ ID NO: 39387 - DNA, 25 bp, Mus musculus
gctaccgccaccagaagcacaagaa

SEQ ID NO: 39388 - DNA, 25 bp, Mus musculus
gctacctccttagactgtattccag

SEQ ID NO: 39389 - DNA, 25 bp, Mus musculus
gctacctctgcacatgactccaagg

SEQ ID NO: 39390 - DNA, 25 bp, Mus musculus
gctacctctggatcagtctgctctc

SEQ ID NO: 39391 - DNA, 25 bp, Mus musculus
gctacctgaagatggagctaatctt

SEQ ID NO: 39392 - DNA, 25 bp, Mus musculus
gctacctgaataagcttccggtgaa

SEQ ID NO: 39393 - DNA, 25 bp, Mus musculus
gctacctgtgcacctgcaggcctgg

SEQ ID NO: 39394 - DNA, 25 bp, Mus musculus
gctacctgtgcagctgcaggcctgg

SEQ ID NO: 39395 - DNA, 25 bp, Mus musculus
gctacctgttggagaaggacccatc

SEQ ID NO: 39396 - DNA, 25 bp, Mus musculus
gctaccttacgatatgccacatcag

SEQ ID NO: 39397 - DNA, 25 bp, Mus musculus
gctacgactggacgctggtgcccat

SEQ ID NO: 39398 - DNA, 25 bp, Mus musculus
gctacgatgaggagtatggctgtcc

SEQ ID NO: 39399 - DNA, 25 bp, Mus musculus
gctacggaaccactagtgtgcagaa

SEQ ID NO: 39400 - DNA, 25 bp, Mus musculus
gctacggaggcagagcttccgacta

SEQ ID NO: 39401 - DNA, 25 bp, Mus musculus
gctacgggaagcatatcactaaata

SEQ ID NO: 39402 - DNA, 25 bp, Mus musculus
gctacgtagcactggccgtgctaaa

SEQ ID NO: 39403 - DNA, 25 bp, Mus musculus
gctacgtccctgaaatcatagagtt

SEQ ID NO: 39404 - DNA, 25 bp, Mus musculus
gctactaacagagggtcctctttaa

SEQ ID NO: 39405 - DNA, 25 bp, Mus musculus
gctactagtcagtgcttcgcaagat

SEQ ID NO: 39406 - DNA, 25 bp, Mus musculus
gctactatacttgcagtgaccgtta

SEQ ID NO: 39407 - DNA, 25 bp, Mus musculus
gctactcacttgacactgacccagg

SEQ ID NO: 39408 - DNA, 25 bp, Mus musculus
gctactcagtgctcggcagcctggt

SEQ ID NO: 39409 - DNA, 25 bp, Mus musculus
gctactcccaggacagcttcagcaa

SEQ ID NO: 39410 - DNA, 25 bp, Mus musculus
gctactctcgtagattccggagaaa

SEQ ID NO: 39411 - DNA, 25 bp, Mus musculus
gctactctttcccagtgtaatgaca

SEQ ID NO: 39412 - DNA, 25 bp, Mus musculus
gctactgaaagatgaagccactgtg

SEQ ID NO: 39413 - DNA, 25 bp, Mus musculus
gctactgatacctgcttgagtgttt

SEQ ID NO: 39414 - DNA, 25 bp, Mus musculus
gctactgggtggacaacgtggccaa

SEQ ID NO: 39415 - DNA, 25 bp, Mus musculus
gctactgtacaaccttcgggtccta

SEQ ID NO: 39416 - DNA, 25 bp, Mus musculus
gctacttccgagactactttcccat

SEQ ID NO: 39417 - DNA, 25 bp, Mus musculus
gctacttcgtgtccggatgcgatcc

SEQ ID NO: 39418 - DNA, 25 bp, Mus musculus
gctacttctaggaaggaatgatcac

SEQ ID NO: 39419 - DNA, 25 bp, Mus musculus
gctacttggagagaagaagactgtc

SEQ ID NO: 39420 - DNA, 25 bp, Mus musculus
gctactttacctctctgttattcag

SEQ ID NO: 39421 - DNA, 25 bp, Mus musculus
gctagaaaaggatacagcagatctt

SEQ ID NO: 39422 - DNA, 25 bp, Mus musculus
gctagaaaattaccactacagggaa

SEQ ID NO: 39423 - DNA, 25 bp, Mus musculus
gctagaagaataaaggcagacatgt

SEQ ID NO: 39424 - DNA, 25 bp, Mus musculus
gctagaagagattgttgacaactat

SEQ ID NO: 39425 - DNA, 25 bp, Mus musculus
gctagaagttttatgcatttcagag

SEQ ID NO: 39426 - DNA, 25 bp, Mus musculus
gctagaagttttttgcatttcagag

SEQ ID NO: 39427 - DNA, 25 bp, Mus musculus
gctagaatgatctgagaaggcctcc

SEQ ID NO: 39428 - DNA, 25 bp, Mus musculus
gctagacaatcttcagaaacttaat

SEQ ID NO: 39429 - DNA, 25 bp, Mus musculus
gctagacacactgagcagagctgaa

SEQ ID NO: 39430 - DNA, 25 bp, Mus musculus
gctagacctggtcaccaataaacag

SEQ ID NO: 39431 - DNA, 25 bp, Mus musculus
gctagactcatcagtggagaggaag

SEQ ID NO: 39432 - DNA, 25 bp, Mus musculus
gctagactggaggaaaagatgaccc

SEQ ID NO: 39433 - DNA, 25 bp, Mus musculus
gctagagcaatttccaggtattgaa

SEQ ID NO: 39434 - DNA, 25 bp, Mus musculus
gctagaggaagaacacaatggctac

SEQ ID NO: 39435 - DNA, 25 bp, Mus musculus
gctagaggctgtaatatgcttcttc

SEQ ID NO: 39436 - DNA, 25 bp, Mus musculus
gctagaggtccagagagactgactg

SEQ ID NO: 39437 - DNA, 25 bp, Mus musculus
gctagatacttttaagcacaccgat

SEQ ID NO: 39438 - DNA, 25 bp, Mus musculus
gctagatcgttcgaagtcatattgg

SEQ ID NO: 39439 - DNA, 25 bp, Mus musculus
gctagatgaagctaacggcaccatc

SEQ ID NO: 39440 - DNA, 25 bp, Mus musculus
gctagatgcctggagccagagttac

SEQ ID NO: 39441 - DNA, 25 bp, Mus musculus
gctagcagagcagcagcacttgggc

SEQ ID NO: 39442 - DNA, 25 bp, Mus musculus
gctagcatgaccaagcctactacca

SEQ ID NO: 39443 - DNA, 25 bp, Mus musculus
gctagcattgcatctgattccagca

SEQ ID NO: 39444 - DNA, 25 bp, Mus musculus
gctagccagacctgatgaaggaggc

SEQ ID NO: 39445 - DNA, 25 bp, Mus musculus
gctagccaggtcctgaattctctgg

SEQ ID NO: 39446 - DNA, 25 bp, Mus musculus
gctagcccacttgagagtattgtat

SEQ ID NO: 39447 - DNA, 25 bp, Mus musculus
gctagcctggaccatttttcagatt

SEQ ID NO: 39448 - DNA, 25 bp, Mus musculus
gctagctactttgggacaatttgtg

SEQ ID NO: 39449 - DNA, 25 bp, Mus musculus
gctagctgggacaagtttacaggct

SEQ ID NO: 39450 - DNA, 25 bp, Mus musculus
gctagctgtaggactaggtgttgca

SEQ ID NO: 39451 - DNA, 25 bp, Mus musculus
gctagcttcagtggacataccacac

SEQ ID NO: 39452 - DNA, 25 bp, Mus musculus
gctaggaagttcaaacaccattgtg

SEQ ID NO: 39453 - DNA, 25 bp, Mus musculus
gctaggacagcagcattaaatgcca

SEQ ID NO: 39454 - DNA, 25 bp, Mus musculus
gctaggcatgacaaaggtacttctc

SEQ ID NO: 39455 - DNA, 25 bp, Mus musculus
gctaggccagctgagctgcatgtcc

SEQ ID NO: 39456 - DNA, 25 bp, Mus musculus
gctagggctgctcccgcctttctga

SEQ ID NO: 39457 - DNA, 25 bp, Mus musculus
gctagtagctactgaaaggctcttc

SEQ ID NO: 39458 - DNA, 25 bp, Mus musculus
gctagtcaatgagaaacggttcccg

SEQ ID NO: 39459 - DNA, 25 bp, Mus musculus
gctagtcacaccaaataacataatg

SEQ ID NO: 39460 - DNA, 25 bp, Mus musculus
gctagtcaccagtgtttttggatca

SEQ ID NO: 39461 - DNA, 25 bp, Mus musculus
gctagtccggagattgataaaccca

SEQ ID NO: 39462 - DNA, 25 bp, Mus musculus
gctagtctattcagtgggttcatct

SEQ ID NO: 39463 - DNA, 25 bp, Mus musculus
gctagtgaagcaataccttcttgcg

SEQ ID NO: 39464 - DNA, 25 bp, Mus musculus
gctagtgactgtctctttctgcgtc

SEQ ID NO: 39465 - DNA, 25 bp, Mus musculus
gctagtgatgagaagattctgtgat

SEQ ID NO: 39466 - DNA, 25 bp, Mus musculus
gctagtgattcaagttcatccacag

SEQ ID NO: 39467 - DNA, 25 bp, Mus musculus
gctagtgcctccttgctggtgagaa

SEQ ID NO: 39468 - DNA, 25 bp, Mus musculus
gctagtgtctacactgaagcacctg

SEQ ID NO: 39469 - DNA, 25 bp, Mus musculus
gctagttaacttctatctgctgtag

SEQ ID NO: 39470 - DNA, 25 bp, Mus musculus
gctataaattcagcattggctcaga

SEQ ID NO: 39471 - DNA, 25 bp, Mus musculus
gctataacaactgtggtcaggtggg

SEQ ID NO: 39472 - DNA, 25 bp, Mus musculus
gctataactgagtatattcctccca

SEQ ID NO: 39473 - DNA, 25 bp, Mus musculus
gctataagggcacaaccaagagctt

SEQ ID NO: 39474 - DNA, 25 bp, Mus musculus
gctataagtgtgacaacgggttttc

SEQ ID NO: 39475 - DNA, 25 bp, Mus musculus
gctatacacgtctccgggactggca

SEQ ID NO: 39476 - DNA, 25 bp, Mus musculus
gctatagacaaggaaacaggagcta

SEQ ID NO: 39477 - DNA, 25 bp, Mus musculus
gctatagagcgaggtccactccagc

SEQ ID NO: 39478 - DNA, 25 bp, Mus musculus
gctatcaaaggcagcagtgaacaaa

SEQ ID NO: 39479 - DNA, 25 bp, Mus musculus
gctatcaagtggcatccacgcttaa

SEQ ID NO: 39480 - DNA, 25 bp, Mus musculus
gctatcatcttcagcctggctgccg

SEQ ID NO: 39481 - DNA, 25 bp, Mus musculus
gctatccaagagaagatcaaagaga

SEQ ID NO: 39482 - DNA, 25 bp, Mus musculus
gctatccagagatacgtgcagctca

SEQ ID NO: 39483 - DNA, 25 bp, Mus musculus
gctatcccctttcaggtggcccaga

SEQ ID NO: 39484 - DNA, 25 bp, Mus musculus
gctatcctgcttcttcgaatagaga

SEQ ID NO: 39485 - DNA, 25 bp, Mus musculus
gctatcgaagccacacgaaggccag

SEQ ID NO: 39486 - DNA, 25 bp, Mus musculus
gctatcgccacaaacggatatgtca

SEQ ID NO: 39487 - DNA, 25 bp, Mus musculus
gctatcgccttcagttctacctcat

SEQ ID NO: 39488 - DNA, 25 bp, Mus musculus
gctatcggttgacaaatgctggcta

SEQ ID NO: 39489 - DNA, 25 bp, Mus musculus
gctatctctgccgagccatctatta

SEQ ID NO: 39490 - DNA, 25 bp, Mus musculus
gctatctcttgccacacaaatggga

SEQ ID NO: 39491 - DNA, 25 bp, Mus musculus
gctatctggaaaatggcttcagcca

SEQ ID NO: 39492 - DNA, 25 bp, Mus musculus
gctatctggaaattggcttcagcca

SEQ ID NO: 39493 - DNA, 25 bp, Mus musculus
gctatgacaagagagcaaacaaaaa

SEQ ID NO: 39494 - DNA, 25 bp, Mus musculus
gctatgacagctataacaacggagg

SEQ ID NO: 39495 - DNA, 25 bp, Mus musculus
gctatgacgtggagaatgaccggca

SEQ ID NO: 39496 - DNA, 25 bp, Mus musculus
gctatgactacgtggaggagcccaa

SEQ ID NO: 39497 - DNA, 25 bp, Mus musculus
gctatgactcttcgcttcgacacac

SEQ ID NO: 39498 - DNA, 25 bp, Mus musculus
gctatgactcttggcttcgacacac

SEQ ID NO: 39499 - DNA, 25 bp, Mus musculus
gctatgagacaaagagccatgagtc

SEQ ID NO: 39500 - DNA, 25 bp, Mus musculus
gctatgaggcagttcgccatggacg

SEQ ID NO: 39501 - DNA, 25 bp, Mus musculus
gctatgatgagtttggtttccgtgt

SEQ ID NO: 39502 - DNA, 25 bp, Mus musculus
gctatgatggcgattttgtctttga

SEQ ID NO: 39503 - DNA, 25 bp, Mus musculus
gctatgatgtagctaccctgcagga

SEQ ID NO: 39504 - DNA, 25 bp, Mus musculus
gctatgatgtagtaaaggaatgcct

SEQ ID NO: 39505 - DNA, 25 bp, Mus musculus
gctatgatgtggttaaacgatggat

SEQ ID NO: 39506 - DNA, 25 bp, Mus musculus
gctatgattcttccaaccaggtcaa

SEQ ID NO: 39507 - DNA, 25 bp, Mus musculus
gctatgcaaactggaatgaagattg

SEQ ID NO: 39508 - DNA, 25 bp, Mus musculus
gctatgcaagtgctcagcgctgaat

SEQ ID NO: 39509 - DNA, 25 bp, Mus musculus
gctatgcactggcaggctcttcaaa

SEQ ID NO: 39510 - DNA, 25 bp, Mus musculus
gctatgcagacctgtacagcttgca

SEQ ID NO: 39511 - DNA, 25 bp, Mus musculus
gctatgcatttcagatctggaaacc

SEQ ID NO: 39512 - DNA, 25 bp, Mus musculus
gctatgccttgagcccggatgatgg

SEQ ID NO: 39513 - DNA, 25 bp, Mus musculus
gctatgctaacccatgaaaatgttg

SEQ ID NO: 39514 - DNA, 25 bp, Mus musculus
gctatggaatcccaacattacattc

SEQ ID NO: 39515 - DNA, 25 bp, Mus musculus
gctatggagcattttgtgaagaagg

SEQ ID NO: 39516 - DNA, 25 bp, Mus musculus
gctatggcaagctaagcagtgacga

SEQ ID NO: 39517 - DNA, 25 bp, Mus musculus
gctatggcggctatgattatactgg

SEQ ID NO: 39518 - DNA, 25 bp, Mus musculus
gctatggtgacagactatggagctt

SEQ ID NO: 39519 - DNA, 25 bp, Mus musculus
gctatgtcatgtgctgagggctctt

SEQ ID NO: 39520 - DNA, 25 bp, Mus musculus
gctatgtctgccacagcggtggcca

(The sequence listing continues in the following parts.)

What is claimed is:

1. A probe array comprising a plurality of nucleic acid probes, wherein each probe in the plurality of nucleic acid probes consists of one of the sequences listed in SEQ ID Nos. 1-991,174 and wherein the plurality of nucleic acid probes of the array consists of each of the sequences listed in SEQ ID Nos. 1-991,174, each sequence present as a different feature of the array.

2. The array of claim 1 wherein said plurality of nucleic acid probes is attached to a solid support.

3. The array of claim 1 wherein the array comprises a plurality of beads wherein the probes are attached to the beads and the probes on a bead consisting of one of the sequences listed in SEQ ID Nos. 1-991,174.

4. The probe array of claim 1 wherein the array consists of a single contiguous solid support.

5. The probe array of claim 1 wherein the array consists of a plurality of solid supports.

6. A kit comprising a probe array according to claim 1, a T7-N6 primer, random primers, a T7 RNA polymerase, dUTP, UDG and optionally an AP endonuclease.

7. A method of detecting a plurality of mature RNA isoforms from each of a plurality of mouse genes in a biological sample from a mouse comprising:
   obtaining a nucleic acid derived from the biological sample;
   labeling the nucleic acid;
   hybridizing the labeled nucleic acid to the array of claim 1;
   detecting the hybridization pattern; and
   analyzing the hybridization pattern to detect a plurality of mature RNA isoforms from at least two mouse multi exon genes.

8. The method of claim 7 wherein the labeled nucleic acid hybridized to the array consists essentially of DNA.

9. The method of claim 7 wherein the labeled nucleic acid hybridized to the array consists essentially of RNA that is complementary to the target mRNA.

10. The method of claim 7 wherein the labeled nucleic acid hybridized to the array consists essentially of RNA that is in the sense orientation relative to the target mRNA.

* * * * *